United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 10

SEQ ID NO: 139329 - DNA, 20 bp, Artificial Sequence
  Description of Artificial Sequence: Synthetic oligonucleotide
  Target: ATXN1; (+) strand; PAM type: NRG; PAM sequence: AAG
gagataatgatacttgtcag

SEQ ID NO: 139330 - DNA, 20 bp, Artificial Sequence
  Description of Artificial Sequence: Synthetic oligonucleotide
  Target: ATXN1; (+) strand; PAM type: NRG; PAM sequence: AAG
gatacttgtcagaagatatt

SEQ ID NO: 139331 - DNA, 20 bp, Artificial Sequence
  Description of Artificial Sequence: Synthetic oligonucleotide
  Target: ATXN1; (+) strand; PAM type: NRG; PAM sequence: TGG
cagaagatattaagacgaca

SEQ ID NO: 139332 - DNA, 20 bp, Artificial Sequence
  Description of Artificial Sequence: Synthetic oligonucleotide
  Target: ATXN1; (+) strand; PAM type: NRG; PAM sequence: AAG
ttaagacgacatggcaataa

SEQ ID NO: 139333 - DNA, 20 bp, Artificial Sequence
  Description of Artificial Sequence: Synthetic oligonucleotide
  Target: ATXN1; (+) strand; PAM type: NRG; PAM sequence: AGG
taagacgacatggcaataaa

SEQ ID NO: 139334 - DNA, 20 bp, Artificial Sequence
  Description of Artificial Sequence: Synthetic oligonucleotide
  Target: ATXN1; (+) strand; PAM type: NRG; PAM sequence: CAG
caataaaaggaatctgttca

SEQ ID NO: 139335 - DNA, 20 bp, Artificial Sequence
  Description of Artificial Sequence: Synthetic oligonucleotide
  Target: ATXN1; (+) strand; PAM type: NRG; PAM sequence: GAG
ataaaaggaatctgttcaca

SEQ ID NO: 139336 - DNA, 20 bp, Artificial Sequence
  Description of Artificial Sequence: Synthetic oligonucleotide
  Target: ATXN1; (+) strand; PAM type: NRG; PAM sequence: GAG
aaaaggaatctgttcacaga

SEQ ID NO: 139337 - DNA, 20 bp, Artificial Sequence
  Description of Artificial Sequence: Synthetic oligonucleotide
  Target: ATXN1; (+) strand; PAM type: NRG; PAM sequence: TGG
gaatgattctaaatacaaaa

SEQ ID NO: 139338 - DNA, 20 bp, Artificial Sequence
  Description of Artificial Sequence: Synthetic oligonucleotide
  Target: ATXN1; (+) strand; PAM type: NRG; PAM sequence: CAG
gattctaaatacaaaatggt

SEQ ID NO: 139339 - DNA, 20 bp, Artificial Sequence
  Description of Artificial Sequence: Synthetic oligonucleotide
  Target: ATXN1; (+) strand; PAM type: NRG; PAM sequence: CAG
aaaatggtcagattgatact

SEQ ID NO: 139340 - DNA, 20 bp, Artificial Sequence
  Description of Artificial Sequence: Synthetic oligonucleotide
  Target: ATXN1; (+) strand; PAM type: NRG; PAM sequence: AAG
atggtcagattgatactcag

SEQ ID NO: 139341 - DNA, 20 bp, Artificial Sequence
  Description of Artificial Sequence: Synthetic oligonucleotide
  Target: ATXN1; (+) strand; PAM type: NRG; PAM sequence: TAG
ctcagaagtattgctattaa

SEQ ID NO: 139342 - DNA, 20 bp, Artificial Sequence
  Description of Artificial Sequence: Synthetic oligonucleotide
  Target: ATXN1; (+) strand; PAM type: NRG; PAM sequence: TAG
gctattaatagaaataatat

SEQ ID NO: 139343 - DNA, 20 bp, Artificial Sequence
  Description of Artificial Sequence: Synthetic oligonucleotide
  Target: ATXN1; (+) strand; PAM type: NRG; PAM sequence: GAG
tattaatagaaataatatta

SEQ ID NO: 139344 - DNA, 20 bp, Artificial Sequence
  Description of Artificial Sequence: Synthetic oligonucleotide
  Target: ATXN1; (+) strand; PAM type: NRG; PAM sequence: GAG
ttaatagaaataatattaga

SEQ ID NO: 139345 - DNA, 20 bp, Artificial Sequence
  Description of Artificial Sequence: Synthetic oligonucleotide
  Target: ATXN1; (+) strand; PAM type: NRG; PAM sequence: AGG
taatagaaataatattagag

SEQ ID NO: 139346 - DNA, 20 bp, Artificial Sequence
  Description of Artificial Sequence: Synthetic oligonucleotide
  Target: ATXN1; (+) strand; PAM type: NRG; PAM sequence: TGG
gagaggtttcattatgtaaa

SEQ ID NO: 139347 - DNA, 20 bp, Artificial Sequence
  Description of Artificial Sequence: Synthetic oligonucleotide
  Target: ATXN1; (+) strand; PAM type: NRG; PAM sequence: CAG
taaatggctcatgtgtctgc

SEQ ID NO: 139348 - DNA, 20 bp, Artificial Sequence
  Description of Artificial Sequence: Synthetic oligonucleotide
  Target: ATXN1; (+) strand; PAM type: NRG; PAM sequence: CAG
gtgtctgccagaaatgtacc

SEQ ID NO: 139349 - DNA, 20 bp, Artificial Sequence
  Description of Artificial Sequence: Synthetic oligonucleotide
  Target: ATXN1; (+) strand; PAM type: NRG; PAM sequence: TAG
aataatttgcatttctgcta

SEQ ID NO: 139350 - DNA, 20 bp, Artificial Sequence
  Description of Artificial Sequence: Synthetic oligonucleotide
  Target: ATXN1; (+) strand; PAM type: NRG; PAM sequence: CAG
ttctgctatagtgaaaattt

SEQ ID NO: 139351 - DNA, 20 bp, Artificial Sequence
  Description of Artificial Sequence: Synthetic oligonucleotide
  Target: ATXN1; (+) strand; PAM type: NRG; PAM sequence: AGG
tctgctatagtgaaaatttc

SEQ ID NO: 139352 - DNA, 20 bp, Artificial Sequence
  Description of Artificial Sequence: Synthetic oligonucleotide
  Target: ATXN1; (+) strand; PAM type: NRG; PAM sequence: GGG
ctgctatagtgaaaatttca

SEQ ID NO: 139353 - DNA, 20 bp, Artificial Sequence
  Description of Artificial Sequence: Synthetic oligonucleotide
  Target: ATXN1; (+) strand; PAM type: NRG; PAM sequence: TGG
tttcagggatgtctctttgt

SEQ ID NO: 139354 - DNA, 20 bp, Artificial Sequence
  Description of Artificial Sequence: Synthetic oligonucleotide
  Target: ATXN1; (+) strand; PAM type: NRG; PAM sequence: AAG
tgtctctttgttggcttatg

SEQ ID NO: 139355 - DNA, 20 bp, Artificial Sequence
  Description of Artificial Sequence: Synthetic oligonucleotide
  Target: ATXN1; (+) strand; PAM type: NRG; PAM sequence: AGG
gtctctttgttggcttatga

SEQ ID NO: 139356 - DNA, 20 bp, Artificial Sequence
  Description of Artificial Sequence: Synthetic oligonucleotide
  Target: ATXN1; (+) strand; PAM type: NRG; PAM sequence: TGG
cttatgaaggaccctttcat

SEQ ID NO: 139357 - DNA, 20 bp, Artificial Sequence
  Description of Artificial Sequence: Synthetic oligonucleotide
  Target: ATXN1; (+) strand; PAM type: NRG; PAM sequence: AAG
tgaaggaccctttcattggt

SEQ ID NO: 139358 - DNA, 20 bp, Artificial Sequence
  Description of Artificial Sequence: Synthetic oligonucleotide
  Target: ATXN1; (+) strand; PAM type: NRG; PAM sequence: CAG
accctttcattggtaagcca

SEQ ID NO: 139359 - DNA, 20 bp, Artificial Sequence
  Description of Artificial Sequence: Synthetic oligonucleotide
  Target: ATXN1; (+) strand; PAM type: NRG; PAM sequence: AAG
acagtttttataatcatgat

SEQ ID NO: 139360 - DNA, 20 bp, Artificial Sequence
  Description of Artificial Sequence: Synthetic oligonucleotide
  Target: ATXN1; (+) strand; PAM type: NRG; PAM sequence: AAG
gtttttataatcatgataag

SEQ ID NO: 139361 - DNA, 20 bp, Artificial Sequence
  Description of Artificial Sequence: Synthetic oligonucleotide
  Target: ATXN1; (+) strand; PAM type: NRG; PAM sequence: AGG
tttttataatcatgataaga

SEQ ID NO: 139362 - DNA, 20 bp, Artificial Sequence
  Description of Artificial Sequence: Synthetic oligonucleotide
  Target: ATXN1; (+) strand; PAM type: NRG; PAM sequence: AAG
tgataataataataactaat

SEQ ID NO: 139363 - DNA, 20 bp, Artificial Sequence
  Description of Artificial Sequence: Synthetic oligonucleotide
  Target: ATXN1; (+) strand; PAM type: NRG; PAM sequence: TGG
ataagacactcgtgtgtgcc

SEQ ID NO: 139364 - DNA, 20 bp, Artificial Sequence
  Description of Artificial Sequence: Synthetic oligonucleotide
  Target: ATXN1; (+) strand; PAM type: NRG; PAM sequence: CAG
tgcgctgactgccgtatgtg

SEQ ID NO: 139365 - DNA, 20 bp, Artificial Sequence
  Description of Artificial Sequence: Synthetic oligonucleotide
  Target: ATXN1; (+) strand; PAM type: NRG; PAM sequence: CAG
gctgactgccgtatgtgcag

SEQ ID NO: 139366 - DNA, 20 bp, Artificial Sequence
  Description of Artificial Sequence: Synthetic oligonucleotide
  Target: ATXN1; (+) strand; PAM type: NRG; PAM sequence: GAG
cgtatgtgcagcagtcctgt

SEQ ID NO: 139367 - DNA, 20 bp, Artificial Sequence
  Description of Artificial Sequence: Synthetic oligonucleotide
  Target: ATXN1; (+) strand; PAM type: NRG; PAM sequence: AGG
gtatgtgcagcagtcctgtg

SEQ ID NO: 139368 - DNA, 20 bp, Artificial Sequence
  Description of Artificial Sequence: Synthetic oligonucleotide
  Target: ATXN1; (+) strand; PAM type: NRG; PAM sequence: CAG
tgtgcagcagtcctgtgagg

SEQ ID NO: 139369 - DNA, 20 bp, Artificial Sequence
  Description of Artificial Sequence: Synthetic oligonucleotide
  Target: ATXN1; (+) strand; PAM type: NRG; PAM sequence: AGG
gtgcagcagtcctgtgaggc

SEQ ID NO: 139370 - DNA, 20 bp, Artificial Sequence
  Description of Artificial Sequence: Synthetic oligonucleotide
  Target: ATXN1; (+) strand; PAM type: NRG; PAM sequence: AAG
ggattattattcatgtttta

SEQ ID NO: 139371 - DNA, 20 bp, Artificial Sequence
  Description of Artificial Sequence: Synthetic oligonucleotide
  Target: ATXN1; (+) strand; PAM type: NRG; PAM sequence: GAG
attattcatgttttaaagct

SEQ ID NO: 139372 - DNA, 20 bp, Artificial Sequence
  Description of Artificial Sequence: Synthetic oligonucleotide
  Target: ATXN1; (+) strand; PAM type: NRG; PAM sequence: CAG
atgttttaaagctgagaaaa

SEQ ID NO: 139373 - DNA, 20 bp, Artificial Sequence
  Description of Artificial Sequence: Synthetic oligonucleotide
  Target: ATXN1; (+) strand; PAM type: NRG; PAM sequence: GAG
gttttaaagctgagaaaaca

SEQ ID NO: 139374 - DNA, 20 bp, Artificial Sequence
  Description of Artificial Sequence: Synthetic oligonucleotide
  Target: ATXN1; (+) strand; PAM type: NRG; PAM sequence: AGG
ttttaaagctgagaaaacag

SEQ ID NO: 139375 - DNA, 20 bp, Artificial Sequence
  Description of Artificial Sequence: Synthetic oligonucleotide
  Target: ATXN1; (+) strand; PAM type: NRG; PAM sequence: TAG
aagctgagaaaacagaggct

SEQ ID NO: 139376 - DNA, 20 bp, Artificial Sequence
  Description of Artificial Sequence: Synthetic oligonucleotide
  Target: ATXN1; (+) strand; PAM type: NRG; PAM sequence: AGG
agctgagaaaacagaggctt

SEQ ID NO: 139377 - DNA, 20 bp, Artificial Sequence
  Description of Artificial Sequence: Synthetic oligonucleotide
  Target: ATXN1; (+) strand; PAM type: NRG; PAM sequence: CAG
gaggcttaggtcaactttcc

SEQ ID NO: 139378 - DNA, 20 bp, Artificial Sequence
  Description of Artificial Sequence: Synthetic oligonucleotide
  Target: ATXN1; (+) strand; PAM type: NRG; PAM sequence: AGG
aggcttaggtcaactttccc

SEQ ID NO: 139379 - DNA, 20 bp, Artificial Sequence
  Description of Artificial Sequence: Synthetic oligonucleotide
  Target: ATXN1; (+) strand; PAM type: NRG; PAM sequence: GGG
ggcttaggtcaactttccca

SEQ ID NO: 139380 - DNA, 20 bp, Artificial Sequence
  Description of Artificial Sequence: Synthetic oligonucleotide
  Target: ATXN1; (+) strand; PAM type: NRG; PAM sequence: AAG
tcaactttcccagggtctta

SEQ ID NO: 139381 - DNA, 20 bp, Artificial Sequence
  Description of Artificial Sequence: Synthetic oligonucleotide
  Target: ATXN1; (+) strand; PAM type: NRG; PAM sequence: TGG
gtcttaaagacgataaatta

SEQ ID NO: 139382 - DNA, 20 bp, Artificial Sequence
  Description of Artificial Sequence: Synthetic oligonucleotide
  Target: ATXN1; (+) strand; PAM type: NRG; PAM sequence: GAG
cttaaagacgataaattatg

SEQ ID NO: 139383 - DNA, 20 bp, Artificial Sequence
  Description of Artificial Sequence: Synthetic oligonucleotide
  Target: ATXN1; (+) strand; PAM type: NRG; PAM sequence: AGG
ttaaagacgataaattatgg

SEQ ID NO: 139384 - DNA, 20 bp, Artificial Sequence
  Description of Artificial Sequence: Synthetic oligonucleotide
  Target: ATXN1; (+) strand; PAM type: NRG; PAM sequence: TGG
agacgataaattatggaggc

SEQ ID NO: 139385 - DNA, 20 bp, Artificial Sequence
  Description of Artificial Sequence: Synthetic oligonucleotide
  Target: ATXN1; (+) strand; PAM type: NRG; PAM sequence: GAG
tggaggctggatttgaactt

SEQ ID NO: 139386 - DNA, 20 bp, Artificial Sequence
  Description of Artificial Sequence: Synthetic oligonucleotide
  Target: ATXN1; (+) strand; PAM type: NRG; PAM sequence: CAG
gcccactctccttccacttg

SEQ ID NO: 139387 - DNA, 20 bp, Artificial Sequence
  Description of Artificial Sequence: Synthetic oligonucleotide
  Target: ATXN1; (+) strand; PAM type: NRG; PAM sequence: CAG
ttccacttgcagcgtaaaca

SEQ ID NO: 139388 - DNA, 20 bp, Artificial Sequence
  Description of Artificial Sequence: Synthetic oligonucleotide
  Target: ATXN1; (+) strand; PAM type: NRG; PAM sequence: TGG
cacttgcagcgtaaacacag

SEQ ID NO: 139389 - DNA, 20 bp, Artificial Sequence
  Description of Artificial Sequence: Synthetic oligonucleotide
  Target: ATXN1; (+) strand; PAM type: NRG; PAM sequence: TGG
acacagtggctcaaactctg

SEQ ID NO: 139390 - DNA, 20 bp, Artificial Sequence
  Description of Artificial Sequence: Synthetic oligonucleotide
  Target: ATXN1; (+) strand; PAM type: NRG; PAM sequence: CAG
ttcatgaatataatgtttca

SEQ ID NO: 139391 - DNA, 20 bp, Artificial Sequence
  Description of Artificial Sequence: Synthetic oligonucleotide
  Target: ATXN1; (+) strand; PAM type: NRG; PAM sequence: AGG
tcatgaatataatgtttcac

SEQ ID NO: 139392 - DNA, 20 bp, Artificial Sequence
  Description of Artificial Sequence: Synthetic oligonucleotide
  Target: ATXN1; (+) strand; PAM type: NRG; PAM sequence: GGG
catgaatataatgtttcaca

SEQ ID NO: 139393 - DNA, 20 bp, Artificial Sequence
  Description of Artificial Sequence: Synthetic oligonucleotide
  Target: ATXN1; (+) strand; PAM type: NRG; PAM sequence: CAG
ataatgtttcacagggtatg

SEQ ID NO: 139394 - DNA, 20 bp, Artificial Sequence
  Description of Artificial Sequence: Synthetic oligonucleotide
  Target: ATXN1; (+) strand; PAM type: NRG; PAM sequence: AAG
agggtatgcagtgatcttat

SEQ ID NO: 139395 - DNA, 20 bp, Artificial Sequence
  Description of Artificial Sequence: Synthetic oligonucleotide
  Target: ATXN1; (+) strand; PAM type: NRG; PAM sequence: TAG
gtatgcagtgatcttataag

SEQ ID NO: 139396 - DNA, 20 bp, Artificial Sequence
  Description of Artificial Sequence: Synthetic oligonucleotide
  Target: ATXN1; (+) strand; PAM type: NRG; PAM sequence: TGG
agtgatcttataagtagaaa

SEQ ID NO: 139397 - DNA, 20 bp, Artificial Sequence
  Description of Artificial Sequence: Synthetic oligonucleotide
  Target: ATXN1; (+) strand; PAM type: NRG; PAM sequence: GGG
gtgatcttataagtagaaat

SEQ ID NO: 139398 - DNA, 20 bp, Artificial Sequence
  Description of Artificial Sequence: Synthetic oligonucleotide
  Target: ATXN1; (+) strand; PAM type: NRG; PAM sequence: TAG
cttataagtagaaatgggtc

SEQ ID NO: 139399 - DNA, 20 bp, Artificial Sequence
  Description of Artificial Sequence: Synthetic oligonucleotide
  Target: ATXN1; (+) strand; PAM type: NRG; PAM sequence: AAG
taagtagaaatgggtctaga

SEQ ID NO: 139400 - DNA, 20 bp, Artificial Sequence
  Description of Artificial Sequence: Synthetic oligonucleotide
  Target: ATXN1; (+) strand; PAM type: NRG; PAM sequence: TGG
tagaaatgggtctagaaaga

SEQ ID NO: 139401 - DNA, 20 bp, Artificial Sequence
  Description of Artificial Sequence: Synthetic oligonucleotide
  Target: ATXN1; (+) strand; PAM type: NRG; PAM sequence: TGG
tctagaaagatggacactcc

SEQ ID NO: 139402 - DNA, 20 bp, Artificial Sequence
  Description of Artificial Sequence: Synthetic oligonucleotide
  Target: ATXN1; (+) strand; PAM type: NRG; PAM sequence: GAG
gacacctatatttgcccctt

SEQ ID NO: 139403 - DNA, 20 bp, Artificial Sequence
  Description of Artificial Sequence: Synthetic oligonucleotide
  Target: ATXN1; (+) strand; PAM type: NRG; PAM sequence: TGG
cccttgagtcccttgaatat

SEQ ID NO: 139404 - DNA, 20 bp, Artificial Sequence
  Description of Artificial Sequence: Synthetic oligonucleotide
  Target: ATXN1; (+) strand; PAM type: NRG; PAM sequence: CAG
tattggtgccacactctgct

SEQ ID NO: 139405 - DNA, 20 bp, Artificial Sequence
  Description of Artificial Sequence: Synthetic oligonucleotide
  Target: ATXN1; (+) strand; PAM type: NRG; PAM sequence: TGG
actctgctcagctcttgata

SEQ ID NO: 139406 - DNA, 20 bp, Artificial Sequence
  Description of Artificial Sequence: Synthetic oligonucleotide
  Target: ATXN1; (+) strand; PAM type: NRG; PAM sequence: AAG
tcagctcttgatatggtgca

SEQ ID NO: 139407 - DNA, 20 bp, Artificial Sequence
  Description of Artificial Sequence: Synthetic oligonucleotide
  Target: ATXN1; (+) strand; PAM type: NRG; PAM sequence: CAG
tgcaaagcactaaaatcaca

SEQ ID NO: 139408 - DNA, 20 bp, Artificial Sequence
  Description of Artificial Sequence: Synthetic oligonucleotide
  Target: ATXN1; (+) strand; PAM type: NRG; PAM sequence: AGG
gcaaagcactaaaatcacac

SEQ ID NO: 139409 - DNA, 20 bp, Artificial Sequence
  Description of Artificial Sequence: Synthetic oligonucleotide
  Target: ATXN1; (+) strand; PAM type: NRG; PAM sequence: CAG
ctaaaatcacacaggtgtca

SEQ ID NO: 139410 - DNA, 20 bp, Artificial Sequence
  Description of Artificial Sequence: Synthetic oligonucleotide
  Target: ATXN1; (+) strand; PAM type: NRG; PAM sequence: AAG
aaaaattctgtatcattcca

SEQ ID NO: 139411 - DNA, 20 bp, Artificial Sequence
  Description of Artificial Sequence: Synthetic oligonucleotide
  Target: ATXN1; (+) strand; PAM type: NRG; PAM sequence: CAG
aaagctgacttgtcccccat

SEQ ID NO: 139412 - DNA, 20 bp, Artificial Sequence
  Description of Artificial Sequence: Synthetic oligonucleotide
  Target: ATXN1; (+) strand; PAM type: NRG; PAM sequence: CAG
catcagtcccaactctgccc

SEQ ID NO: 139413 - DNA, 20 bp, Artificial Sequence
  Description of Artificial Sequence: Synthetic oligonucleotide
  Target: ATXN1; (+) strand; PAM type: NRG; PAM sequence: AAG
cagtcccaactctgccccag

SEQ ID NO: 139414 - DNA, 20 bp, Artificial Sequence
  Description of Artificial Sequence: Synthetic oligonucleotide
  Target: ATXN1; (+) strand; PAM type: NRG; PAM sequence: AAG
ccagaagtctcactgaaata

SEQ ID NO: 139415 - DNA, 20 bp, Artificial Sequence
  Description of Artificial Sequence: Synthetic oligonucleotide
  Target: ATXN1; (+) strand; PAM type: NRG; PAM sequence: CAG
tctcactgaaataaagtctc

SEQ ID NO: 139416 - DNA, 20 bp, Artificial Sequence
  Description of Artificial Sequence: Synthetic oligonucleotide
  Target: ATXN1; (+) strand; PAM type: NRG; PAM sequence: AGG
ctcactgaaataaagtctcc

SEQ ID NO: 139417 - DNA, 20 bp, Artificial Sequence
  Description of Artificial Sequence: Synthetic oligonucleotide
  Target: ATXN1; (+) strand; PAM type: NRG; PAM sequence: TGG
ccactcctcattcacatcct

SEQ ID NO: 139418 - DNA, 20 bp, Artificial Sequence
  Description of Artificial Sequence: Synthetic oligonucleotide
  Target: ATXN1; (+) strand; PAM type: NRG; PAM sequence: TAG
ttttatgacccacacttcta

SEQ ID NO: 139419 - DNA, 20 bp, Artificial Sequence
  Description of Artificial Sequence: Synthetic oligonucleotide
  Target: ATXN1; (+) strand; PAM type: NRG; PAM sequence: AGG
tttatgacccacacttctat

SEQ ID NO: 139420 - DNA, 20 bp, Artificial Sequence
  Description of Artificial Sequence: Synthetic oligonucleotide
  Target: ATXN1; (+) strand; PAM type: NRG; PAM sequence: TAG
ctataggactctcccttctt

SEQ ID NO: 139421 - DNA, 20 bp, Artificial Sequence
  Description of Artificial Sequence: Synthetic oligonucleotide
  Target: ATXN1; (+) strand; PAM type: NRG; PAM sequence: AAG
tctttagttctaattattaa

SEQ ID NO: 139422 - DNA, 20 bp, Artificial Sequence
  Description of Artificial Sequence: Synthetic oligonucleotide
  Target: ATXN1; (+) strand; PAM type: NRG; PAM sequence: CAG
ttagttctaattattaaaag

SEQ ID NO: 139423 - DNA, 20 bp, Artificial Sequence
  Description of Artificial Sequence: Synthetic oligonucleotide
  Target: ATXN1; (+) strand; PAM type: NRG; PAM sequence: AGG
tagttctaattattaaaagc

SEQ ID NO: 139424 - DNA, 20 bp, Artificial Sequence
  Description of Artificial Sequence: Synthetic oligonucleotide
  Target: ATXN1; (+) strand; PAM type: NRG; PAM sequence: GGG
agttctaattattaaaagca

SEQ ID NO: 139425 - DNA, 20 bp, Artificial Sequence
  Description of Artificial Sequence: Synthetic oligonucleotide
  Target: ATXN1; (+) strand; PAM type: NRG; PAM sequence: AAG
aagcagggttctgaaatccc

SEQ ID NO: 139426 - DNA, 20 bp, Artificial Sequence
  Description of Artificial Sequence: Synthetic oligonucleotide
  Target: ATXN1; (+) strand; PAM type: NRG; PAM sequence: AGG
agcagggttctgaaatccca

SEQ ID NO: 139427 - DNA, 20 bp, Artificial Sequence
  Description of Artificial Sequence: Synthetic oligonucleotide
  Target: ATXN1; (+) strand; PAM type: NRG; PAM sequence: CAG
tgattgcaaaactcccatct

SEQ ID NO: 139428 - DNA, 20 bp, Artificial Sequence
  Description of Artificial Sequence: Synthetic oligonucleotide
  Target: ATXN1; (+) strand; PAM type: NRG; PAM sequence: TAG
tctcagccacaaatcttcat

SEQ ID NO: 139429 - DNA, 20 bp, Artificial Sequence
  Description of Artificial Sequence: Synthetic oligonucleotide
  Target: ATXN1; (+) strand; PAM type: NRG; PAM sequence: TGG
gccacaaatcttcattagaa

SEQ ID NO: 139430 - DNA, 20 bp, Artificial Sequence
  Description of Artificial Sequence: Synthetic oligonucleotide
  Target: ATXN1; (+) strand; PAM type: NRG; PAM sequence: AAG
cattagaatggctaatcaat

SEQ ID NO: 139431 - DNA, 20 bp, Artificial Sequence
  Description of Artificial Sequence: Synthetic oligonucleotide
  Target: ATXN1; (+) strand; PAM type: NRG; PAM sequence: GAG
ttagaatggctaatcaataa

SEQ ID NO: 139432 - DNA, 20 bp, Artificial Sequence
  Description of Artificial Sequence: Synthetic oligonucleotide
  Target: ATXN1; (+) strand; PAM type: NRG; PAM sequence: CAG
aatcaataagagttttgttt

SEQ ID NO: 139433 - DNA, 20 bp, Artificial Sequence
  Description of Artificial Sequence: Synthetic oligonucleotide
  Target: ATXN1; (+) strand; PAM type: NRG; PAM sequence: AAG
tttcctctgtatgttttttg

SEQ ID NO: 139434 - DNA, 20 bp, Artificial Sequence
  Description of Artificial Sequence: Synthetic oligonucleotide
  Target: ATXN1; (+) strand; PAM type: NRG; PAM sequence: AAG
ccatgatataactaaaactc

SEQ ID NO: 139435 - DNA, 20 bp, Artificial Sequence
  Description of Artificial Sequence: Synthetic oligonucleotide
  Target: ATXN1; (+) strand; PAM type: NRG; PAM sequence: CAG
aactaaaactcaagcatcaa

SEQ ID NO: 139436 - DNA, 20 bp, Artificial Sequence
  Description of Artificial Sequence: Synthetic oligonucleotide
  Target: ATXN1; (+) strand; PAM type: NRG; PAM sequence: AGG
actaaaactcaagcatcaac

SEQ ID NO: 139437 - DNA, 20 bp, Artificial Sequence
  Description of Artificial Sequence: Synthetic oligonucleotide
  Target: ATXN1; (+) strand; PAM type: NRG; PAM sequence: AAG
aaactcaagcatcaacagga

SEQ ID NO: 139438 - DNA, 20 bp, Artificial Sequence
  Description of Artificial Sequence: Synthetic oligonucleotide
  Target: ATXN1; (+) strand; PAM type: NRG; PAM sequence: GAG
actcaagcatcaacaggaaa

SEQ ID NO: 139439 - DNA, 20 bp, Artificial Sequence
  Description of Artificial Sequence: Synthetic oligonucleotide
  Target: ATXN1; (+) strand; PAM type: NRG; PAM sequence: AGG
ctcaagcatcaacaggaaag

SEQ ID NO: 139440 - DNA, 20 bp, Artificial Sequence
  Description of Artificial Sequence: Synthetic oligonucleotide
  Target: ATXN1; (+) strand; PAM type: NRG; PAM sequence: AAG
aagcatcaacaggaaagagg

SEQ ID NO: 139441 - DNA, 20 bp, Artificial Sequence
  Description of Artificial Sequence: Synthetic oligonucleotide
  Target: ATXN1; (+) strand; PAM type: NRG; PAM sequence: GAG
gcatcaacaggaaagaggaa

SEQ ID NO: 139442 - DNA, 20 bp, Artificial Sequence
  Description of Artificial Sequence: Synthetic oligonucleotide
  Target: ATXN1; (+) strand; PAM type: NRG; PAM sequence: AAG
tcaacaggaaagaggaagag

SEQ ID NO: 139443 - DNA, 20 bp, Artificial Sequence
  Description of Artificial Sequence: Synthetic oligonucleotide
  Target: ATXN1; (+) strand; PAM type: NRG; PAM sequence: GAG
aacaggaaagaggaagagaa

SEQ ID NO: 139444 - DNA, 20 bp, Artificial Sequence
  Description of Artificial Sequence: Synthetic oligonucleotide
  Target: ATXN1; (+) strand; PAM type: NRG; PAM sequence: CAG
gaaagaggaagagaagagct

SEQ ID NO: 139445 - DNA, 20 bp, Artificial Sequence
  Description of Artificial Sequence: Synthetic oligonucleotide
  Target: ATXN1; (+) strand; PAM type: NRG; PAM sequence: AAG
gaagagaagagctcagaaat

SEQ ID NO: 139446 - DNA, 20 bp, Artificial Sequence
  Description of Artificial Sequence: Synthetic oligonucleotide
  Target: ATXN1; (+) strand; PAM type: NRG; PAM sequence: TAG
agagctcagaaataagccac

SEQ ID NO: 139447 - DNA, 20 bp, Artificial Sequence
  Description of Artificial Sequence: Synthetic oligonucleotide
  Target: ATXN1; (+) strand; PAM type: NRG; PAM sequence: TAG
aagccactagtgctcgaaaa

SEQ ID NO: 139448 - DNA, 20 bp, Artificial Sequence
  Description of Artificial Sequence: Synthetic oligonucleotide
  Target: ATXN1; (+) strand; PAM type: NRG; PAM sequence: AGG
agccactagtgctcgaaaat

SEQ ID NO: 139449 - DNA, 20 bp, Artificial Sequence
  Description of Artificial Sequence: Synthetic oligonucleotide
  Target: ATXN1; (+) strand; PAM type: NRG; PAM sequence: GGG
gccactagtgctcgaaaata

SEQ ID NO: 139450 - DNA, 20 bp, Artificial Sequence
  Description of Artificial Sequence: Synthetic oligonucleotide
  Target: ATXN1; (+) strand; PAM type: NRG; PAM sequence: TAG
gaaaatagggcatgtgatgt

SEQ ID NO: 139451 - DNA, 20 bp, Artificial Sequence
  Description of Artificial Sequence: Synthetic oligonucleotide
  Target: ATXN1; (+) strand; PAM type: NRG; PAM sequence: GAG
aaatagggcatgtgatgtta

SEQ ID NO: 139452 - DNA, 20 bp, Artificial Sequence
  Description of Artificial Sequence: Synthetic oligonucleotide
  Target: ATXN1; (+) strand; PAM type: NRG; PAM sequence: TGG
agggcatgtgatgttagagc

SEQ ID NO: 139453 - DNA, 20 bp, Artificial Sequence
  Description of Artificial Sequence: Synthetic oligonucleotide
  Target: ATXN1; (+) strand; PAM type: NRG; PAM sequence: TAG
atgtgatgttagagctggtt

SEQ ID NO: 139454 - DNA, 20 bp, Artificial Sequence
  Description of Artificial Sequence: Synthetic oligonucleotide
  Target: ATXN1; (+) strand; PAM type: NRG; PAM sequence: TAG
atccatgctccactgcatcg

SEQ ID NO: 139455 - DNA, 20 bp, Artificial Sequence
  Description of Artificial Sequence: Synthetic oligonucleotide
  Target: ATXN1; (+) strand; PAM type: NRG; PAM sequence: TGG
gctccactgcatcgtagcta

SEQ ID NO: 139456 - DNA, 20 bp, Artificial Sequence
  Description of Artificial Sequence: Synthetic oligonucleotide
  Target: ATXN1; (+) strand; PAM type: NRG; PAM sequence: TGG
ccactgcatcgtagctatgg

SEQ ID NO: 139457 - DNA, 20 bp, Artificial Sequence
  Description of Artificial Sequence: Synthetic oligonucleotide
  Target: ATXN1; (+) strand; PAM type: NRG; PAM sequence: GGG
cactgcatcgtagctatggt

SEQ ID NO: 139458 - DNA, 20 bp, Artificial Sequence
  Description of Artificial Sequence: Synthetic oligonucleotide
  Target: ATXN1; (+) strand; PAM type: NRG; PAM sequence: GGG
actgcatcgtagctatggtg

SEQ ID NO: 139459 - DNA, 20 bp, Artificial Sequence
  Description of Artificial Sequence: Synthetic oligonucleotide
  Target: ATXN1; (+) strand; PAM type: NRG; PAM sequence: TGG
atcgtagctatggtggggca

SEQ ID NO: 139460 - DNA, 20 bp, Artificial Sequence
  Description of Artificial Sequence: Synthetic oligonucleotide
  Target: ATXN1; (+) strand; PAM type: NRG; PAM sequence: TAG
catggattcttattattaat

SEQ ID NO: 139461 - DNA, 20 bp, Artificial Sequence
  Description of Artificial Sequence: Synthetic oligonucleotide
  Target: ATXN1; (+) strand; PAM type: NRG; PAM sequence: AAG
tcacaccacctgtaaaacaa

SEQ ID NO: 139462 - DNA, 20 bp, Artificial Sequence
  Description of Artificial Sequence: Synthetic oligonucleotide
  Target: ATXN1; (+) strand; PAM type: NRG; PAM sequence: TGG
aagcaataatgcttacttca

SEQ ID NO: 139463 - DNA, 20 bp, Artificial Sequence
  Description of Artificial Sequence: Synthetic oligonucleotide
  Target: ATXN1; (+) strand; PAM type: NRG; PAM sequence: GGG
agcaataatgcttacttcat

SEQ ID NO: 139464 - DNA, 20 bp, Artificial Sequence
  Description of Artificial Sequence: Synthetic oligonucleotide
  Target: ATXN1; (+) strand; PAM type: NRG; PAM sequence: GGG
gcaataatgcttacttcatg

SEQ ID NO: 139465 - DNA, 20 bp, Artificial Sequence
  Description of Artificial Sequence: Synthetic oligonucleotide
  Target: ATXN1; (+) strand; PAM type: NRG; PAM sequence: TAG
ataatgcttacttcatgggg

SEQ ID NO: 139466 - DNA, 20 bp, Artificial Sequence
  Description of Artificial Sequence: Synthetic oligonucleotide
  Target: ATXN1; (+) strand; PAM type: NRG; PAM sequence: GAG
tgcttacttcatggggtagt

SEQ ID NO: 139467 - DNA, 20 bp, Artificial Sequence
  Description of Artificial Sequence: Synthetic oligonucleotide
  Target: ATXN1; (+) strand; PAM type: NRG; PAM sequence: AGG
gcttacttcatggggtagtg

SEQ ID NO: 139468 - DNA, 20 bp, Artificial Sequence
  Description of Artificial Sequence: Synthetic oligonucleotide
  Target: ATXN1; (+) strand; PAM type: NRG; PAM sequence: GAG
ttacttcatggggtagtgag

SEQ ID NO: 139469 - DNA, 20 bp, Artificial Sequence
  Description of Artificial Sequence: Synthetic oligonucleotide
  Target: ATXN1; (+) strand; PAM type: NRG; PAM sequence: AGG
tacttcatggggtagtgagg

SEQ ID NO: 139470 - DNA, 20 bp, Artificial Sequence
  Description of Artificial Sequence: Synthetic oligonucleotide
  Target: ATXN1; (+) strand; PAM type: NRG; PAM sequence: GAG
ggtagtgaggaggtttaaat

SEQ ID NO: 139471 - DNA, 20 bp, Artificial Sequence
  Description of Artificial Sequence: Synthetic oligonucleotide
  Target: ATXN1; (+) strand; PAM type: NRG; PAM sequence: GAG
tagtgaggaggtttaaatga

SEQ ID NO: 139472 - DNA, 20 bp, Artificial Sequence
  Description of Artificial Sequence: Synthetic oligonucleotide
  Target: ATXN1; (+) strand; PAM type: NRG; PAM sequence: AGG
agtgaggaggtttaaatgag

SEQ ID NO: 139473 - DNA, 20 bp, Artificial Sequence
  Description of Artificial Sequence: Synthetic oligonucleotide
  Target: ATXN1; (+) strand; PAM type: NRG; PAM sequence: CAG
gaggtttaaatgagaggcta

SEQ ID NO: 139474 - DNA, 20 bp, Artificial Sequence
  Description of Artificial Sequence: Synthetic oligonucleotide
  Target: ATXN1; (+) strand; PAM type: NRG; PAM sequence: GAG
ctacagctaatgctcttaat

SEQ ID NO: 139475 - DNA, 20 bp, Artificial Sequence
  Description of Artificial Sequence: Synthetic oligonucleotide
  Target: ATXN1; (+) strand; PAM type: NRG; PAM sequence: TGG
gatgccttccttttcctctc

SEQ ID NO: 139476 - DNA, 20 bp, Artificial Sequence
  Description of Artificial Sequence: Synthetic oligonucleotide
  Target: ATXN1; (+) strand; PAM type: NRG; PAM sequence: CAG
ccttccttttcctctctggc

SEQ ID NO: 139477 - DNA, 20 bp, Artificial Sequence
  Description of Artificial Sequence: Synthetic oligonucleotide
  Target: ATXN1; (+) strand; PAM type: NRG; PAM sequence: GAG
ccttttcctctctggccagt

SEQ ID NO: 139478 - DNA, 20 bp, Artificial Sequence
  Description of Artificial Sequence: Synthetic oligonucleotide
  Target: ATXN1; (+) strand; PAM type: NRG; PAM sequence: AGG
cttttcctctctggccagtg

SEQ ID NO: 139479 - DNA, 20 bp, Artificial Sequence
  Description of Artificial Sequence: Synthetic oligonucleotide
  Target: ATXN1; (+) strand; PAM type: NRG; PAM sequence: GGG
ttttcctctctggccagtga

SEQ ID NO: 139480 - DNA, 20 bp, Artificial Sequence
  Description of Artificial Sequence: Synthetic oligonucleotide
  Target: ATXN1; (+) strand; PAM type: NRG; PAM sequence: GGG
tttcctctctggccagtgag

SEQ ID NO: 139481 - DNA, 20 bp, Artificial Sequence
  Description of Artificial Sequence: Synthetic oligonucleotide
  Target: ATXN1; (+) strand; PAM type: NRG; PAM sequence: TGG
cctctctggccagtgagggg

SEQ ID NO: 139482 - DNA, 20 bp, Artificial Sequence
  Description of Artificial Sequence: Synthetic oligonucleotide
  Target: ATXN1; (+) strand; PAM type: NRG; PAM sequence: CAG
tcttccccaactaatcccct

SEQ ID NO: 139483 - DNA, 20 bp, Artificial Sequence
  Description of Artificial Sequence: Synthetic oligonucleotide
  Target: ATXN1; (+) strand; PAM type: NRG; PAM sequence: TGG
caactaatcccctcagccac

SEQ ID NO: 139484 - DNA, 20 bp, Artificial Sequence
  Description of Artificial Sequence: Synthetic oligonucleotide
  Target: ATXN1; (+) strand; PAM type: NRG; PAM sequence: TAG
tggcaccatgttccgcatgt

SEQ ID NO: 139485 - DNA, 20 bp, Artificial Sequence
  Description of Artificial Sequence: Synthetic oligonucleotide
  Target: ATXN1; (+) strand; PAM type: NRG; PAM sequence: GAG
gcaccatgttccgcatgtta

SEQ ID NO: 139486 - DNA, 20 bp, Artificial Sequence
  Description of Artificial Sequence: Synthetic oligonucleotide
  Target: ATXN1; (+) strand; PAM type: NRG; PAM sequence: AGG
caccatgttccgcatgttag

SEQ ID NO: 139487 - DNA, 20 bp, Artificial Sequence
  Description of Artificial Sequence: Synthetic oligonucleotide
  Target: ATXN1; (+) strand; PAM type: NRG; PAM sequence: TGG
catgttagaggcatccttcc

SEQ ID NO: 139488 - DNA, 20 bp, Artificial Sequence
  Description of Artificial Sequence: Synthetic oligonucleotide
  Target: ATXN1; (+) strand; PAM type: NRG; PAM sequence: GGG
atgttagaggcatccttcct

SEQ ID NO: 139489 - DNA, 20 bp, Artificial Sequence
  Description of Artificial Sequence: Synthetic oligonucleotide
  Target: ATXN1; (+) strand; PAM type: NRG; PAM sequence: GGG
tgttagaggcatccttcctg

SEQ ID NO: 139490 - DNA, 20 bp, Artificial Sequence
  Description of Artificial Sequence: Synthetic oligonucleotide
  Target: ATXN1; (+) strand; PAM type: NRG; PAM sequence: CAG
tagaggcatccttcctgggg

SEQ ID NO: 139491 - DNA, 20 bp, Artificial Sequence
  Description of Artificial Sequence: Synthetic oligonucleotide
  Target: ATXN1; (+) strand; PAM type: NRG; PAM sequence: GAG
ggcatccttcctggggcagt

SEQ ID NO: 139492 - DNA, 20 bp, Artificial Sequence
  Description of Artificial Sequence: Synthetic oligonucleotide
  Target: ATXN1; (+) strand; PAM type: NRG; PAM sequence: CAG
cagtgagacacatcctgaat

SEQ ID NO: 139493 - DNA, 20 bp, Artificial Sequence
  Description of Artificial Sequence: Synthetic oligonucleotide
  Target: ATXN1; (+) strand; PAM type: NRG; PAM sequence: AAG
gaatcagccttgtcacccta

SEQ ID NO: 139494 - DNA, 20 bp, Artificial Sequence
  Description of Artificial Sequence: Synthetic oligonucleotide
  Target: ATXN1; (+) strand; PAM type: NRG; PAM sequence: AGG
aatcagccttgtcaccctaa

SEQ ID NO: 139495 - DNA, 20 bp, Artificial Sequence
  Description of Artificial Sequence: Synthetic oligonucleotide
  Target: ATXN1; (+) strand; PAM type: NRG; PAM sequence: GGG
atcagccttgtcaccctaaa

SEQ ID NO: 139496 - DNA, 20 bp, Artificial Sequence
  Description of Artificial Sequence: Synthetic oligonucleotide
  Target: ATXN1; (+) strand; PAM type: NRG; PAM sequence: GGG
tcagccttgtcaccctaaag

SEQ ID NO: 139497 - DNA, 20 bp, Artificial Sequence
  Description of Artificial Sequence: Synthetic oligonucleotide
  Target: ATXN1; (+) strand; PAM type: NRG; PAM sequence: TGG
gaccttgcaacgtttgctcg

SEQ ID NO: 139498 - DNA, 20 bp, Artificial Sequence
  Description of Artificial Sequence: Synthetic oligonucleotide
  Target: ATXN1; (+) strand; PAM type: NRG; PAM sequence: GGG
accttgcaacgtttgctcgt

SEQ ID NO: 139499 - DNA, 20 bp, Artificial Sequence
  Description of Artificial Sequence: Synthetic oligonucleotide
  Target: ATXN1; (+) strand; PAM type: NRG; PAM sequence: CAG
cgtgggtcgacaacaccaca

SEQ ID NO: 139500 - DNA, 20 bp, Artificial Sequence
  Description of Artificial Sequence: Synthetic oligonucleotide
  Target: ATXN1; (+) strand; PAM type: NRG; PAM sequence: GAG
tgggtcgacaacaccacaca

SEQ ID NO: 139501 - DNA, 20 bp, Artificial Sequence
  Description of Artificial Sequence: Synthetic oligonucleotide
  Target: ATXN1; (+) strand; PAM type: NRG; PAM sequence: GAG
acaccacacagagctgacat

SEQ ID NO: 139502 - DNA, 20 bp, Artificial Sequence
  Description of Artificial Sequence: Synthetic oligonucleotide
  Target: ATXN1; (+) strand; PAM type: NRG; PAM sequence: AGG
caccacacagagctgacatg

SEQ ID NO: 139503 - DNA, 20 bp, Artificial Sequence
  Description of Artificial Sequence: Synthetic oligonucleotide
  Target: ATXN1; (+) strand; PAM type: NRG; PAM sequence: AAG
acatgaggatgacatgtgac

SEQ ID NO: 139504 - DNA, 20 bp, Artificial Sequence
  Description of Artificial Sequence: Synthetic oligonucleotide
  Target: ATXN1; (+) strand; PAM type: NRG; PAM sequence: TAG
tgacatgtgacaagatgact

SEQ ID NO: 139505 - DNA, 20 bp, Artificial Sequence
  Description of Artificial Sequence: Synthetic oligonucleotide
  Target: ATXN1; (+) strand; PAM type: NRG; PAM sequence: GAG
acatgtgacaagatgactta

SEQ ID NO: 139506 - DNA, 20 bp, Artificial Sequence
  Description of Artificial Sequence: Synthetic oligonucleotide
  Target: ATXN1; (+) strand; PAM type: NRG; PAM sequence: GAG
agcctgctaaatgaacacat

SEQ ID NO: 139507 - DNA, 20 bp, Artificial Sequence
  Description of Artificial Sequence: Synthetic oligonucleotide
  Target: ATXN1; (+) strand; PAM type: NRG; PAM sequence: TAG
tgaacacatgagctaaatgc

SEQ ID NO: 139508 - DNA, 20 bp, Artificial Sequence
  Description of Artificial Sequence: Synthetic oligonucleotide
  Target: ATXN1; (+) strand; PAM type: NRG; PAM sequence: AGG
gaacacatgagctaaatgct

SEQ ID NO: 139509 - DNA, 20 bp, Artificial Sequence
  Description of Artificial Sequence: Synthetic oligonucleotide
  Target: ATXN1; (+) strand; PAM type: NRG; PAM sequence: GAG
ggtaccactgtgctttccat

SEQ ID NO: 139510 - DNA, 20 bp, Artificial Sequence
  Description of Artificial Sequence: Synthetic oligonucleotide
  Target: ATXN1; (+) strand; PAM type: NRG; PAM sequence: TAG
tgtgctttccatgagattgt

SEQ ID NO: 139511 - DNA, 20 bp, Artificial Sequence
  Description of Artificial Sequence: Synthetic oligonucleotide
  Target: ATXN1; (+) strand; PAM type: NRG; PAM sequence: AGG
gtgctttccatgagattgtt

SEQ ID NO: 139512 - DNA, 20 bp, Artificial Sequence
  Description of Artificial Sequence: Synthetic oligonucleotide
  Target: ATXN1; (+) strand; PAM type: NRG; PAM sequence: CAG
ctttccatgagattgttagg

SEQ ID NO: 139513 - DNA, 20 bp, Artificial Sequence
  Description of Artificial Sequence: Synthetic oligonucleotide
  Target: ATXN1; (+) strand; PAM type: NRG; PAM sequence: AAG
tccatgagattgttaggcag

SEQ ID NO: 139514 - DNA, 20 bp, Artificial Sequence
  Description of Artificial Sequence: Synthetic oligonucleotide
  Target: ATXN1; (+) strand; PAM type: NRG; PAM sequence: AGG
ccatgagattgttaggcaga

SEQ ID NO: 139515 - DNA, 20 bp, Artificial Sequence
  Description of Artificial Sequence: Synthetic oligonucleotide
  Target: ATXN1; (+) strand; PAM type: NRG; PAM sequence: AAG
cactgaatctttgctctcca

SEQ ID NO: 139516 - DNA, 20 bp, Artificial Sequence
  Description of Artificial Sequence: Synthetic oligonucleotide
  Target: ATXN1; (+) strand; PAM type: NRG; PAM sequence: CAG
agttttgatttgaattcaca

SEQ ID NO: 139517 - DNA, 20 bp, Artificial Sequence
  Description of Artificial Sequence: Synthetic oligonucleotide
  Target: ATXN1; (+) strand; PAM type: NRG; PAM sequence: AGG
gttttgatttgaattcacac

SEQ ID NO: 139518 - DNA, 20 bp, Artificial Sequence
  Description of Artificial Sequence: Synthetic oligonucleotide
  Target: ATXN1; (+) strand; PAM type: NRG; PAM sequence: AAG
tgatttgaattcacacaggc

SEQ ID NO: 139519 - DNA, 20 bp, Artificial Sequence
  Description of Artificial Sequence: Synthetic oligonucleotide
  Target: ATXN1; (+) strand; PAM type: NRG; PAM sequence: CAG
caagattcttgtcaatgacc

SEQ ID NO: 139520 - DNA, 20 bp, Artificial Sequence
  Description of Artificial Sequence: Synthetic oligonucleotide
  Target: ATXN1; (+) strand; PAM type: NRG; PAM sequence: AAG
tcaatgacccagaatcactt

SEQ ID NO: 139521 - DNA, 20 bp, Artificial Sequence
  Description of Artificial Sequence: Synthetic oligonucleotide
  Target: ATXN1; (+) strand; PAM type: NRG; PAM sequence: GAG
cccagaatcacttaagcccc

SEQ ID NO: 139522 - DNA, 20 bp, Artificial Sequence
  Description of Artificial Sequence: Synthetic oligonucleotide
  Target: ATXN1; (+) strand; PAM type: NRG; PAM sequence: AGG
ccagaatcacttaagccccg

SEQ ID NO: 139523 - DNA, 20 bp, Artificial Sequence
  Description of Artificial Sequence: Synthetic oligonucleotide
  Target: ATXN1; (+) strand; PAM type: NRG; PAM sequence: GGG
cagaatcacttaagccccga

SEQ ID NO: 139524 - DNA, 20 bp, Artificial Sequence
  Description of Artificial Sequence: Synthetic oligonucleotide
  Target: ATXN1; (+) strand; PAM type: NRG; PAM sequence: GGG
agaatcacttaagccccgag

SEQ ID NO: 139525 - DNA, 20 bp, Artificial Sequence
  Description of Artificial Sequence: Synthetic oligonucleotide
  Target: ATXN1; (+) strand; PAM type: NRG; PAM sequence: GGG
gaatcacttaagccccgagg

SEQ ID NO: 139526 - DNA, 20 bp, Artificial Sequence
  Description of Artificial Sequence: Synthetic oligonucleotide
  Target: ATXN1; (+) strand; PAM type: NRG; PAM sequence: CAG
ccccgagggggccatgccac

SEQ ID NO: 139527 - DNA, 20 bp, Artificial Sequence
  Description of Artificial Sequence: Synthetic oligonucleotide
  Target: ATXN1; (+) strand; PAM type: NRG; PAM sequence: CAG
agggggccatgccaccagca

SEQ ID NO: 139528 - DNA, 20 bp, Artificial Sequence
  Description of Artificial Sequence: Synthetic oligonucleotide
  Target: ATXN1; (+) strand; PAM type: NRG; PAM sequence: CAG
gggccatgccaccagcacag

SEQ ID NO: 139529 - DNA, 20 bp, Artificial Sequence
  Description of Artificial Sequence: Synthetic oligonucleotide
  Target: ATXN1; (+) strand; PAM type: NRG; PAM sequence: AGG
ggccatgccaccagcacagc

SEQ ID NO: 139530 - DNA, 20 bp, Artificial Sequence
  Description of Artificial Sequence: Synthetic oligonucleotide
  Target: ATXN1; (+) strand; PAM type: NRG; PAM sequence: GGG
gccatgccaccagcacagca

SEQ ID NO: 139531 - DNA, 20 bp, Artificial Sequence
  Description of Artificial Sequence: Synthetic oligonucleotide
  Target: ATXN1; (+) strand; PAM type: NRG; PAM sequence: CAG
tgccaccagcacagcagggc

SEQ ID NO: 139532 - DNA, 20 bp, Artificial Sequence
  Description of Artificial Sequence: Synthetic oligonucleotide
  Target: ATXN1; (+) strand; PAM type: NRG; PAM sequence: AAG
cacagcagggccagatcatg

SEQ ID NO: 139533 - DNA, 20 bp, Artificial Sequence
  Description of Artificial Sequence: Synthetic oligonucleotide
  Target: ATXN1; (+) strand; PAM type: NRG; PAM sequence: TGG
gccagatcatgaagccccac

SEQ ID NO: 139534 - DNA, 20 bp, Artificial Sequence
  Description of Artificial Sequence: Synthetic oligonucleotide
  Target: ATXN1; (+) strand; PAM type: NRG; PAM sequence: GGG
ccagatcatgaagccccact

SEQ ID NO: 139535 - DNA, 20 bp, Artificial Sequence
  Description of Artificial Sequence: Synthetic oligonucleotide
  Target: ATXN1; (+) strand; PAM type: NRG; PAM sequence: CGG
catgaagccccactgggatg

SEQ ID NO: 139536 - DNA, 20 bp, Artificial Sequence
  Description of Artificial Sequence: Synthetic oligonucleotide
  Target: ATXN1; (+) strand; PAM type: NRG; PAM sequence: GGG
atgaagccccactgggatgc

SEQ ID NO: 139537 - DNA, 20 bp, Artificial Sequence
  Description of Artificial Sequence: Synthetic oligonucleotide
  Target: ATXN1; (+) strand; PAM type: NRG; PAM sequence: GGG
tgaagccccactgggatgcg

SEQ ID NO: 139538 - DNA, 20 bp, Artificial Sequence
  Description of Artificial Sequence: Synthetic oligonucleotide
  Target: ATXN1; (+) strand; PAM type: NRG; PAM sequence: TGG
gccccactgggatgcggggt

SEQ ID NO: 139539 - DNA, 20 bp, Artificial Sequence
  Description of Artificial Sequence: Synthetic oligonucleotide
  Target: ATXN1; (+) strand; PAM type: NRG; PAM sequence: GGG
ccccactgggatgcggggtt

SEQ ID NO: 139540 - DNA, 20 bp, Artificial Sequence
  Description of Artificial Sequence: Synthetic oligonucleotide
  Target: ATXN1; (+) strand; PAM type: NRG; PAM sequence: GGG
cccactgggatgcggggttg

SEQ ID NO: 139541 - DNA, 20 bp, Artificial Sequence
  Description of Artificial Sequence: Synthetic oligonucleotide
  Target: ATXN1; (+) strand; PAM type: NRG; PAM sequence: GGG
ccactgggatgcggggttgg

SEQ ID NO: 139542 - DNA, 20 bp, Artificial Sequence
  Description of Artificial Sequence: Synthetic oligonucleotide
  Target: ATXN1; (+) strand; PAM type: NRG; PAM sequence: AAG
gatgcggggttgggggctgt

SEQ ID NO: 139543 - DNA, 20 bp, Artificial Sequence
  Description of Artificial Sequence: Synthetic oligonucleotide
  Target: ATXN1; (+) strand; PAM type: NRG; PAM sequence: AGG
atgcggggttgggggctgta

SEQ ID NO: 139544 - DNA, 20 bp, Artificial Sequence
  Description of Artificial Sequence: Synthetic oligonucleotide
  Target: ATXN1; (+) strand; PAM type: NRG; PAM sequence: GGG
tgcggggttgggggctgtaa

SEQ ID NO: 139545 - DNA, 20 bp, Artificial Sequence
  Description of Artificial Sequence: Synthetic oligonucleotide
  Target: ATXN1; (+) strand; PAM type: NRG; PAM sequence: AAG
gctgtaagggtctcgctgtc

SEQ ID NO: 139546 - DNA, 20 bp, Artificial Sequence
  Description of Artificial Sequence: Synthetic oligonucleotide
  Target: ATXN1; (+) strand; PAM type: NRG; PAM sequence: TGG
agggtctcgctgtcaagatg

SEQ ID NO: 139547 - DNA, 20 bp, Artificial Sequence
  Description of Artificial Sequence: Synthetic oligonucleotide
  Target: ATXN1; (+) strand; PAM type: NRG; PAM sequence: CAG
ctgtcaagatgtggccccac

SEQ ID NO: 139548 - DNA, 20 bp, Artificial Sequence
  Description of Artificial Sequence: Synthetic oligonucleotide
  Target: ATXN1; (+) strand; PAM type: NRG; PAM sequence: AAG
gatgtggccccaccagtgct

SEQ ID NO: 139549 - DNA, 20 bp, Artificial Sequence
  Description of Artificial Sequence: Synthetic oligonucleotide
  Target: ATXN1; (+) strand; PAM type: NRG; PAM sequence: TAG
ccccaccagtgctaagttta

SEQ ID NO: 139550 - DNA, 20 bp, Artificial Sequence
  Description of Artificial Sequence: Synthetic oligonucleotide
  Target: ATXN1; (+) strand; PAM type: NRG; PAM sequence: AAG
ctaagtttatagtgctccaa

SEQ ID NO: 139551 - DNA, 20 bp, Artificial Sequence
  Description of Artificial Sequence: Synthetic oligonucleotide
  Target: ATXN1; (+) strand; PAM type: NRG; PAM sequence: CAG
gtttatagtgctccaaaagc

SEQ ID NO: 139552 - DNA, 20 bp, Artificial Sequence
  Description of Artificial Sequence: Synthetic oligonucleotide
  Target: ATXN1; (+) strand; PAM type: NRG; PAM sequence: AGG
tttatagtgctccaaaagcc

SEQ ID NO: 139553 - DNA, 20 bp, Artificial Sequence
  Description of Artificial Sequence: Synthetic oligonucleotide
  Target: ATXN1; (+) strand; PAM type: NRG; PAM sequence: GAG
tatagtgctccaaaagccag

SEQ ID NO: 139554 - DNA, 20 bp, Artificial Sequence
  Description of Artificial Sequence: Synthetic oligonucleotide
  Target: ATXN1; (+) strand; PAM type: NRG; PAM sequence: AGG
atagtgctccaaaagccagg

SEQ ID NO: 139555 - DNA, 20 bp, Artificial Sequence
  Description of Artificial Sequence: Synthetic oligonucleotide
  Target: ATXN1; (+) strand; PAM type: NRG; PAM sequence: GGG
tagtgctccaaaagccagga

SEQ ID NO: 139556 - DNA, 20 bp, Artificial Sequence
  Description of Artificial Sequence: Synthetic oligonucleotide
  Target: ATXN1; (+) strand; PAM type: NRG; PAM sequence: GGG
agtgctccaaaagccaggag

SEQ ID NO: 139557 - DNA, 20 bp, Artificial Sequence
  Description of Artificial Sequence: Synthetic oligonucleotide
  Target: ATXN1; (+) strand; PAM type: NRG; PAM sequence: GGG
gtgctccaaaagccaggagg

SEQ ID NO: 139558 - DNA, 20 bp, Artificial Sequence
  Description of Artificial Sequence: Synthetic oligonucleotide
  Target: ATXN1; (+) strand; PAM type: NRG; PAM sequence: GGG
tgctccaaaagccaggaggg

SEQ ID NO: 139559 - DNA, 20 bp, Artificial Sequence
  Description of Artificial Sequence: Synthetic oligonucleotide
  Target: ATXN1; (+) strand; PAM type: NRG; PAM sequence: AAG
caaaagccaggaggggggtt

SEQ ID NO: 139560 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaatgcaaaaaac

SEQ ID NO: 139561 - DNA, 20 bp, Artificial Sequence
  Description of Artificial Sequence: Synthetic oligonucleotide
  Target: ATXN1; (+) strand; PAM type: NRG; PAM sequence: CAG
gccacaaacatgaacctcta

SEQ ID NO: 139562 - DNA, 20 bp, Artificial Sequence
  Description of Artificial Sequence: Synthetic oligonucleotide
  Target: ATXN1; (+) strand; PAM type: NRG; PAM sequence: TAG
acatgaacctctacagaacc

SEQ ID NO: 139563 - DNA, 20 bp, Artificial Sequence
  Description of Artificial Sequence: Synthetic oligonucleotide
  Target: ATXN1; (+) strand; PAM type: NRG; PAM sequence: TGG
gaacctagaaaatgtgaaat

SEQ ID NO: 139564 - DNA, 20 bp, Artificial Sequence
  Description of Artificial Sequence: Synthetic oligonucleotide
  Target: ATXN1; (+) strand; PAM type: NRG; PAM sequence: GGG
aacctagaaaatgtgaaatt

SEQ ID NO: 139565 - DNA, 20 bp, Artificial Sequence
  Description of Artificial Sequence: Synthetic oligonucleotide
  Target: ATXN1; (+) strand; PAM type: NRG; PAM sequence: CAG
tagaaaatgtgaaattgggc

SEQ ID NO: 139566 - DNA, 20 bp, Artificial Sequence
  Description of Artificial Sequence: Synthetic oligonucleotide
  Target: ATXN1; (+) strand; PAM type: NRG; PAM sequence: AGG
agaaaatgtgaaattgggcc

SEQ ID NO: 139567 - DNA, 20 bp, Artificial Sequence
  Description of Artificial Sequence: Synthetic oligonucleotide
  Target: ATXN1; (+) strand; PAM type: NRG; PAM sequence: TAG
ttgggccaggctcacatctg

SEQ ID NO: 139568 - DNA, 20 bp, Artificial Sequence
  Description of Artificial Sequence: Synthetic oligonucleotide
  Target: ATXN1; (+) strand; PAM type: NRG; PAM sequence: CAG
caggctcacatctgtagtcc

SEQ ID NO: 139569 - DNA, 20 bp, Artificial Sequence
  Description of Artificial Sequence: Synthetic oligonucleotide
  Target: ATXN1; (+) strand; PAM type: NRG; PAM sequence: TAG
catctgtagtcccagcactt

SEQ ID NO: 139570 - DNA, 20 bp, Artificial Sequence
  Description of Artificial Sequence: Synthetic oligonucleotide
  Target: ATXN1; (+) strand; PAM type: NRG; PAM sequence: AGG
atctgtagtcccagcacttt

SEQ ID NO: 139571 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagcactttag

SEQ ID NO: 139572 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagcactttagg

SEQ ID NO: 139573 - DNA, 20 bp, Artificial Sequence
  Description of Artificial Sequence: Synthetic oligonucleotide
  Target: ATXN1; (+) strand; PAM type: NRG; PAM sequence: CAG
agtcccagcactttaggagg

SEQ ID NO: 139574 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttaggaggca

SEQ ID NO: 139575 - DNA, 20 bp, Artificial Sequence
  Description of Artificial Sequence: Synthetic oligonucleotide
  Target: ATXN1; (+) strand; PAM type: NRG; PAM sequence: AGG
cccagcactttaggaggcag

SEQ ID NO: 139576 - DNA, 20 bp, Artificial Sequence
  Description of Artificial Sequence: Synthetic oligonucleotide
  Target: ATXN1; (+) strand; PAM type: NRG; PAM sequence: TGG
ctttaggaggcagaggtgaa

SEQ ID NO: 139577 - DNA, 20 bp, Artificial Sequence
  Description of Artificial Sequence: Synthetic oligonucleotide
  Target: ATXN1; (+) strand; PAM type: NRG; PAM sequence: GAG
cagaggtgaatggatcacct

SEQ ID NO: 139578 - DNA, 20 bp, Artificial Sequence
  Description of Artificial Sequence: Synthetic oligonucleotide
  Target: ATXN1; (+) strand; PAM type: NRG; PAM sequence: AGG
agaggtgaatggatcacctg

SEQ ID NO: 139579 - DNA, 20 bp, Artificial Sequence
  Description of Artificial Sequence: Synthetic oligonucleotide
  Target: ATXN1; (+) strand; PAM type: NRG; PAM sequence: TGG
tgaatggatcacctgaggtc

SEQ ID NO: 139580 - DNA, 20 bp, Artificial Sequence
  Description of Artificial Sequence: Synthetic oligonucleotide
  Target: ATXN1; (+) strand; PAM type: NRG; PAM sequence: GAG
aatggatcacctgaggtctg

SEQ ID NO: 139581 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtctggagttc

SEQ ID NO: 139582 - DNA, 20 bp, Artificial Sequence
  Description of Artificial Sequence: Synthetic oligonucleotide
  Target: ATXN1; (+) strand; PAM type: NRG; PAM sequence: TAG
tactaataacacaaaaaaat

SEQ ID NO: 139583 - DNA, 20 bp, Artificial Sequence
  Description of Artificial Sequence: Synthetic oligonucleotide
  Target: ATXN1; (+) strand; PAM type: NRG; PAM sequence: CGG
aataacacaaaaaaattagc

SEQ ID NO: 139584 - DNA, 20 bp, Artificial Sequence
  Description of Artificial Sequence: Synthetic oligonucleotide
  Target: ATXN1; (+) strand; PAM type: NRG; PAM sequence: GGG
ataacacaaaaaaattagcc

SEQ ID NO: 139585 - DNA, 20 bp, Artificial Sequence
  Description of Artificial Sequence: Synthetic oligonucleotide
  Target: ATXN1; (+) strand; PAM type: NRG; PAM sequence: TGG
acaaaaaaattagccgggtg

SEQ ID NO: 139586 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccgggtgtgg

SEQ ID NO: 139587 - DNA, 20 bp, Artificial Sequence
  Description of Artificial Sequence: Synthetic oligonucleotide
  Target: ATXN1; (+) strand; PAM type: NRG; PAM sequence: CAG
gtggcatgcgcctgtaatcc

SEQ ID NO: 139588 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagctact

SEQ ID NO: 139589 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagctactt

SEQ ID NO: 139590 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctacttgg

SEQ ID NO: 139591 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctacttggg

SEQ ID NO: 139592 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 139593 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgaga

SEQ ID NO: 139594 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggctgagac

SEQ ID NO: 139595 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctgagacag

SEQ ID NO: 139596 - DNA, 20 bp, Artificial Sequence
  Description of Artificial Sequence: Synthetic oligonucleotide
  Target: ATXN1; (+) strand; PAM type: NRG; PAM sequence: TGG
acaggagaatcgcttgaacc

SEQ ID NO: 139597 - DNA, 20 bp, Artificial Sequence
  Description of Artificial Sequence: Synthetic oligonucleotide
  Target: ATXN1; (+) strand; PAM type: NRG; PAM sequence: GGG
caggagaatcgcttgaacct

SEQ ID NO: 139598 - DNA, 20 bp, Artificial Sequence
  Description of Artificial Sequence: Synthetic oligonucleotide
  Target: ATXN1; (+) strand; PAM type: NRG; PAM sequence: GAG
ggagaatcgcttgaacctgg

SEQ ID NO: 139599 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacctggg

SEQ ID NO: 139600 - DNA, 20 bp, Artificial Sequence
  Description of Artificial Sequence: Synthetic oligonucleotide
  Target: ATXN1; (+) strand; PAM type: NRG; PAM sequence: TGG
aatcgcttgaacctgggagg

SEQ ID NO: 139601 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacctgggaggtg

SEQ ID NO: 139602 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacctgggaggtgg

SEQ ID NO: 139603 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggtggaggttg

SEQ ID NO: 139604 - DNA, 20 bp, Artificial Sequence
  Description of Artificial Sequence: Synthetic oligonucleotide
  Target: ATXN1; (+) strand; PAM type: NRG; PAM sequence: GAG
tgggaggtggaggttgcagt

SEQ ID NO: 139605 - DNA, 20 bp, Artificial Sequence
  Description of Artificial Sequence: Synthetic oligonucleotide
  Target: ATXN1; (+) strand; PAM type: NRG; PAM sequence: AAG
ggtggaggttgcagtgagcc

SEQ ID NO: 139606 - DNA, 20 bp, Artificial Sequence
  Description of Artificial Sequence: Synthetic oligonucleotide
  Target: ATXN1; (+) strand; PAM type: NRG; PAM sequence: TAG
aagatcacgtcattgctctc

SEQ ID NO: 139607 - DNA, 20 bp, Artificial Sequence
  Description of Artificial Sequence: Synthetic oligonucleotide
  Target: ATXN1; (+) strand; PAM type: NRG; PAM sequence: TGG
cacgtcattgctctctagcc

SEQ ID NO: 139608 - DNA, 20 bp, Artificial Sequence
  Description of Artificial Sequence: Synthetic oligonucleotide
  Target: ATXN1; (+) strand; PAM type: NRG; PAM sequence: GGG
acgtcattgctctctagcct

SEQ ID NO: 139609 - DNA, 20 bp, Artificial Sequence
  Description of Artificial Sequence: Synthetic oligonucleotide
  Target: ATXN1; (+) strand; PAM type: NRG; PAM sequence: AAG
tgctctctagcctgggcaac

SEQ ID NO: 139610 - DNA, 20 bp, Artificial Sequence
  Description of Artificial Sequence: Synthetic oligonucleotide
  Target: ATXN1; (+) strand; PAM type: NRG; PAM sequence: GAG
ctctctagcctgggcaacaa

SEQ ID NO: 139611 - DNA, 20 bp, Artificial Sequence
  Description of Artificial Sequence: Synthetic oligonucleotide
  Target: ATXN1; (+) strand; PAM type: NRG; PAM sequence: AAG
tccgcctcaaaaaaaaaaaa

SEQ ID NO: 139612 - DNA, 20 bp, Artificial Sequence
  Description of Artificial Sequence: Synthetic oligonucleotide
  Target: ATXN1; (+) strand; PAM type: NRG; PAM sequence: AAG
ctcaaaaaaaaaaaaaagaa

SEQ ID NO: 139613 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaagaaaaga

SEQ ID NO: 139614 - DNA, 20 bp, Artificial Sequence
  Description of Artificial Sequence: Synthetic oligonucleotide
  Target: ATXN1; (+) strand; PAM type: NRG; PAM sequence: AAG
aatgaaaatgtgaaattgtt

SEQ ID NO: 139615 - DNA, 20 bp, Artificial Sequence
  Description of Artificial Sequence: Synthetic oligonucleotide
  Target: ATXN1; (+) strand; PAM type: NRG; PAM sequence: TGG
gtgaaattgttaagacaatt

SEQ ID NO: 139616 - DNA, 20 bp, Artificial Sequence
  Description of Artificial Sequence: Synthetic oligonucleotide
  Target: ATXN1; (+) strand; PAM type: NRG; PAM sequence: GAG
gaaattgttaagacaatttg

SEQ ID NO: 139617 - DNA, 20 bp, Artificial Sequence
  Description of Artificial Sequence: Synthetic oligonucleotide
  Target: ATXN1; (+) strand; PAM type: NRG; PAM sequence: AAG
gttaagacaatttggagttt

SEQ ID NO: 139618 - DNA, 20 bp, Artificial Sequence
  Description of Artificial Sequence: Synthetic oligonucleotide
  Target: ATXN1; (+) strand; PAM type: NRG; PAM sequence: AGG
ttaagacaatttggagttta

SEQ ID NO: 139619 - DNA, 20 bp, Artificial Sequence
  Description of Artificial Sequence: Synthetic oligonucleotide
  Target: ATXN1; (+) strand; PAM type: NRG; PAM sequence: GGG
taagacaatttggagtttaa

SEQ ID NO: 139620 - DNA, 20 bp, Artificial Sequence
  Description of Artificial Sequence: Synthetic oligonucleotide
  Target: ATXN1; (+) strand; PAM type: NRG; PAM sequence: AAG
caatttggagtttaagggaa

SEQ ID NO: 139621 - DNA, 20 bp, Artificial Sequence
  Description of Artificial Sequence: Synthetic oligonucleotide
  Target: ATXN1; (+) strand; PAM type: NRG; PAM sequence: AAG
agggaaaagcacatttttga

SEQ ID NO: 139622 - DNA, 20 bp, Artificial Sequence
  Description of Artificial Sequence: Synthetic oligonucleotide
  Target: ATXN1; (+) strand; PAM type: NRG; PAM sequence: TGG
gaaaagcacatttttgaaag

SEQ ID NO: 139623 - DNA, 20 bp, Artificial Sequence
  Description of Artificial Sequence: Synthetic oligonucleotide
  Target: ATXN1; (+) strand; PAM type: NRG; PAM sequence: TAG
acatttttgaaagtggaaaa

SEQ ID NO: 139624 - DNA, 20 bp, Artificial Sequence
  Description of Artificial Sequence: Synthetic oligonucleotide
  Target: ATXN1; (+) strand; PAM type: NRG; PAM sequence: GAG
tttgaaagtggaaaatagat

SEQ ID NO: 139625 - DNA, 20 bp, Artificial Sequence
  Description of Artificial Sequence: Synthetic oligonucleotide
  Target: ATXN1; (+) strand; PAM type: NRG; PAM sequence: CAG
acatttgctacgcattgtta

SEQ ID NO: 139626 - DNA, 20 bp, Artificial Sequence
  Description of Artificial Sequence: Synthetic oligonucleotide
  Target: ATXN1; (+) strand; PAM type: NRG; PAM sequence: TGG
tacagtctgttattgatata

SEQ ID NO: 139627 - DNA, 20 bp, Artificial Sequence
  Description of Artificial Sequence: Synthetic oligonucleotide
  Target: ATXN1; (+) strand; PAM type: NRG; PAM sequence: AAG
tatatggtcattttgttata

SEQ ID NO: 139628 - DNA, 20 bp, Artificial Sequence
  Description of Artificial Sequence: Synthetic oligonucleotide
  Target: ATXN1; (+) strand; PAM type: NRG; PAM sequence: AAG
tgttataaagaaacatttaa

SEQ ID NO: 139629 - DNA, 20 bp, Artificial Sequence
  Description of Artificial Sequence: Synthetic oligonucleotide
  Target: ATXN1; (+) strand; PAM type: NRG; PAM sequence: AGG
gttataaagaaacatttaaa

SEQ ID NO: 139630 - DNA, 20 bp, Artificial Sequence
  Description of Artificial Sequence: Synthetic oligonucleotide
  Target: ATXN1; (+) strand; PAM type: NRG; PAM sequence: GAG
tataaagaaacatttaaaag

SEQ ID NO: 139631 - DNA, 20 bp, Artificial Sequence
  Description of Artificial Sequence: Synthetic oligonucleotide
  Target: ATXN1; (+) strand; PAM type: NRG; PAM sequence: AGG
ataaagaaacatttaaaagg

SEQ ID NO: 139632 - DNA, 20 bp, Artificial Sequence
  Description of Artificial Sequence: Synthetic oligonucleotide
  Target: ATXN1; (+) strand; PAM type: NRG; PAM sequence: AAG
tgttaacttgtttacttcat

SEQ ID NO: 139633 - DNA, 20 bp, Artificial Sequence
  Description of Artificial Sequence: Synthetic oligonucleotide
  Target: ATXN1; (+) strand; PAM type: NRG; PAM sequence: TGG
acttcataagattctcttgt

SEQ ID NO: 139634 - DNA, 20 bp, Artificial Sequence
  Description of Artificial Sequence: Synthetic oligonucleotide
  Target: ATXN1; (+) strand; PAM type: NRG; PAM sequence: GGG
cttcataagattctcttgtt

SEQ ID NO: 139635 - DNA, 20 bp, Artificial Sequence
  Description of Artificial Sequence: Synthetic oligonucleotide
  Target: ATXN1; (+) strand; PAM type: NRG; PAM sequence: TAG
cataagattctcttgttggg

SEQ ID NO: 139636 - DNA, 20 bp, Artificial Sequence
  Description of Artificial Sequence: Synthetic oligonucleotide
  Target: ATXN1; (+) strand; PAM type: NRG; PAM sequence: CAG
tctcttgttgggtagattta

SEQ ID NO: 139637 - DNA, 20 bp, Artificial Sequence
  Description of Artificial Sequence: Synthetic oligonucleotide
  Target: ATXN1; (+) strand; PAM type: NRG; PAM sequence: AAG
ttgggtagatttacagattt

SEQ ID NO: 139638 - DNA, 20 bp, Artificial Sequence
  Description of Artificial Sequence: Synthetic oligonucleotide
  Target: ATXN1; (+) strand; PAM type: NRG; PAM sequence: AGG
tgggtagatttacagattta

SEQ ID NO: 139639 - DNA, 20 bp, Artificial Sequence
  Description of Artificial Sequence: Synthetic oligonucleotide
  Target: ATXN1; (+) strand; PAM type: NRG; PAM sequence: AAG
gccataaatcttttcaaaac

SEQ ID NO: 139640 - DNA, 20 bp, Artificial Sequence
  Description of Artificial Sequence: Synthetic oligonucleotide
  Target: ATXN1; (+) strand; PAM type: NRG; PAM sequence: AGG
ccataaatcttttcaaaaca

SEQ ID NO: 139641 - DNA, 20 bp, Artificial Sequence
  Description of Artificial Sequence: Synthetic oligonucleotide
  Target: ATXN1; (+) strand; PAM type: NRG; PAM sequence: AAG
taaatcttttcaaaacaagg

SEQ ID NO: 139642 - DNA, 20 bp, Artificial Sequence
  Description of Artificial Sequence: Synthetic oligonucleotide
  Target: ATXN1; (+) strand; PAM type: NRG; PAM sequence: AAG
aaacaaggaagattataaac

SEQ ID NO: 139643 - DNA, 20 bp, Artificial Sequence
  Description of Artificial Sequence: Synthetic oligonucleotide
  Target: ATXN1; (+) strand; PAM type: NRG; PAM sequence: AGG
aacaaggaagattataaaca

SEQ ID NO: 139644 - DNA, 20 bp, Artificial Sequence
  Description of Artificial Sequence: Synthetic oligonucleotide
  Target: ATXN1; (+) strand; PAM type: NRG; PAM sequence: CGG
aattaattatttaattaatt

SEQ ID NO: 139645 - DNA, 20 bp, Artificial Sequence
  Description of Artificial Sequence: Synthetic oligonucleotide
  Target: ATXN1; (+) strand; PAM type: NRG; PAM sequence: AAG
atttaattaattcggcaaac

SEQ ID NO: 139646 - DNA, 20 bp, Artificial Sequence
  Description of Artificial Sequence: Synthetic oligonucleotide
  Target: ATXN1; (+) strand; PAM type: NRG; PAM sequence: AAG
caaacaagtcacccattgac

SEQ ID NO: 139647 - DNA, 20 bp, Artificial Sequence
  Description of Artificial Sequence: Synthetic oligonucleotide
  Target: ATXN1; (+) strand; PAM type: NRG; PAM sequence: TAG
aagtcacccattgacaagcc

SEQ ID NO: 139648 - DNA, 20 bp, Artificial Sequence
  Description of Artificial Sequence: Synthetic oligonucleotide
  Target: ATXN1; (+) strand; PAM type: NRG; PAM sequence: CAG
ccacccaatgtttgttttat

SEQ ID NO: 139649 - DNA, 20 bp, Artificial Sequence
  Description of Artificial Sequence: Synthetic oligonucleotide
  Target: ATXN1; (+) strand; PAM type: NRG; PAM sequence: CAG
gttttatcagttttcttttc

SEQ ID NO: 139650 - DNA, 20 bp, Artificial Sequence
  Description of Artificial Sequence: Synthetic oligonucleotide
  Target: ATXN1; (+) strand; PAM type: NRG; PAM sequence: TGG
tcagttttcttttccagttt

SEQ ID NO: 139651 - DNA, 20 bp, Artificial Sequence
  Description of Artificial Sequence: Synthetic oligonucleotide
  Target: ATXN1; (+) strand; PAM type: NRG; PAM sequence: AAG
gttttcttttccagttttgg

SEQ ID NO: 139652 - DNA, 20 bp, Artificial Sequence
  Description of Artificial Sequence: Synthetic oligonucleotide
  Target: ATXN1; (+) strand; PAM type: NRG; PAM sequence: AGG
ttttcttttccagttttgga

SEQ ID NO: 139653 - DNA, 20 bp, Artificial Sequence
  Description of Artificial Sequence: Synthetic oligonucleotide
  Target: ATXN1; (+) strand; PAM type: NRG; PAM sequence: GGG
tttcttttccagttttggaa

SEQ ID NO: 139654 - DNA, 20 bp, Artificial Sequence
  Description of Artificial Sequence: Synthetic oligonucleotide
  Target: ATXN1; (+) strand; PAM type: NRG; PAM sequence: AAG
ttttccagttttggaaggga

SEQ ID NO: 139655 - DNA, 20 bp, Artificial Sequence
  Description of Artificial Sequence: Synthetic oligonucleotide
  Target: ATXN1; (+) strand; PAM type: NRG; PAM sequence: GAG
catgaccacacgacccatat

SEQ ID NO: 139656 - DNA, 20 bp, Artificial Sequence
  Description of Artificial Sequence: Synthetic oligonucleotide
  Target: ATXN1; (+) strand; PAM type: NRG; PAM sequence: AAG
tcattgtaatgtttttcccc

SEQ ID NO: 139657 - DNA, 20 bp, Artificial Sequence
  Description of Artificial Sequence: Synthetic oligonucleotide
  Target: ATXN1; (+) strand; PAM type: NRG; PAM sequence: CAG
tccccaagcacccacaattc

SEQ ID NO: 139658 - DNA, 20 bp, Artificial Sequence
  Description of Artificial Sequence: Synthetic oligonucleotide
  Target: ATXN1; (+) strand; PAM type: NRG; PAM sequence: AGG
ccccaagcacccacaattcc

SEQ ID NO: 139659 - DNA, 20 bp, Artificial Sequence
  Description of Artificial Sequence: Synthetic oligonucleotide
  Target: ATXN1; (+) strand; PAM type: NRG; PAM sequence: CAG
aggtcctcccaatttgcttc

SEQ ID NO: 139660 - DNA, 20 bp, Artificial Sequence
  Description of Artificial Sequence: Synthetic oligonucleotide
  Target: ATXN1; (+) strand; PAM type: NRG; PAM sequence: AAG
tttgcttccagttcttgccc

SEQ ID NO: 139661 - DNA, 20 bp, Artificial Sequence
  Description of Artificial Sequence: Synthetic oligonucleotide
  Target: ATXN1; (+) strand; PAM type: NRG; PAM sequence: CAG
taaccaatgcctactatctg

SEQ ID NO: 139662 - DNA, 20 bp, Artificial Sequence
  Description of Artificial Sequence: Synthetic oligonucleotide
  Target: ATXN1; (+) strand; PAM type: NRG; PAM sequence: AAG
gcctactatctgcagcctca

SEQ ID NO: 139663 - DNA, 20 bp, Artificial Sequence
  Description of Artificial Sequence: Synthetic oligonucleotide
  Target: ATXN1; (+) strand; PAM type: NRG; PAM sequence: AGG
cctactatctgcagcctcaa

SEQ ID NO: 139664 - DNA, 20 bp, Artificial Sequence
  Description of Artificial Sequence: Synthetic oligonucleotide
  Target: ATXN1; (+) strand; PAM type: NRG; PAM sequence: GGG
ctactatctgcagcctcaaa

SEQ ID NO: 139665 - DNA, 20 bp, Artificial Sequence
  Description of Artificial Sequence: Synthetic oligonucleotide
  Target: ATXN1; (+) strand; PAM type: NRG; PAM sequence: GAG
actatctgcagcctcaaagg

SEQ ID NO: 139666 - DNA, 20 bp, Artificial Sequence
  Description of Artificial Sequence: Synthetic oligonucleotide
  Target: ATXN1; (+) strand; PAM type: NRG; PAM sequence: GAG
ctgcagcctcaaagggagct

SEQ ID NO: 139667 - DNA, 20 bp, Artificial Sequence
  Description of Artificial Sequence: Synthetic oligonucleotide
  Target: ATXN1; (+) strand; PAM type: NRG; PAM sequence: CAG
gggagctgagtacttgccaa

SEQ ID NO: 139668 - DNA, 20 bp, Artificial Sequence
  Description of Artificial Sequence: Synthetic oligonucleotide
  Target: ATXN1; (+) strand; PAM type: NRG; PAM sequence: GAG
caccgccacctcccctccct

SEQ ID NO: 139669 - DNA, 20 bp, Artificial Sequence
  Description of Artificial Sequence: Synthetic oligonucleotide
  Target: ATXN1; (+) strand; PAM type: NRG; PAM sequence: AGG
accgccacctcccctccctg

SEQ ID NO: 139670 - DNA, 20 bp, Artificial Sequence
  Description of Artificial Sequence: Synthetic oligonucleotide
  Target: ATXN1; (+) strand; PAM type: NRG; PAM sequence: GAG
ccctgaggttcctgccttgc

SEQ ID NO: 139671 - DNA, 20 bp, Artificial Sequence
  Description of Artificial Sequence: Synthetic oligonucleotide
  Target: ATXN1; (+) strand; PAM type: NRG; PAM sequence: GAG
ctgaggttcctgccttgcga

SEQ ID NO: 139672 - DNA, 20 bp, Artificial Sequence
  Description of Artificial Sequence: Synthetic oligonucleotide
  Target: ATXN1; (+) strand; PAM type: NRG; PAM sequence: TGG
ccttgcgagagtgtgtcatg

SEQ ID NO: 139673 - DNA, 20 bp, Artificial Sequence
  Description of Artificial Sequence: Synthetic oligonucleotide
  Target: ATXN1; (+) strand; PAM type: NRG; PAM sequence: CAG
agagtgtgtcatgtggctgc

SEQ ID NO: 139674 - DNA, 20 bp, Artificial Sequence
  Description of Artificial Sequence: Synthetic oligonucleotide
  Target: ATXN1; (+) strand; PAM type: NRG; PAM sequence: AGG
gagtgtgtcatgtggctgcc

SEQ ID NO: 139675 - DNA, 20 bp, Artificial Sequence
  Description of Artificial Sequence: Synthetic oligonucleotide
  Target: ATXN1; (+) strand; PAM type: NRG; PAM sequence: GGG
agtgtgtcatgtggctgcca

SEQ ID NO: 139676 - DNA, 20 bp, Artificial Sequence
  Description of Artificial Sequence: Synthetic oligonucleotide
  Target: ATXN1; (+) strand; PAM type: NRG; PAM sequence: AAG
tgtcatgtggctgccagggc

SEQ ID NO: 139677 - DNA, 20 bp, Artificial Sequence
  Description of Artificial Sequence: Synthetic oligonucleotide
  Target: ATXN1; (+) strand; PAM type: NRG; PAM sequence: AGG
gtcatgtggctgccagggca

SEQ ID NO: 139678 - DNA, 20 bp, Artificial Sequence
  Description of Artificial Sequence: Synthetic oligonucleotide
  Target: ATXN1; (+) strand; PAM type: NRG; PAM sequence: CAG
atgtggctgccagggcaagg

SEQ ID NO: 139679 - DNA, 20 bp, Artificial Sequence
  Description of Artificial Sequence: Synthetic oligonucleotide
  Target: ATXN1; (+) strand; PAM type: NRG; PAM sequence: AAG
tggctgccagggcaaggcag

SEQ ID NO: 139680 - DNA, 20 bp, Artificial Sequence
  Description of Artificial Sequence: Synthetic oligonucleotide
  Target: ATXN1; (+) strand; PAM type: NRG; PAM sequence: TAG
gccagggcaaggcagaagtg

SEQ ID NO: 139681 - DNA, 20 bp, Artificial Sequence
  Description of Artificial Sequence: Synthetic oligonucleotide
  Target: ATXN1; (+) strand; PAM type: NRG; PAM sequence: AGG
ccagggcaaggcagaagtgt

SEQ ID NO: 139682 - DNA, 20 bp, Artificial Sequence
  Description of Artificial Sequence: Synthetic oligonucleotide
  Target: ATXN1; (+) strand; PAM type: NRG; PAM sequence: AAG
gcaaggcagaagtgtaggaa

SEQ ID NO: 139683 - DNA, 20 bp, Artificial Sequence
  Description of Artificial Sequence: Synthetic oligonucleotide
  Target: ATXN1; (+) strand; PAM type: NRG; PAM sequence: AGG
caaggcagaagtgtaggaaa

SEQ ID NO: 139684 - DNA, 20 bp, Artificial Sequence
  Description of Artificial Sequence: Synthetic oligonucleotide
  Target: ATXN1; (+) strand; PAM type: NRG; PAM sequence: CAG
gtaggaaaaggcacatctca

SEQ ID NO: 139685 - DNA, 20 bp, Artificial Sequence
  Description of Artificial Sequence: Synthetic oligonucleotide
  Target: ATXN1; (+) strand; PAM type: NRG; PAM sequence: AGG
taggaaaaggcacatctcac

SEQ ID NO: 139686 - DNA, 20 bp, Artificial Sequence
  Description of Artificial Sequence: Synthetic oligonucleotide
  Target: ATXN1; (+) strand; PAM type: NRG; PAM sequence: CAG
ggcacatctcacaggttgtc

SEQ ID NO: 139687 - DNA, 20 bp, Artificial Sequence
  Description of Artificial Sequence: Synthetic oligonucleotide
  Target: ATXN1; (+) strand; PAM type: NRG; PAM sequence: AGG
gcacatctcacaggttgtcc

SEQ ID NO: 139688 - DNA, 20 bp, Artificial Sequence
  Description of Artificial Sequence: Synthetic oligonucleotide
  Target: ATXN1; (+) strand; PAM type: NRG; PAM sequence: GAG
acatctcacaggttgtccag

SEQ ID NO: 139689 - DNA, 20 bp, Artificial Sequence
  Description of Artificial Sequence: Synthetic oligonucleotide
  Target: ATXN1; (+) strand; PAM type: NRG; PAM sequence: AGG
catctcacaggttgtccagg

SEQ ID NO: 139690 - DNA, 20 bp, Artificial Sequence
  Description of Artificial Sequence: Synthetic oligonucleotide
  Target: ATXN1; (+) strand; PAM type: NRG; PAM sequence: TAG
cacaggttgtccaggaggat

SEQ ID NO: 139691 - DNA, 20 bp, Artificial Sequence
  Description of Artificial Sequence: Synthetic oligonucleotide
  Target: ATXN1; (+) strand; PAM type: NRG; PAM sequence: GAG
caggttgtccaggaggatta

SEQ ID NO: 139692 - DNA, 20 bp, Artificial Sequence
  Description of Artificial Sequence: Synthetic oligonucleotide
  Target: ATXN1; (+) strand; PAM type: NRG; PAM sequence: CAG
aggattagagcaaatatgtc

SEQ ID NO: 139693 - DNA, 20 bp, Artificial Sequence
  Description of Artificial Sequence: Synthetic oligonucleotide
  Target: ATXN1; (+) strand; PAM type: NRG; PAM sequence: GAG
gattagagcaaatatgtcca

SEQ ID NO: 139694 - DNA, 20 bp, Artificial Sequence
  Description of Artificial Sequence: Synthetic oligonucleotide
  Target: ATXN1; (+) strand; PAM type: NRG; PAM sequence: CAG
tagagcaaatatgtccagag

SEQ ID NO: 139695 - DNA, 20 bp, Artificial Sequence
  Description of Artificial Sequence: Synthetic oligonucleotide
  Target: ATXN1; (+) strand; PAM type: NRG; PAM sequence: AAG
aatatgtccagagcagtttc

SEQ ID NO: 139696 - DNA, 20 bp, Artificial Sequence
  Description of Artificial Sequence: Synthetic oligonucleotide
  Target: ATXN1; (+) strand; PAM type: NRG; PAM sequence: TAG
gagcagtttcaagttgacta

SEQ ID NO: 139697 - DNA, 20 bp, Artificial Sequence
  Description of Artificial Sequence: Synthetic oligonucleotide
  Target: ATXN1; (+) strand; PAM type: NRG; PAM sequence: AAG
ttcaagttgactatagaacc

SEQ ID NO: 139698 - DNA, 20 bp, Artificial Sequence
  Description of Artificial Sequence: Synthetic oligonucleotide
  Target: ATXN1; (+) strand; PAM type: NRG; PAM sequence: AGG
tcaagttgactatagaacca

SEQ ID NO: 139699 - DNA, 20 bp, Artificial Sequence
  Description of Artificial Sequence: Synthetic oligonucleotide
  Target: ATXN1; (+) strand; PAM type: NRG; PAM sequence: GAG
gactatagaaccaaggctcc

SEQ ID NO: 139700 - DNA, 20 bp, Artificial Sequence
  Description of Artificial Sequence: Synthetic oligonucleotide
  Target: ATXN1; (+) strand; PAM type: NRG; PAM sequence: TAG
caaggctccgagctaattaa

SEQ ID NO: 139701 - DNA, 20 bp, Artificial Sequence
  Description of Artificial Sequence: Synthetic oligonucleotide
  Target: ATXN1; (+) strand; PAM type: NRG; PAM sequence: AAG
gctccgagctaattaataga

SEQ ID NO: 139702 - DNA, 20 bp, Artificial Sequence
  Description of Artificial Sequence: Synthetic oligonucleotide
  Target: ATXN1; (+) strand; PAM type: NRG; PAM sequence: AAG
gagctaattaatagaaagtg

SEQ ID NO: 139703 - DNA, 20 bp, Artificial Sequence
  Description of Artificial Sequence: Synthetic oligonucleotide
  Target: ATXN1; (+) strand; PAM type: NRG; PAM sequence: TAG
aatagaaagtgaagcaatga

SEQ ID NO: 139704 - DNA, 20 bp, Artificial Sequence
  Description of Artificial Sequence: Synthetic oligonucleotide
  Target: ATXN1; (+) strand; PAM type: NRG; PAM sequence: CAG
aagtgaagcaatgatagtga

SEQ ID NO: 139705 - DNA, 20 bp, Artificial Sequence
  Description of Artificial Sequence: Synthetic oligonucleotide
  Target: ATXN1; (+) strand; PAM type: NRG; PAM sequence: AAG
agcaatgatagtgacagctc

SEQ ID NO: 139706 - DNA, 20 bp, Artificial Sequence
  Description of Artificial Sequence: Synthetic oligonucleotide
  Target: ATXN1; (+) strand; PAM type: NRG; PAM sequence: AGG
gcaatgatagtgacagctca

SEQ ID NO: 139707 - DNA, 20 bp, Artificial Sequence
  Description of Artificial Sequence: Synthetic oligonucleotide
  Target: ATXN1; (+) strand; PAM type: NRG; PAM sequence: AAG
tgatagtgacagctcaaggc

SEQ ID NO: 139708 - DNA, 20 bp, Artificial Sequence
  Description of Artificial Sequence: Synthetic oligonucleotide
  Target: ATXN1; (+) strand; PAM type: NRG; PAM sequence: AGG
gatagtgacagctcaaggca

SEQ ID NO: 139709 - DNA, 20 bp, Artificial Sequence
  Description of Artificial Sequence: Synthetic oligonucleotide
  Target: ATXN1; (+) strand; PAM type: NRG; PAM sequence: GGG
atagtgacagctcaaggcaa

SEQ ID NO: 139710 - DNA, 20 bp, Artificial Sequence
  Description of Artificial Sequence: Synthetic oligonucleotide
  Target: ATXN1; (+) strand; PAM type: NRG; PAM sequence: AAG
cagctcaaggcaagggtgtg

SEQ ID NO: 139711 - DNA, 20 bp, Artificial Sequence
  Description of Artificial Sequence: Synthetic oligonucleotide
  Target: ATXN1; (+) strand; PAM type: NRG; PAM sequence: CGG
ggtgtgaagctcatgtcatt

SEQ ID NO: 139712 - DNA, 20 bp, Artificial Sequence
  Description of Artificial Sequence: Synthetic oligonucleotide
  Target: ATXN1; (+) strand; PAM type: NRG; PAM sequence: AAG
gaagctcatgtcattcggta

SEQ ID NO: 139713 - DNA, 20 bp, Artificial Sequence
  Description of Artificial Sequence: Synthetic oligonucleotide
  Target: ATXN1; (+) strand; PAM type: NRG; PAM sequence: CAG
ctcatgtcattcggtaaaga

SEQ ID NO: 139714 - DNA, 20 bp, Artificial Sequence
  Description of Artificial Sequence: Synthetic oligonucleotide
  Target: ATXN1; (+) strand; PAM type: NRG; PAM sequence: AAG
tcattcggtaaagacagtcc

SEQ ID NO: 139715 - DNA, 20 bp, Artificial Sequence
  Description of Artificial Sequence: Synthetic oligonucleotide
  Target: ATXN1; (+) strand; PAM type: NRG; PAM sequence: AGG
cattcggtaaagacagtcca

SEQ ID NO: 139716 - DNA, 20 bp, Artificial Sequence
  Description of Artificial Sequence: Synthetic oligonucleotide
  Target: ATXN1; (+) strand; PAM type: NRG; PAM sequence: AAG
gtaaagacagtccaaggaaa

SEQ ID NO: 139717 - DNA, 20 bp, Artificial Sequence
  Description of Artificial Sequence: Synthetic oligonucleotide
  Target: ATXN1; (+) strand; PAM type: NRG; PAM sequence: AGG
taaagacagtccaaggaaaa

SEQ ID NO: 139718 - DNA, 20 bp, Artificial Sequence
  Description of Artificial Sequence: Synthetic oligonucleotide
  Target: ATXN1; (+) strand; PAM type: NRG; PAM sequence: CAG
cttgcaccttatttgctttg

SEQ ID NO: 139719 - DNA, 20 bp, Artificial Sequence
  Description of Artificial Sequence: Synthetic oligonucleotide
  Target: ATXN1; (+) strand; PAM type: NRG; PAM sequence: TAG
gcagactaacacatttctgt

SEQ ID NO: 139720 - DNA, 20 bp, Artificial Sequence
  Description of Artificial Sequence: Synthetic oligonucleotide
  Target: ATXN1; (+) strand; PAM type: NRG; PAM sequence: CAG
agaaatatgtctttacactc

SEQ ID NO: 139721 - DNA, 20 bp, Artificial Sequence
  Description of Artificial Sequence: Synthetic oligonucleotide
  Target: ATXN1; (+) strand; PAM type: NRG; PAM sequence: GAG
aaatatgtctttacactcca

SEQ ID NO: 139722 - DNA, 20 bp, Artificial Sequence
  Description of Artificial Sequence: Synthetic oligonucleotide
  Target: ATXN1; (+) strand; PAM type: NRG; PAM sequence: GAG
atatgtctttacactccaga

SEQ ID NO: 139723 - DNA, 20 bp, Artificial Sequence
  Description of Artificial Sequence: Synthetic oligonucleotide
  Target: ATXN1; (+) strand; PAM type: NRG; PAM sequence: AAG
acactccagagagatgttac

SEQ ID NO: 139724 - DNA, 20 bp, Artificial Sequence
  Description of Artificial Sequence: Synthetic oligonucleotide
  Target: ATXN1; (+) strand; PAM type: NRG; PAM sequence: AGG
cactccagagagatgttaca

SEQ ID NO: 139725 - DNA, 20 bp, Artificial Sequence
  Description of Artificial Sequence: Synthetic oligonucleotide
  Target: ATXN1; (+) strand; PAM type: NRG; PAM sequence: CGG
agagagatgttacaaggtgt

SEQ ID NO: 139726 - DNA, 20 bp, Artificial Sequence
  Description of Artificial Sequence: Synthetic oligonucleotide
  Target: ATXN1; (+) strand; PAM type: NRG; PAM sequence: CAG
tgtcggcctgctactaatta

SEQ ID NO: 139727 - DNA, 20 bp, Artificial Sequence
  Description of Artificial Sequence: Synthetic oligonucleotide
  Target: ATXN1; (+) strand; PAM type: NRG; PAM sequence: AAG
ggcctgctactaattacagc

SEQ ID NO: 139728 - DNA, 20 bp, Artificial Sequence
  Description of Artificial Sequence: Synthetic oligonucleotide
  Target: ATXN1; (+) strand; PAM type: NRG; PAM sequence: CAG
attacagcaagcccgcacta

SEQ ID NO: 139729 - DNA, 20 bp, Artificial Sequence
  Description of Artificial Sequence: Synthetic oligonucleotide
  Target: ATXN1; (+) strand; PAM type: NRG; PAM sequence: AAG
attacctacctgtcatatga

SEQ ID NO: 139730 - DNA, 20 bp, Artificial Sequence
  Description of Artificial Sequence: Synthetic oligonucleotide
  Target: ATXN1; (+) strand; PAM type: NRG; PAM sequence: AGG
ttacctacctgtcatatgaa

SEQ ID NO: 139731 - DNA, 20 bp, Artificial Sequence
  Description of Artificial Sequence: Synthetic oligonucleotide
  Target: ATXN1; (+) strand; PAM type: NRG; PAM sequence: CAG
tgaaaggctattcttcactc

SEQ ID NO: 139732 - DNA, 20 bp, Artificial Sequence
  Description of Artificial Sequence: Synthetic oligonucleotide
  Target: ATXN1; (+) strand; PAM type: NRG; PAM sequence: TAG
ctccagttgaacaaacctat

SEQ ID NO: 139733 - DNA, 20 bp, Artificial Sequence
  Description of Artificial Sequence: Synthetic oligonucleotide
  Target: ATXN1; (+) strand; PAM type: NRG; PAM sequence: TGG
gaacaaacctattagatgtc

SEQ ID NO: 139734 - DNA, 20 bp, Artificial Sequence
  Description of Artificial Sequence: Synthetic oligonucleotide
  Target: ATXN1; (+) strand; PAM type: NRG; PAM sequence: AAG
tcttgatgtttaactctcac

SEQ ID NO: 139735 - DNA, 20 bp, Artificial Sequence
  Description of Artificial Sequence: Synthetic oligonucleotide
  Target: ATXN1; (+) strand; PAM type: NRG; PAM sequence: CAG
ctctcacaagcaattatctc

SEQ ID NO: 139736 - DNA, 20 bp, Artificial Sequence
  Description of Artificial Sequence: Synthetic oligonucleotide
  Target: ATXN1; (+) strand; PAM type: NRG; PAM sequence: TAG
caatcactactctttcttct

SEQ ID NO: 139737 - DNA, 20 bp, Artificial Sequence
  Description of Artificial Sequence: Synthetic oligonucleotide
  Target: ATXN1; (+) strand; PAM type: NRG; PAM sequence: CAG
ctctttcttcttagaaaaca

SEQ ID NO: 139738 - DNA, 20 bp, Artificial Sequence
  Description of Artificial Sequence: Synthetic oligonucleotide
  Target: ATXN1; (+) strand; PAM type: NRG; PAM sequence: TAG
ccatctaaactaaccccatc

SEQ ID NO: 139739 - DNA, 20 bp, Artificial Sequence
  Description of Artificial Sequence: Synthetic oligonucleotide
  Target: ATXN1; (+) strand; PAM type: NRG; PAM sequence: TGG
aaactaaccccatctagttc

SEQ ID NO: 139740 - DNA, 20 bp, Artificial Sequence
  Description of Artificial Sequence: Synthetic oligonucleotide
  Target: ATXN1; (+) strand; PAM type: NRG; PAM sequence: TAG
tctggcatccatgcaatcaa

SEQ ID NO: 139741 - DNA, 20 bp, Artificial Sequence
  Description of Artificial Sequence: Synthetic oligonucleotide
  Target: ATXN1; (+) strand; PAM type: NRG; PAM sequence: TAG
atccatgcaatcaatagatt

SEQ ID NO: 139742 - DNA, 20 bp, Artificial Sequence
  Description of Artificial Sequence: Synthetic oligonucleotide
  Target: ATXN1; (+) strand; PAM type: NRG; PAM sequence: TAG
caatagatttagcatttact

SEQ ID NO: 139743 - DNA, 20 bp, Artificial Sequence
  Description of Artificial Sequence: Synthetic oligonucleotide
  Target: ATXN1; (+) strand; PAM type: NRG; PAM sequence: AAG
agatttagcatttacttagc

SEQ ID NO: 139744 - DNA, 20 bp, Artificial Sequence
  Description of Artificial Sequence: Synthetic oligonucleotide
  Target: ATXN1; (+) strand; PAM type: NRG; PAM sequence: TGG
ttacttagcaagcactacca

SEQ ID NO: 139745 - DNA, 20 bp, Artificial Sequence
  Description of Artificial Sequence: Synthetic oligonucleotide
  Target: ATXN1; (+) strand; PAM type: NRG; PAM sequence: AAG
tggatttctctgtaatgaaa

SEQ ID NO: 139746 - DNA, 20 bp, Artificial Sequence
  Description of Artificial Sequence: Synthetic oligonucleotide
  Target: ATXN1; (+) strand; PAM type: NRG; PAM sequence: GAG
tatgccttatatgtaatctt

SEQ ID NO: 139747 - DNA, 20 bp, Artificial Sequence
  Description of Artificial Sequence: Synthetic oligonucleotide
  Target: ATXN1; (+) strand; PAM type: NRG; PAM sequence: CAG
gccttatatgtaatcttgag

SEQ ID NO: 139748 - DNA, 20 bp, Artificial Sequence
  Description of Artificial Sequence: Synthetic oligonucleotide
  Target: ATXN1; (+) strand; PAM type: NRG; PAM sequence: AGG
ccttatatgtaatcttgagc

SEQ ID NO: 139749 - DNA, 20 bp, Artificial Sequence
  Description of Artificial Sequence: Synthetic oligonucleotide
  Target: ATXN1; (+) strand; PAM type: NRG; PAM sequence: TGG
gagcaggttctcctcttttc

SEQ ID NO: 139750 - DNA, 20 bp, Artificial Sequence
  Description of Artificial Sequence: Synthetic oligonucleotide
  Target: ATXN1; (+) strand; PAM type: NRG; PAM sequence: GGG
agcaggttctcctcttttct

SEQ ID NO: 139751 - DNA, 20 bp, Artificial Sequence
  Description of Artificial Sequence: Synthetic oligonucleotide
  Target: ATXN1; (+) strand; PAM type: NRG; PAM sequence: CGG
ttctcctcttttctgggcct

SEQ ID NO: 139752 - DNA, 20 bp, Artificial Sequence
  Description of Artificial Sequence: Synthetic oligonucleotide
  Target: ATXN1; (+) strand; PAM type: NRG; PAM sequence: TAG
ggcctcggttttctcatctg

SEQ ID NO: 139753 - DNA, 20 bp, Artificial Sequence
  Description of Artificial Sequence: Synthetic oligonucleotide
  Target: ATXN1; (+) strand; PAM type: NRG; PAM sequence: AGG
gcctcggttttctcatctgt

SEQ ID NO: 139754 - DNA, 20 bp, Artificial Sequence
  Description of Artificial Sequence: Synthetic oligonucleotide
  Target: ATXN1; (+) strand; PAM type: NRG; PAM sequence: GAG
ctcggttttctcatctgtag

SEQ ID NO: 139755 - DNA, 20 bp, Artificial Sequence
  Description of Artificial Sequence: Synthetic oligonucleotide
  Target: ATXN1; (+) strand; PAM type: NRG; PAM sequence: AGG
tcggttttctcatctgtagg

SEQ ID NO: 139756 - DNA, 20 bp, Artificial Sequence
  Description of Artificial Sequence: Synthetic oligonucleotide
  Target: ATXN1; (+) strand; PAM type: NRG; PAM sequence: TAG
ggataatactccctacctca

SEQ ID NO: 139757 - DNA, 20 bp, Artificial Sequence
  Description of Artificial Sequence: Synthetic oligonucleotide
  Target: ATXN1; (+) strand; PAM type: NRG; PAM sequence: AGG
gataatactccctacctcat

SEQ ID NO: 139758 - DNA, 20 bp, Artificial Sequence
  Description of Artificial Sequence: Synthetic oligonucleotide
  Target: ATXN1; (+) strand; PAM type: NRG; PAM sequence: GGG
ataatactccctacctcata

SEQ ID NO: 139759 - DNA, 20 bp, Artificial Sequence
  Description of Artificial Sequence: Synthetic oligonucleotide
  Target: ATXN1; (+) strand; PAM type: NRG; PAM sequence: GAG
tacctcatagggttgtttct

SEQ ID NO: 139760 - DNA, 20 bp, Artificial Sequence
  Description of Artificial Sequence: Synthetic oligonucleotide
  Target: ATXN1; (+) strand; PAM type: NRG; PAM sequence: CAG
aacatttatttttaaaaaaa

SEQ ID NO: 139761 - DNA, 20 bp, Artificial Sequence
  Description of Artificial Sequence: Synthetic oligonucleotide
  Target: ATXN1; (+) strand; PAM type: NRG; PAM sequence: AAG
tttaaaaaaacagctttatt

SEQ ID NO: 139762 - DNA, 20 bp, Artificial Sequence
  Description of Artificial Sequence: Synthetic oligonucleotide
  Target: ATXN1; (+) strand; PAM type: NRG; PAM sequence: AAG
atttaatttacatataactc

SEQ ID NO: 139763 - DNA, 20 bp, Artificial Sequence
  Description of Artificial Sequence: Synthetic oligonucleotide
  Target: ATXN1; (+) strand; PAM type: NRG; PAM sequence: TAG
tgtataactcaaatgttttt

SEQ ID NO: 139764 - DNA, 20 bp, Artificial Sequence
  Description of Artificial Sequence: Synthetic oligonucleotide
  Target: ATXN1; (+) strand; PAM type: NRG; PAM sequence: TAG
aactcaaatgttttttagta

SEQ ID NO: 139765 - DNA, 20 bp, Artificial Sequence
  Description of Artificial Sequence: Synthetic oligonucleotide
  Target: ATXN1; (+) strand; PAM type: NRG; PAM sequence: TAG
ccaacatcacaatctaattt

SEQ ID NO: 139766 - DNA, 20 bp, Artificial Sequence
  Description of Artificial Sequence: Synthetic oligonucleotide
  Target: ATXN1; (+) strand; PAM type: NRG; PAM sequence: AAG
ttagattttcttctccaaaa

SEQ ID NO: 139767 - DNA, 20 bp, Artificial Sequence
  Description of Artificial Sequence: Synthetic oligonucleotide
  Target: ATXN1; (+) strand; PAM type: NRG; PAM sequence: TAG
aaaagaaaccctgtgtacat

SEQ ID NO: 139768 - DNA, 20 bp, Artificial Sequence
  Description of Artificial Sequence: Synthetic oligonucleotide
  Target: ATXN1; (+) strand; PAM type: NRG; PAM sequence: CAG
agaaaccctgtgtacattag

SEQ ID NO: 139769 - DNA, 20 bp, Artificial Sequence
  Description of Artificial Sequence: Synthetic oligonucleotide
  Target: ATXN1; (+) strand; PAM type: NRG; PAM sequence: CGG
ctgcattcctctcccacctc

SEQ ID NO: 139770 - DNA, 20 bp, Artificial Sequence
  Description of Artificial Sequence: Synthetic oligonucleotide
  Target: ATXN1; (+) strand; PAM type: NRG; PAM sequence: TGG
caaactaacttctgtctcta

SEQ ID NO: 139771 - DNA, 20 bp, Artificial Sequence
  Description of Artificial Sequence: Synthetic oligonucleotide
  Target: ATXN1; (+) strand; PAM type: NRG; PAM sequence: TGG
ctctatggatttgtctattc

SEQ ID NO: 139772 - DNA, 20 bp, Artificial Sequence
  Description of Artificial Sequence: Synthetic oligonucleotide
  Target: ATXN1; (+) strand; PAM type: NRG; PAM sequence: AAG
ctttcatataaatgaaattg

SEQ ID NO: 139773 - DNA, 20 bp, Artificial Sequence
  Description of Artificial Sequence: Synthetic oligonucleotide
  Target: ATXN1; (+) strand; PAM type: NRG; PAM sequence: TGG
ataaatgaaattgaagtatg

SEQ ID NO: 139774 - DNA, 20 bp, Artificial Sequence
  Description of Artificial Sequence: Synthetic oligonucleotide
  Target: ATXN1; (+) strand; PAM type: NRG; PAM sequence: GAG
ctcaattcacatgatgtttt

SEQ ID NO: 139775 - DNA, 20 bp, Artificial Sequence
  Description of Artificial Sequence: Synthetic oligonucleotide
  Target: ATXN1; (+) strand; PAM type: NRG; PAM sequence: AGG
tcaattcacatgatgttttg

SEQ ID NO: 139776 - DNA, 20 bp, Artificial Sequence
  Description of Artificial Sequence: Synthetic oligonucleotide
  Target: ATXN1; (+) strand; PAM type: NRG; PAM sequence: TAG
tttgaggttcatctatgttg

SEQ ID NO: 139777 - DNA, 20 bp, Artificial Sequence
  Description of Artificial Sequence: Synthetic oligonucleotide
  Target: ATXN1; (+) strand; PAM type: NRG; PAM sequence: TGG
tgtattaatactttgcttac

SEQ ID NO: 139778 - DNA, 20 bp, Artificial Sequence
  Description of Artificial Sequence: Synthetic oligonucleotide
  Target: ATXN1; (+) strand; PAM type: NRG; PAM sequence: GAG
tattttgcgtgtgtgtgtgt

SEQ ID NO: 139779 - DNA, 20 bp, Artificial Sequence
  Description of Artificial Sequence: Synthetic oligonucleotide
  Target: ATXN1; (+) strand; PAM type: NRG; PAM sequence: AGG
attttgcgtgtgtgtgtgtg

SEQ ID NO: 139780 - DNA, 20 bp, Artificial Sequence
  Description of Artificial Sequence: Synthetic oligonucleotide
  Target: ATXN1; (+) strand; PAM type: NRG; PAM sequence: GAG
tttgcgtgtgtgtgtgtgag

SEQ ID NO: 139781 - DNA, 20 bp, Artificial Sequence
  Description of Artificial Sequence: Synthetic oligonucleotide
  Target: ATXN1; (+) strand; PAM type: NRG; PAM sequence: AGG
ttgcgtgtgtgtgtgtgagg

SEQ ID NO: 139782 - DNA, 20 bp, Artificial Sequence
  Description of Artificial Sequence: Synthetic oligonucleotide
  Target: ATXN1; (+) strand; PAM type: NRG; PAM sequence: GAG
gaggaggatacatatttcat

SEQ ID NO: 139783 - DNA, 20 bp, Artificial Sequence
  Description of Artificial Sequence: Synthetic oligonucleotide
  Target: ATXN1; (+) strand; PAM type: NRG; PAM sequence: CAG
ggatacatatttcatgagtg

SEQ ID NO: 139784 - DNA, 20 bp, Artificial Sequence
  Description of Artificial Sequence: Synthetic oligonucleotide
  Target: ATXN1; (+) strand; PAM type: NRG; PAM sequence: GAG
atacatatttcatgagtgca

SEQ ID NO: 139785 - DNA, 20 bp, Artificial Sequence
  Description of Artificial Sequence: Synthetic oligonucleotide
  Target: ATXN1; (+) strand; PAM type: NRG; PAM sequence: CAG
tttcatgagtgcagagtgct

SEQ ID NO: 139786 - DNA, 20 bp, Artificial Sequence
  Description of Artificial Sequence: Synthetic oligonucleotide
  Target: ATXN1; (+) strand; PAM type: NRG; PAM sequence: CAG
tgagtgcagagtgctcagct

SEQ ID NO: 139787 - DNA, 20 bp, Artificial Sequence
  Description of Artificial Sequence: Synthetic oligonucleotide
  Target: ATXN1; (+) strand; PAM type: NRG; PAM sequence: TGG
agagtgctcagctcagtact

SEQ ID NO: 139788 - DNA, 20 bp, Artificial Sequence
  Description of Artificial Sequence: Synthetic oligonucleotide
  Target: ATXN1; (+) strand; PAM type: NRG; PAM sequence: GAG
agtgctcagctcagtacttg

SEQ ID NO: 139789 - DNA, 20 bp, Artificial Sequence
  Description of Artificial Sequence: Synthetic oligonucleotide
  Target: ATXN1; (+) strand; PAM type: NRG; PAM sequence: CAG
cagctcagtacttggagaca

SEQ ID NO: 139790 - DNA, 20 bp, Artificial Sequence
  Description of Artificial Sequence: Synthetic oligonucleotide
  Target: ATXN1; (+) strand; PAM type: NRG; PAM sequence: TAG
cagcactctgaaaatgtctg

SEQ ID NO: 139791 - DNA, 20 bp, Artificial Sequence
  Description of Artificial Sequence: Synthetic oligonucleotide
  Target: ATXN1; (+) strand; PAM type: NRG; PAM sequence: TGG
tctgtagctttcattaccat

SEQ ID NO: 139792 - DNA, 20 bp, Artificial Sequence
  Description of Artificial Sequence: Synthetic oligonucleotide
  Target: ATXN1; (+) strand; PAM type: NRG; PAM sequence: TGG
acttttgtttacaattgcac

SEQ ID NO: 139793 - DNA, 20 bp, Artificial Sequence
  Description of Artificial Sequence: Synthetic oligonucleotide
  Target: ATXN1; (+) strand; PAM type: NRG; PAM sequence: CAG
acaattgcactggtctccac

SEQ ID NO: 139794 - DNA, 20 bp, Artificial Sequence
  Description of Artificial Sequence: Synthetic oligonucleotide
  Target: ATXN1; (+) strand; PAM type: NRG; PAM sequence: AAG
gtctccaccagttgattatt

SEQ ID NO: 139795 - DNA, 20 bp, Artificial Sequence
  Description of Artificial Sequence: Synthetic oligonucleotide
  Target: ATXN1; (+) strand; PAM type: NRG; PAM sequence: TAG
accagttgattattaagctc

SEQ ID NO: 139796 - DNA, 20 bp, Artificial Sequence
  Description of Artificial Sequence: Synthetic oligonucleotide
  Target: ATXN1; (+) strand; PAM type: NRG; PAM sequence: GAG
cagttgattattaagctcta

SEQ ID NO: 139797 - DNA, 20 bp, Artificial Sequence
  Description of Artificial Sequence: Synthetic oligonucleotide
  Target: ATXN1; (+) strand; PAM type: NRG; PAM sequence: CAG
ttgattattaagctctagag

SEQ ID NO: 139798 - DNA, 20 bp, Artificial Sequence
  Description of Artificial Sequence: Synthetic oligonucleotide
  Target: ATXN1; (+) strand; PAM type: NRG; PAM sequence: AGG
tgattattaagctctagagc

SEQ ID NO: 139799 - DNA, 20 bp, Artificial Sequence
  Description of Artificial Sequence: Synthetic oligonucleotide
  Target: ATXN1; (+) strand; PAM type: NRG; PAM sequence: GGG
gattattaagctctagagca

SEQ ID NO: 139800 - DNA, 20 bp, Artificial Sequence
  Description of Artificial Sequence: Synthetic oligonucleotide
  Target: ATXN1; (+) strand; PAM type: NRG; PAM sequence: GGG
attattaagctctagagcag

SEQ ID NO: 139801 - DNA, 20 bp, Artificial Sequence
  Description of Artificial Sequence: Synthetic oligonucleotide
  Target: ATXN1; (+) strand; PAM type: NRG; PAM sequence: TGG
gagcaggggttcccaacccc

SEQ ID NO: 139802 - DNA, 20 bp, Artificial Sequence
  Description of Artificial Sequence: Synthetic oligonucleotide
  Target: ATXN1; (+) strand; PAM type: NRG; PAM sequence: GGG
agcaggggttcccaacccct

SEQ ID NO: 139803 - DNA, 20 bp, Artificial Sequence
  Description of Artificial Sequence: Synthetic oligonucleotide
  Target: ATXN1; (+) strand; PAM type: NRG; PAM sequence: CAG
ggttcccaacccctgggcta

SEQ ID NO: 139804 - DNA, 20 bp, Artificial Sequence
  Description of Artificial Sequence: Synthetic oligonucleotide
  Target: ATXN1; (+) strand; PAM type: NRG; PAM sequence: CAG
gctacagacctcctgcacaa

SEQ ID NO: 139805 - DNA, 20 bp, Artificial Sequence
  Description of Artificial Sequence: Synthetic oligonucleotide
  Target: ATXN1; (+) strand; PAM type: NRG; PAM sequence: AGG
ctacagacctcctgcacaac

SEQ ID NO: 139806 - DNA, 20 bp, Artificial Sequence
  Description of Artificial Sequence: Synthetic oligonucleotide
  Target: ATXN1; (+) strand; PAM type: NRG; PAM sequence: GAG
acagacctcctgcacaacag

SEQ ID NO: 139807 - DNA, 20 bp, Artificial Sequence
  Description of Artificial Sequence: Synthetic oligonucleotide
  Target: ATXN1; (+) strand; PAM type: NRG; PAM sequence: AGG
cagacctcctgcacaacagg

SEQ ID NO: 139808 - DNA, 20 bp, Artificial Sequence
  Description of Artificial Sequence: Synthetic oligonucleotide
  Target: ATXN1; (+) strand; PAM type: NRG; PAM sequence: GAG
cctcctgcacaacaggaggt

SEQ ID NO: 139809 - DNA, 20 bp, Artificial Sequence
  Description of Artificial Sequence: Synthetic oligonucleotide
  Target: ATXN1; (+) strand; PAM type: NRG; PAM sequence: CAG
cctgcacaacaggaggtgag

SEQ ID NO: 139810 - DNA, 20 bp, Artificial Sequence
  Description of Artificial Sequence: Synthetic oligonucleotide
  Target: ATXN1; (+) strand; PAM type: NRG; PAM sequence: TAG
gcacaacaggaggtgagcag

SEQ ID NO: 139811 - DNA, 20 bp, Artificial Sequence
  Description of Artificial Sequence: Synthetic oligonucleotide
  Target: ATXN1; (+) strand; PAM type: NRG; PAM sequence: AGG
cacaacaggaggtgagcagt

SEQ ID NO: 139812 - DNA, 20 bp, Artificial Sequence
  Description of Artificial Sequence: Synthetic oligonucleotide
  Target: ATXN1; (+) strand; PAM type: NRG; PAM sequence: GAG
gaggtgagcagtaggcgaat

SEQ ID NO: 139813 - DNA, 20 bp, Artificial Sequence
  Description of Artificial Sequence: Synthetic oligonucleotide
  Target: ATXN1; (+) strand; PAM type: NRG; PAM sequence: AAG
gagcagtaggcgaatgagca

SEQ ID NO: 139814 - DNA, 20 bp, Artificial Sequence
  Description of Artificial Sequence: Synthetic oligonucleotide
  Target: ATXN1; (+) strand; PAM type: NRG; PAM sequence: CAG
caaagcttcatctgtattta

SEQ ID NO: 139815 - DNA, 20 bp, Artificial Sequence
  Description of Artificial Sequence: Synthetic oligonucleotide
  Target: ATXN1; (+) strand; PAM type: NRG; PAM sequence: GAG
cattgttcaaattaccacct

SEQ ID NO: 139816 - DNA, 20 bp, Artificial Sequence
  Description of Artificial Sequence: Synthetic oligonucleotide
  Target: ATXN1; (+) strand; PAM type: NRG; PAM sequence: CAG
acctgagctctgcctcctgt

SEQ ID NO: 139817 - DNA, 20 bp, Artificial Sequence
  Description of Artificial Sequence: Synthetic oligonucleotide
  Target: ATXN1; (+) strand; PAM type: NRG; PAM sequence: AGG
cctgagctctgcctcctgtc

SEQ ID NO: 139818 - DNA, 20 bp, Artificial Sequence
  Description of Artificial Sequence: Synthetic oligonucleotide
  Target: ATXN1; (+) strand; PAM type: NRG; PAM sequence: CAG
agctctgcctcctgtcaggt

SEQ ID NO: 139819 - DNA, 20 bp, Artificial Sequence
  Description of Artificial Sequence: Synthetic oligonucleotide
  Target: ATXN1; (+) strand; PAM type: NRG; PAM sequence: CGG
gcctcctgtcaggtcagcaa

SEQ ID NO: 139820 - DNA, 20 bp, Artificial Sequence
  Description of Artificial Sequence: Synthetic oligonucleotide
  Target: ATXN1; (+) strand; PAM type: NRG; PAM sequence: GAG
tgtcaggtcagcaacggcat

SEQ ID NO: 139821 - DNA, 20 bp, Artificial Sequence
  Description of Artificial Sequence: Synthetic oligonucleotide
  Target: ATXN1; (+) strand; PAM type: NRG; PAM sequence: TAG
gcaacggcatgagattctca

SEQ ID NO: 139822 - DNA, 20 bp, Artificial Sequence
  Description of Artificial Sequence: Synthetic oligonucleotide
  Target: ATXN1; (+) strand; PAM type: NRG; PAM sequence: AGG
caacggcatgagattctcat

SEQ ID NO: 139823 - DNA, 20 bp, Artificial Sequence
  Description of Artificial Sequence: Synthetic oligonucleotide
  Target: ATXN1; (+) strand; PAM type: NRG; PAM sequence: GAG
acggcatgagattctcatag

SEQ ID NO: 139824 - DNA, 20 bp, Artificial Sequence
  Description of Artificial Sequence: Synthetic oligonucleotide
  Target: ATXN1; (+) strand; PAM type: NRG; PAM sequence: GAG
ctattgtgaactgcacatgt

SEQ ID NO: 139825 - DNA, 20 bp, Artificial Sequence
  Description of Artificial Sequence: Synthetic oligonucleotide
  Target: ATXN1; (+) strand; PAM type: NRG; PAM sequence: AGG
tattgtgaactgcacatgtg

SEQ ID NO: 139826 - DNA, 20 bp, Artificial Sequence
  Description of Artificial Sequence: Synthetic oligonucleotide
  Target: ATXN1; (+) strand; PAM type: NRG; PAM sequence: GGG
attgtgaactgcacatgtga

SEQ ID NO: 139827 - DNA, 20 bp, Artificial Sequence
  Description of Artificial Sequence: Synthetic oligonucleotide
  Target: ATXN1; (+) strand; PAM type: NRG; PAM sequence: TAG
aactgcacatgtgagggatg

SEQ ID NO: 139828 - DNA, 20 bp, Artificial Sequence
  Description of Artificial Sequence: Synthetic oligonucleotide
  Target: ATXN1; (+) strand; PAM type: NRG; PAM sequence: AGG
actgcacatgtgagggatgt

SEQ ID NO: 139829 - DNA, 20 bp, Artificial Sequence
  Description of Artificial Sequence: Synthetic oligonucleotide
  Target: ATXN1; (+) strand; PAM type: NRG; PAM sequence: GAG
gtaggttgcaccctctttat

SEQ ID NO: 139830 - DNA, 20 bp, Artificial Sequence
  Description of Artificial Sequence: Synthetic oligonucleotide
  Target: ATXN1; (+) strand; PAM type: NRG; PAM sequence: TAG
tcactgtctcccatcacccc

SEQ ID NO: 139831 - DNA, 20 bp, Artificial Sequence
  Description of Artificial Sequence: Synthetic oligonucleotide
  Target: ATXN1; (+) strand; PAM type: NRG; PAM sequence: TGG
tgtctcccatcacccctaga

SEQ ID NO: 139832 - DNA, 20 bp, Artificial Sequence
  Description of Artificial Sequence: Synthetic oligonucleotide
  Target: ATXN1; (+) strand; PAM type: NRG; PAM sequence: GGG
gtctcccatcacccctagat

SEQ ID NO: 139833 - DNA, 20 bp, Artificial Sequence
  Description of Artificial Sequence: Synthetic oligonucleotide
  Target: ATXN1; (+) strand; PAM type: NRG; PAM sequence: CAG
tagatgggaccgttttgttg

SEQ ID NO: 139834 - DNA, 20 bp, Artificial Sequence
  Description of Artificial Sequence: Synthetic oligonucleotide
  Target: ATXN1; (+) strand; PAM type: NRG; PAM sequence: AGG
agatgggaccgttttgttgc

SEQ ID NO: 139835 - DNA, 20 bp, Artificial Sequence
  Description of Artificial Sequence: Synthetic oligonucleotide
  Target: ATXN1; (+) strand; PAM type: NRG; PAM sequence: AAG
ccgttttgttgcaggaaaac

SEQ ID NO: 139836 - DNA, 20 bp, Artificial Sequence
  Description of Artificial Sequence: Synthetic oligonucleotide
  Target: ATXN1; (+) strand; PAM type: NRG; PAM sequence: AAG
tgttgcaggaaaacaagctc

SEQ ID NO: 139837 - DNA, 20 bp, Artificial Sequence
  Description of Artificial Sequence: Synthetic oligonucleotide
  Target: ATXN1; (+) strand; PAM type: NRG; PAM sequence: AGG
gttgcaggaaaacaagctca

SEQ ID NO: 139838 - DNA, 20 bp, Artificial Sequence
  Description of Artificial Sequence: Synthetic oligonucleotide
  Target: ATXN1; (+) strand; PAM type: NRG; PAM sequence: TGG
atctcactgattctacatta

SEQ ID NO: 139839 - DNA, 20 bp, Artificial Sequence
  Description of Artificial Sequence: Synthetic oligonucleotide
  Target: ATXN1; (+) strand; PAM type: NRG; PAM sequence: GAG
cactgattctacattatggt

SEQ ID NO: 139840 - DNA, 20 bp, Artificial Sequence
  Description of Artificial Sequence: Synthetic oligonucleotide
  Target: ATXN1; (+) strand; PAM type: NRG; PAM sequence: AAG
acaacataataatataaata

SEQ ID NO: 139841 - DNA, 20 bp, Artificial Sequence
  Description of Artificial Sequence: Synthetic oligonucleotide
  Target: ATXN1; (+) strand; PAM type: NRG; PAM sequence: TAG
aaccatcccccgctccaccc

SEQ ID NO: 139842 - DNA, 20 bp, Artificial Sequence
  Description of Artificial Sequence: Synthetic oligonucleotide
  Target: ATXN1; (+) strand; PAM type: NRG; PAM sequence: TGG
ccccgctccaccctagtctg

SEQ ID NO: 139843 - DNA, 20 bp, Artificial Sequence
  Description of Artificial Sequence: Synthetic oligonucleotide
  Target: ATXN1; (+) strand; PAM type: NRG; PAM sequence: CAG
aaaactgtcttccatgaaac

SEQ ID NO: 139844 - DNA, 20 bp, Artificial Sequence
  Description of Artificial Sequence: Synthetic oligonucleotide
  Target: ATXN1; (+) strand; PAM type: NRG; PAM sequence: TGG
tcttccatgaaaccagtccc

SEQ ID NO: 139845 - DNA, 20 bp, Artificial Sequence
  Description of Artificial Sequence: Synthetic oligonucleotide
  Target: ATXN1; (+) strand; PAM type: NRG; PAM sequence: AAG
aaccagtccctggtgccaaa

SEQ ID NO: 139846 - DNA, 20 bp, Artificial Sequence
  Description of Artificial Sequence: Synthetic oligonucleotide
  Target: ATXN1; (+) strand; PAM type: NRG; PAM sequence: AGG
accagtccctggtgccaaaa

SEQ ID NO: 139847 - DNA, 20 bp, Artificial Sequence
  Description of Artificial Sequence: Synthetic oligonucleotide
  Target: ATXN1; (+) strand; PAM type: NRG; PAM sequence: TAG
gtccctggtgccaaaaaggt

SEQ ID NO: 139848 - DNA, 20 bp, Artificial Sequence
  Description of Artificial Sequence: Synthetic oligonucleotide
  Target: ATXN1; (+) strand; PAM type: NRG; PAM sequence: AGG
tccctggtgccaaaaaggtt

SEQ ID NO: 139849 - DNA, 20 bp, Artificial Sequence
  Description of Artificial Sequence: Synthetic oligonucleotide
  Target: ATXN1; (+) strand; PAM type: NRG; PAM sequence: GGG
ccctggtgccaaaaaggtta

SEQ ID NO: 139850 - DNA, 20 bp, Artificial Sequence
  Description of Artificial Sequence: Synthetic oligonucleotide
  Target: ATXN1; (+) strand; PAM type: NRG; PAM sequence: TGG
ccaaaaaggttagggaccac

SEQ ID NO: 139851 - DNA, 20 bp, Artificial Sequence
  Description of Artificial Sequence: Synthetic oligonucleotide
  Target: ATXN1; (+) strand; PAM type: NRG; PAM sequence: TAG
aaggttagggaccactggtc

SEQ ID NO: 139852 - DNA, 20 bp, Artificial Sequence
  Description of Artificial Sequence: Synthetic oligonucleotide
  Target: ATXN1; (+) strand; PAM type: NRG; PAM sequence: GAG
ggttagggaccactggtcta

SEQ ID NO: 139853 - DNA, 20 bp, Artificial Sequence
  Description of Artificial Sequence: Synthetic oligonucleotide
  Target: ATXN1; (+) strand; PAM type: NRG; PAM sequence: GAG
ttagggaccactggtctaga

SEQ ID NO: 139854 - DNA, 20 bp, Artificial Sequence
  Description of Artificial Sequence: Synthetic oligonucleotide
  Target: ATXN1; (+) strand; PAM type: NRG; PAM sequence: AAG
gggaccactggtctagagag

SEQ ID NO: 139855 - DNA, 20 bp, Artificial Sequence
  Description of Artificial Sequence: Synthetic oligonucleotide
  Target: ATXN1; (+) strand; PAM type: NRG; PAM sequence: AGG
ggaccactggtctagagaga

SEQ ID NO: 139856 - DNA, 20 bp, Artificial Sequence
  Description of Artificial Sequence: Synthetic oligonucleotide
  Target: ATXN1; (+) strand; PAM type: NRG; PAM sequence: GAG
accactggtctagagagaag

SEQ ID NO: 139857 - DNA, 20 bp, Artificial Sequence
  Description of Artificial Sequence: Synthetic oligonucleotide
  Target: ATXN1; (+) strand; PAM type: NRG; PAM sequence: CAG
agctcttcttacacactgcc

SEQ ID NO: 139858 - DNA, 20 bp, Artificial Sequence
  Description of Artificial Sequence: Synthetic oligonucleotide
  Target: ATXN1; (+) strand; PAM type: NRG; PAM sequence: GAG
ttacacactgcccagaaact

SEQ ID NO: 139859 - DNA, 20 bp, Artificial Sequence
  Description of Artificial Sequence: Synthetic oligonucleotide
  Target: ATXN1; (+) strand; PAM type: NRG; PAM sequence: AGG
tacacactgcccagaaactg

SEQ ID NO: 139860 - DNA, 20 bp, Artificial Sequence
  Description of Artificial Sequence: Synthetic oligonucleotide
  Target: ATXN1; (+) strand; PAM type: NRG; PAM sequence: CAG
cccagaaactgaggatgtga

SEQ ID NO: 139861 - DNA, 20 bp, Artificial Sequence
  Description of Artificial Sequence: Synthetic oligonucleotide
  Target: ATXN1; (+) strand; PAM type: NRG; PAM sequence: AAG
agaaactgaggatgtgacag

SEQ ID NO: 139862 - DNA, 20 bp, Artificial Sequence
  Description of Artificial Sequence: Synthetic oligonucleotide
  Target: ATXN1; (+) strand; PAM type: NRG; PAM sequence: GAG
ggatgtgacagaagttcaac

SEQ ID NO: 139863 - DNA, 20 bp, Artificial Sequence
  Description of Artificial Sequence: Synthetic oligonucleotide
  Target: ATXN1; (+) strand; PAM type: NRG; PAM sequence: GAG
atgtgacagaagttcaacga

SEQ ID NO: 139864 - DNA, 20 bp, Artificial Sequence
  Description of Artificial Sequence: Synthetic oligonucleotide
  Target: ATXN1; (+) strand; PAM type: NRG; PAM sequence: AAG
cgagagctaactaaacaact

SEQ ID NO: 139865 - DNA, 20 bp, Artificial Sequence
  Description of Artificial Sequence: Synthetic oligonucleotide
  Target: ATXN1; (+) strand; PAM type: NRG; PAM sequence: TAG
gagctaactaaacaactaag

SEQ ID NO: 139866 - DNA, 20 bp, Artificial Sequence
  Description of Artificial Sequence: Synthetic oligonucleotide
  Target: ATXN1; (+) strand; PAM type: NRG; PAM sequence: AAG
caactaagtagcaacctgac

SEQ ID NO: 139867 - DNA, 20 bp, Artificial Sequence
  Description of Artificial Sequence: Synthetic oligonucleotide
  Target: ATXN1; (+) strand; PAM type: NRG; PAM sequence: AGG
aactaagtagcaacctgaca

SEQ ID NO: 139868 - DNA, 20 bp, Artificial Sequence
  Description of Artificial Sequence: Synthetic oligonucleotide
  Target: ATXN1; (+) strand; PAM type: NRG; PAM sequence: GGG
actaagtagcaacctgacaa

SEQ ID NO: 139869 - DNA, 20 bp, Artificial Sequence
  Description of Artificial Sequence: Synthetic oligonucleotide
  Target: ATXN1; (+) strand; PAM type: NRG; PAM sequence: CAG
gtagcaacctgacaagggct

SEQ ID NO: 139870 - DNA, 20 bp, Artificial Sequence
  Description of Artificial Sequence: Synthetic oligonucleotide
  Target: ATXN1; (+) strand; PAM type: NRG; PAM sequence: CAG
caacctgacaagggctcaga

SEQ ID NO: 139871 - DNA, 20 bp, Artificial Sequence
  Description of Artificial Sequence: Synthetic oligonucleotide
  Target: ATXN1; (+) strand; PAM type: NRG; PAM sequence: AAG
actgctgctgccgcttacaa

SEQ ID NO: 139872 - DNA, 20 bp, Artificial Sequence
  Description of Artificial Sequence: Synthetic oligonucleotide
  Target: ATXN1; (+) strand; PAM type: NRG; PAM sequence: GAG
aaaagctcattcatatgtgt

SEQ ID NO: 139873 - DNA, 20 bp, Artificial Sequence
  Description of Artificial Sequence: Synthetic oligonucleotide
  Target: ATXN1; (+) strand; PAM type: NRG; PAM sequence: CAG
ctcattcatatgtgtgagtt

SEQ ID NO: 139874 - DNA, 20 bp, Artificial Sequence
  Description of Artificial Sequence: Synthetic oligonucleotide
  Target: ATXN1; (+) strand; PAM type: NRG; PAM sequence: AGG
tcattcatatgtgtgagttc

SEQ ID NO: 139875 - DNA, 20 bp, Artificial Sequence
  Description of Artificial Sequence: Synthetic oligonucleotide
  Target: ATXN1; (+) strand; PAM type: NRG; PAM sequence: CAG
tgtgagttcaggcaaaaaca

SEQ ID NO: 139876 - DNA, 20 bp, Artificial Sequence
  Description of Artificial Sequence: Synthetic oligonucleotide
  Target: ATXN1; (+) strand; PAM type: NRG; PAM sequence: TAG
acagtcgttatctgattctt

SEQ ID NO: 139877 - DNA, 20 bp, Artificial Sequence
  Description of Artificial Sequence: Synthetic oligonucleotide
  Target: ATXN1; (+) strand; PAM type: NRG; PAM sequence: AGG
cagtcgttatctgattcttt

SEQ ID NO: 139878 - DNA, 20 bp, Artificial Sequence
  Description of Artificial Sequence: Synthetic oligonucleotide
  Target: ATXN1; (+) strand; PAM type: NRG; PAM sequence: CAG
tcgttatctgattctttagg

SEQ ID NO: 139879 - DNA, 20 bp, Artificial Sequence
  Description of Artificial Sequence: Synthetic oligonucleotide
  Target: ATXN1; (+) strand; PAM type: NRG; PAM sequence: AGG
cgttatctgattctttaggc

SEQ ID NO: 139880 - DNA, 20 bp, Artificial Sequence
  Description of Artificial Sequence: Synthetic oligonucleotide
  Target: ATXN1; (+) strand; PAM type: NRG; PAM sequence: CAG
tctttaggcaggacattgac

SEQ ID NO: 139881 - DNA, 20 bp, Artificial Sequence
  Description of Artificial Sequence: Synthetic oligonucleotide
  Target: ATXN1; (+) strand; PAM type: NRG; PAM sequence: CAG
aataaatatgtctgaatctg

SEQ ID NO: 139882 - DNA, 20 bp, Artificial Sequence
  Description of Artificial Sequence: Synthetic oligonucleotide
  Target: ATXN1; (+) strand; PAM type: NRG; PAM sequence: GAG
taaatatgtctgaatctgca

SEQ ID NO: 139883 - DNA, 20 bp, Artificial Sequence
  Description of Artificial Sequence: Synthetic oligonucleotide
  Target: ATXN1; (+) strand; PAM type: NRG; PAM sequence: AAG
ctgcagagaaataatttcaa

SEQ ID NO: 139884 - DNA, 20 bp, Artificial Sequence
  Description of Artificial Sequence: Synthetic oligonucleotide
  Target: ATXN1; (+) strand; PAM type: NRG; PAM sequence: AGG
tgcagagaaataatttcaaa

SEQ ID NO: 139885 - DNA, 20 bp, Artificial Sequence
  Description of Artificial Sequence: Synthetic oligonucleotide
  Target: ATXN1; (+) strand; PAM type: NRG; PAM sequence: GGG
gcagagaaataatttcaaaa

SEQ ID NO: 139886 - DNA, 20 bp, Artificial Sequence
  Description of Artificial Sequence: Synthetic oligonucleotide
  Target: ATXN1; (+) strand; PAM type: NRG; PAM sequence: CAG
aaataatttcaaaagggctt

SEQ ID NO: 139887 - DNA, 20 bp, Artificial Sequence
  Description of Artificial Sequence: Synthetic oligonucleotide
  Target: ATXN1; (+) strand; PAM type: NRG; PAM sequence: AAG
taatttcaaaagggcttcag

SEQ ID NO: 139888 - DNA, 20 bp, Artificial Sequence
  Description of Artificial Sequence: Synthetic oligonucleotide
  Target: ATXN1; (+) strand; PAM type: NRG; PAM sequence: AGG
aatttcaaaagggcttcaga

SEQ ID NO: 139889 - DNA, 20 bp, Artificial Sequence
  Description of Artificial Sequence: Synthetic oligonucleotide
  Target: ATXN1; (+) strand; PAM type: NRG; PAM sequence: GAG
tttcaaaagggcttcagaag

SEQ ID NO: 139890 - DNA, 20 bp, Artificial Sequence
  Description of Artificial Sequence: Synthetic oligonucleotide
  Target: ATXN1; (+) strand; PAM type: NRG; PAM sequence: AAG
caaaagggcttcagaaggag

SEQ ID NO: 139891 - DNA, 20 bp, Artificial Sequence
  Description of Artificial Sequence: Synthetic oligonucleotide
  Target: ATXN1; (+) strand; PAM type: NRG; PAM sequence: AGG
aaaagggcttcagaaggaga

SEQ ID NO: 139892 - DNA, 20 bp, Artificial Sequence
  Description of Artificial Sequence: Synthetic oligonucleotide
  Target: ATXN1; (+) strand; PAM type: NRG; PAM sequence: TAG
aggagaaggaaaatccactg

SEQ ID NO: 139893 - DNA, 20 bp, Artificial Sequence
  Description of Artificial Sequence: Synthetic oligonucleotide
  Target: ATXN1; (+) strand; PAM type: NRG; PAM sequence: CAG
gaaggaaaatccactgtagc

SEQ ID NO: 139894 - DNA, 20 bp, Artificial Sequence
  Description of Artificial Sequence: Synthetic oligonucleotide
  Target: ATXN1; (+) strand; PAM type: NRG; PAM sequence: AAG
ggaaaatccactgtagccag

SEQ ID NO: 139895 - DNA, 20 bp, Artificial Sequence
  Description of Artificial Sequence: Synthetic oligonucleotide
  Target: ATXN1; (+) strand; PAM type: NRG; PAM sequence: AAG
ctgtagccagaagcatccaa

SEQ ID NO: 139896 - DNA, 20 bp, Artificial Sequence
  Description of Artificial Sequence: Synthetic oligonucleotide
  Target: ATXN1; (+) strand; PAM type: NRG; PAM sequence: GAG
caaaagcatcctgaaaacat

SEQ ID NO: 139897 - DNA, 20 bp, Artificial Sequence
  Description of Artificial Sequence: Synthetic oligonucleotide
  Target: ATXN1; (+) strand; PAM type: NRG; PAM sequence: TGG
aagcatcctgaaaacatgag

SEQ ID NO: 139898 - DNA, 20 bp, Artificial Sequence
  Description of Artificial Sequence: Synthetic oligonucleotide
  Target: ATXN1; (+) strand; PAM type: NRG; PAM sequence: GAG
gcatcctgaaaacatgagtg

SEQ ID NO: 139899 - DNA, 20 bp, Artificial Sequence
  Description of Artificial Sequence: Synthetic oligonucleotide
  Target: ATXN1; (+) strand; PAM type: NRG; PAM sequence: AGG
catcctgaaaacatgagtgg

SEQ ID NO: 139900 - DNA, 20 bp, Artificial Sequence
  Description of Artificial Sequence: Synthetic oligonucleotide
  Target: ATXN1; (+) strand; PAM type: NRG; PAM sequence: AAG
cctgaaaacatgagtggagg

SEQ ID NO: 139901 - DNA, 20 bp, Artificial Sequence
  Description of Artificial Sequence: Synthetic oligonucleotide
  Target: ATXN1; (+) strand; PAM type: NRG; PAM sequence: AGG
ctgaaaacatgagtggagga

SEQ ID NO: 139902 - DNA, 20 bp, Artificial Sequence
  Description of Artificial Sequence: Synthetic oligonucleotide
  Target: ATXN1; (+) strand; PAM type: NRG; PAM sequence: GAG
aacatgagtggaggaaggct

SEQ ID NO: 139903 - DNA, 20 bp, Artificial Sequence
  Description of Artificial Sequence: Synthetic oligonucleotide
  Target: ATXN1; (+) strand; PAM type: NRG; PAM sequence: CAG
atgagtggaggaaggctgag

SEQ ID NO: 139904 - DNA, 20 bp, Artificial Sequence
  Description of Artificial Sequence: Synthetic oligonucleotide
  Target: ATXN1; (+) strand; PAM type: NRG; PAM sequence: AGG
tgagtggaggaaggctgagc

SEQ ID NO: 139905 - DNA, 20 bp, Artificial Sequence
  Description of Artificial Sequence: Synthetic oligonucleotide
  Target: ATXN1; (+) strand; PAM type: NRG; PAM sequence: TGG
ggaggaaggctgagcaggtg

SEQ ID NO: 139906 - DNA, 20 bp, Artificial Sequence
  Description of Artificial Sequence: Synthetic oligonucleotide
  Target: ATXN1; (+) strand; PAM type: NRG; PAM sequence: GGG
gaggaaggctgagcaggtgt

SEQ ID NO: 139907 - DNA, 20 bp, Artificial Sequence
  Description of Artificial Sequence: Synthetic oligonucleotide
  Target: ATXN1; (+) strand; PAM type: NRG; PAM sequence: TGG
aaggctgagcaggtgtgggc

SEQ ID NO: 139908 - DNA, 20 bp, Artificial Sequence
  Description of Artificial Sequence: Synthetic oligonucleotide
  Target: ATXN1; (+) strand; PAM type: NRG; PAM sequence: GGG
aggctgagcaggtgtgggct

SEQ ID NO: 139909 - DNA, 20 bp, Artificial Sequence
  Description of Artificial Sequence: Synthetic oligonucleotide
  Target: ATXN1; (+) strand; PAM type: NRG; PAM sequence: GGG
ggctgagcaggtgtgggctg

SEQ ID NO: 139910 - DNA, 20 bp, Artificial Sequence
  Description of Artificial Sequence: Synthetic oligonucleotide
  Target: ATXN1; (+) strand; PAM type: NRG; PAM sequence: GAG
ctgagcaggtgtgggctggg

SEQ ID NO: 139911 - DNA, 20 bp, Artificial Sequence
  Description of Artificial Sequence: Synthetic oligonucleotide
  Target: ATXN1; (+) strand; PAM type: NRG; PAM sequence: AGG
tgagcaggtgtgggctgggg

SEQ ID NO: 139912 - DNA, 20 bp, Artificial Sequence
  Description of Artificial Sequence: Synthetic oligonucleotide
  Target: ATXN1; (+) strand; PAM type: NRG; PAM sequence: CAG
gcaggtgtgggctggggagg

SEQ ID NO: 139913 - DNA, 20 bp, Artificial Sequence
  Description of Artificial Sequence: Synthetic oligonucleotide
  Target: ATXN1; (+) strand; PAM type: NRG; PAM sequence: AGG
caggtgtgggctggggaggc

SEQ ID NO: 139914 - DNA, 20 bp, Artificial Sequence
  Description of Artificial Sequence: Synthetic oligonucleotide
  Target: ATXN1; (+) strand; PAM type: NRG; PAM sequence: CAG
gggaggcaggcaaccccgca

SEQ ID NO: 139915 - DNA, 20 bp, Artificial Sequence
  Description of Artificial Sequence: Synthetic oligonucleotide
  Target: ATXN1; (+) strand; PAM type: NRG; PAM sequence: CAG
aggcaggcaaccccgcacag

SEQ ID NO: 139916 - DNA, 20 bp, Artificial Sequence
  Description of Artificial Sequence: Synthetic oligonucleotide
  Target: ATXN1; (+) strand; PAM type: NRG; PAM sequence: CAG
aggcaaccccgcacagcagc

SEQ ID NO: 139917 - DNA, 20 bp, Artificial Sequence
  Description of Artificial Sequence: Synthetic oligonucleotide
  Target: ATXN1; (+) strand; PAM type: NRG; PAM sequence: AAG
cagcagccagcacaaacaca

SEQ ID NO: 139918 - DNA, 20 bp, Artificial Sequence
  Description of Artificial Sequence: Synthetic oligonucleotide
  Target: ATXN1; (+) strand; PAM type: NRG; PAM sequence: TGG
agcgacgacgcccactgtgc

SEQ ID NO: 139919 - DNA, 20 bp, Artificial Sequence
  Description of Artificial Sequence: Synthetic oligonucleotide
  Target: ATXN1; (+) strand; PAM type: NRG; PAM sequence: GGG
gcgacgacgcccactgtgct

SEQ ID NO: 139920 - DNA, 20 bp, Artificial Sequence
  Description of Artificial Sequence: Synthetic oligonucleotide
  Target: ATXN1; (+) strand; PAM type: NRG; PAM sequence: GGG
cgacgacgcccactgtgctg

SEQ ID NO: 139921 - DNA, 20 bp, Artificial Sequence
  Description of Artificial Sequence: Synthetic oligonucleotide
  Target: ATXN1; (+) strand; PAM type: NRG; PAM sequence: AAG
cgacgcccactgtgctgggg

SEQ ID NO: 139922 - DNA, 20 bp, Artificial Sequence
  Description of Artificial Sequence: Synthetic oligonucleotide
  Target: ATXN1; (+) strand; PAM type: NRG; PAM sequence: CAG
cccactgtgctggggaagca

SEQ ID NO: 139923 - DNA, 20 bp, Artificial Sequence
  Description of Artificial Sequence: Synthetic oligonucleotide
  Target: ATXN1; (+) strand; PAM type: NRG; PAM sequence: AGG
ccactgtgctggggaagcac

SEQ ID NO: 139924 - DNA, 20 bp, Artificial Sequence
  Description of Artificial Sequence: Synthetic oligonucleotide
  Target: ATXN1; (+) strand; PAM type: NRG; PAM sequence: CAG
ctgtgctggggaagcacagg

SEQ ID NO: 139925 - DNA, 20 bp, Artificial Sequence
  Description of Artificial Sequence: Synthetic oligonucleotide
  Target: ATXN1; (+) strand; PAM type: NRG; PAM sequence: CAG
ctggggaagcacaggcagca

SEQ ID NO: 139926 - DNA, 20 bp, Artificial Sequence
  Description of Artificial Sequence: Synthetic oligonucleotide
  Target: ATXN1; (+) strand; PAM type: NRG; PAM sequence: AAG
acaggcagcacagtccgtgc

SEQ ID NO: 139927 - DNA, 20 bp, Artificial Sequence
  Description of Artificial Sequence: Synthetic oligonucleotide
  Target: ATXN1; (+) strand; PAM type: NRG; PAM sequence: AGG
caggcagcacagtccgtgca

SEQ ID NO: 139928 - DNA, 20 bp, Artificial Sequence
  Description of Artificial Sequence: Synthetic oligonucleotide
  Target: ATXN1; (+) strand; PAM type: NRG; PAM sequence: GGG
aggcagcacagtccgtgcaa

SEQ ID NO: 139929 - DNA, 20 bp, Artificial Sequence
  Description of Artificial Sequence: Synthetic oligonucleotide
  Target: ATXN1; (+) strand; PAM type: NRG; PAM sequence: CGG
cagtccgtgcaagggaaacg

SEQ ID NO: 139930 - DNA, 20 bp, Artificial Sequence
  Description of Artificial Sequence: Synthetic oligonucleotide
  Target: ATXN1; (+) strand; PAM type: NRG; PAM sequence: AAG
agggaaacgcggctccctac

SEQ ID NO: 139931 - DNA, 20 bp, Artificial Sequence
  Description of Artificial Sequence: Synthetic oligonucleotide
  Target: ATXN1; (+) strand; PAM type: NRG; PAM sequence: AGG
gggaaacgcggctccctaca

SEQ ID NO: 139932 - DNA, 20 bp, Artificial Sequence
  Description of Artificial Sequence: Synthetic oligonucleotide
  Target: ATXN1; (+) strand; PAM type: NRG; PAM sequence: AAG
gctccctacaaggtgttttc

SEQ ID NO: 139933 - DNA, 20 bp, Artificial Sequence
  Description of Artificial Sequence: Synthetic oligonucleotide
  Target: ATXN1; (+) strand; PAM type: NRG; PAM sequence: AGG
ctccctacaaggtgttttca

SEQ ID NO: 139934 - DNA, 20 bp, Artificial Sequence
  Description of Artificial Sequence: Synthetic oligonucleotide
  Target: ATXN1; (+) strand; PAM type: NRG; PAM sequence: CGG
acaaggtgttttcaaggttc

SEQ ID NO: 139935 - DNA, 20 bp, Artificial Sequence
  Description of Artificial Sequence: Synthetic oligonucleotide
  Target: ATXN1; (+) strand; PAM type: NRG; PAM sequence: CAG
tttcaaggttccggtttccc

SEQ ID NO: 139936 - DNA, 20 bp, Artificial Sequence
  Description of Artificial Sequence: Synthetic oligonucleotide
  Target: ATXN1; (+) strand; PAM type: NRG; PAM sequence: GAG
tcaaggttccggtttcccca

SEQ ID NO: 139937 - DNA, 20 bp, Artificial Sequence
  Description of Artificial Sequence: Synthetic oligonucleotide
  Target: ATXN1; (+) strand; PAM type: NRG; PAM sequence: CAG
ccagagcacaaccctaacct

SEQ ID NO: 139938 - DNA, 20 bp, Artificial Sequence
  Description of Artificial Sequence: Synthetic oligonucleotide
  Target: ATXN1; (+) strand; PAM type: NRG; PAM sequence: AGG
cagagcacaaccctaacctc

SEQ ID NO: 139939 - DNA, 20 bp, Artificial Sequence
  Description of Artificial Sequence: Synthetic oligonucleotide
  Target: ATXN1; (+) strand; PAM type: NRG; PAM sequence: CAG
agcacaaccctaacctcagg

SEQ ID NO: 139940 - DNA, 20 bp, Artificial Sequence
  Description of Artificial Sequence: Synthetic oligonucleotide
  Target: ATXN1; (+) strand; PAM type: NRG; PAM sequence: CAG
ccctaacctcaggcagtgca

SEQ ID NO: 139941 - DNA, 20 bp, Artificial Sequence
  Description of Artificial Sequence: Synthetic oligonucleotide
  Target: ATXN1; (+) strand; PAM type: NRG; PAM sequence: AAG
gtgcacagttctcccaataa

SEQ ID NO: 139942 - DNA, 20 bp, Artificial Sequence
  Description of Artificial Sequence: Synthetic oligonucleotide
  Target: ATXN1; (+) strand; PAM type: NRG; PAM sequence: TGG
caataaaagtcactcgcccg

SEQ ID NO: 139943 - DNA, 20 bp, Artificial Sequence
  Description of Artificial Sequence: Synthetic oligonucleotide
  Target: ATXN1; (+) strand; PAM type: NRG; PAM sequence: GAG
ataaaagtcactcgcccgtg

SEQ ID NO: 139944 - DNA, 20 bp, Artificial Sequence
  Description of Artificial Sequence: Synthetic oligonucleotide
  Target: ATXN1; (+) strand; PAM type: NRG; PAM sequence: CGG
gaacacctgaattgacacca

SEQ ID NO: 139945 - DNA, 20 bp, Artificial Sequence
  Description of Artificial Sequence: Synthetic oligonucleotide
  Target: ATXN1; (+) strand; PAM type: NRG; PAM sequence: GGG
aacacctgaattgacaccac

SEQ ID NO: 139946 - DNA, 20 bp, Artificial Sequence
  Description of Artificial Sequence: Synthetic oligonucleotide
  Target: ATXN1; (+) strand; PAM type: NRG; PAM sequence: TGG
atttctgttttcctttccca

SEQ ID NO: 139947 - DNA, 20 bp, Artificial Sequence
  Description of Artificial Sequence: Synthetic oligonucleotide
  Target: ATXN1; (+) strand; PAM type: NRG; PAM sequence: CAG
ctttcaaatgcaaaatgtca

SEQ ID NO: 139948 - DNA, 20 bp, Artificial Sequence
  Description of Artificial Sequence: Synthetic oligonucleotide
  Target: ATXN1; (+) strand; PAM type: NRG; PAM sequence: AAG
aatgcaaaatgtcacagctg

SEQ ID NO: 139949 - DNA, 20 bp, Artificial Sequence
  Description of Artificial Sequence: Synthetic oligonucleotide
  Target: ATXN1; (+) strand; PAM type: NRG; PAM sequence: AGG
atgcaaaatgtcacagctga

SEQ ID NO: 139950 - DNA, 20 bp, Artificial Sequence
  Description of Artificial Sequence: Synthetic oligonucleotide
  Target: ATXN1; (+) strand; PAM type: NRG; PAM sequence: GGG
tgcaaaatgtcacagctgaa

SEQ ID NO: 139951 - DNA, 20 bp, Artificial Sequence
  Description of Artificial Sequence: Synthetic oligonucleotide
  Target: ATXN1; (+) strand; PAM type: NRG; PAM sequence: AAG
aaaatgtcacagctgaaggg

SEQ ID NO: 139952 - DNA, 20 bp, Artificial Sequence
  Description of Artificial Sequence: Synthetic oligonucleotide
  Target: ATXN1; (+) strand; PAM type: NRG; PAM sequence: AGG
aaatgtcacagctgaaggga

SEQ ID NO: 139953 - DNA, 20 bp, Artificial Sequence
  Description of Artificial Sequence: Synthetic oligonucleotide
  Target: ATXN1; (+) strand; PAM type: NRG; PAM sequence: AAG
gctgaagggaaggaacctcc

SEQ ID NO: 139954 - DNA, 20 bp, Artificial Sequence
  Description of Artificial Sequence: Synthetic oligonucleotide
  Target: ATXN1; (+) strand; PAM type: NRG; PAM sequence: AGG
ctgaagggaaggaacctcca

SEQ ID NO: 139955 - DNA, 20 bp, Artificial Sequence
  Description of Artificial Sequence: Synthetic oligonucleotide
  Target: ATXN1; (+) strand; PAM type: NRG; PAM sequence: TGG
aggaacctccaaggatgatc

SEQ ID NO: 139956 - DNA, 20 bp, Artificial Sequence
  Description of Artificial Sequence: Synthetic oligonucleotide
  Target: ATXN1; (+) strand; PAM type: NRG; PAM sequence: GGG
ggaacctccaaggatgatct

SEQ ID NO: 139957 - DNA, 20 bp, Artificial Sequence
  Description of Artificial Sequence: Synthetic oligonucleotide
  Target: ATXN1; (+) strand; PAM type: NRG; PAM sequence: TAG
ggctactgctttcttcttca

SEQ ID NO: 139958 - DNA, 20 bp, Artificial Sequence
  Description of Artificial Sequence: Synthetic oligonucleotide
  Target: ATXN1; (+) strand; PAM type: NRG; PAM sequence: AGG
gctactgctttcttcttcat

SEQ ID NO: 139959 - DNA, 20 bp, Artificial Sequence
  Description of Artificial Sequence: Synthetic oligonucleotide
  Target: ATXN1; (+) strand; PAM type: NRG; PAM sequence: GGG
ctactgctttcttcttcata

SEQ ID NO: 139960 - DNA, 20 bp, Artificial Sequence
  Description of Artificial Sequence: Synthetic oligonucleotide
  Target: ATXN1; (+) strand; PAM type: NRG; PAM sequence: GGG
tactgctttcttcttcatag

SEQ ID NO: 139961 - DNA, 20 bp, Artificial Sequence
  Description of Artificial Sequence: Synthetic oligonucleotide
  Target: ATXN1; (+) strand; PAM type: NRG; PAM sequence: GAG
ctgctttcttcttcataggg

SEQ ID NO: 139962 - DNA, 20 bp, Artificial Sequence
  Description of Artificial Sequence: Synthetic oligonucleotide
  Target: ATXN1; (+) strand; PAM type: NRG; PAM sequence: AGG
tgctttcttcttcatagggg

SEQ ID NO: 139963 - DNA, 20 bp, Artificial Sequence
  Description of Artificial Sequence: Synthetic oligonucleotide
  Target: ATXN1; (+) strand; PAM type: NRG; PAM sequence: GAG
tcttcataggggaggaaact

SEQ ID NO: 139964 - DNA, 20 bp, Artificial Sequence
  Description of Artificial Sequence: Synthetic oligonucleotide
  Target: ATXN1; (+) strand; PAM type: NRG; PAM sequence: CAG
aggggaggaaactgagattc

SEQ ID NO: 139965 - DNA, 20 bp, Artificial Sequence
  Description of Artificial Sequence: Synthetic oligonucleotide
  Target: ATXN1; (+) strand; PAM type: NRG; PAM sequence: GAG
gggaggaaactgagattcca

SEQ ID NO: 139966 - DNA, 20 bp, Artificial Sequence
  Description of Artificial Sequence: Synthetic oligonucleotide
  Target: ATXN1; (+) strand; PAM type: NRG; PAM sequence: GAG
gaggaaactgagattccaga

SEQ ID NO: 139967 - DNA, 20 bp, Artificial Sequence
  Description of Artificial Sequence: Synthetic oligonucleotide
  Target: ATXN1; (+) strand; PAM type: NRG; PAM sequence: AGG
aggaaactgagattccagag

SEQ ID NO: 139968 - DNA, 20 bp, Artificial Sequence
  Description of Artificial Sequence: Synthetic oligonucleotide
  Target: ATXN1; (+) strand; PAM type: NRG; PAM sequence: TGG
aactgagattccagagaggt

SEQ ID NO: 139969 - DNA, 20 bp, Artificial Sequence
  Description of Artificial Sequence: Synthetic oligonucleotide
  Target: ATXN1; (+) strand; PAM type: NRG; PAM sequence: AAG
gagaggttggtaactttccc

SEQ ID NO: 139970 - DNA, 20 bp, Artificial Sequence
  Description of Artificial Sequence: Synthetic oligonucleotide
  Target: ATXN1; (+) strand; PAM type: NRG; PAM sequence: AGG
agaggttggtaactttccca

SEQ ID NO: 139971 - DNA, 20 bp, Artificial Sequence
  Description of Artificial Sequence: Synthetic oligonucleotide
  Target: ATXN1; (+) strand; PAM type: NRG; PAM sequence: TAG
ctttcccaaggttacaaaat

SEQ ID NO: 139972 - DNA, 20 bp, Artificial Sequence
  Description of Artificial Sequence: Synthetic oligonucleotide
  Target: ATXN1; (+) strand; PAM type: NRG; PAM sequence: CAG
tcccaaggttacaaaattag

SEQ ID NO: 139973 - DNA, 20 bp, Artificial Sequence
  Description of Artificial Sequence: Synthetic oligonucleotide
  Target: ATXN1; (+) strand; PAM type: NRG; PAM sequence: CAG
aggttacaaaattagcagtg

SEQ ID NO: 139974 - DNA, 20 bp, Artificial Sequence
  Description of Artificial Sequence: Synthetic oligonucleotide
  Target: ATXN1; (+) strand; PAM type: NRG; PAM sequence: CGG
tacaaaattagcagtgcagc

SEQ ID NO: 139975 - DNA, 20 bp, Artificial Sequence
  Description of Artificial Sequence: Synthetic oligonucleotide
  Target: ATXN1; (+) strand; PAM type: NRG; PAM sequence: AAG
tgaccactctcctcctccca

SEQ ID NO: 139976 - DNA, 20 bp, Artificial Sequence
  Description of Artificial Sequence: Synthetic oligonucleotide
  Target: ATXN1; (+) strand; PAM type: NRG; PAM sequence: TAG
ctcctcctcccaaagcaatt

SEQ ID NO: 139977 - DNA, 20 bp, Artificial Sequence
  Description of Artificial Sequence: Synthetic oligonucleotide
  Target: ATXN1; (+) strand; PAM type: NRG; PAM sequence: TGG
aaagcaatttagtttccaac

SEQ ID NO: 139978 - DNA, 20 bp, Artificial Sequence
  Description of Artificial Sequence: Synthetic oligonucleotide
  Target: ATXN1; (+) strand; PAM type: NRG; PAM sequence: CAG
ctgcctacttgtttctcccc

SEQ ID NO: 139979 - DNA, 20 bp, Artificial Sequence
  Description of Artificial Sequence: Synthetic oligonucleotide
  Target: ATXN1; (+) strand; PAM type: NRG; PAM sequence: CAG
cttgtttctcccccagcccc

SEQ ID NO: 139980 - DNA, 20 bp, Artificial Sequence
  Description of Artificial Sequence: Synthetic oligonucleotide
  Target: ATXN1; (+) strand; PAM type: NRG; PAM sequence: AGG
ttgtttctcccccagccccc

SEQ ID NO: 139981 - DNA, 20 bp, Artificial Sequence
  Description of Artificial Sequence: Synthetic oligonucleotide
  Target: ATXN1; (+) strand; PAM type: NRG; PAM sequence: CAG
tttctcccccagcccccagg

SEQ ID NO: 139982 - DNA, 20 bp, Artificial Sequence
  Description of Artificial Sequence: Synthetic oligonucleotide
  Target: ATXN1; (+) strand; PAM type: NRG; PAM sequence: TGG
ccccaggcagcccttcactg

SEQ ID NO: 139983 - DNA, 20 bp, Artificial Sequence
  Description of Artificial Sequence: Synthetic oligonucleotide
  Target: ATXN1; (+) strand; PAM type: NRG; PAM sequence: GAG
agcccttcactgtggctgct

SEQ ID NO: 139984 - DNA, 20 bp, Artificial Sequence
  Description of Artificial Sequence: Synthetic oligonucleotide
  Target: ATXN1; (+) strand; PAM type: NRG; PAM sequence: CAG
cactgtggctgctgagtcat

SEQ ID NO: 139985 - DNA, 20 bp, Artificial Sequence
  Description of Artificial Sequence: Synthetic oligonucleotide
  Target: ATXN1; (+) strand; PAM type: NRG; PAM sequence: AGG
actgtggctgctgagtcatc

SEQ ID NO: 139986 - DNA, 20 bp, Artificial Sequence
  Description of Artificial Sequence: Synthetic oligonucleotide
  Target: ATXN1; (+) strand; PAM type: NRG; PAM sequence: GAG
ggctgctgagtcatcaggat

SEQ ID NO: 139987 - DNA, 20 bp, Artificial Sequence
  Description of Artificial Sequence: Synthetic oligonucleotide
  Target: ATXN1; (+) strand; PAM type: NRG; PAM sequence: AAG
tcaggatgagctttgttctc

SEQ ID NO: 139988 - DNA, 20 bp, Artificial Sequence
  Description of Artificial Sequence: Synthetic oligonucleotide
  Target: ATXN1; (+) strand; PAM type: NRG; PAM sequence: AAG
gatgagctttgttctcaagc

SEQ ID NO: 139989 - DNA, 20 bp, Artificial Sequence
  Description of Artificial Sequence: Synthetic oligonucleotide
  Target: ATXN1; (+) strand; PAM type: NRG; PAM sequence: TGG
tttgttctcaagcaagccac

SEQ ID NO: 139990 - DNA, 20 bp, Artificial Sequence
  Description of Artificial Sequence: Synthetic oligonucleotide
  Target: ATXN1; (+) strand; PAM type: NRG; PAM sequence: GGG
ttgttctcaagcaagccact

SEQ ID NO: 139991 - DNA, 20 bp, Artificial Sequence
  Description of Artificial Sequence: Synthetic oligonucleotide
  Target: ATXN1; (+) strand; PAM type: NRG; PAM sequence: CAG
tctcaagcaagccactggga

SEQ ID NO: 139992 - DNA, 20 bp, Artificial Sequence
  Description of Artificial Sequence: Synthetic oligonucleotide
  Target: ATXN1; (+) strand; PAM type: NRG; PAM sequence: AGG
ctcaagcaagccactgggac

SEQ ID NO: 139993 - DNA, 20 bp, Artificial Sequence
  Description of Artificial Sequence: Synthetic oligonucleotide
  Target: ATXN1; (+) strand; PAM type: NRG; PAM sequence: GAG
gggacaggccctcatgtctt

SEQ ID NO: 139994 - DNA, 20 bp, Artificial Sequence
  Description of Artificial Sequence: Synthetic oligonucleotide
  Target: ATXN1; (+) strand; PAM type: NRG; PAM sequence: TAG
acaggccctcatgtcttgag

SEQ ID NO: 139995 - DNA, 20 bp, Artificial Sequence
  Description of Artificial Sequence: Synthetic oligonucleotide
  Target: ATXN1; (+) strand; PAM type: NRG; PAM sequence: AGG
caggccctcatgtcttgagt

SEQ ID NO: 139996 - DNA, 20 bp, Artificial Sequence
  Description of Artificial Sequence: Synthetic oligonucleotide
  Target: ATXN1; (+) strand; PAM type: NRG; PAM sequence: AAG
ctcatgtcttgagtaggaca

SEQ ID NO: 139997 - DNA, 20 bp, Artificial Sequence
  Description of Artificial Sequence: Synthetic oligonucleotide
  Target: ATXN1; (+) strand; PAM type: NRG; PAM sequence: TGG
tgagtaggacaaagtatatt

SEQ ID NO: 139998 - DNA, 20 bp, Artificial Sequence
  Description of Artificial Sequence: Synthetic oligonucleotide
  Target: ATXN1; (+) strand; PAM type: NRG; PAM sequence: TGG
tttggccactccccactttg

SEQ ID NO: 139999 - DNA, 20 bp, Artificial Sequence
  Description of Artificial Sequence: Synthetic oligonucleotide
  Target: ATXN1; (+) strand; PAM type: NRG; PAM sequence: TGG
accctgctctgcctgatgca

SEQ ID NO: 140000 - DNA, 20 bp, Artificial Sequence
  Description of Artificial Sequence: Synthetic oligonucleotide
  Target: ATXN1; (+) strand; PAM type: NRG; PAM sequence: GGG
ccctgctctgcctgatgcat

SEQ ID NO: 140001 - DNA, 20 bp, Artificial Sequence
  Description of Artificial Sequence: Synthetic oligonucleotide
  Target: ATXN1; (+) strand; PAM type: NRG; PAM sequence: TAG
caactgtcattcgccctgaa

SEQ ID NO: 140002 - DNA, 20 bp, Artificial Sequence
  Description of Artificial Sequence: Synthetic oligonucleotide
  Target: ATXN1; (+) strand; PAM type: NRG; PAM sequence: TGG
tatgccatcacacctcctta

SEQ ID NO: 140003 - DNA, 20 bp, Artificial Sequence
  Description of Artificial Sequence: Synthetic oligonucleotide
  Target: ATXN1; (+) strand; PAM type: NRG; PAM sequence: AAG
ccttatggctactaacataa

SEQ ID NO: 140004 - DNA, 20 bp, Artificial Sequence
  Description of Artificial Sequence: Synthetic oligonucleotide
  Target: ATXN1; (+) strand; PAM type: NRG; PAM sequence: AGG
cttatggctactaacataaa

SEQ ID NO: 140005 - DNA, 20 bp, Artificial Sequence
  Description of Artificial Sequence: Synthetic oligonucleotide
  Target: ATXN1; (+) strand; PAM type: NRG; PAM sequence: AAG
tggctactaacataaaaggt

SEQ ID NO: 140006 - DNA, 20 bp, Artificial Sequence
  Description of Artificial Sequence: Synthetic oligonucleotide
  Target: ATXN1; (+) strand; PAM type: NRG; PAM sequence: TGG
aaaggtaagtgactaataaa

SEQ ID NO: 140007 - DNA, 20 bp, Artificial Sequence
  Description of Artificial Sequence: Synthetic oligonucleotide
  Target: ATXN1; (+) strand; PAM type: NRG; PAM sequence: CAG
ttaatatgaaaccttttata

SEQ ID NO: 140008 - DNA, 20 bp, Artificial Sequence
  Description of Artificial Sequence: Synthetic oligonucleotide
  Target: ATXN1; (+) strand; PAM type: NRG; PAM sequence: CAG
cagacaaatatttgattcct

SEQ ID NO: 140009 - DNA, 20 bp, Artificial Sequence
  Description of Artificial Sequence: Synthetic oligonucleotide
  Target: ATXN1; (+) strand; PAM type: NRG; PAM sequence: TGG
attcctcagttatattttct

SEQ ID NO: 140010 - DNA, 20 bp, Artificial Sequence
  Description of Artificial Sequence: Synthetic oligonucleotide
  Target: ATXN1; (+) strand; PAM type: NRG; PAM sequence: GGG
ttcctcagttatattttctt

SEQ ID NO: 140011 - DNA, 20 bp, Artificial Sequence
  Description of Artificial Sequence: Synthetic oligonucleotide
  Target: ATXN1; (+) strand; PAM type: NRG; PAM sequence: CAG
ttcttgggatcttttcttcc

SEQ ID NO: 140012 - DNA, 20 bp, Artificial Sequence
  Description of Artificial Sequence: Synthetic oligonucleotide
  Target: ATXN1; (+) strand; PAM type: NRG; PAM sequence: AGG
tcttgggatcttttcttccc

SEQ ID NO: 140013 - DNA, 20 bp, Artificial Sequence
  Description of Artificial Sequence: Synthetic oligonucleotide
  Target: ATXN1; (+) strand; PAM type: NRG; PAM sequence: TAG
gatcttttcttcccaggtca

SEQ ID NO: 140014 - DNA, 20 bp, Artificial Sequence
  Description of Artificial Sequence: Synthetic oligonucleotide
  Target: ATXN1; (+) strand; PAM type: NRG; PAM sequence: CAG
cttttcttcccaggtcatag

SEQ ID NO: 140015 - DNA, 20 bp, Artificial Sequence
  Description of Artificial Sequence: Synthetic oligonucleotide
  Target: ATXN1; (+) strand; PAM type: NRG; PAM sequence: CAG
tcatagcagtgctgtttcaa

SEQ ID NO: 140016 - DNA, 20 bp, Artificial Sequence
  Description of Artificial Sequence: Synthetic oligonucleotide
  Target: ATXN1; (+) strand; PAM type: NRG; PAM sequence: AGG
catagcagtgctgtttcaac

SEQ ID NO: 140017 - DNA, 20 bp, Artificial Sequence
  Description of Artificial Sequence: Synthetic oligonucleotide
  Target: ATXN1; (+) strand; PAM type: NRG; PAM sequence: TAG
tgtttcaacaggaaatgtca

SEQ ID NO: 140018 - DNA, 20 bp, Artificial Sequence
  Description of Artificial Sequence: Synthetic oligonucleotide
  Target: ATXN1; (+) strand; PAM type: NRG; PAM sequence: CAG
aaatgtcatagcttgaatgc

SEQ ID NO: 140019 - DNA, 20 bp, Artificial Sequence
  Description of Artificial Sequence: Synthetic oligonucleotide
  Target: ATXN1; (+) strand; PAM type: NRG; PAM sequence: AGG
aatgtcatagcttgaatgcc

SEQ ID NO: 140020 - DNA, 20 bp, Artificial Sequence
  Description of Artificial Sequence: Synthetic oligonucleotide
  Target: ATXN1; (+) strand; PAM type: NRG; PAM sequence: TAG
aaaaataatctaaactaaat

SEQ ID NO: 140021 - DNA, 20 bp, Artificial Sequence
  Description of Artificial Sequence: Synthetic oligonucleotide
  Target: ATXN1; (+) strand; PAM type: NRG; PAM sequence: CGG
ttagcttttacacctaacga

SEQ ID NO: 140022 - DNA, 20 bp, Artificial Sequence
  Description of Artificial Sequence: Synthetic oligonucleotide
  Target: ATXN1; (+) strand; PAM type: NRG; PAM sequence: TGG
ttttacacctaacgacggcc

SEQ ID NO: 140023 - DNA, 20 bp, Artificial Sequence
  Description of Artificial Sequence: Synthetic oligonucleotide
  Target: ATXN1; (+) strand; PAM type: NRG; PAM sequence: GGG
tttacacctaacgacggcct

SEQ ID NO: 140024 - DNA, 20 bp, Artificial Sequence
  Description of Artificial Sequence: Synthetic oligonucleotide
  Target: ATXN1; (+) strand; PAM type: NRG; PAM sequence: AAG
acgacggcctgggaataata

SEQ ID NO: 140025 - DNA, 20 bp, Artificial Sequence
  Description of Artificial Sequence: Synthetic oligonucleotide
  Target: ATXN1; (+) strand; PAM type: NRG; PAM sequence: AGG
cgacggcctgggaataataa

SEQ ID NO: 140026 - DNA, 20 bp, Artificial Sequence
  Description of Artificial Sequence: Synthetic oligonucleotide
  Target: ATXN1; (+) strand; PAM type: NRG; PAM sequence: AAG
aataaaggaactctttgaaa

SEQ ID NO: 140027 - DNA, 20 bp, Artificial Sequence
  Description of Artificial Sequence: Synthetic oligonucleotide
  Target: ATXN1; (+) strand; PAM type: NRG; PAM sequence: AGG
ataaaggaactctttgaaaa

SEQ ID NO: 140028 - DNA, 20 bp, Artificial Sequence
  Description of Artificial Sequence: Synthetic oligonucleotide
  Target: ATXN1; (+) strand; PAM type: NRG; PAM sequence: AAG
aaggaactctttgaaaaagg

SEQ ID NO: 140029 - DNA, 20 bp, Artificial Sequence
  Description of Artificial Sequence: Synthetic oligonucleotide
  Target: ATXN1; (+) strand; PAM type: NRG; PAM sequence: AAG
aactctttgaaaaaggaaga

SEQ ID NO: 140030 - DNA, 20 bp, Artificial Sequence
  Description of Artificial Sequence: Synthetic oligonucleotide
  Target: ATXN1; (+) strand; PAM type: NRG; PAM sequence: TGG
tctttgaaaaaggaagaaag

SEQ ID NO: 140031 - DNA, 20 bp, Artificial Sequence
  Description of Artificial Sequence: Synthetic oligonucleotide
  Target: ATXN1; (+) strand; PAM type: NRG; PAM sequence: GAG
tttgaaaaaggaagaaagtg

SEQ ID NO: 140032 - DNA, 20 bp, Artificial Sequence
  Description of Artificial Sequence: Synthetic oligonucleotide
  Target: ATXN1; (+) strand; PAM type: NRG; PAM sequence: TAG
aaaggaagaaagtggagaaa

SEQ ID NO: 140033 - DNA, 20 bp, Artificial Sequence
  Description of Artificial Sequence: Synthetic oligonucleotide
  Target: ATXN1; (+) strand; PAM type: NRG; PAM sequence: AGG
aaggaagaaagtggagaaat

SEQ ID NO: 140034 - DNA, 20 bp, Artificial Sequence
  Description of Artificial Sequence: Synthetic oligonucleotide
  Target: ATXN1; (+) strand; PAM type: NRG; PAM sequence: TGG
taggaacacttttacactgt

SEQ ID NO: 140035 - DNA, 20 bp, Artificial Sequence
  Description of Artificial Sequence: Synthetic oligonucleotide
  Target: ATXN1; (+) strand; PAM type: NRG; PAM sequence: TGG
gaacacttttacactgttgg

SEQ ID NO: 140036 - DNA, 20 bp, Artificial Sequence
  Description of Artificial Sequence: Synthetic oligonucleotide
  Target: ATXN1; (+) strand; PAM type: NRG; PAM sequence: GGG
aacacttttacactgttggt

SEQ ID NO: 140037 - DNA, 20 bp, Artificial Sequence
  Description of Artificial Sequence: Synthetic oligonucleotide
  Target: ATXN1; (+) strand; PAM type: NRG; PAM sequence: TAG
ctgttggtgggcctgcaaac

SEQ ID NO: 140038 - DNA, 20 bp, Artificial Sequence
  Description of Artificial Sequence: Synthetic oligonucleotide
  Target: ATXN1; (+) strand; PAM type: NRG; PAM sequence: TGG
gcaaactagttcaaccattg

SEQ ID NO: 140039 - DNA, 20 bp, Artificial Sequence
  Description of Artificial Sequence: Synthetic oligonucleotide
  Target: ATXN1; (+) strand; PAM type: NRG; PAM sequence: AAG
aactagttcaaccattgtgg

SEQ ID NO: 140040 - DNA, 20 bp, Artificial Sequence
  Description of Artificial Sequence: Synthetic oligonucleotide
  Target: ATXN1; (+) strand; PAM type: NRG; PAM sequence: CAG
agttcaaccattgtggaaga

SEQ ID NO: 140041 - DNA, 20 bp, Artificial Sequence
  Description of Artificial Sequence: Synthetic oligonucleotide
  Target: ATXN1; (+) strand; PAM type: NRG; PAM sequence: TGG
aaccattgtggaagacagtg

SEQ ID NO: 140042 - DNA, 20 bp, Artificial Sequence
  Description of Artificial Sequence: Synthetic oligonucleotide
  Target: ATXN1; (+) strand; PAM type: NRG; PAM sequence: AAG
agacagtgtggcgattcctc

SEQ ID NO: 140043 - DNA, 20 bp, Artificial Sequence
  Description of Artificial Sequence: Synthetic oligonucleotide
  Target: ATXN1; (+) strand; PAM type: NRG; PAM sequence: AGG
gacagtgtggcgattcctca

SEQ ID NO: 140044 - DNA, 20 bp, Artificial Sequence
  Description of Artificial Sequence: Synthetic oligonucleotide
  Target: ATXN1; (+) strand; PAM type: NRG; PAM sequence: TAG
gtggcgattcctcaaggatc

SEQ ID NO: 140045 - DNA, 20 bp, Artificial Sequence
  Description of Artificial Sequence: Synthetic oligonucleotide
  Target: ATXN1; (+) strand; PAM type: NRG; PAM sequence: TAG
attcctcaaggatctagaac

SEQ ID NO: 140046 - DNA, 20 bp, Artificial Sequence
  Description of Artificial Sequence: Synthetic oligonucleotide
  Target: ATXN1; (+) strand; PAM type: NRG; PAM sequence: CAG
actagaaataccatttgacc

SEQ ID NO: 140047 - DNA, 20 bp, Artificial Sequence
  Description of Artificial Sequence: Synthetic oligonucleotide
  Target: ATXN1; (+) strand; PAM type: NRG; PAM sequence: TGG
tgacccagccatcccattac

SEQ ID NO: 140048 - DNA, 20 bp, Artificial Sequence
  Description of Artificial Sequence: Synthetic oligonucleotide
  Target: ATXN1; (+) strand; PAM type: NRG; PAM sequence: GGG
gacccagccatcccattact

SEQ ID NO: 140049 - DNA, 20 bp, Artificial Sequence
  Description of Artificial Sequence: Synthetic oligonucleotide
  Target: ATXN1; (+) strand; PAM type: NRG; PAM sequence: GGG
acccagccatcccattactg

SEQ ID NO: 140050 - DNA, 20 bp, Artificial Sequence
  Description of Artificial Sequence: Synthetic oligonucleotide
  Target: ATXN1; (+) strand; PAM type: NRG; PAM sequence: AAG
cattactggggatataccca

SEQ ID NO: 140051 - DNA, 20 bp, Artificial Sequence
  Description of Artificial Sequence: Synthetic oligonucleotide
  Target: ATXN1; (+) strand; PAM type: NRG; PAM sequence: AGG
attactggggatatacccaa

SEQ ID NO: 140052 - DNA, 20 bp, Artificial Sequence
  Description of Artificial Sequence: Synthetic oligonucleotide
  Target: ATXN1; (+) strand; PAM type: NRG; PAM sequence: AAG
ttataaatcatgctgctata

SEQ ID NO: 140053 - DNA, 20 bp, Artificial Sequence
  Description of Artificial Sequence: Synthetic oligonucleotide
  Target: ATXN1; (+) strand; PAM type: NRG; PAM sequence: AGG
tataaatcatgctgctataa

SEQ ID NO: 140054 - DNA, 20 bp, Artificial Sequence
  Description of Artificial Sequence: Synthetic oligonucleotide
  Target: ATXN1; (+) strand; PAM type: NRG; PAM sequence: CGG
atgcgcacgtatgtttattg

SEQ ID NO: 140055 - DNA, 20 bp, Artificial Sequence
  Description of Artificial Sequence: Synthetic oligonucleotide
  Target: ATXN1; (+) strand; PAM type: NRG; PAM sequence: TAG
tattgcggcactattcacaa

SEQ ID NO: 140056 - DNA, 20 bp, Artificial Sequence
  Description of Artificial Sequence: Synthetic oligonucleotide
  Target: ATXN1; (+) strand; PAM type: NRG; PAM sequence: AAG
cggcactattcacaatagca

SEQ ID NO: 140057 - DNA, 20 bp, Artificial Sequence
  Description of Artificial Sequence: Synthetic oligonucleotide
  Target: ATXN1; (+) strand; PAM type: NRG; PAM sequence: TGG
tattcacaatagcaaagact

SEQ ID NO: 140058 - DNA, 20 bp, Artificial Sequence
  Description of Artificial Sequence: Synthetic oligonucleotide
  Target: ATXN1; (+) strand; PAM type: NRG; PAM sequence: TAG
acccaaatgtccatcaatga

SEQ ID NO: 140059 - DNA, 20 bp, Artificial Sequence
  Description of Artificial Sequence: Synthetic oligonucleotide
  Target: ATXN1; (+) strand; PAM type: NRG; PAM sequence: TGG
aatgtccatcaatgatagac

SEQ ID NO: 140060 - DNA, 20 bp, Artificial Sequence
  Description of Artificial Sequence: Synthetic oligonucleotide
  Target: ATXN1; (+) strand; PAM type: NRG; PAM sequence: AAG
catcaatgatagactggatt

SEQ ID NO: 140061 - DNA, 20 bp, Artificial Sequence
  Description of Artificial Sequence: Synthetic oligonucleotide
  Target: ATXN1; (+) strand; PAM type: NRG; PAM sequence: TGG
tagactggattaagaaaatg

SEQ ID NO: 140062 - DNA, 20 bp, Artificial Sequence
  Description of Artificial Sequence: Synthetic oligonucleotide
  Target: ATXN1; (+) strand; PAM type: NRG; PAM sequence: TGG
aatgtggcacatatacacca

SEQ ID NO: 140063 - DNA, 20 bp, Artificial Sequence
  Description of Artificial Sequence: Synthetic oligonucleotide
  Target: ATXN1; (+) strand; PAM type: NRG; PAM sequence: TAG
atacaccatggaatactatg

SEQ ID NO: 140064 - DNA, 20 bp, Artificial Sequence
  Description of Artificial Sequence: Synthetic oligonucleotide
  Target: ATXN1; (+) strand; PAM type: NRG; PAM sequence: AAG
aatactatgtagccataaaa

SEQ ID NO: 140065 - DNA, 20 bp, Artificial Sequence
  Description of Artificial Sequence: Synthetic oligonucleotide
  Target: ATXN1; (+) strand; PAM type: NRG; PAM sequence: AGG
atactatgtagccataaaaa

SEQ ID NO: 140066 - DNA, 20 bp, Artificial Sequence
  Description of Artificial Sequence: Synthetic oligonucleotide
  Target: ATXN1; (+) strand; PAM type: NRG; PAM sequence: GAG
atgtagccataaaaaaggat

SEQ ID NO: 140067 - DNA, 20 bp, Artificial Sequence
  Description of Artificial Sequence: Synthetic oligonucleotide
  Target: ATXN1; (+) strand; PAM type: NRG; PAM sequence: TGG
gatgagttcatgtcctttgt

SEQ ID NO: 140068 - DNA, 20 bp, Artificial Sequence
  Description of Artificial Sequence: Synthetic oligonucleotide
  Target: ATXN1; (+) strand; PAM type: NRG; PAM sequence: GGG
atgagttcatgtcctttgtt

SEQ ID NO: 140069 - DNA, 20 bp, Artificial Sequence
  Description of Artificial Sequence: Synthetic oligonucleotide
  Target: ATXN1; (+) strand; PAM type: NRG; PAM sequence: TGG
tcatgtcctttgttgggaca

SEQ ID NO: 140070 - DNA, 20 bp, Artificial Sequence
  Description of Artificial Sequence: Synthetic oligonucleotide
  Target: ATXN1; (+) strand; PAM type: NRG; PAM sequence: AAG
cctttgttgggacatggatg

SEQ ID NO: 140071 - DNA, 20 bp, Artificial Sequence
  Description of Artificial Sequence: Synthetic oligonucleotide
  Target: ATXN1; (+) strand; PAM type: NRG; PAM sequence: TGG
tgttgggacatggatgaagc

SEQ ID NO: 140072 - DNA, 20 bp, Artificial Sequence
  Description of Artificial Sequence: Synthetic oligonucleotide
  Target: ATXN1; (+) strand; PAM type: NRG; PAM sequence: CAG
aagctggaaaccatcattct

SEQ ID NO: 140073 - DNA, 20 bp, Artificial Sequence
  Description of Artificial Sequence: Synthetic oligonucleotide
  Target: ATXN1; (+) strand; PAM type: NRG; PAM sequence: AAG
cattctcagcaaattatcgc

SEQ ID NO: 140074 - DNA, 20 bp, Artificial Sequence
  Description of Artificial Sequence: Synthetic oligonucleotide
  Target: ATXN1; (+) strand; PAM type: NRG; PAM sequence: AGG
attctcagcaaattatcgca

SEQ ID NO: 140075 - DNA, 20 bp, Artificial Sequence
  Description of Artificial Sequence: Synthetic oligonucleotide
  Target: ATXN1; (+) strand; PAM type: NRG; PAM sequence: TAG
acaccgcatgttctcactca

SEQ ID NO: 140076 - DNA, 20 bp, Artificial Sequence
  Description of Artificial Sequence: Synthetic oligonucleotide
  Target: ATXN1; (+) strand; PAM type: NRG; PAM sequence: AGG
caccgcatgttctcactcat

SEQ ID NO: 140077 - DNA, 20 bp, Artificial Sequence
  Description of Artificial Sequence: Synthetic oligonucleotide
  Target: ATXN1; (+) strand; PAM type: NRG; PAM sequence: TGG
cgcatgttctcactcatagg

SEQ ID NO: 140078 - DNA, 20 bp, Artificial Sequence
  Description of Artificial Sequence: Synthetic oligonucleotide
  Target: ATXN1; (+) strand; PAM type: NRG; PAM sequence: GGG
gcatgttctcactcataggt

SEQ ID NO: 140079 - DNA, 20 bp, Artificial Sequence
  Description of Artificial Sequence: Synthetic oligonucleotide
  Target: ATXN1; (+) strand; PAM type: NRG; PAM sequence: GAG
ataggtgggaattgaacaat

SEQ ID NO: 140080 - DNA, 20 bp, Artificial Sequence
  Description of Artificial Sequence: Synthetic oligonucleotide
  Target: ATXN1; (+) strand; PAM type: NRG; PAM sequence: TGG
aattgaacaatgagaacact

SEQ ID NO: 140081 - DNA, 20 bp, Artificial Sequence
  Description of Artificial Sequence: Synthetic oligonucleotide
  Target: ATXN1; (+) strand; PAM type: NRG; PAM sequence: CAG
acaatgagaacacttggtca

SEQ ID NO: 140082 - DNA, 20 bp, Artificial Sequence
  Description of Artificial Sequence: Synthetic oligonucleotide
  Target: ATXN1; (+) strand; PAM type: NRG; PAM sequence: AGG
caatgagaacacttggtcac

SEQ ID NO: 140083 - DNA, 20 bp, Artificial Sequence
  Description of Artificial Sequence: Synthetic oligonucleotide
  Target: ATXN1; (+) strand; PAM type: NRG; PAM sequence: AAG
tgagaacacttggtcacagg

SEQ ID NO: 140084 - DNA, 20 bp, Artificial Sequence
  Description of Artificial Sequence: Synthetic oligonucleotide
  Target: ATXN1; (+) strand; PAM type: NRG; PAM sequence: AGG
gagaacacttggtcacagga

SEQ ID NO: 140085 - DNA, 20 bp, Artificial Sequence
  Description of Artificial Sequence: Synthetic oligonucleotide
  Target: ATXN1; (+) strand; PAM type: NRG; PAM sequence: GGG
agaacacttggtcacaggaa

SEQ ID NO: 140086 - DNA, 20 bp, Artificial Sequence
  Description of Artificial Sequence: Synthetic oligonucleotide
  Target: ATXN1; (+) strand; PAM type: NRG; PAM sequence: GGG
gaacacttggtcacaggaag

SEQ ID NO: 140087 - DNA, 20 bp, Artificial Sequence
  Description of Artificial Sequence: Synthetic oligonucleotide
  Target: ATXN1; (+) strand; PAM type: NRG; PAM sequence: CGG
ggaaggggaacatcgcacac

SEQ ID NO: 140088 - DNA, 20 bp, Artificial Sequence
  Description of Artificial Sequence: Synthetic oligonucleotide
  Target: ATXN1; (+) strand; PAM type: NRG; PAM sequence: GGG
gaaggggaacatcgcacacc

SEQ ID NO: 140089 - DNA, 20 bp, Artificial Sequence
  Description of Artificial Sequence: Synthetic oligonucleotide
  Target: ATXN1; (+) strand; PAM type: NRG; PAM sequence: GGG
aaggggaacatcgcacaccg

SEQ ID NO: 140090 - DNA, 20 bp, Artificial Sequence
  Description of Artificial Sequence: Synthetic oligonucleotide
  Target: ATXN1; (+) strand; PAM type: NRG; PAM sequence: TGG
tcgcacaccggggcctgtca

SEQ ID NO: 140091 - DNA, 20 bp, Artificial Sequence
  Description of Artificial Sequence: Synthetic oligonucleotide
  Target: ATXN1; (+) strand; PAM type: NRG; PAM sequence: GAG
gcacaccggggcctgtcatg

SEQ ID NO: 140092 - DNA, 20 bp, Artificial Sequence
  Description of Artificial Sequence: Synthetic oligonucleotide
  Target: ATXN1; (+) strand; PAM type: NRG; PAM sequence: TGG
caccggggcctgtcatggag

SEQ ID NO: 140093 - DNA, 20 bp, Artificial Sequence
  Description of Artificial Sequence: Synthetic oligonucleotide
  Target: ATXN1; (+) strand; PAM type: NRG; PAM sequence: GGG
accggggcctgtcatggagt

SEQ ID NO: 140094 - DNA, 20 bp, Artificial Sequence
  Description of Artificial Sequence: Synthetic oligonucleotide
  Target: ATXN1; (+) strand; PAM type: NRG; PAM sequence: GGG
ccggggcctgtcatggagtg

SEQ ID NO: 140095 - DNA, 20 bp, Artificial Sequence
  Description of Artificial Sequence: Synthetic oligonucleotide
  Target: ATXN1; (+) strand; PAM type: NRG; PAM sequence: GGG
cggggcctgtcatggagtgg

SEQ ID NO: 140096 - DNA, 20 bp, Artificial Sequence
  Description of Artificial Sequence: Synthetic oligonucleotide
  Target: ATXN1; (+) strand; PAM type: NRG; PAM sequence: GGG
ggggcctgtcatggagtggg

SEQ ID NO: 140097 - DNA, 20 bp, Artificial Sequence
  Description of Artificial Sequence: Synthetic oligonucleotide
  Target: ATXN1; (+) strand; PAM type: NRG; PAM sequence: GAG
ggcctgtcatggagtggggg

SEQ ID NO: 140098 - DNA, 20 bp, Artificial Sequence
  Description of Artificial Sequence: Synthetic oligonucleotide
  Target: ATXN1; (+) strand; PAM type: NRG; PAM sequence: AGG
gcctgtcatggagtgggggg

SEQ ID NO: 140099 - DNA, 20 bp, Artificial Sequence
  Description of Artificial Sequence: Synthetic oligonucleotide
  Target: ATXN1; (+) strand; PAM type: NRG; PAM sequence: GGG
cctgtcatggagtgggggga

SEQ ID NO: 140100 - DNA, 20 bp, Artificial Sequence
  Description of Artificial Sequence: Synthetic oligonucleotide
  Target: ATXN1; (+) strand; PAM type: NRG; PAM sequence: GGG
ctgtcatggagtggggggag

SEQ ID NO: 140101 - DNA, 20 bp, Artificial Sequence
  Description of Artificial Sequence: Synthetic oligonucleotide
  Target: ATXN1; (+) strand; PAM type: NRG; PAM sequence: GGG
tgtcatggagtggggggagg

SEQ ID NO: 140102 - DNA, 20 bp, Artificial Sequence
  Description of Artificial Sequence: Synthetic oligonucleotide
  Target: ATXN1; (+) strand; PAM type: NRG; PAM sequence: GGG
gtcatggagtggggggaggg

SEQ ID NO: 140103 - DNA, 20 bp, Artificial Sequence
  Description of Artificial Sequence: Synthetic oligonucleotide
  Target: ATXN1; (+) strand; PAM type: NRG; PAM sequence: GAG
catggagtggggggaggggg

SEQ ID NO: 140104 - DNA, 20 bp, Artificial Sequence
  Description of Artificial Sequence: Synthetic oligonucleotide
  Target: ATXN1; (+) strand; PAM type: NRG; PAM sequence: AGG
atggagtggggggagggggg

SEQ ID NO: 140105 - DNA, 20 bp, Artificial Sequence
  Description of Artificial Sequence: Synthetic oligonucleotide
  Target: ATXN1; (+) strand; PAM type: NRG; PAM sequence: GGG
tggagtggggggagggggga

SEQ ID NO: 140106 - DNA, 20 bp, Artificial Sequence
  Description of Artificial Sequence: Synthetic oligonucleotide
  Target: ATXN1; (+) strand; PAM type: NRG; PAM sequence: AAG
gtggggggaggggggaggga

SEQ ID NO: 140107 - DNA, 20 bp, Artificial Sequence
  Description of Artificial Sequence: Synthetic oligonucleotide
  Target: ATXN1; (+) strand; PAM type: NRG; PAM sequence: TAG
ggaggggggagggaaagctt

SEQ ID NO: 140108 - DNA, 20 bp, Artificial Sequence
  Description of Artificial Sequence: Synthetic oligonucleotide
  Target: ATXN1; (+) strand; PAM type: NRG; PAM sequence: AGG
gaggggggagggaaagcttt

SEQ ID NO: 140109 - DNA, 20 bp, Artificial Sequence
  Description of Artificial Sequence: Synthetic oligonucleotide
  Target: ATXN1; (+) strand; PAM type: NRG; PAM sequence: GAG
ggggggagggaaagctttag

SEQ ID NO: 140110 - DNA, 20 bp, Artificial Sequence
  Description of Artificial Sequence: Synthetic oligonucleotide
  Target: ATXN1; (+) strand; PAM type: NRG; PAM sequence: GAG
atatacctaatgtaaatgat

SEQ ID NO: 140111 - DNA, 20 bp, Artificial Sequence
  Description of Artificial Sequence: Synthetic oligonucleotide
  Target: ATXN1; (+) strand; PAM type: NRG; PAM sequence: TGG
taatgtaaatgatgagttaa

SEQ ID NO: 140112 - DNA, 20 bp, Artificial Sequence
  Description of Artificial Sequence: Synthetic oligonucleotide
  Target: ATXN1; (+) strand; PAM type: NRG; PAM sequence: GGG
aatgtaaatgatgagttaat

SEQ ID NO: 140113 - DNA, 20 bp, Artificial Sequence
  Description of Artificial Sequence: Synthetic oligonucleotide
  Target: ATXN1; (+) strand; PAM type: NRG; PAM sequence: CAG
aaatgatgagttaatgggtg

SEQ ID NO: 140114 - DNA, 20 bp, Artificial Sequence
  Description of Artificial Sequence: Synthetic oligonucleotide
  Target: ATXN1; (+) strand; PAM type: NRG; PAM sequence: TAG
cacattgtgcacatgtaccc

SEQ ID NO: 140115 - DNA, 20 bp, Artificial Sequence
  Description of Artificial Sequence: Synthetic oligonucleotide
  Target: ATXN1; (+) strand; PAM type: NRG; PAM sequence: AAG
cacatgtaccctagaactta

SEQ ID NO: 140116 - DNA, 20 bp, Artificial Sequence
  Description of Artificial Sequence: Synthetic oligonucleotide
  Target: ATXN1; (+) strand; PAM type: NRG; PAM sequence: AAG
taaataaaataaaataaaaa

SEQ ID NO: 140117 - DNA, 20 bp, Artificial Sequence
  Description of Artificial Sequence: Synthetic oligonucleotide
  Target: ATXN1; (+) strand; PAM type: NRG; PAM sequence: AAG
aaataaaataaaaaaagaaa

SEQ ID NO: 140118 - DNA, 20 bp, Artificial Sequence
  Description of Artificial Sequence: Synthetic oligonucleotide
  Target: ATXN1; (+) strand; PAM type: NRG; PAM sequence: AGG
aataaaataaaaaaagaaaa

SEQ ID NO: 140119 - DNA, 20 bp, Artificial Sequence
  Description of Artificial Sequence: Synthetic oligonucleotide
  Target: ATXN1; (+) strand; PAM type: NRG; PAM sequence: AAG
aaaataaaaaaagaaaaagg

SEQ ID NO: 140120 - DNA, 20 bp, Artificial Sequence
  Description of Artificial Sequence: Synthetic oligonucleotide
  Target: ATXN1; (+) strand; PAM type: NRG; PAM sequence: AAG
taaaaaaagaaaaaggaaga

SEQ ID NO: 140121 - DNA, 20 bp, Artificial Sequence
  Description of Artificial Sequence: Synthetic oligonucleotide
  Target: ATXN1; (+) strand; PAM type: NRG; PAM sequence: GAG
aaggaagaaagaaactaatt

SEQ ID NO: 140122 - DNA, 20 bp, Artificial Sequence
  Description of Artificial Sequence: Synthetic oligonucleotide
  Target: ATXN1; (+) strand; PAM type: NRG; PAM sequence: TAG
aagaaactaattgagcacac

SEQ ID NO: 140123 - DNA, 20 bp, Artificial Sequence
  Description of Artificial Sequence: Synthetic oligonucleotide
  Target: ATXN1; (+) strand; PAM type: NRG; PAM sequence: AAG
aaactaattgagcacactag

SEQ ID NO: 140124 - DNA, 20 bp, Artificial Sequence
  Description of Artificial Sequence: Synthetic oligonucleotide
  Target: ATXN1; (+) strand; PAM type: NRG; PAM sequence: CAG
ttgagcacactagaagtcaa

SEQ ID NO: 140125 - DNA, 20 bp, Artificial Sequence
  Description of Artificial Sequence: Synthetic oligonucleotide
  Target: ATXN1; (+) strand; PAM type: NRG; PAM sequence: TAG
tcaacagctgtttctccaat

SEQ ID NO: 140126 - DNA, 20 bp, Artificial Sequence
  Description of Artificial Sequence: Synthetic oligonucleotide
  Target: ATXN1; (+) strand; PAM type: NRG; PAM sequence: GAG
aacagctgtttctccaatta

SEQ ID NO: 140127 - DNA, 20 bp, Artificial Sequence
  Description of Artificial Sequence: Synthetic oligonucleotide
  Target: ATXN1; (+) strand; PAM type: NRG; PAM sequence: AAG
caattagagtcacctataac

SEQ ID NO: 140128 - DNA, 20 bp, Artificial Sequence
  Description of Artificial Sequence: Synthetic oligonucleotide
  Target: ATXN1; (+) strand; PAM type: NRG; PAM sequence: TAG
acctataacaagtgaattct

SEQ ID NO: 140129 - DNA, 20 bp, Artificial Sequence
  Description of Artificial Sequence: Synthetic oligonucleotide
  Target: ATXN1; (+) strand; PAM type: NRG; PAM sequence: CAG
tataacaagtgaattcttag

SEQ ID NO: 140130 - DNA, 20 bp, Artificial Sequence
  Description of Artificial Sequence: Synthetic oligonucleotide
  Target: ATXN1; (+) strand; PAM type: NRG; PAM sequence: AGG
ataacaagtgaattcttagc

SEQ ID NO: 140131 - DNA, 20 bp, Artificial Sequence
  Description of Artificial Sequence: Synthetic oligonucleotide
  Target: ATXN1; (+) strand; PAM type: NRG; PAM sequence: GGG
taacaagtgaattcttagca

SEQ ID NO: 140132 - DNA, 20 bp, Artificial Sequence
  Description of Artificial Sequence: Synthetic oligonucleotide
  Target: ATXN1; (+) strand; PAM type: NRG; PAM sequence: GAG
caccttaaaatatccatgtc

SEQ ID NO: 140133 - DNA, 20 bp, Artificial Sequence
  Description of Artificial Sequence: Synthetic oligonucleotide
  Target: ATXN1; (+) strand; PAM type: NRG; PAM sequence: TAG
ttaaaatatccatgtcgagt

SEQ ID NO: 140134 - DNA, 20 bp, Artificial Sequence
  Description of Artificial Sequence: Synthetic oligonucleotide
  Target: ATXN1; (+) strand; PAM type: NRG; PAM sequence: AGG
taaaatatccatgtcgagtt

SEQ ID NO: 140135 - DNA, 20 bp, Artificial Sequence
  Description of Artificial Sequence: Synthetic oligonucleotide
  Target: ATXN1; (+) strand; PAM type: NRG; PAM sequence: TAG
ggaaaaaatgtttcataaaa

SEQ ID NO: 140136 - DNA, 20 bp, Artificial Sequence
  Description of Artificial Sequence: Synthetic oligonucleotide
  Target: ATXN1; (+) strand; PAM type: NRG; PAM sequence: TGG
ttaaattaattttcttgaat

SEQ ID NO: 140137 - DNA, 20 bp, Artificial Sequence
  Description of Artificial Sequence: Synthetic oligonucleotide
  Target: ATXN1; (+) strand; PAM type: NRG; PAM sequence: TGG
ttaattttcttgaattggca

SEQ ID NO: 140138 - DNA, 20 bp, Artificial Sequence
  Description of Artificial Sequence: Synthetic oligonucleotide
  Target: ATXN1; (+) strand; PAM type: NRG; PAM sequence: GGG
taattttcttgaattggcat

SEQ ID NO: 140139 - DNA, 20 bp, Artificial Sequence
  Description of Artificial Sequence: Synthetic oligonucleotide
  Target: ATXN1; (+) strand; PAM type: NRG; PAM sequence: AAG
ttcttgaattggcatgggac

SEQ ID NO: 140140 - DNA, 20 bp, Artificial Sequence
  Description of Artificial Sequence: Synthetic oligonucleotide
  Target: ATXN1; (+) strand; PAM type: NRG; PAM sequence: AAG
ttgaattggcatgggacaag

SEQ ID NO: 140141 - DNA, 20 bp, Artificial Sequence
  Description of Artificial Sequence: Synthetic oligonucleotide
  Target: ATXN1; (+) strand; PAM type: NRG; PAM sequence: TAG
gcatgggacaagaagctata

SEQ ID NO: 140142 - DNA, 20 bp, Artificial Sequence
  Description of Artificial Sequence: Synthetic oligonucleotide
  Target: ATXN1; (+) strand; PAM type: NRG; PAM sequence: CAG
ggacaagaagctatatagtt

SEQ ID NO: 140143 - DNA, 20 bp, Artificial Sequence
  Description of Artificial Sequence: Synthetic oligonucleotide
  Target: ATXN1; (+) strand; PAM type: NRG; PAM sequence: CAG
taaaaaactctgatatacta

SEQ ID NO: 140144 - DNA, 20 bp, Artificial Sequence
  Description of Artificial Sequence: Synthetic oligonucleotide
  Target: ATXN1; (+) strand; PAM type: NRG; PAM sequence: CAG
ctgatatactacagctacgc

SEQ ID NO: 140145 - DNA, 20 bp, Artificial Sequence
  Description of Artificial Sequence: Synthetic oligonucleotide
  Target: ATXN1; (+) strand; PAM type: NRG; PAM sequence: AGG
tgatatactacagctacgcc

SEQ ID NO: 140146 - DNA, 20 bp, Artificial Sequence
  Description of Artificial Sequence: Synthetic oligonucleotide
  Target: ATXN1; (+) strand; PAM type: NRG; PAM sequence: AAG
agctacgccaggcaaatcgc

SEQ ID NO: 140147 - DNA, 20 bp, Artificial Sequence
  Description of Artificial Sequence: Synthetic oligonucleotide
  Target: ATXN1; (+) strand; PAM type: NRG; PAM sequence: TGG
ccaggcaaatcgcaagttgt

SEQ ID NO: 140148 - DNA, 20 bp, Artificial Sequence
  Description of Artificial Sequence: Synthetic oligonucleotide
  Target: ATXN1; (+) strand; PAM type: NRG; PAM sequence: GGG
caggcaaatcgcaagttgtt

SEQ ID NO: 140149 - DNA, 20 bp, Artificial Sequence
  Description of Artificial Sequence: Synthetic oligonucleotide
  Target: ATXN1; (+) strand; PAM type: NRG; PAM sequence: GGG
aggcaaatcgcaagttgttg

SEQ ID NO: 140150 - DNA, 20 bp, Artificial Sequence
  Description of Artificial Sequence: Synthetic oligonucleotide
  Target: ATXN1; (+) strand; PAM type: NRG; PAM sequence: GGG
ggcaaatcgcaagttgttgg

SEQ ID NO: 140151 - DNA, 20 bp, Artificial Sequence
  Description of Artificial Sequence: Synthetic oligonucleotide
  Target: ATXN1; (+) strand; PAM type: NRG; PAM sequence: GGG
gcaaatcgcaagttgttggg

SEQ ID NO: 140152 - DNA, 20 bp, Artificial Sequence
  Description of Artificial Sequence: Synthetic oligonucleotide
  Target: ATXN1; (+) strand; PAM type: NRG; PAM sequence: CAG
agttgttggggggcgattcc

SEQ ID NO: 140153 - DNA, 20 bp, Artificial Sequence
  Description of Artificial Sequence: Synthetic oligonucleotide
  Target: ATXN1; (+) strand; PAM type: NRG; PAM sequence: CAG
gaatcacgattgtgactcat

SEQ ID NO: 140154 - DNA, 20 bp, Artificial Sequence
  Description of Artificial Sequence: Synthetic oligonucleotide
  Target: ATXN1; (+) strand; PAM type: NRG; PAM sequence: TGG
acgattgtgactcatcagtt

SEQ ID NO: 140155 - DNA, 20 bp, Artificial Sequence
  Description of Artificial Sequence: Synthetic oligonucleotide
  Target: ATXN1; (+) strand; PAM type: NRG; PAM sequence: GGG
cgattgtgactcatcagttt

SEQ ID NO: 140156 - DNA, 20 bp, Artificial Sequence
  Description of Artificial Sequence: Synthetic oligonucleotide
  Target: ATXN1; (+) strand; PAM type: NRG; PAM sequence: TAG
actcatcagtttgggaaatt

SEQ ID NO: 140157 - DNA, 20 bp, Artificial Sequence
  Description of Artificial Sequence: Synthetic oligonucleotide
  Target: ATXN1; (+) strand; PAM type: NRG; PAM sequence: AGG
ctcatcagtttgggaaattt

SEQ ID NO: 140158 - DNA, 20 bp, Artificial Sequence
  Description of Artificial Sequence: Synthetic oligonucleotide
  Target: ATXN1; (+) strand; PAM type: NRG; PAM sequence: CAG
atttaggacatgatcactat

SEQ ID NO: 140159 - DNA, 20 bp, Artificial Sequence
  Description of Artificial Sequence: Synthetic oligonucleotide
  Target: ATXN1; (+) strand; PAM type: NRG; PAM sequence: AAG
ttattatctgccaaatgtcc

SEQ ID NO: 140160 - DNA, 20 bp, Artificial Sequence
  Description of Artificial Sequence: Synthetic oligonucleotide
  Target: ATXN1; (+) strand; PAM type: NRG; PAM sequence: TGG
gtccaagatataaatttcct

SEQ ID NO: 140161 - DNA, 20 bp, Artificial Sequence
  Description of Artificial Sequence: Synthetic oligonucleotide
  Target: ATXN1; (+) strand; PAM type: NRG; PAM sequence: CAG
gatataaatttccttggaaa

SEQ ID NO: 140162 - DNA, 20 bp, Artificial Sequence
  Description of Artificial Sequence: Synthetic oligonucleotide
  Target: ATXN1; (+) strand; PAM type: NRG; PAM sequence: TGG
taaatttccttggaaacagc

SEQ ID NO: 140163 - DNA, 20 bp, Artificial Sequence
  Description of Artificial Sequence: Synthetic oligonucleotide
  Target: ATXN1; (+) strand; PAM type: NRG; PAM sequence: CAG
atttccttggaaacagctgg

SEQ ID NO: 140164 - DNA, 20 bp, Artificial Sequence
  Description of Artificial Sequence: Synthetic oligonucleotide
  Target: ATXN1; (+) strand; PAM type: NRG; PAM sequence: GAG
ttccttggaaacagctggca

SEQ ID NO: 140165 - DNA, 20 bp, Artificial Sequence
  Description of Artificial Sequence: Synthetic oligonucleotide
  Target: ATXN1; (+) strand; PAM type: NRG; PAM sequence: AGG
tccttggaaacagctggcag

SEQ ID NO: 140166 - DNA, 20 bp, Artificial Sequence
  Description of Artificial Sequence: Synthetic oligonucleotide
  Target: ATXN1; (+) strand; PAM type: NRG; PAM sequence: TAG
ttggaaacagctggcagagg

SEQ ID NO: 140167 - DNA, 20 bp, Artificial Sequence
  Description of Artificial Sequence: Synthetic oligonucleotide
  Target: ATXN1; (+) strand; PAM type: NRG; PAM sequence: AGG
tggaaacagctggcagaggt

SEQ ID NO: 140168 - DNA, 20 bp, Artificial Sequence
  Description of Artificial Sequence: Synthetic oligonucleotide
  Target: ATXN1; (+) strand; PAM type: NRG; PAM sequence: TAG
acagctggcagaggtaggca

SEQ ID NO: 140169 - DNA, 20 bp, Artificial Sequence
  Description of Artificial Sequence: Synthetic oligonucleotide
  Target: ATXN1; (+) strand; PAM type: NRG; PAM sequence: TGG
cctttaattttcctaatttg

SEQ ID NO: 140170 - DNA, 20 bp, Artificial Sequence
  Description of Artificial Sequence: Synthetic oligonucleotide
  Target: ATXN1; (+) strand; PAM type: NRG; PAM sequence: GGG
ctttaattttcctaatttgt

SEQ ID NO: 140171 - DNA, 20 bp, Artificial Sequence
  Description of Artificial Sequence: Synthetic oligonucleotide
  Target: ATXN1; (+) strand; PAM type: NRG; PAM sequence: TAG
aattttcctaatttgtgggc

SEQ ID NO: 140172 - DNA, 20 bp, Artificial Sequence
  Description of Artificial Sequence: Synthetic oligonucleotide
  Target: ATXN1; (+) strand; PAM type: NRG; PAM sequence: CAG
tttcctaatttgtgggctag

SEQ ID NO: 140173 - DNA, 20 bp, Artificial Sequence
  Description of Artificial Sequence: Synthetic oligonucleotide
  Target: ATXN1; (+) strand; PAM type: NRG; PAM sequence: TGG
ttgtgggctagcagattttt

SEQ ID NO: 140174 - DNA, 20 bp, Artificial Sequence
  Description of Artificial Sequence: Synthetic oligonucleotide
  Target: ATXN1; (+) strand; PAM type: NRG; PAM sequence: TAG
ttttttggaatttcacatac

SEQ ID NO: 140175 - DNA, 20 bp, Artificial Sequence
  Description of Artificial Sequence: Synthetic oligonucleotide
  Target: ATXN1; (+) strand; PAM type: NRG; PAM sequence: AAG
aatttcacatactagtatga

SEQ ID NO: 140176 - DNA, 20 bp, Artificial Sequence
  Description of Artificial Sequence: Synthetic oligonucleotide
  Target: ATXN1; (+) strand; PAM type: NRG; PAM sequence: GAG
tttcacatactagtatgaaa

SEQ ID NO: 140177 - DNA, 20 bp, Artificial Sequence
  Description of Artificial Sequence: Synthetic oligonucleotide
  Target: ATXN1; (+) strand; PAM type: NRG; PAM sequence: CAG
aattaatgcatacatatgca

SEQ ID NO: 140178 - DNA, 20 bp, Artificial Sequence
  Description of Artificial Sequence: Synthetic oligonucleotide
  Target: ATXN1; (+) strand; PAM type: NRG; PAM sequence: CAG
agtttaaacatattcataat

SEQ ID NO: 140179 - DNA, 20 bp, Artificial Sequence
  Description of Artificial Sequence: Synthetic oligonucleotide
  Target: ATXN1; (+) strand; PAM type: NRG; PAM sequence: AGG
gtttaaacatattcataatc

SEQ ID NO: 140180 - DNA, 20 bp, Artificial Sequence
  Description of Artificial Sequence: Synthetic oligonucleotide
  Target: ATXN1; (+) strand; PAM type: NRG; PAM sequence: GGG
tttaaacatattcataatca

SEQ ID NO: 140181 - DNA, 20 bp, Artificial Sequence
  Description of Artificial Sequence: Synthetic oligonucleotide
  Target: ATXN1; (+) strand; PAM type: NRG; PAM sequence: GGG
ttaaacatattcataatcag

SEQ ID NO: 140182 - DNA, 20 bp, Artificial Sequence
  Description of Artificial Sequence: Synthetic oligonucleotide
  Target: ATXN1; (+) strand; PAM type: NRG; PAM sequence: TGG
aacatattcataatcagggg

SEQ ID NO: 140183 - DNA, 20 bp, Artificial Sequence
  Description of Artificial Sequence: Synthetic oligonucleotide
  Target: ATXN1; (+) strand; PAM type: NRG; PAM sequence: CAG
ttcataatcaggggtggatc

SEQ ID NO: 140184 - DNA, 20 bp, Artificial Sequence
  Description of Artificial Sequence: Synthetic oligonucleotide
  Target: ATXN1; (+) strand; PAM type: NRG; PAM sequence: GAG
caggggtggatccagtctgt

SEQ ID NO: 140185 - DNA, 20 bp, Artificial Sequence
  Description of Artificial Sequence: Synthetic oligonucleotide
  Target: ATXN1; (+) strand; PAM type: NRG; PAM sequence: AGG
aggggtggatccagtctgtg

SEQ ID NO: 140186 - DNA, 20 bp, Artificial Sequence
  Description of Artificial Sequence: Synthetic oligonucleotide
  Target: ATXN1; (+) strand; PAM type: NRG; PAM sequence: CAG
gatccagtctgtgaggtctg

SEQ ID NO: 140187 - DNA, 20 bp, Artificial Sequence
  Description of Artificial Sequence: Synthetic oligonucleotide
  Target: ATXN1; (+) strand; PAM type: NRG; PAM sequence: TAG
aggtctgcagtttataaaac

SEQ ID NO: 140188 - DNA, 20 bp, Artificial Sequence
  Description of Artificial Sequence: Synthetic oligonucleotide
  Target: ATXN1; (+) strand; PAM type: NRG; PAM sequence: AAG
tgcagtttataaaactagtc

SEQ ID NO: 140189 - DNA, 20 bp, Artificial Sequence
  Description of Artificial Sequence: Synthetic oligonucleotide
  Target: ATXN1; (+) strand; PAM type: NRG; PAM sequence: AGG
gcagtttataaaactagtca

SEQ ID NO: 140190 - DNA, 20 bp, Artificial Sequence
  Description of Artificial Sequence: Synthetic oligonucleotide
  Target: ATXN1; (+) strand; PAM type: NRG; PAM sequence: GGG
cagtttataaaactagtcaa

SEQ ID NO: 140191 - DNA, 20 bp, Artificial Sequence
  Description of Artificial Sequence: Synthetic oligonucleotide
  Target: ATXN1; (+) strand; PAM type: NRG; PAM sequence: GGG
agtttataaaactagtcaag

SEQ ID NO: 140192 - DNA, 20 bp, Artificial Sequence
  Description of Artificial Sequence: Synthetic oligonucleotide
  Target: ATXN1; (+) strand; PAM type: NRG; PAM sequence: TAG
ttataaaactagtcaagggg

SEQ ID NO: 140193 - DNA, 20 bp, Artificial Sequence
  Description of Artificial Sequence: Synthetic oligonucleotide
  Target: ATXN1; (+) strand; PAM type: NRG; PAM sequence: GAG
ataaaactagtcaaggggta

SEQ ID NO: 140194 - DNA, 20 bp, Artificial Sequence
  Description of Artificial Sequence: Synthetic oligonucleotide
  Target: ATXN1; (+) strand; PAM type: NRG; PAM sequence: AGG
taaaactagtcaaggggtag

SEQ ID NO: 140195 - DNA, 20 bp, Artificial Sequence
  Description of Artificial Sequence: Synthetic oligonucleotide
  Target: ATXN1; (+) strand; PAM type: NRG; PAM sequence: GAG
aaactagtcaaggggtagag

SEQ ID NO: 140196 - DNA, 20 bp, Artificial Sequence
  Description of Artificial Sequence: Synthetic oligonucleotide
  Target: ATXN1; (+) strand; PAM type: NRG; PAM sequence: TGG
aaggggtagaggagtgtgta

SEQ ID NO: 140197 - DNA, 20 bp, Artificial Sequence
  Description of Artificial Sequence: Synthetic oligonucleotide
  Target: ATXN1; (+) strand; PAM type: NRG; PAM sequence: GGG
aggggtagaggagtgtgtat

SEQ ID NO: 140198 - DNA, 20 bp, Artificial Sequence
  Description of Artificial Sequence: Synthetic oligonucleotide
  Target: ATXN1; (+) strand; PAM type: NRG; PAM sequence: GGG
ggggtagaggagtgtgtatg

SEQ ID NO: 140199 - DNA, 20 bp, Artificial Sequence
  Description of Artificial Sequence: Synthetic oligonucleotide
  Target: ATXN1; (+) strand; PAM type: NRG; PAM sequence: TAG
gaggagtgtgtatggggtgt

SEQ ID NO: 140200 - DNA, 20 bp, Artificial Sequence
  Description of Artificial Sequence: Synthetic oligonucleotide
  Target: ATXN1; (+) strand; PAM type: NRG; PAM sequence: AGG
aggagtgtgtatggggtgtt

SEQ ID NO: 140201 - DNA, 20 bp, Artificial Sequence
  Description of Artificial Sequence: Synthetic oligonucleotide
  Target: ATXN1; (+) strand; PAM type: NRG; PAM sequence: GGG
ggagtgtgtatggggtgtta

SEQ ID NO: 140202 - DNA, 20 bp, Artificial Sequence
  Description of Artificial Sequence: Synthetic oligonucleotide
  Target: ATXN1; (+) strand; PAM type: NRG; PAM sequence: AAG
tatggggtgttagggtcttt

SEQ ID NO: 140203 - DNA, 20 bp, Artificial Sequence
  Description of Artificial Sequence: Synthetic oligonucleotide
  Target: ATXN1; (+) strand; PAM type: NRG; PAM sequence: AAG
ggtgttagggtctttaagaa

SEQ ID NO: 140204 - DNA, 20 bp, Artificial Sequence
  Description of Artificial Sequence: Synthetic oligonucleotide
  Target: ATXN1; (+) strand; PAM type: NRG; PAM sequence: AAG
gtctttaagaaaagatctca

SEQ ID NO: 140205 - DNA, 20 bp, Artificial Sequence
  Description of Artificial Sequence: Synthetic oligonucleotide
  Target: ATXN1; (+) strand; PAM type: NRG; PAM sequence: AGG
tctttaagaaaagatctcaa

SEQ ID NO: 140206 - DNA, 20 bp, Artificial Sequence
  Description of Artificial Sequence: Synthetic oligonucleotide
  Target: ATXN1; (+) strand; PAM type: NRG; PAM sequence: CAG
taagaaaagatctcaaaggc

SEQ ID NO: 140207 - DNA, 20 bp, Artificial Sequence
  Description of Artificial Sequence: Synthetic oligonucleotide
  Target: ATXN1; (+) strand; PAM type: NRG; PAM sequence: TGG
aagatctcaaaggccagcca

SEQ ID NO: 140208 - DNA, 20 bp, Artificial Sequence
  Description of Artificial Sequence: Synthetic oligonucleotide
  Target: ATXN1; (+) strand; PAM type: NRG; PAM sequence: CAG
gtcactcacgcctgtaatcc

SEQ ID NO: 140209 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagaactt

SEQ ID NO: 140210 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagaacttt

SEQ ID NO: 140211 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagaactttgg

SEQ ID NO: 140212 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagaactttggg

SEQ ID NO: 140213 - DNA, 20 bp, Artificial Sequence
  Description of Artificial Sequence: Synthetic oligonucleotide
  Target: ATXN1; (+) strand; PAM type: NRG; PAM sequence: AAG
cccagaactttgggaggctg

SEQ ID NO: 140214 - DNA, 20 bp, Artificial Sequence
  Description of Artificial Sequence: Synthetic oligonucleotide
  Target: ATXN1; (+) strand; PAM type: NRG; PAM sequence: TGG
agaactttgggaggctgaag

SEQ ID NO: 140215 - DNA, 20 bp, Artificial Sequence
  Description of Artificial Sequence: Synthetic oligonucleotide
  Target: ATXN1; (+) strand; PAM type: NRG; PAM sequence: GAG
aactttgggaggctgaagtg

SEQ ID NO: 140216 - DNA, 20 bp, Artificial Sequence
  Description of Artificial Sequence: Synthetic oligonucleotide
  Target: ATXN1; (+) strand; PAM type: NRG; PAM sequence: AGG
actttgggaggctgaagtgg

SEQ ID NO: 140217 - DNA, 20 bp, Artificial Sequence
  Description of Artificial Sequence: Synthetic oligonucleotide
  Target: ATXN1; (+) strand; PAM type: NRG; PAM sequence: GAG
gctgaagtggaggatcgctt

SEQ ID NO: 140218 - DNA, 20 bp, Artificial Sequence
  Description of Artificial Sequence: Synthetic oligonucleotide
  Target: ATXN1; (+) strand; PAM type: NRG; PAM sequence: CAG
agtggaggatcgcttgagcc

SEQ ID NO: 140219 - DNA, 20 bp, Artificial Sequence
  Description of Artificial Sequence: Synthetic oligonucleotide
  Target: ATXN1; (+) strand; PAM type: NRG; PAM sequence: AGG
gtggaggatcgcttgagccc

SEQ ID NO: 140220 - DNA, 20 bp, Artificial Sequence
  Description of Artificial Sequence: Synthetic oligonucleotide
  Target: ATXN1; (+) strand; PAM type: NRG; PAM sequence: GAG
ggaggatcgcttgagcccag

SEQ ID NO: 140221 - DNA, 20 bp, Artificial Sequence
  Description of Artificial Sequence: Synthetic oligonucleotide
  Target: ATXN1; (+) strand; PAM type: NRG; PAM sequence: AAG
tcgcttgagcccaggagttc

SEQ ID NO: 140222 - DNA, 20 bp, Artificial Sequence
  Description of Artificial Sequence: Synthetic oligonucleotide
  Target: ATXN1; (+) strand; PAM type: NRG; PAM sequence: TGG
ccaggagttcaagacaaaac

SEQ ID NO: 140223 - DNA, 20 bp, Artificial Sequence
  Description of Artificial Sequence: Synthetic oligonucleotide
  Target: ATXN1; (+) strand; PAM type: NRG; PAM sequence: GGG
caggagttcaagacaaaact

SEQ ID NO: 140224 - DNA, 20 bp, Artificial Sequence
  Description of Artificial Sequence: Synthetic oligonucleotide
  Target: ATXN1; (+) strand; PAM type: NRG; PAM sequence: TAG
caagacaaaactgggcaaca

SEQ ID NO: 140225 - DNA, 20 bp, Artificial Sequence
  Description of Artificial Sequence: Synthetic oligonucleotide
  Target: ATXN1; (+) strand; PAM type: NRG; PAM sequence: GAG
acaaaactgggcaacatagt

SEQ ID NO: 140226 - DNA, 20 bp, Artificial Sequence
  Description of Artificial Sequence: Synthetic oligonucleotide
  Target: ATXN1; (+) strand; PAM type: NRG; PAM sequence: TAG
ctacaaaaaaatacaaaaat

SEQ ID NO: 140227 - DNA, 20 bp, Artificial Sequence
  Description of Artificial Sequence: Synthetic oligonucleotide
  Target: ATXN1; (+) strand; PAM type: NRG; PAM sequence: GAG
aaaaaatacaaaaattagct

SEQ ID NO: 140228 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagctgagca

SEQ ID NO: 140229 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgagcatgg

SEQ ID NO: 140230 - DNA, 20 bp, Artificial Sequence
  Description of Artificial Sequence: Synthetic oligonucleotide
  Target: ATXN1; (+) strand; PAM type: NRG; PAM sequence: CAG
gtggcatatgtatctgctca

SEQ ID NO: 140231 - DNA, 20 bp, Artificial Sequence
  Description of Artificial Sequence: Synthetic oligonucleotide
  Target: ATXN1; (+) strand; PAM type: NRG; PAM sequence: CAG
tgtatctgctcacagctact

SEQ ID NO: 140232 - DNA, 20 bp, Artificial Sequence
  Description of Artificial Sequence: Synthetic oligonucleotide
  Target: ATXN1; (+) strand; PAM type: NRG; PAM sequence: AAG
atctgctcacagctactcag

SEQ ID NO: 140233 - DNA, 20 bp, Artificial Sequence
  Description of Artificial Sequence: Synthetic oligonucleotide
  Target: ATXN1; (+) strand; PAM type: NRG; PAM sequence: AGG
tctgctcacagctactcaga

SEQ ID NO: 140234 - DNA, 20 bp, Artificial Sequence
  Description of Artificial Sequence: Synthetic oligonucleotide
  Target: ATXN1; (+) strand; PAM type: NRG; PAM sequence: CAG
tcacagctactcagaaggct

SEQ ID NO: 140235 - DNA, 20 bp, Artificial Sequence
  Description of Artificial Sequence: Synthetic oligonucleotide
  Target: ATXN1; (+) strand; PAM type: NRG; PAM sequence: AGG
cacagctactcagaaggctc

SEQ ID NO: 140236 - DNA, 20 bp, Artificial Sequence
  Description of Artificial Sequence: Synthetic oligonucleotide
  Target: ATXN1; (+) strand; PAM type: NRG; PAM sequence: TGG
agctactcagaaggctcagg

SEQ ID NO: 140237 - DNA, 20 bp, Artificial Sequence
  Description of Artificial Sequence: Synthetic oligonucleotide
  Target: ATXN1; (+) strand; PAM type: NRG; PAM sequence: GGG
gctactcagaaggctcaggt

SEQ ID NO: 140238 - DNA, 20 bp, Artificial Sequence
  Description of Artificial Sequence: Synthetic oligonucleotide
  Target: ATXN1; (+) strand; PAM type: NRG; PAM sequence: GAG
tactcagaaggctcaggtgg

SEQ ID NO: 140239 - DNA, 20 bp, Artificial Sequence
  Description of Artificial Sequence: Synthetic oligonucleotide
  Target: ATXN1; (+) strand; PAM type: NRG; PAM sequence: AGG
actcagaaggctcaggtggg

SEQ ID NO: 140240 - DNA, 20 bp, Artificial Sequence
  Description of Artificial Sequence: Synthetic oligonucleotide
  Target: ATXN1; (+) strand; PAM type: NRG; PAM sequence: GAG
ctcaggtgggaggatcactt

SEQ ID NO: 140241 - DNA, 20 bp, Artificial Sequence
  Description of Artificial Sequence: Synthetic oligonucleotide
  Target: ATXN1; (+) strand; PAM type: NRG; PAM sequence: TGG
gtgggaggatcacttgagcc

SEQ ID NO: 140242 - DNA, 20 bp, Artificial Sequence
  Description of Artificial Sequence: Synthetic oligonucleotide
  Target: ATXN1; (+) strand; PAM type: NRG; PAM sequence: GGG
tgggaggatcacttgagcct

SEQ ID NO: 140243 - DNA, 20 bp, Artificial Sequence
  Description of Artificial Sequence: Synthetic oligonucleotide
  Target: ATXN1; (+) strand; PAM type: NRG; PAM sequence: GAG
ggaggatcacttgagcctgg

SEQ ID NO: 140244 - DNA, 20 bp, Artificial Sequence
  Description of Artificial Sequence: Synthetic oligonucleotide
  Target: ATXN1; (+) strand; PAM type: NRG; PAM sequence: AGG
gaggatcacttgagcctggg

SEQ ID NO: 140245 - DNA, 20 bp, Artificial Sequence
  Description of Artificial Sequence: Synthetic oligonucleotide
  Target: ATXN1; (+) strand; PAM type: NRG; PAM sequence: GAG
tcacttgagcctgggaggtt

SEQ ID NO: 140246 - DNA, 20 bp, Artificial Sequence
  Description of Artificial Sequence: Synthetic oligonucleotide
  Target: ATXN1; (+) strand; PAM type: NRG; PAM sequence: AGG
cacttgagcctgggaggttg

SEQ ID NO: 140247 - DNA, 20 bp, Artificial Sequence
  Description of Artificial Sequence: Synthetic oligonucleotide
  Target: ATXN1; (+) strand; PAM type: NRG; PAM sequence: CAG
agcctgggaggttgaggctg

SEQ ID NO: 140248 - DNA, 20 bp, Artificial Sequence
  Description of Artificial Sequence: Synthetic oligonucleotide
  Target: ATXN1; (+) strand; PAM type: NRG; PAM sequence: GAG
tgggaggttgaggctgcagt

SEQ ID NO: 140249 - DNA, 20 bp, Artificial Sequence
  Description of Artificial Sequence: Synthetic oligonucleotide
  Target: ATXN1; (+) strand; PAM type: NRG; PAM sequence: AAG
ggttgaggctgcagtgagcc

SEQ ID NO: 140250 - DNA, 20 bp, Artificial Sequence
  Description of Artificial Sequence: Synthetic oligonucleotide
  Target: ATXN1; (+) strand; PAM type: NRG; PAM sequence: CAG
aagatcacaacactgcaatc

SEQ ID NO: 140251 - DNA, 20 bp, Artificial Sequence
  Description of Artificial Sequence: Synthetic oligonucleotide
  Target: ATXN1; (+) strand; PAM type: NRG; PAM sequence: TGG
cacaacactgcaatccagcc

SEQ ID NO: 140252 - DNA, 20 bp, Artificial Sequence
  Description of Artificial Sequence: Synthetic oligonucleotide
  Target: ATXN1; (+) strand; PAM type: NRG; PAM sequence: CAG
ctgcaatccagcctggatga

SEQ ID NO: 140253 - DNA, 20 bp, Artificial Sequence
  Description of Artificial Sequence: Synthetic oligonucleotide
  Target: ATXN1; (+) strand; PAM type: NRG; PAM sequence: GAG
gcaatccagcctggatgaca

SEQ ID NO: 140254 - DNA, 20 bp, Artificial Sequence
  Description of Artificial Sequence: Synthetic oligonucleotide
  Target: ATXN1; (+) strand; PAM type: NRG; PAM sequence: TAG
tccagcctggatgacagagc

SEQ ID NO: 140255 - DNA, 20 bp, Artificial Sequence
  Description of Artificial Sequence: Synthetic oligonucleotide
  Target: ATXN1; (+) strand; PAM type: NRG; PAM sequence: TAG
caaaattatcaacataaaat

SEQ ID NO: 140256 - DNA, 20 bp, Artificial Sequence
  Description of Artificial Sequence: Synthetic oligonucleotide
  Target: ATXN1; (+) strand; PAM type: NRG; PAM sequence: AGG
aaaattatcaacataaaatt

SEQ ID NO: 140257 - DNA, 20 bp, Artificial Sequence
  Description of Artificial Sequence: Synthetic oligonucleotide
  Target: ATXN1; (+) strand; PAM type: NRG; PAM sequence: CAG
tatcaacataaaattaggta

SEQ ID NO: 140258 - DNA, 20 bp, Artificial Sequence
  Description of Artificial Sequence: Synthetic oligonucleotide
  Target: ATXN1; (+) strand; PAM type: NRG; PAM sequence: AGG
atcaacataaaattaggtac

SEQ ID NO: 140259 - DNA, 20 bp, Artificial Sequence
  Description of Artificial Sequence: Synthetic oligonucleotide
  Target: ATXN1; (+) strand; PAM type: NRG; PAM sequence: GGG
tcaacataaaattaggtaca

SEQ ID NO: 140260 - DNA, 20 bp, Artificial Sequence
  Description of Artificial Sequence: Synthetic oligonucleotide
  Target: ATXN1; (+) strand; PAM type: NRG; PAM sequence: AAG
attaggtacagggtcttaca

SEQ ID NO: 140261 - DNA, 20 bp, Artificial Sequence
  Description of Artificial Sequence: Synthetic oligonucleotide
  Target: ATXN1; (+) strand; PAM type: NRG; PAM sequence: AGG
ttaggtacagggtcttacaa

SEQ ID NO: 140262 - DNA, 20 bp, Artificial Sequence
  Description of Artificial Sequence: Synthetic oligonucleotide
  Target: ATXN1; (+) strand; PAM type: NRG; PAM sequence: GGG
taggtacagggtcttacaaa

SEQ ID NO: 140263 - DNA, 20 bp, Artificial Sequence
  Description of Artificial Sequence: Synthetic oligonucleotide
  Target: ATXN1; (+) strand; PAM type: NRG; PAM sequence: CAG
agggtcttacaaagggcctg

SEQ ID NO: 140264 - DNA, 20 bp, Artificial Sequence
  Description of Artificial Sequence: Synthetic oligonucleotide
  Target: ATXN1; (+) strand; PAM type: NRG; PAM sequence: AGG
gggtcttacaaagggcctgc

SEQ ID NO: 140265 - DNA, 20 bp, Artificial Sequence
  Description of Artificial Sequence: Synthetic oligonucleotide
  Target: ATXN1; (+) strand; PAM type: NRG; PAM sequence: GAG
gtcttacaaagggcctgcag

SEQ ID NO: 140266 - DNA, 20 bp, Artificial Sequence
  Description of Artificial Sequence: Synthetic oligonucleotide
  Target: ATXN1; (+) strand; PAM type: NRG; PAM sequence: GAG
tacaaagggcctgcaggagc

SEQ ID NO: 140267 - DNA, 20 bp, Artificial Sequence
  Description of Artificial Sequence: Synthetic oligonucleotide
  Target: ATXN1; (+) strand; PAM type: NRG; PAM sequence: AAG
agcgagacgccttgacgctg

SEQ ID NO: 140268 - DNA, 20 bp, Artificial Sequence
  Description of Artificial Sequence: Synthetic oligonucleotide
  Target: ATXN1; (+) strand; PAM type: NRG; PAM sequence: TAG
ccttgacgctgaagtgtcac

SEQ ID NO: 140269 - DNA, 20 bp, Artificial Sequence
  Description of Artificial Sequence: Synthetic oligonucleotide
  Target: ATXN1; (+) strand; PAM type: NRG; PAM sequence: CAG
gctgaagtgtcactagcttc

SEQ ID NO: 140270 - DNA, 20 bp, Artificial Sequence
  Description of Artificial Sequence: Synthetic oligonucleotide
  Target: ATXN1; (+) strand; PAM type: NRG; PAM sequence: TGG
agcttccagataaaacctcc

SEQ ID NO: 140271 - DNA, 20 bp, Artificial Sequence
  Description of Artificial Sequence: Synthetic oligonucleotide
  Target: ATXN1; (+) strand; PAM type: NRG; PAM sequence: CAG
cacaatgcatgcacacatca

SEQ ID NO: 140272 - DNA, 20 bp, Artificial Sequence
  Description of Artificial Sequence: Synthetic oligonucleotide
  Target: ATXN1; (+) strand; PAM type: NRG; PAM sequence: TGG
aatgcatgcacacatcacag

SEQ ID NO: 140273 - DNA, 20 bp, Artificial Sequence
  Description of Artificial Sequence: Synthetic oligonucleotide
  Target: ATXN1; (+) strand; PAM type: NRG; PAM sequence: TGG
gcatgcacacatcacagtgg

SEQ ID NO: 140274 - DNA, 20 bp, Artificial Sequence
  Description of Artificial Sequence: Synthetic oligonucleotide
  Target: ATXN1; (+) strand; PAM type: NRG; PAM sequence: GGG
catgcacacatcacagtggt

SEQ ID NO: 140275 - DNA, 20 bp, Artificial Sequence
  Description of Artificial Sequence: Synthetic oligonucleotide
  Target: ATXN1; (+) strand; PAM type: NRG; PAM sequence: AAG
gggaacacctataaatgacc

SEQ ID NO: 140276 - DNA, 20 bp, Artificial Sequence
  Description of Artificial Sequence: Synthetic oligonucleotide
  Target: ATXN1; (+) strand; PAM type: NRG; PAM sequence: AAG
ttataattcccttcaatgcc

SEQ ID NO: 140277 - DNA, 20 bp, Artificial Sequence
  Description of Artificial Sequence: Synthetic oligonucleotide
  Target: ATXN1; (+) strand; PAM type: NRG; PAM sequence: TGG
tcccttcaatgccaagtata

SEQ ID NO: 140278 - DNA, 20 bp, Artificial Sequence
  Description of Artificial Sequence: Synthetic oligonucleotide
  Target: ATXN1; (+) strand; PAM type: NRG; PAM sequence: TAG
caagtatatggtaaacactt

SEQ ID NO: 140279 - DNA, 20 bp, Artificial Sequence
  Description of Artificial Sequence: Synthetic oligonucleotide
  Target: ATXN1; (+) strand; PAM type: NRG; PAM sequence: GAG
ctttagtatacatttttgct

SEQ ID NO: 140280 - DNA, 20 bp, Artificial Sequence
  Description of Artificial Sequence: Synthetic oligonucleotide
  Target: ATXN1; (+) strand; PAM type: NRG; PAM sequence: TAG
gctgagtacacgtgactaaa

SEQ ID NO: 140281 - DNA, 20 bp, Artificial Sequence
  Description of Artificial Sequence: Synthetic oligonucleotide
  Target: ATXN1; (+) strand; PAM type: NRG; PAM sequence: GAG
tgtttacaaattatgttgtc

SEQ ID NO: 140282 - DNA, 20 bp, Artificial Sequence
  Description of Artificial Sequence: Synthetic oligonucleotide
  Target: ATXN1; (+) strand; PAM type: NRG; PAM sequence: TGG
gttaaatgaattccaatatg

SEQ ID NO: 140283 - DNA, 20 bp, Artificial Sequence
  Description of Artificial Sequence: Synthetic oligonucleotide
  Target: ATXN1; (+) strand; PAM type: NRG; PAM sequence: CAG
atgtggctttactacctcat

SEQ ID NO: 140284 - DNA, 20 bp, Artificial Sequence
  Description of Artificial Sequence: Synthetic oligonucleotide
  Target: ATXN1; (+) strand; PAM type: NRG; PAM sequence: AGG
tgtggctttactacctcatc

SEQ ID NO: 140285 - DNA, 20 bp, Artificial Sequence
  Description of Artificial Sequence: Synthetic oligonucleotide
  Target: ATXN1; (+) strand; PAM type: NRG; PAM sequence: CAG
tcaggaaaacctgtatccca

SEQ ID NO: 140286 - DNA, 20 bp, Artificial Sequence
  Description of Artificial Sequence: Synthetic oligonucleotide
  Target: ATXN1; (+) strand; PAM type: NRG; PAM sequence: CAG
tgtatcccacagtcatttat

SEQ ID NO: 140287 - DNA, 20 bp, Artificial Sequence
  Description of Artificial Sequence: Synthetic oligonucleotide
  Target: ATXN1; (+) strand; PAM type: NRG; PAM sequence: AGG
gtatcccacagtcatttatc

SEQ ID NO: 140288 - DNA, 20 bp, Artificial Sequence
  Description of Artificial Sequence: Synthetic oligonucleotide
  Target: ATXN1; (+) strand; PAM type: NRG; PAM sequence: CAG
tcccacagtcatttatcagg

SEQ ID NO: 140289 - DNA, 20 bp, Artificial Sequence
  Description of Artificial Sequence: Synthetic oligonucleotide
  Target: ATXN1; (+) strand; PAM type: NRG; PAM sequence: TAG
atttatcaggcagcaatgtc

SEQ ID NO: 140290 - DNA, 20 bp, Artificial Sequence
  Description of Artificial Sequence: Synthetic oligonucleotide
  Target: ATXN1; (+) strand; PAM type: NRG; PAM sequence: TGG
aggcagcaatgtctagctta

SEQ ID NO: 140291 - DNA, 20 bp, Artificial Sequence
  Description of Artificial Sequence: Synthetic oligonucleotide
  Target: ATXN1; (+) strand; PAM type: NRG; PAM sequence: CAG
agcttatggaaacccatctg

SEQ ID NO: 140292 - DNA, 20 bp, Artificial Sequence
  Description of Artificial Sequence: Synthetic oligonucleotide
  Target: ATXN1; (+) strand; PAM type: NRG; PAM sequence: AGG
gcttatggaaacccatctgc

SEQ ID NO: 140293 - DNA, 20 bp, Artificial Sequence
  Description of Artificial Sequence: Synthetic oligonucleotide
  Target: ATXN1; (+) strand; PAM type: NRG; PAM sequence: AAG
aaacccatctgcaggttcct

SEQ ID NO: 140294 - DNA, 20 bp, Artificial Sequence
  Description of Artificial Sequence: Synthetic oligonucleotide
  Target: ATXN1; (+) strand; PAM type: NRG; PAM sequence: AAG
ccatctgcaggttcctaagc

SEQ ID NO: 140295 - DNA, 20 bp, Artificial Sequence
  Description of Artificial Sequence: Synthetic oligonucleotide
  Target: ATXN1; (+) strand; PAM type: NRG; PAM sequence: TAG
tctgcaggttcctaagcaag

SEQ ID NO: 140296 - DNA, 20 bp, Artificial Sequence
  Description of Artificial Sequence: Synthetic oligonucleotide
  Target: ATXN1; (+) strand; PAM type: NRG; PAM sequence: CAG
aggttcctaagcaagtagcc

SEQ ID NO: 140297 - DNA, 20 bp, Artificial Sequence
  Description of Artificial Sequence: Synthetic oligonucleotide
  Target: ATXN1; (+) strand; PAM type: NRG; PAM sequence: TAG
agtagcccagattaatatca

SEQ ID NO: 140298 - DNA, 20 bp, Artificial Sequence
  Description of Artificial Sequence: Synthetic oligonucleotide
  Target: ATXN1; (+) strand; PAM type: NRG; PAM sequence: CAG
cccagattaatatcatagtg

SEQ ID NO: 140299 - DNA, 20 bp, Artificial Sequence
  Description of Artificial Sequence: Synthetic oligonucleotide
  Target: ATXN1; (+) strand; PAM type: NRG; PAM sequence: TAG
gattaatatcatagtgcagc

SEQ ID NO: 140300 - DNA, 20 bp, Artificial Sequence
  Description of Artificial Sequence: Synthetic oligonucleotide
  Target: ATXN1; (+) strand; PAM type: NRG; PAM sequence: CGG
aatatcatagtgcagctagt

SEQ ID NO: 140301 - DNA, 20 bp, Artificial Sequence
  Description of Artificial Sequence: Synthetic oligonucleotide
  Target: ATXN1; (+) strand; PAM type: NRG; PAM sequence: TGG
atcatagtgcagctagtcgg

SEQ ID NO: 140302 - DNA, 20 bp, Artificial Sequence
  Description of Artificial Sequence: Synthetic oligonucleotide
  Target: ATXN1; (+) strand; PAM type: NRG; PAM sequence: CAG
tcggtggctataattaaatg

SEQ ID NO: 140303 - DNA, 20 bp, Artificial Sequence
  Description of Artificial Sequence: Synthetic oligonucleotide
  Target: ATXN1; (+) strand; PAM type: NRG; PAM sequence: AAG
gtggctataattaaatgcag

SEQ ID NO: 140304 - DNA, 20 bp, Artificial Sequence
  Description of Artificial Sequence: Synthetic oligonucleotide
  Target: ATXN1; (+) strand; PAM type: NRG; PAM sequence: TGG
gctataattaaatgcagaag

SEQ ID NO: 140305 - DNA, 20 bp, Artificial Sequence
  Description of Artificial Sequence: Synthetic oligonucleotide
  Target: ATXN1; (+) strand; PAM type: NRG; PAM sequence: GAG
ttaaatgcagaagtggtatt

SEQ ID NO: 140306 - DNA, 20 bp, Artificial Sequence
  Description of Artificial Sequence: Synthetic oligonucleotide
  Target: ATXN1; (+) strand; PAM type: NRG; PAM sequence: GAG
aaatgcagaagtggtattga

SEQ ID NO: 140307 - DNA, 20 bp, Artificial Sequence
  Description of Artificial Sequence: Synthetic oligonucleotide
  Target: ATXN1; (+) strand; PAM type: NRG; PAM sequence: AGG
aatgcagaagtggtattgag

SEQ ID NO: 140308 - DNA, 20 bp, Artificial Sequence
  Description of Artificial Sequence: Synthetic oligonucleotide
  Target: ATXN1; (+) strand; PAM type: NRG; PAM sequence: AAG
agaagtggtattgagaggtg

SEQ ID NO: 140309 - DNA, 20 bp, Artificial Sequence
  Description of Artificial Sequence: Synthetic oligonucleotide
  Target: ATXN1; (+) strand; PAM type: NRG; PAM sequence: CAG
gtggtattgagaggtgaagc

SEQ ID NO: 140310 - DNA, 20 bp, Artificial Sequence
  Description of Artificial Sequence: Synthetic oligonucleotide
  Target: ATXN1; (+) strand; PAM type: NRG; PAM sequence: TGG
tattgagaggtgaagccagc

SEQ ID NO: 140311 - DNA, 20 bp, Artificial Sequence
  Description of Artificial Sequence: Synthetic oligonucleotide
  Target: ATXN1; (+) strand; PAM type: NRG; PAM sequence: TGG
gtgaagccagctggacttct

SEQ ID NO: 140312 - DNA, 20 bp, Artificial Sequence
  Description of Artificial Sequence: Synthetic oligonucleotide
  Target: ATXN1; (+) strand; PAM type: NRG; PAM sequence: GGG
tgaagccagctggacttctt

SEQ ID NO: 140313 - DNA, 20 bp, Artificial Sequence
  Description of Artificial Sequence: Synthetic oligonucleotide
  Target: ATXN1; (+) strand; PAM type: NRG; PAM sequence: GAG
ccagctggacttcttgggtc

SEQ ID NO: 140314 - DNA, 20 bp, Artificial Sequence
  Description of Artificial Sequence: Synthetic oligonucleotide
  Target: ATXN1; (+) strand; PAM type: NRG; PAM sequence: TGG
gctggacttcttgggtcgag

SEQ ID NO: 140315 - DNA, 20 bp, Artificial Sequence
  Description of Artificial Sequence: Synthetic oligonucleotide
  Target: ATXN1; (+) strand; PAM type: NRG; PAM sequence: GGG
ctggacttcttgggtcgagt

SEQ ID NO: 140316 - DNA, 20 bp, Artificial Sequence
  Description of Artificial Sequence: Synthetic oligonucleotide
  Target: ATXN1; (+) strand; PAM type: NRG; PAM sequence: GGG
tggacttcttgggtcgagtg

SEQ ID NO: 140317 - DNA, 20 bp, Artificial Sequence
  Description of Artificial Sequence: Synthetic oligonucleotide
  Target: ATXN1; (+) strand; PAM type: NRG; PAM sequence: TGG
tcttgggtcgagtggggact

SEQ ID NO: 140318 - DNA, 20 bp, Artificial Sequence
  Description of Artificial Sequence: Synthetic oligonucleotide
  Target: ATXN1; (+) strand; PAM type: NRG; PAM sequence: GAG
ttgggtcgagtggggacttg

SEQ ID NO: 140319 - DNA, 20 bp, Artificial Sequence
  Description of Artificial Sequence: Synthetic oligonucleotide
  Target: ATXN1; (+) strand; PAM type: NRG; PAM sequence: AAG
ggagaacttttctgtcttac

SEQ ID NO: 140320 - DNA, 20 bp, Artificial Sequence
  Description of Artificial Sequence: Synthetic oligonucleotide
  Target: ATXN1; (+) strand; PAM type: NRG; PAM sequence: AGG
gagaacttttctgtcttaca

SEQ ID NO: 140321 - DNA, 20 bp, Artificial Sequence
  Description of Artificial Sequence: Synthetic oligonucleotide
  Target: ATXN1; (+) strand; PAM type: NRG; PAM sequence: GGG
agaacttttctgtcttacaa

SEQ ID NO: 140322 - DNA, 20 bp, Artificial Sequence
  Description of Artificial Sequence: Synthetic oligonucleotide
  Target: ATXN1; (+) strand; PAM type: NRG; PAM sequence: GGG
gaacttttctgtcttacaag

SEQ ID NO: 140323 - DNA, 20 bp, Artificial Sequence
  Description of Artificial Sequence: Synthetic oligonucleotide
  Target: ATXN1; (+) strand; PAM type: NRG; PAM sequence: GAG
ggattgtaaaatgcaccaat

SEQ ID NO: 140324 - DNA, 20 bp, Artificial Sequence
  Description of Artificial Sequence: Synthetic oligonucleotide
  Target: ATXN1; (+) strand; PAM type: NRG; PAM sequence: CAG
ctctgtaaaaacacaccaat

SEQ ID NO: 140325 - DNA, 20 bp, Artificial Sequence
  Description of Artificial Sequence: Synthetic oligonucleotide
  Target: ATXN1; (+) strand; PAM type: NRG; PAM sequence: TAG
acacaccaatcagcgctctg

SEQ ID NO: 140326 - DNA, 20 bp, Artificial Sequence
  Description of Artificial Sequence: Synthetic oligonucleotide
  Target: ATXN1; (+) strand; PAM type: NRG; PAM sequence: TAG
accaatcagcgctctgtagc

SEQ ID NO: 140327 - DNA, 20 bp, Artificial Sequence
  Description of Artificial Sequence: Synthetic oligonucleotide
  Target: ATXN1; (+) strand; PAM type: NRG; PAM sequence: GAG
cagcgctctgtagctagctt

SEQ ID NO: 140328 - DNA, 20 bp, Artificial Sequence
  Description of Artificial Sequence: Synthetic oligonucleotide
  Target: ATXN1; (+) strand; PAM type: NRG; PAM sequence: AGG
agcgctctgtagctagcttg

SEQ ID NO: 140329 - DNA, 20 bp, Artificial Sequence
  Description of Artificial Sequence: Synthetic oligonucleotide
  Target: ATXN1; (+) strand; PAM type: NRG; PAM sequence: TGG
ctagcttgaggtttgtaaaa

SEQ ID NO: 140330 - DNA, 20 bp, Artificial Sequence
  Description of Artificial Sequence: Synthetic oligonucleotide
  Target: ATXN1; (+) strand; PAM type: NRG; PAM sequence: CAG
ggtttgtaaaatggaccaat

SEQ ID NO: 140331 - DNA, 20 bp, Artificial Sequence
  Description of Artificial Sequence: Synthetic oligonucleotide
  Target: ATXN1; (+) strand; PAM type: NRG; PAM sequence: TGG
ccaatcagcactctgtaaaa

SEQ ID NO: 140332 - DNA, 20 bp, Artificial Sequence
  Description of Artificial Sequence: Synthetic oligonucleotide
  Target: ATXN1; (+) strand; PAM type: NRG; PAM sequence: CAG
actctgtaaaatggaccaat

SEQ ID NO: 140333 - DNA, 20 bp, Artificial Sequence
  Description of Artificial Sequence: Synthetic oligonucleotide
  Target: ATXN1; (+) strand; PAM type: NRG; PAM sequence: TAG
atggaccaatcagtgctctg

SEQ ID NO: 140334 - DNA, 20 bp, Artificial Sequence
  Description of Artificial Sequence: Synthetic oligonucleotide
  Target: ATXN1; (+) strand; PAM type: NRG; PAM sequence: TGG
ccaatcagtgctctgtagaa

SEQ ID NO: 140335 - DNA, 20 bp, Artificial Sequence
  Description of Artificial Sequence: Synthetic oligonucleotide
  Target: ATXN1; (+) strand; PAM type: NRG; PAM sequence: CAG
gctctgtagaatggaccaat

SEQ ID NO: 140336 - DNA, 20 bp, Artificial Sequence
  Description of Artificial Sequence: Synthetic oligonucleotide
  Target: ATXN1; (+) strand; PAM type: NRG; PAM sequence: CAG
ctgtagaatggaccaatcag

SEQ ID NO: 140337 - DNA, 20 bp, Artificial Sequence
  Description of Artificial Sequence: Synthetic oligonucleotide
  Target: ATXN1; (+) strand; PAM type: NRG; PAM sequence: AGG
tgtagaatggaccaatcagc

SEQ ID NO: 140338 - DNA, 20 bp, Artificial Sequence
  Description of Artificial Sequence: Synthetic oligonucleotide
  Target: ATXN1; (+) strand; PAM type: NRG; PAM sequence: TGG
atggaccaatcagcaggaca

SEQ ID NO: 140339 - DNA, 20 bp, Artificial Sequence
  Description of Artificial Sequence: Synthetic oligonucleotide
  Target: ATXN1; (+) strand; PAM type: NRG; PAM sequence: GGG
tggaccaatcagcaggacat

SEQ ID NO: 140340 - DNA, 20 bp, Artificial Sequence
  Description of Artificial Sequence: Synthetic oligonucleotide
  Target: ATXN1; (+) strand; PAM type: NRG; PAM sequence: CAG
accaatcagcaggacatggg

SEQ ID NO: 140341 - DNA, 20 bp, Artificial Sequence
  Description of Artificial Sequence: Synthetic oligonucleotide
  Target: ATXN1; (+) strand; PAM type: NRG; PAM sequence: AGG
ccaatcagcaggacatgggc

SEQ ID NO: 140342 - DNA, 20 bp, Artificial Sequence
  Description of Artificial Sequence: Synthetic oligonucleotide
  Target: ATXN1; (+) strand; PAM type: NRG; PAM sequence: GGG
caatcagcaggacatgggca

SEQ ID NO: 140343 - DNA, 20 bp, Artificial Sequence
  Description of Artificial Sequence: Synthetic oligonucleotide
  Target: ATXN1; (+) strand; PAM type: NRG; PAM sequence: AAG
ggacatgggcagggacaaat

SEQ ID NO: 140344 - DNA, 20 bp, Artificial Sequence
  Description of Artificial Sequence: Synthetic oligonucleotide
  Target: ATXN1; (+) strand; PAM type: NRG; PAM sequence: AGG
gacatgggcagggacaaata

SEQ ID NO: 140345 - DNA, 20 bp, Artificial Sequence
  Description of Artificial Sequence: Synthetic oligonucleotide
  Target: ATXN1; (+) strand; PAM type: NRG; PAM sequence: GGG
acatgggcagggacaaataa

SEQ ID NO: 140346 - DNA, 20 bp, Artificial Sequence
  Description of Artificial Sequence: Synthetic oligonucleotide
  Target: ATXN1; (+) strand; PAM type: NRG; PAM sequence: AAG
agggacaaataagggaataa

SEQ ID NO: 140347 - DNA, 20 bp, Artificial Sequence
  Description of Artificial Sequence: Synthetic oligonucleotide
  Target: ATXN1; (+) strand; PAM type: NRG; PAM sequence: TGG
acaaataagggaataaaagc

SEQ ID NO: 140348 - DNA, 20 bp, Artificial Sequence
  Description of Artificial Sequence: Synthetic oligonucleotide
  Target: ATXN1; (+) strand; PAM type: NRG; PAM sequence: CAG
ggaataaaagctggccacgc

SEQ ID NO: 140349 - DNA, 20 bp, Artificial Sequence
  Description of Artificial Sequence: Synthetic oligonucleotide
  Target: ATXN1; (+) strand; PAM type: NRG; PAM sequence: CAG
taaaagctggccacgccagc

SEQ ID NO: 140350 - DNA, 20 bp, Artificial Sequence
  Description of Artificial Sequence: Synthetic oligonucleotide
  Target: ATXN1; (+) strand; PAM type: NRG; PAM sequence: CAG
aagctggccacgccagccag

SEQ ID NO: 140351 - DNA, 20 bp, Artificial Sequence
  Description of Artificial Sequence: Synthetic oligonucleotide
  Target: ATXN1; (+) strand; PAM type: NRG; PAM sequence: GAG
gctggccacgccagccagca

SEQ ID NO: 140352 - DNA, 20 bp, Artificial Sequence
  Description of Artificial Sequence: Synthetic oligonucleotide
  Target: ATXN1; (+) strand; PAM type: NRG; PAM sequence: CGG
gccagcagagacaacccgct

SEQ ID NO: 140353 - DNA, 20 bp, Artificial Sequence
  Description of Artificial Sequence: Synthetic oligonucleotide
  Target: ATXN1; (+) strand; PAM type: NRG; PAM sequence: GGG
ccagcagagacaacccgctc

SEQ ID NO: 140354 - DNA, 20 bp, Artificial Sequence
  Description of Artificial Sequence: Synthetic oligonucleotide
  Target: ATXN1; (+) strand; PAM type: NRG; PAM sequence: TGG
tcgggtccccttccacgctg

SEQ ID NO: 140355 - DNA, 20 bp, Artificial Sequence
  Description of Artificial Sequence: Synthetic oligonucleotide
  Target: ATXN1; (+) strand; PAM type: NRG; PAM sequence: AAG
ggtccccttccacgctgtgg

SEQ ID NO: 140356 - DNA, 20 bp, Artificial Sequence
  Description of Artificial Sequence: Synthetic oligonucleotide
  Target: ATXN1; (+) strand; PAM type: NRG; PAM sequence: AGG
gtccccttccacgctgtgga

SEQ ID NO: 140357 - DNA, 20 bp, Artificial Sequence
  Description of Artificial Sequence: Synthetic oligonucleotide
  Target: ATXN1; (+) strand; PAM type: NRG; PAM sequence: TGG
tcttgctactgctcgctctt

SEQ ID NO: 140358 - DNA, 20 bp, Artificial Sequence
  Description of Artificial Sequence: Synthetic oligonucleotide
  Target: ATXN1; (+) strand; PAM type: NRG; PAM sequence: GGG
cttgctactgctcgctcttt

SEQ ID NO: 140359 - DNA, 20 bp, Artificial Sequence
  Description of Artificial Sequence: Synthetic oligonucleotide
  Target: ATXN1; (+) strand; PAM type: NRG; PAM sequence: AAG
tttgggtccctaccatcttt

SEQ ID NO: 140360 - DNA, 20 bp, Artificial Sequence
  Description of Artificial Sequence: Synthetic oligonucleotide
  Target: ATXN1; (+) strand; PAM type: NRG; PAM sequence: GAG
tgggtccctaccatctttaa

SEQ ID NO: 140361 - DNA, 20 bp, Artificial Sequence
  Description of Artificial Sequence: Synthetic oligonucleotide
  Target: ATXN1; (+) strand; PAM type: NRG; PAM sequence: AAG
gagctgtaacactcactgtg

SEQ ID NO: 140362 - DNA, 20 bp, Artificial Sequence
  Description of Artificial Sequence: Synthetic oligonucleotide
  Target: ATXN1; (+) strand; PAM type: NRG; PAM sequence: AGG
agctgtaacactcactgtga

SEQ ID NO: 140363 - DNA, 20 bp, Artificial Sequence
  Description of Artificial Sequence: Synthetic oligonucleotide
  Target: ATXN1; (+) strand; PAM type: NRG; PAM sequence: TGG
acactcactgtgaaggtccg

SEQ ID NO: 140364 - DNA, 20 bp, Artificial Sequence
  Description of Artificial Sequence: Synthetic oligonucleotide
  Target: ATXN1; (+) strand; PAM type: NRG; PAM sequence: AAG
ggtccgtggctccattcttg

SEQ ID NO: 140365 - DNA, 20 bp, Artificial Sequence
  Description of Artificial Sequence: Synthetic oligonucleotide
  Target: ATXN1; (+) strand; PAM type: NRG; PAM sequence: CAG
cgtggctccattcttgaagt

SEQ ID NO: 140366 - DNA, 20 bp, Artificial Sequence
  Description of Artificial Sequence: Synthetic oligonucleotide
  Target: ATXN1; (+) strand; PAM type: NRG; PAM sequence: AAG
gctccattcttgaagtcagc

SEQ ID NO: 140367 - DNA, 20 bp, Artificial Sequence
  Description of Artificial Sequence: Synthetic oligonucleotide
  Target: ATXN1; (+) strand; PAM type: NRG; PAM sequence: CGG
cagcaagaccacaaacctat

SEQ ID NO: 140368 - DNA, 20 bp, Artificial Sequence
  Description of Artificial Sequence: Synthetic oligonucleotide
  Target: ATXN1; (+) strand; PAM type: NRG; PAM sequence: AAG
caagaccacaaacctatcgg

SEQ ID NO: 140369 - DNA, 20 bp, Artificial Sequence
  Description of Artificial Sequence: Synthetic oligonucleotide
  Target: ATXN1; (+) strand; PAM type: NRG; PAM sequence: AGG
aagaccacaaacctatcgga

SEQ ID NO: 140370 - DNA, 20 bp, Artificial Sequence
  Description of Artificial Sequence: Synthetic oligonucleotide
  Target: ATXN1; (+) strand; PAM type: NRG; PAM sequence: CAG
ctatcggaaggaaccaactc

SEQ ID NO: 140371 - DNA, 20 bp, Artificial Sequence
  Description of Artificial Sequence: Synthetic oligonucleotide
  Target: ATXN1; (+) strand; PAM type: NRG; PAM sequence: CAG
gaaggaaccaactccagaca

SEQ ID NO: 140372 - DNA, 20 bp, Artificial Sequence
  Description of Artificial Sequence: Synthetic oligonucleotide
  Target: ATXN1; (+) strand; PAM type: NRG; PAM sequence: AGG
aaggaaccaactccagacac

SEQ ID NO: 140373 - DNA, 20 bp, Artificial Sequence
  Description of Artificial Sequence: Synthetic oligonucleotide
  Target: ATXN1; (+) strand; PAM type: NRG; PAM sequence: TAG
tcaccgcaacctccacctcc

SEQ ID NO: 140374 - DNA, 20 bp, Artificial Sequence
  Description of Artificial Sequence: Synthetic oligonucleotide
  Target: ATXN1; (+) strand; PAM type: NRG; PAM sequence: AGG
caccgcaacctccacctcct

SEQ ID NO: 140375 - DNA, 20 bp, Artificial Sequence
  Description of Artificial Sequence: Synthetic oligonucleotide
  Target: ATXN1; (+) strand; PAM type: NRG; PAM sequence: AAG
aacctccacctcctaggttc

SEQ ID NO: 140376 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgattctcctgcct

SEQ ID NO: 140377 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcctcagccgcct

SEQ ID NO: 140378 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagccgcctaag

SEQ ID NO: 140379 - DNA, 20 bp, Artificial Sequence
  Description of Artificial Sequence: Synthetic oligonucleotide
  Target: ATXN1; (+) strand; PAM type: NRG; PAM sequence: TGG
gcctcagccgcctaagtagc

SEQ ID NO: 140380 - DNA, 20 bp, Artificial Sequence
  Description of Artificial Sequence: Synthetic oligonucleotide
  Target: ATXN1; (+) strand; PAM type: NRG; PAM sequence: GGG
cctcagccgcctaagtagct

SEQ ID NO: 140381 - DNA, 20 bp, Artificial Sequence
  Description of Artificial Sequence: Synthetic oligonucleotide
  Target: ATXN1; (+) strand; PAM type: NRG; PAM sequence: CAG
cgcctaagtagctgggatta

SEQ ID NO: 140382 - DNA, 20 bp, Artificial Sequence
  Description of Artificial Sequence: Synthetic oligonucleotide
  Target: ATXN1; (+) strand; PAM type: NRG; PAM sequence: AGG
gcctaagtagctgggattac

SEQ ID NO: 140383 - DNA, 20 bp, Artificial Sequence
  Description of Artificial Sequence: Synthetic oligonucleotide
  Target: ATXN1; (+) strand; PAM type: NRG; PAM sequence: CGG
caggcatgccccaccacacc

SEQ ID NO: 140384 - DNA, 20 bp, Artificial Sequence
  Description of Artificial Sequence: Synthetic oligonucleotide
  Target: ATXN1; (+) strand; PAM type: NRG; PAM sequence: TAG
cccggctaattttgtatttt

SEQ ID NO: 140385 - DNA, 20 bp, Artificial Sequence
  Description of Artificial Sequence: Synthetic oligonucleotide
  Target: ATXN1; (+) strand; PAM type: NRG; PAM sequence: TAG
ggctaattttgtatttttag

SEQ ID NO: 140386 - DNA, 20 bp, Artificial Sequence
  Description of Artificial Sequence: Synthetic oligonucleotide
  Target: ATXN1; (+) strand; PAM type: NRG; PAM sequence: GAG
ctaattttgtatttttagta

SEQ ID NO: 140387 - DNA, 20 bp, Artificial Sequence
  Description of Artificial Sequence: Synthetic oligonucleotide
  Target: ATXN1; (+) strand; PAM type: NRG; PAM sequence: TGG
ttttgtatttttagtagaga

SEQ ID NO: 140388 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagat

SEQ ID NO: 140389 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagatg

SEQ ID NO: 140390 - DNA, 20 bp, Artificial Sequence
  Description of Artificial Sequence: Synthetic oligonucleotide
  Target: ATXN1; (+) strand; PAM type: NRG; PAM sequence: TGG
gagatggggtttctccatgt

SEQ ID NO: 140391 - DNA, 20 bp, Artificial Sequence
  Description of Artificial Sequence: Synthetic oligonucleotide
  Target: ATXN1; (+) strand; PAM type: NRG; PAM sequence: CAG
tggggtttctccatgttggt

SEQ ID NO: 140392 - DNA, 20 bp, Artificial Sequence
  Description of Artificial Sequence: Synthetic oligonucleotide
  Target: ATXN1; (+) strand; PAM type: NRG; PAM sequence: AGG
ggggtttctccatgttggtc

SEQ ID NO: 140393 - DNA, 20 bp, Artificial Sequence
  Description of Artificial Sequence: Synthetic oligonucleotide
  Target: ATXN1; (+) strand; PAM type: NRG; PAM sequence: TGG
tttctccatgttggtcaggc

SEQ ID NO: 140394 - DNA, 20 bp, Artificial Sequence
  Description of Artificial Sequence: Synthetic oligonucleotide
  Target: ATXN1; (+) strand; PAM type: NRG; PAM sequence: CAG
ggttcttgaactcccaacct

SEQ ID NO: 140395 - DNA, 20 bp, Artificial Sequence
  Description of Artificial Sequence: Synthetic oligonucleotide
  Target: ATXN1; (+) strand; PAM type: NRG; PAM sequence: AGG
gttcttgaactcccaacctc

SEQ ID NO: 140396 - DNA, 20 bp, Artificial Sequence
  Description of Artificial Sequence: Synthetic oligonucleotide
  Target: ATXN1; (+) strand; PAM type: NRG; PAM sequence: CAG
ctcaggtgattcgcctgcct

SEQ ID NO: 140397 - DNA, 20 bp, Artificial Sequence
  Description of Artificial Sequence: Synthetic oligonucleotide
  Target: ATXN1; (+) strand; PAM type: NRG; PAM sequence: AAG
ttcgcctgcctcagcttccc

SEQ ID NO: 140398 - DNA, 20 bp, Artificial Sequence
  Description of Artificial Sequence: Synthetic oligonucleotide
  Target: ATXN1; (+) strand; PAM type: NRG; PAM sequence: AGG
tcgcctgcctcagcttccca

SEQ ID NO: 140399 - DNA, 20 bp, Artificial Sequence
  Description of Artificial Sequence: Synthetic oligonucleotide
  Target: ATXN1; (+) strand; PAM type: NRG; PAM sequence: TGG
gcctcagcttcccaaggtgc

SEQ ID NO: 140400 - DNA, 20 bp, Artificial Sequence
  Description of Artificial Sequence: Synthetic oligonucleotide
  Target: ATXN1; (+) strand; PAM type: NRG; PAM sequence: GGG
cctcagcttcccaaggtgct

SEQ ID NO: 140401 - DNA, 20 bp, Artificial Sequence
  Description of Artificial Sequence: Synthetic oligonucleotide
  Target: ATXN1; (+) strand; PAM type: NRG; PAM sequence: CAG
ttcccaaggtgctgggatta

SEQ ID NO: 140402 - DNA, 20 bp, Artificial Sequence
  Description of Artificial Sequence: Synthetic oligonucleotide
  Target: ATXN1; (+) strand; PAM type: NRG; PAM sequence: AGG
tcccaaggtgctgggattac

SEQ ID NO: 140403 - DNA, 20 bp, Artificial Sequence
  Description of Artificial Sequence: Synthetic oligonucleotide
  Target: ATXN1; (+) strand; PAM type: NRG; PAM sequence: GAG
ggtgctgggattacaggcct

SEQ ID NO: 140404 - DNA, 20 bp, Artificial Sequence
  Description of Artificial Sequence: Synthetic oligonucleotide
  Target: ATXN1; (+) strand; PAM type: NRG; PAM sequence: CGG
caggcctgagccattgcgcc

SEQ ID NO: 140405 - DNA, 20 bp, Artificial Sequence
  Description of Artificial Sequence: Synthetic oligonucleotide
  Target: ATXN1; (+) strand; PAM type: NRG; PAM sequence: TGG
gagccattgcgcccggcccc

SEQ ID NO: 140406 - DNA, 20 bp, Artificial Sequence
  Description of Artificial Sequence: Synthetic oligonucleotide
  Target: ATXN1; (+) strand; PAM type: NRG; PAM sequence: GGG
agccattgcgcccggcccct

SEQ ID NO: 140407 - DNA, 20 bp, Artificial Sequence
  Description of Artificial Sequence: Synthetic oligonucleotide
  Target: ATXN1; (+) strand; PAM type: NRG; PAM sequence: AAG
ggcccctgggtttctttctt

SEQ ID NO: 140408 - DNA, 20 bp, Artificial Sequence
  Description of Artificial Sequence: Synthetic oligonucleotide
  Target: ATXN1; (+) strand; PAM type: NRG; PAM sequence: AGG
gcccctgggtttctttctta

SEQ ID NO: 140409 - DNA, 20 bp, Artificial Sequence
  Description of Artificial Sequence: Synthetic oligonucleotide
  Target: ATXN1; (+) strand; PAM type: NRG; PAM sequence: TGG
ggtttctttcttaaggcttt

SEQ ID NO: 140410 - DNA, 20 bp, Artificial Sequence
  Description of Artificial Sequence: Synthetic oligonucleotide
  Target: ATXN1; (+) strand; PAM type: NRG; PAM sequence: GAG
tttctttcttaaggcttttg

SEQ ID NO: 140411 - DNA, 20 bp, Artificial Sequence
  Description of Artificial Sequence: Synthetic oligonucleotide
  Target: ATXN1; (+) strand; PAM type: NRG; PAM sequence: AAG
cttaaggcttttggagctcc

SEQ ID NO: 140412 - DNA, 20 bp, Artificial Sequence
  Description of Artificial Sequence: Synthetic oligonucleotide
  Target: ATXN1; (+) strand; PAM type: NRG; PAM sequence: AGG
ttaaggcttttggagctcca

SEQ ID NO: 140413 - DNA, 20 bp, Artificial Sequence
  Description of Artificial Sequence: Synthetic oligonucleotide
  Target: ATXN1; (+) strand; PAM type: NRG; PAM sequence: GGG
taaggcttttggagctccaa

SEQ ID NO: 140414 - DNA, 20 bp, Artificial Sequence
  Description of Artificial Sequence: Synthetic oligonucleotide
  Target: ATXN1; (+) strand; PAM type: NRG; PAM sequence: GGG
aaggcttttggagctccaag

SEQ ID NO: 140415 - DNA, 20 bp, Artificial Sequence
  Description of Artificial Sequence: Synthetic oligonucleotide
  Target: ATXN1; (+) strand; PAM type: NRG; PAM sequence: CAG
cttttggagctccaaggggc

SEQ ID NO: 140416 - DNA, 20 bp, Artificial Sequence
  Description of Artificial Sequence: Synthetic oligonucleotide
  Target: ATXN1; (+) strand; PAM type: NRG; PAM sequence: AGG
ttttggagctccaaggggcc

SEQ ID NO: 140417 - DNA, 20 bp, Artificial Sequence
  Description of Artificial Sequence: Synthetic oligonucleotide
  Target: ATXN1; (+) strand; PAM type: NRG; PAM sequence: GGG
tttggagctccaaggggcca

SEQ ID NO: 140418 - DNA, 20 bp, Artificial Sequence
  Description of Artificial Sequence: Synthetic oligonucleotide
  Target: ATXN1; (+) strand; PAM type: NRG; PAM sequence: AAG
ggagctccaaggggccaggg

SEQ ID NO: 140419 - DNA, 20 bp, Artificial Sequence
  Description of Artificial Sequence: Synthetic oligonucleotide
  Target: ATXN1; (+) strand; PAM type: NRG; PAM sequence: CAG
tccaaggggccagggaagtg

SEQ ID NO: 140420 - DNA, 20 bp, Artificial Sequence
  Description of Artificial Sequence: Synthetic oligonucleotide
  Target: ATXN1; (+) strand; PAM type: NRG; PAM sequence: CAG
cagggaagtgcagcttcaac

SEQ ID NO: 140421 - DNA, 20 bp, Artificial Sequence
  Description of Artificial Sequence: Synthetic oligonucleotide
  Target: ATXN1; (+) strand; PAM type: NRG; PAM sequence: CAG
ggaagtgcagcttcaaccag

SEQ ID NO: 140422 - DNA, 20 bp, Artificial Sequence
  Description of Artificial Sequence: Synthetic oligonucleotide
  Target: ATXN1; (+) strand; PAM type: NRG; PAM sequence: CAG
agtgcagcttcaaccagcag

SEQ ID NO: 140423 - DNA, 20 bp, Artificial Sequence
  Description of Artificial Sequence: Synthetic oligonucleotide
  Target: ATXN1; (+) strand; PAM type: NRG; PAM sequence: CAG
agcagcagccattgttctaa

SEQ ID NO: 140424 - DNA, 20 bp, Artificial Sequence
  Description of Artificial Sequence: Synthetic oligonucleotide
  Target: ATXN1; (+) strand; PAM type: NRG; PAM sequence: TGG
caactcactacttttaattg

SEQ ID NO: 140425 - DNA, 20 bp, Artificial Sequence
  Description of Artificial Sequence: Synthetic oligonucleotide
  Target: ATXN1; (+) strand; PAM type: NRG; PAM sequence: AAG
cttttaattgtggctcatta

SEQ ID NO: 140426 - DNA, 20 bp, Artificial Sequence
  Description of Artificial Sequence: Synthetic oligonucleotide
  Target: ATXN1; (+) strand; PAM type: NRG; PAM sequence: TAG
tggctcattaaagatgtaaa

SEQ ID NO: 140427 - DNA, 20 bp, Artificial Sequence
  Description of Artificial Sequence: Synthetic oligonucleotide
  Target: ATXN1; (+) strand; PAM type: NRG; PAM sequence: AAG
ctcattaaagatgtaaatag

SEQ ID NO: 140428 - DNA, 20 bp, Artificial Sequence
  Description of Artificial Sequence: Synthetic oligonucleotide
  Target: ATXN1; (+) strand; PAM type: NRG; PAM sequence: CAG
ctactacaatttcattgctg

SEQ ID NO: 140429 - DNA, 20 bp, Artificial Sequence
  Description of Artificial Sequence: Synthetic oligonucleotide
  Target: ATXN1; (+) strand; PAM type: NRG; PAM sequence: CAG
ttacaatgtttccttctatg

SEQ ID NO: 140430 - DNA, 20 bp, Artificial Sequence
  Description of Artificial Sequence: Synthetic oligonucleotide
  Target: ATXN1; (+) strand; PAM type: NRG; PAM sequence: AAG
aatgtttccttctatgcaga

SEQ ID NO: 140431 - DNA, 20 bp, Artificial Sequence
  Description of Artificial Sequence: Synthetic oligonucleotide
  Target: ATXN1; (+) strand; PAM type: NRG; PAM sequence: GAG
gaaagaaatacttcttctct

SEQ ID NO: 140432 - DNA, 20 bp, Artificial Sequence
  Description of Artificial Sequence: Synthetic oligonucleotide
  Target: ATXN1; (+) strand; PAM type: NRG; PAM sequence: TAG
aatacttcttctctgagtaa

SEQ ID NO: 140433 - DNA, 20 bp, Artificial Sequence
  Description of Artificial Sequence: Synthetic oligonucleotide
  Target: ATXN1; (+) strand; PAM type: NRG; PAM sequence: CAG
tcttctctgagtaatagcac

SEQ ID NO: 140434 - DNA, 20 bp, Artificial Sequence
  Description of Artificial Sequence: Synthetic oligonucleotide
  Target: ATXN1; (+) strand; PAM type: NRG; PAM sequence: AAG
tctctgagtaatagcaccag

SEQ ID NO: 140435 - DNA, 20 bp, Artificial Sequence
  Description of Artificial Sequence: Synthetic oligonucleotide
  Target: ATXN1; (+) strand; PAM type: NRG; PAM sequence: TGG
ctgagtaatagcaccagaag

SEQ ID NO: 140436 - DNA, 20 bp, Artificial Sequence
  Description of Artificial Sequence: Synthetic oligonucleotide
  Target: ATXN1; (+) strand; PAM type: NRG; PAM sequence: GAG
gagtaatagcaccagaagtg

SEQ ID NO: 140437 - DNA, 20 bp, Artificial Sequence
  Description of Artificial Sequence: Synthetic oligonucleotide
  Target: ATXN1; (+) strand; PAM type: NRG; PAM sequence: AGG
agtaatagcaccagaagtgg

SEQ ID NO: 140438 - DNA, 20 bp, Artificial Sequence
  Description of Artificial Sequence: Synthetic oligonucleotide
  Target: ATXN1; (+) strand; PAM type: NRG; PAM sequence: CAG
atgattcaccaattctccaa

SEQ ID NO: 140439 - DNA, 20 bp, Artificial Sequence
  Description of Artificial Sequence: Synthetic oligonucleotide
  Target: ATXN1; (+) strand; PAM type: NRG; PAM sequence: TAG
attcaccaattctccaacag

SEQ ID NO: 140440 - DNA, 20 bp, Artificial Sequence
  Description of Artificial Sequence: Synthetic oligonucleotide
  Target: ATXN1; (+) strand; PAM type: NRG; PAM sequence: AGG
ttcaccaattctccaacagt

SEQ ID NO: 140441 - DNA, 20 bp, Artificial Sequence
  Description of Artificial Sequence: Synthetic oligonucleotide
  Target: ATXN1; (+) strand; PAM type: NRG; PAM sequence: TGG
cacatgtgactgcctgttgt

SEQ ID NO: 140442 - DNA, 20 bp, Artificial Sequence
  Description of Artificial Sequence: Synthetic oligonucleotide
  Target: ATXN1; (+) strand; PAM type: NRG; PAM sequence: CAG
tgtgactgcctgttgttgga

SEQ ID NO: 140443 - DNA, 20 bp, Artificial Sequence
  Description of Artificial Sequence: Synthetic oligonucleotide
  Target: ATXN1; (+) strand; PAM type: NRG; PAM sequence: GAG
tgactgcctgttgttggaca

SEQ ID NO: 140444 - DNA, 20 bp, Artificial Sequence
  Description of Artificial Sequence: Synthetic oligonucleotide
  Target: ATXN1; (+) strand; PAM type: NRG; PAM sequence: AGG
gactgcctgttgttggacag

SEQ ID NO: 140445 - DNA, 20 bp, Artificial Sequence
  Description of Artificial Sequence: Synthetic oligonucleotide
  Target: ATXN1; (+) strand; PAM type: NRG; PAM sequence: CAG
tgcctgttgttggacagagg

SEQ ID NO: 140446 - DNA, 20 bp, Artificial Sequence
  Description of Artificial Sequence: Synthetic oligonucleotide
  Target: ATXN1; (+) strand; PAM type: NRG; PAM sequence: TGG
tgttgttggacagaggcaga

SEQ ID NO: 140447 - DNA, 20 bp, Artificial Sequence
  Description of Artificial Sequence: Synthetic oligonucleotide
  Target: ATXN1; (+) strand; PAM type: NRG; PAM sequence: CAG
gttggacagaggcagatgga

SEQ ID NO: 140448 - DNA, 20 bp, Artificial Sequence
  Description of Artificial Sequence: Synthetic oligonucleotide
  Target: ATXN1; (+) strand; PAM type: NRG; PAM sequence: AAG
cgttatttttttttaatgaa

SEQ ID NO: 140449 - DNA, 20 bp, Artificial Sequence
  Description of Artificial Sequence: Synthetic oligonucleotide
  Target: ATXN1; (+) strand; PAM type: NRG; PAM sequence: AAG
atttttttttaatgaaaaga

SEQ ID NO: 140450 - DNA, 20 bp, Artificial Sequence
  Description of Artificial Sequence: Synthetic oligonucleotide
  Target: ATXN1; (+) strand; PAM type: NRG; PAM sequence: AGG
tttttttttaatgaaaagaa

SEQ ID NO: 140451 - DNA, 20 bp, Artificial Sequence
  Description of Artificial Sequence: Synthetic oligonucleotide
  Target: ATXN1; (+) strand; PAM type: NRG; PAM sequence: CAG
aatgaaaagaaaggacacat

SEQ ID NO: 140452 - DNA, 20 bp, Artificial Sequence
  Description of Artificial Sequence: Synthetic oligonucleotide
  Target: ATXN1; (+) strand; PAM type: NRG; PAM sequence: AAG
agaaaggacacatcagttga

SEQ ID NO: 140453 - DNA, 20 bp, Artificial Sequence
  Description of Artificial Sequence: Synthetic oligonucleotide
  Target: ATXN1; (+) strand; PAM type: NRG; PAM sequence: CAG
acatcagttgaaagatgcaa

SEQ ID NO: 140454 - DNA, 20 bp, Artificial Sequence
  Description of Artificial Sequence: Synthetic oligonucleotide
  Target: ATXN1; (+) strand; PAM type: NRG; PAM sequence: AGG
catcagttgaaagatgcaac

SEQ ID NO: 140455 - DNA, 20 bp, Artificial Sequence
  Description of Artificial Sequence: Synthetic oligonucleotide
  Target: ATXN1; (+) strand; PAM type: NRG; PAM sequence: CAG
tttcactttgttgtcctttg

SEQ ID NO: 140456 - DNA, 20 bp, Artificial Sequence
  Description of Artificial Sequence: Synthetic oligonucleotide
  Target: ATXN1; (+) strand; PAM type: NRG; PAM sequence: AAG
tgcatttttttttcaaattg

SEQ ID NO: 140457 - DNA, 20 bp, Artificial Sequence
  Description of Artificial Sequence: Synthetic oligonucleotide
  Target: ATXN1; (+) strand; PAM type: NRG; PAM sequence: TGG
tttttcaaattgaagttctg

SEQ ID NO: 140458 - DNA, 20 bp, Artificial Sequence
  Description of Artificial Sequence: Synthetic oligonucleotide
  Target: ATXN1; (+) strand; PAM type: NRG; PAM sequence: AAG
ttctgtggcaaccccgtgtc

SEQ ID NO: 140459 - DNA, 20 bp, Artificial Sequence
  Description of Artificial Sequence: Synthetic oligonucleotide
  Target: ATXN1; (+) strand; PAM type: NRG; PAM sequence: CAG
cccgtgtcaagcaactccac

SEQ ID NO: 140460 - DNA, 20 bp, Artificial Sequence
  Description of Artificial Sequence: Synthetic oligonucleotide
  Target: ATXN1; (+) strand; PAM type: NRG; PAM sequence: CAG
caccagcatcacctctccaa

SEQ ID NO: 140461 - DNA, 20 bp, Artificial Sequence
  Description of Artificial Sequence: Synthetic oligonucleotide
  Target: ATXN1; (+) strand; PAM type: NRG; PAM sequence: GAG
caacagcatgtgctcatgtt

SEQ ID NO: 140462 - DNA, 20 bp, Artificial Sequence
  Description of Artificial Sequence: Synthetic oligonucleotide
  Target: ATXN1; (+) strand; PAM type: NRG; PAM sequence: CGG
gttgagcctctgccacattt

SEQ ID NO: 140463 - DNA, 20 bp, Artificial Sequence
  Description of Artificial Sequence: Synthetic oligonucleotide
  Target: ATXN1; (+) strand; PAM type: NRG; PAM sequence: CAG
tctgccacatttcggtaata

SEQ ID NO: 140464 - DNA, 20 bp, Artificial Sequence
  Description of Artificial Sequence: Synthetic oligonucleotide
  Target: ATXN1; (+) strand; PAM type: NRG; PAM sequence: TGG
ttgcgctgttatatctgtta

SEQ ID NO: 140465 - DNA, 20 bp, Artificial Sequence
  Description of Artificial Sequence: Synthetic oligonucleotide
  Target: ATXN1; (+) strand; PAM type: NRG; PAM sequence: GAG
tatatctgttatggtgatct

SEQ ID NO: 140466 - DNA, 20 bp, Artificial Sequence
  Description of Artificial Sequence: Synthetic oligonucleotide
  Target: ATXN1; (+) strand; PAM type: NRG; PAM sequence: CAG
ctgttatggtgatctgagat

SEQ ID NO: 140467 - DNA, 20 bp, Artificial Sequence
  Description of Artificial Sequence: Synthetic oligonucleotide
  Target: ATXN1; (+) strand; PAM type: NRG; PAM sequence: AAG
atgaaccacacaccccatat

SEQ ID NO: 140468 - DNA, 20 bp, Artificial Sequence
  Description of Artificial Sequence: Synthetic oligonucleotide
  Target: ATXN1; (+) strand; PAM type: NRG; PAM sequence: AGG
tgaaccacacaccccatata

SEQ ID NO: 140469 - DNA, 20 bp, Artificial Sequence
  Description of Artificial Sequence: Synthetic oligonucleotide
  Target: ATXN1; (+) strand; PAM type: NRG; PAM sequence: CAG
tataaggtaatgaacttaat

SEQ ID NO: 140470 - DNA, 20 bp, Artificial Sequence
  Description of Artificial Sequence: Synthetic oligonucleotide
  Target: ATXN1; (+) strand; PAM type: NRG; PAM sequence: AAG
tgtgtgttctgactgctaca

SEQ ID NO: 140471 - DNA, 20 bp, Artificial Sequence
  Description of Artificial Sequence: Synthetic oligonucleotide
  Target: ATXN1; (+) strand; PAM type: NRG; PAM sequence: TGG
gttctgactgctacaaagac

SEQ ID NO: 140472 - DNA, 20 bp, Artificial Sequence
  Description of Artificial Sequence: Synthetic oligonucleotide
  Target: ATXN1; (+) strand; PAM type: NRG; PAM sequence: CGG
ctgttctctctccctcctct

SEQ ID NO: 140473 - DNA, 20 bp, Artificial Sequence
  Description of Artificial Sequence: Synthetic oligonucleotide
  Target: ATXN1; (+) strand; PAM type: NRG; PAM sequence: GGG
tgttctctctccctcctctc

SEQ ID NO: 140474 - DNA, 20 bp, Artificial Sequence
  Description of Artificial Sequence: Synthetic oligonucleotide
  Target: ATXN1; (+) strand; PAM type: NRG; PAM sequence: CAG
ctcgggcctccttgtttcct

SEQ ID NO: 140475 - DNA, 20 bp, Artificial Sequence
  Description of Artificial Sequence: Synthetic oligonucleotide
  Target: ATXN1; (+) strand; PAM type: NRG; PAM sequence: AAG
ctccttgtttcctcagacac

SEQ ID NO: 140476 - DNA, 20 bp, Artificial Sequence
  Description of Artificial Sequence: Synthetic oligonucleotide
  Target: ATXN1; (+) strand; PAM type: NRG; PAM sequence: AAG
cctcagacacaagaatattg

SEQ ID NO: 140477 - DNA, 20 bp, Artificial Sequence
  Description of Artificial Sequence: Synthetic oligonucleotide
  Target: ATXN1; (+) strand; PAM type: NRG; PAM sequence: TGG
agacacaagaatattgaagt

SEQ ID NO: 140478 - DNA, 20 bp, Artificial Sequence
  Description of Artificial Sequence: Synthetic oligonucleotide
  Target: ATXN1; (+) strand; PAM type: NRG; PAM sequence: CAG
acaagaatattgaagttggc

SEQ ID NO: 140479 - DNA, 20 bp, Artificial Sequence
  Description of Artificial Sequence: Synthetic oligonucleotide
  Target: ATXN1; (+) strand; PAM type: NRG; PAM sequence: AGG
caagaatattgaagttggcc

SEQ ID NO: 140480 - DNA, 20 bp, Artificial Sequence
  Description of Artificial Sequence: Synthetic oligonucleotide
  Target: ATXN1; (+) strand; PAM type: NRG; PAM sequence: CGG
atattgaagttggccaggca

SEQ ID NO: 140481 - DNA, 20 bp, Artificial Sequence
  Description of Artificial Sequence: Synthetic oligonucleotide
  Target: ATXN1; (+) strand; PAM type: NRG; PAM sequence: GGG
tattgaagttggccaggcac

SEQ ID NO: 140482 - DNA, 20 bp, Artificial Sequence
  Description of Artificial Sequence: Synthetic oligonucleotide
  Target: ATXN1; (+) strand; PAM type: NRG; PAM sequence: GGG
attgaagttggccaggcacg

SEQ ID NO: 140483 - DNA, 20 bp, Artificial Sequence
  Description of Artificial Sequence: Synthetic oligonucleotide
  Target: ATXN1; (+) strand; PAM type: NRG; PAM sequence: GGG
ttgaagttggccaggcacgg

SEQ ID NO: 140484 - DNA, 20 bp, Artificial Sequence
  Description of Artificial Sequence: Synthetic oligonucleotide
  Target: ATXN1; (+) strand; PAM type: NRG; PAM sequence: CAG
ggggctcacgcctgtaatcc

SEQ ID NO: 140485 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 140486 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 140487 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 140488 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 140489 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggaggcc

SEQ ID NO: 140490 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggcca

SEQ ID NO: 140491 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggccaagg

SEQ ID NO: 140492 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccaaggt

SEQ ID NO: 140493 - DNA, 20 bp, Artificial Sequence
  Description of Artificial Sequence: Synthetic oligonucleotide
  Target: ATXN1; (+) strand; PAM type: NRG; PAM sequence: CAG
ctttgggaggccaaggtggg

SEQ ID NO: 140494 - DNA, 20 bp, Artificial Sequence
  Description of Artificial Sequence: Synthetic oligonucleotide
  Target: ATXN1; (+) strand; PAM type: NRG; PAM sequence: GAG
ggccaaggtgggcagatcac

SEQ ID NO: 140495 - DNA, 20 bp, Artificial Sequence
  Description of Artificial Sequence: Synthetic oligonucleotide
  Target: ATXN1; (+) strand; PAM type: NRG; PAM sequence: CAG
aggtgggcagatcacgagtt

SEQ ID NO: 140496 - DNA, 20 bp, Artificial Sequence
  Description of Artificial Sequence: Synthetic oligonucleotide
  Target: ATXN1; (+) strand; PAM type: NRG; PAM sequence: AGG
ggtgggcagatcacgagttc

SEQ ID NO: 140497 - DNA, 20 bp, Artificial Sequence
  Description of Artificial Sequence: Synthetic oligonucleotide
  Target: ATXN1; (+) strand; PAM type: NRG; PAM sequence: GAG
tgggcagatcacgagttcag

SEQ ID NO: 140498 - DNA, 20 bp, Artificial Sequence
  Description of Artificial Sequence: Synthetic oligonucleotide
  Target: ATXN1; (+) strand; PAM type: NRG; PAM sequence: AAG
gatcacgagttcaggagatc

SEQ ID NO: 140499 - DNA, 20 bp, Artificial Sequence
  Description of Artificial Sequence: Synthetic oligonucleotide
  Target: ATXN1; (+) strand; PAM type: NRG; PAM sequence: TGG
tcaggagatcaagaccatcc

SEQ ID NO: 140500 - DNA, 20 bp, Artificial Sequence
  Description of Artificial Sequence: Synthetic oligonucleotide
  Target: ATXN1; (+) strand; PAM type: NRG; PAM sequence: TGG
caagaccatcctggctaaca

SEQ ID NO: 140501 - DNA, 20 bp, Artificial Sequence
  Description of Artificial Sequence: Synthetic oligonucleotide
  Target: ATXN1; (+) strand; PAM type: NRG; PAM sequence: AAG
atctctactaaaaatacaaa

SEQ ID NO: 140502 - DNA, 20 bp, Artificial Sequence
  Description of Artificial Sequence: Synthetic oligonucleotide
  Target: ATXN1; (+) strand; PAM type: NRG; PAM sequence: TAG
ctactaaaaatacaaaaagt

SEQ ID NO: 140503 - DNA, 20 bp, Artificial Sequence
  Description of Artificial Sequence: Synthetic oligonucleotide
  Target: ATXN1; (+) strand; PAM type: NRG; PAM sequence: CGG
taaaaatacaaaaagttagc

SEQ ID NO: 140504 - DNA, 20 bp, Artificial Sequence
  Description of Artificial Sequence: Synthetic oligonucleotide
  Target: ATXN1; (+) strand; PAM type: NRG; PAM sequence: TAG
tacaaaaagttagccggacg

SEQ ID NO: 140505 - DNA, 20 bp, Artificial Sequence
  Description of Artificial Sequence: Synthetic oligonucleotide
  Target: ATXN1; (+) strand; PAM type: NRG; PAM sequence: TGG
aaaaagttagccggacgtag

SEQ ID NO: 140506 - DNA, 20 bp, Artificial Sequence
  Description of Artificial Sequence: Synthetic oligonucleotide
  Target: ATXN1; (+) strand; PAM type: NRG; PAM sequence: CGG
aagttagccggacgtagtgg

SEQ ID NO: 140507 - DNA, 20 bp, Artificial Sequence
  Description of Artificial Sequence: Synthetic oligonucleotide
  Target: ATXN1; (+) strand; PAM type: NRG; PAM sequence: GGG
agttagccggacgtagtggc

SEQ ID NO: 140508 - DNA, 20 bp, Artificial Sequence
  Description of Artificial Sequence: Synthetic oligonucleotide
  Target: ATXN1; (+) strand; PAM type: NRG; PAM sequence: TAG
gacgtagtggcgggtgcctg

SEQ ID NO: 140509 - DNA, 20 bp, Artificial Sequence
  Description of Artificial Sequence: Synthetic oligonucleotide
  Target: ATXN1; (+) strand; PAM type: NRG; PAM sequence: CAG
gtggcgggtgcctgtagtct

SEQ ID NO: 140510 - DNA, 20 bp, Artificial Sequence
  Description of Artificial Sequence: Synthetic oligonucleotide
  Target: ATXN1; (+) strand; PAM type: NRG; PAM sequence: CGG
tgcctgtagtctcagctatt

SEQ ID NO: 140511 - DNA, 20 bp, Artificial Sequence
  Description of Artificial Sequence: Synthetic oligonucleotide
  Target: ATXN1; (+) strand; PAM type: NRG; PAM sequence: GGG
gcctgtagtctcagctattc

SEQ ID NO: 140512 - DNA, 20 bp, Artificial Sequence
  Description of Artificial Sequence: Synthetic oligonucleotide
  Target: ATXN1; (+) strand; PAM type: NRG; PAM sequence: GAG
ctgtagtctcagctattcgg

SEQ ID NO: 140513 - DNA, 20 bp, Artificial Sequence
  Description of Artificial Sequence: Synthetic oligonucleotide
  Target: ATXN1; (+) strand; PAM type: NRG; PAM sequence: AGG
tgtagtctcagctattcggg

SEQ ID NO: 140514 - DNA, 20 bp, Artificial Sequence
  Description of Artificial Sequence: Synthetic oligonucleotide
  Target: ATXN1; (+) strand; PAM type: NRG; PAM sequence: GAG
tctcagctattcgggaggct

SEQ ID NO: 140515 - DNA, 20 bp, Artificial Sequence
  Description of Artificial Sequence: Synthetic oligonucleotide
  Target: ATXN1; (+) strand; PAM type: NRG; PAM sequence: AGG
ctcagctattcgggaggctg

SEQ ID NO: 140516 - DNA, 20 bp, Artificial Sequence
  Description of Artificial Sequence: Synthetic oligonucleotide
  Target: ATXN1; (+) strand; PAM type: NRG; PAM sequence: CAG
agctattcgggaggctgagg

SEQ ID NO: 140517 - DNA, 20 bp, Artificial Sequence
  Description of Artificial Sequence: Synthetic oligonucleotide
  Target: ATXN1; (+) strand; PAM type: NRG; PAM sequence: AGG
gctattcgggaggctgaggc

SEQ ID NO: 140518 - DNA, 20 bp, Artificial Sequence
  Description of Artificial Sequence: Synthetic oligonucleotide
  Target: ATXN1; (+) strand; PAM type: NRG; PAM sequence: GAG
tattcgggaggctgaggcag

SEQ ID NO: 140519 - DNA, 20 bp, Artificial Sequence
  Description of Artificial Sequence: Synthetic oligonucleotide
  Target: ATXN1; (+) strand; PAM type: NRG; PAM sequence: TGG
gggaggctgaggcaggagaa

SEQ ID NO: 140520 - DNA, 20 bp, Artificial Sequence
  Description of Artificial Sequence: Synthetic oligonucleotide
  Target: ATXN1; (+) strand; PAM type: NRG; PAM sequence: CGG
gcaggagaatggcgtgaacc

SEQ ID NO: 140521 - DNA, 20 bp, Artificial Sequence
  Description of Artificial Sequence: Synthetic oligonucleotide
  Target: ATXN1; (+) strand; PAM type: NRG; PAM sequence: GGG
caggagaatggcgtgaaccc

SEQ ID NO: 140522 - DNA, 20 bp, Artificial Sequence
  Description of Artificial Sequence: Synthetic oligonucleotide
  Target: ATXN1; (+) strand; PAM type: NRG; PAM sequence: GAG
ggagaatggcgtgaacccgg

SEQ ID NO: 140523 - DNA, 20 bp, Artificial Sequence
  Description of Artificial Sequence: Synthetic oligonucleotide
  Target: ATXN1; (+) strand; PAM type: NRG; PAM sequence: AGG
gagaatggcgtgaacccggg

SEQ ID NO: 140524 - DNA, 20 bp, Artificial Sequence
  Description of Artificial Sequence: Synthetic oligonucleotide
  Target: ATXN1; (+) strand; PAM type: NRG; PAM sequence: CGG
aatggcgtgaacccgggagg

SEQ ID NO: 140525 - DNA, 20 bp, Artificial Sequence
  Description of Artificial Sequence: Synthetic oligonucleotide
  Target: ATXN1; (+) strand; PAM type: NRG; PAM sequence: GAG
tggcgtgaacccgggaggcg

SEQ ID NO: 140526 - DNA, 20 bp, Artificial Sequence
  Description of Artificial Sequence: Synthetic oligonucleotide
  Target: ATXN1; (+) strand; PAM type: NRG; PAM sequence: CAG
aacccgggaggcggagcttg

SEQ ID NO: 140527 - DNA, 20 bp, Artificial Sequence
  Description of Artificial Sequence: Synthetic oligonucleotide
  Target: ATXN1; (+) strand; PAM type: NRG; PAM sequence: AAG
cgggaggcggagcttgcagt

SEQ ID NO: 140528 - DNA, 20 bp, Artificial Sequence
  Description of Artificial Sequence: Synthetic oligonucleotide
  Target: ATXN1; (+) strand; PAM type: NRG; PAM sequence: CAG
gaggcggagcttgcagtaag

SEQ ID NO: 140529 - DNA, 20 bp, Artificial Sequence
  Description of Artificial Sequence: Synthetic oligonucleotide
  Target: ATXN1; (+) strand; PAM type: NRG; PAM sequence: GAG
ggcggagcttgcagtaagca

SEQ ID NO: 140530 - DNA, 20 bp, Artificial Sequence
  Description of Artificial Sequence: Synthetic oligonucleotide
  Target: ATXN1; (+) strand; PAM type: NRG; PAM sequence: AAG
gagatcgtgccactgcactc

SEQ ID NO: 140531 - DNA, 20 bp, Artificial Sequence
  Description of Artificial Sequence: Synthetic oligonucleotide
  Target: ATXN1; (+) strand; PAM type: NRG; PAM sequence: TGG
cgtgccactgcactcaagcc

SEQ ID NO: 140532 - DNA, 20 bp, Artificial Sequence
  Description of Artificial Sequence: Synthetic oligonucleotide
  Target: ATXN1; (+) strand; PAM type: NRG; PAM sequence: GGG
gtgccactgcactcaagcct

SEQ ID NO: 140533 - DNA, 20 bp, Artificial Sequence
  Description of Artificial Sequence: Synthetic oligonucleotide
  Target: ATXN1; (+) strand; PAM type: NRG; PAM sequence: CAG
ctgcactcaagcctgggtga

SEQ ID NO: 140534 - DNA, 20 bp, Artificial Sequence
  Description of Artificial Sequence: Synthetic oligonucleotide
  Target: ATXN1; (+) strand; PAM type: NRG; PAM sequence: GAG
gcactcaagcctgggtgaca

SEQ ID NO: 140535 - DNA, 20 bp, Artificial Sequence
  Description of Artificial Sequence: Synthetic oligonucleotide
  Target: ATXN1; (+) strand; PAM type: NRG; PAM sequence: GAG
tcaagcctgggtgacagagc

SEQ ID NO: 140536 - DNA, 20 bp, Artificial Sequence
  Description of Artificial Sequence: Synthetic oligonucleotide
  Target: ATXN1; (+) strand; PAM type: NRG; PAM sequence: AAG
agcgagactctgtctcaaaa

SEQ ID NO: 140537 - DNA, 20 bp, Artificial Sequence
  Description of Artificial Sequence: Synthetic oligonucleotide
  Target: ATXN1; (+) strand; PAM type: NRG; PAM sequence: AAG
ctcaaaaaagaaaaaaaaaa

SEQ ID NO: 140538 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaagaatattgaaat

SEQ ID NO: 140539 - DNA, 20 bp, Artificial Sequence
  Description of Artificial Sequence: Synthetic oligonucleotide
  Target: ATXN1; (+) strand; PAM type: NRG; PAM sequence: AGG
aaaaaaagaatattgaaatt

SEQ ID NO: 140540 - DNA, 20 bp, Artificial Sequence
  Description of Artificial Sequence: Synthetic oligonucleotide
  Target: ATXN1; (+) strand; PAM type: NRG; PAM sequence: TAG
gccaattaataaccctaaaa

SEQ ID NO: 140541 - DNA, 20 bp, Artificial Sequence
  Description of Artificial Sequence: Synthetic oligonucleotide
  Target: ATXN1; (+) strand; PAM type: NRG; PAM sequence: AAG
ataaccctaaaatagccgct

SEQ ID NO: 140542 - DNA, 20 bp, Artificial Sequence
  Description of Artificial Sequence: Synthetic oligonucleotide
  Target: ATXN1; (+) strand; PAM type: NRG; PAM sequence: AAG
aaaatagccgctaagcattc

SEQ ID NO: 140543 - DNA, 20 bp, Artificial Sequence
  Description of Artificial Sequence: Synthetic oligonucleotide
  Target: ATXN1; (+) strand; PAM type: NRG; PAM sequence: AAG
gccgctaagcattcaagtga

SEQ ID NO: 140544 - DNA, 20 bp, Artificial Sequence
  Description of Artificial Sequence: Synthetic oligonucleotide
  Target: ATXN1; (+) strand; PAM type: NRG; PAM sequence: AGG
ccgctaagcattcaagtgaa

SEQ ID NO: 140545 - DNA, 20 bp, Artificial Sequence
  Description of Artificial Sequence: Synthetic oligonucleotide
  Target: ATXN1; (+) strand; PAM type: NRG; PAM sequence: AAG
ctaagcattcaagtgaaagg

SEQ ID NO: 140546 - DNA, 20 bp, Artificial Sequence
  Description of Artificial Sequence: Synthetic oligonucleotide
  Target: ATXN1; (+) strand; PAM type: NRG; PAM sequence: GAG
aagcattcaagtgaaaggaa

SEQ ID NO: 140547 - DNA, 20 bp, Artificial Sequence
  Description of Artificial Sequence: Synthetic oligonucleotide
  Target: ATXN1; (+) strand; PAM type: NRG; PAM sequence: GAG
attcaagtgaaaggaagagt

SEQ ID NO: 140548 - DNA, 20 bp, Artificial Sequence
  Description of Artificial Sequence: Synthetic oligonucleotide
  Target: ATXN1; (+) strand; PAM type: NRG; PAM sequence: AAG
acatacctctcaatttaaat

SEQ ID NO: 140549 - DNA, 20 bp, Artificial Sequence
  Description of Artificial Sequence: Synthetic oligonucleotide
  Target: ATXN1; (+) strand; PAM type: NRG; PAM sequence: TAG
ctcaatttaaataagaaaac

SEQ ID NO: 140550 - DNA, 20 bp, Artificial Sequence
  Description of Artificial Sequence: Synthetic oligonucleotide
  Target: ATXN1; (+) strand; PAM type: NRG; PAM sequence: AAG
taagaaaactagaaatgatt

SEQ ID NO: 140551 - DNA, 20 bp, Artificial Sequence
  Description of Artificial Sequence: Synthetic oligonucleotide
  Target: ATXN1; (+) strand; PAM type: NRG; PAM sequence: TAG
aaactagaaatgattaagct

SEQ ID NO: 140552 - DNA, 20 bp, Artificial Sequence
  Description of Artificial Sequence: Synthetic oligonucleotide
  Target: ATXN1; (+) strand; PAM type: NRG; PAM sequence: GAG
tagaaatgattaagcttagc

SEQ ID NO: 140553 - DNA, 20 bp, Artificial Sequence
  Description of Artificial Sequence: Synthetic oligonucleotide
  Target: ATXN1; (+) strand; PAM type: NRG; PAM sequence: AGG
agaaatgattaagcttagcg

SEQ ID NO: 140554 - DNA, 20 bp, Artificial Sequence
  Description of Artificial Sequence: Synthetic oligonucleotide
  Target: ATXN1; (+) strand; PAM type: NRG; PAM sequence: AAG
aatgattaagcttagcgagg

SEQ ID NO: 140555 - DNA, 20 bp, Artificial Sequence
  Description of Artificial Sequence: Synthetic oligonucleotide
  Target: ATXN1; (+) strand; PAM type: NRG; PAM sequence: AGG
atgattaagcttagcgagga

SEQ ID NO: 140556 - DNA, 20 bp, Artificial Sequence
  Description of Artificial Sequence: Synthetic oligonucleotide
  Target: ATXN1; (+) strand; PAM type: NRG; PAM sequence: AAG
tagcgaggaaggcatgttga

SEQ ID NO: 140557 - DNA, 20 bp, Artificial Sequence
  Description of Artificial Sequence: Synthetic oligonucleotide
  Target: ATXN1; (+) strand; PAM type: NRG; PAM sequence: AAG
tgaaagctgacatatgtcaa

SEQ ID NO: 140558 - DNA, 20 bp, Artificial Sequence
  Description of Artificial Sequence: Synthetic oligonucleotide
  Target: ATXN1; (+) strand; PAM type: NRG; PAM sequence: CAG
agctgacatatgtcaaaagc

SEQ ID NO: 140559 - DNA, 20 bp, Artificial Sequence
  Description of Artificial Sequence: Synthetic oligonucleotide
  Target: ATXN1; (+) strand; PAM type: NRG; PAM sequence: AGG
gctgacatatgtcaaaagcc

SEQ ID NO: 140560 - DNA, 20 bp, Artificial Sequence
  Description of Artificial Sequence: Synthetic oligonucleotide
  Target: ATXN1; (+) strand; PAM type: NRG; PAM sequence: AAG
agccaggcttcttgtgactg

SEQ ID NO: 140561 - DNA, 20 bp, Artificial Sequence
  Description of Artificial Sequence: Synthetic oligonucleotide
  Target: ATXN1; (+) strand; PAM type: NRG; PAM sequence: AGG
gccaggcttcttgtgactga

SEQ ID NO: 140562 - DNA, 20 bp, Artificial Sequence
  Description of Artificial Sequence: Synthetic oligonucleotide
  Target: ATXN1; (+) strand; PAM type: NRG; PAM sequence: GGG
ccaggcttcttgtgactgaa

SEQ ID NO: 140563 - DNA, 20 bp, Artificial Sequence
  Description of Artificial Sequence: Synthetic oligonucleotide
  Target: ATXN1; (+) strand; PAM type: NRG; PAM sequence: TAG
gcttcttgtgactgaagggt

SEQ ID NO: 140564 - DNA, 20 bp, Artificial Sequence
  Description of Artificial Sequence: Synthetic oligonucleotide
  Target: ATXN1; (+) strand; PAM type: NRG; PAM sequence: AAG
ttgtgactgaagggttagcc

SEQ ID NO: 140565 - DNA, 20 bp, Artificial Sequence
  Description of Artificial Sequence: Synthetic oligonucleotide
  Target: ATXN1; (+) strand; PAM type: NRG; PAM sequence: AAG
ttagccaagctgtgaatgct

SEQ ID NO: 140566 - DNA, 20 bp, Artificial Sequence
  Description of Artificial Sequence: Synthetic oligonucleotide
  Target: ATXN1; (+) strand; PAM type: NRG; PAM sequence: AGG
tagccaagctgtgaatgcta

SEQ ID NO: 140567 - DNA, 20 bp, Artificial Sequence
  Description of Artificial Sequence: Synthetic oligonucleotide
  Target: ATXN1; (+) strand; PAM type: NRG; PAM sequence: AAG
aagctgtgaatgctaaggaa

SEQ ID NO: 140568 - DNA, 20 bp, Artificial Sequence
  Description of Artificial Sequence: Synthetic oligonucleotide
  Target: ATXN1; (+) strand; PAM type: NRG; PAM sequence: AAG
atgctaaggaaaagttcttg

SEQ ID NO: 140569 - DNA, 20 bp, Artificial Sequence
  Description of Artificial Sequence: Synthetic oligonucleotide
  Target: ATXN1; (+) strand; PAM type: NRG; PAM sequence: AAG
aagttcttgaagaaaattaa

SEQ ID NO: 140570 - DNA, 20 bp, Artificial Sequence
  Description of Artificial Sequence: Synthetic oligonucleotide
  Target: ATXN1; (+) strand; PAM type: NRG; PAM sequence: CAG
gaaaattaaaagtgctactc

SEQ ID NO: 140571 - DNA, 20 bp, Artificial Sequence
  Description of Artificial Sequence: Synthetic oligonucleotide
  Target: ATXN1; (+) strand; PAM type: NRG; PAM sequence: TGG
tactccagtgaactcatcaa

SEQ ID NO: 140572 - DNA, 20 bp, Artificial Sequence
  Description of Artificial Sequence: Synthetic oligonucleotide
  Target: ATXN1; (+) strand; PAM type: NRG; PAM sequence: AAG
ccagtgaactcatcaatggt

SEQ ID NO: 140573 - DNA, 20 bp, Artificial Sequence
  Description of Artificial Sequence: Synthetic oligonucleotide
  Target: ATXN1; (+) strand; PAM type: NRG; PAM sequence: AAG
tgaactcatcaatggtaaga

SEQ ID NO: 140574 - DNA, 20 bp, Artificial Sequence
  Description of Artificial Sequence: Synthetic oligonucleotide
  Target: ATXN1; (+) strand; PAM type: NRG; PAM sequence: CAG
tcaatggtaagaaagtgaaa

SEQ ID NO: 140575 - DNA, 20 bp, Artificial Sequence
  Description of Artificial Sequence: Synthetic oligonucleotide
  Target: ATXN1; (+) strand; PAM type: NRG; PAM sequence: TGG
aaacagccttgttgctgata

SEQ ID NO: 140576 - DNA, 20 bp, Artificial Sequence
  Description of Artificial Sequence: Synthetic oligonucleotide
  Target: ATXN1; (+) strand; PAM type: NRG; PAM sequence: AAG
ccttgttgctgatatggaca

SEQ ID NO: 140577 - DNA, 20 bp, Artificial Sequence
  Description of Artificial Sequence: Synthetic oligonucleotide
  Target: ATXN1; (+) strand; PAM type: NRG; PAM sequence: TAG
gttgctgatatggacaaagt

SEQ ID NO: 140578 - DNA, 20 bp, Artificial Sequence
  Description of Artificial Sequence: Synthetic oligonucleotide
  Target: ATXN1; (+) strand; PAM type: NRG; PAM sequence: GAG
tgctgatatggacaaagtta

SEQ ID NO: 140579 - DNA, 20 bp, Artificial Sequence
  Description of Artificial Sequence: Synthetic oligonucleotide
  Target: ATXN1; (+) strand; PAM type: NRG; PAM sequence: TGG
tgatatggacaaagttagag

SEQ ID NO: 140580 - DNA, 20 bp, Artificial Sequence
  Description of Artificial Sequence: Synthetic oligonucleotide
  Target: ATXN1; (+) strand; PAM type: NRG; PAM sequence: TAG
caaagttagagtggtctgaa

SEQ ID NO: 140581 - DNA, 20 bp, Artificial Sequence
  Description of Artificial Sequence: Synthetic oligonucleotide
  Target: ATXN1; (+) strand; PAM type: NRG; PAM sequence: AAG
ttagagtggtctgaatagaa

SEQ ID NO: 140582 - DNA, 20 bp, Artificial Sequence
  Description of Artificial Sequence: Synthetic oligonucleotide
  Target: ATXN1; (+) strand; PAM type: NRG; PAM sequence: CAG
gtctgaatagaaaagcaaac

SEQ ID NO: 140583 - DNA, 20 bp, Artificial Sequence
  Description of Artificial Sequence: Synthetic oligonucleotide
  Target: ATXN1; (+) strand; PAM type: NRG; PAM sequence: AAG
aaccagccatacattccctt

SEQ ID NO: 140584 - DNA, 20 bp, Artificial Sequence
  Description of Artificial Sequence: Synthetic oligonucleotide
  Target: ATXN1; (+) strand; PAM type: NRG; PAM sequence: AAG
ccatacattcccttaagcca

SEQ ID NO: 140585 - DNA, 20 bp, Artificial Sequence
  Description of Artificial Sequence: Synthetic oligonucleotide
  Target: ATXN1; (+) strand; PAM type: NRG; PAM sequence: CAG
ccttaagccaaagcctaatc

SEQ ID NO: 140586 - DNA, 20 bp, Artificial Sequence
  Description of Artificial Sequence: Synthetic oligonucleotide
  Target: ATXN1; (+) strand; PAM type: NRG; PAM sequence: AAG
gccaaagcctaatccagatc

SEQ ID NO: 140587 - DNA, 20 bp, Artificial Sequence
  Description of Artificial Sequence: Synthetic oligonucleotide
  Target: ATXN1; (+) strand; PAM type: NRG; PAM sequence: AGG
ccaaagcctaatccagatca

SEQ ID NO: 140588 - DNA, 20 bp, Artificial Sequence
  Description of Artificial Sequence: Synthetic oligonucleotide
  Target: ATXN1; (+) strand; PAM type: NRG; PAM sequence: AAG
taactctcttcacttctatg

SEQ ID NO: 140589 - DNA, 20 bp, Artificial Sequence
  Description of Artificial Sequence: Synthetic oligonucleotide
  Target: ATXN1; (+) strand; PAM type: NRG; PAM sequence: AGG
aactctcttcacttctatga

SEQ ID NO: 140590 - DNA, 20 bp, Artificial Sequence
  Description of Artificial Sequence: Synthetic oligonucleotide
  Target: ATXN1; (+) strand; PAM type: NRG; PAM sequence: GAG
tcttcacttctatgaaggct

SEQ ID NO: 140591 - DNA, 20 bp, Artificial Sequence
  Description of Artificial Sequence: Synthetic oligonucleotide
  Target: ATXN1; (+) strand; PAM type: NRG; PAM sequence: GAG
ttcacttctatgaaggctga

SEQ ID NO: 140592 - DNA, 20 bp, Artificial Sequence
  Description of Artificial Sequence: Synthetic oligonucleotide
  Target: ATXN1; (+) strand; PAM type: NRG; PAM sequence: GAG
cacttctatgaaggctgaga

SEQ ID NO: 140593 - DNA, 20 bp, Artificial Sequence
  Description of Artificial Sequence: Synthetic oligonucleotide
  Target: ATXN1; (+) strand; PAM type: NRG; PAM sequence: AGG
acttctatgaaggctgagag

SEQ ID NO: 140594 - DNA, 20 bp, Artificial Sequence
  Description of Artificial Sequence: Synthetic oligonucleotide
  Target: ATXN1; (+) strand; PAM type: NRG; PAM sequence: GAG
ctatgaaggctgagagaggt

SEQ ID NO: 140595 - DNA, 20 bp, Artificial Sequence
  Description of Artificial Sequence: Synthetic oligonucleotide
  Target: ATXN1; (+) strand; PAM type: NRG; PAM sequence: AGG
tatgaaggctgagagaggtg

SEQ ID NO: 140596 - DNA, 20 bp, Artificial Sequence
  Description of Artificial Sequence: Synthetic oligonucleotide
  Target: ATXN1; (+) strand; PAM type: NRG; PAM sequence: TGG
gctgagagaggtgaggaact

SEQ ID NO: 140597 - DNA, 20 bp, Artificial Sequence
  Description of Artificial Sequence: Synthetic oligonucleotide
  Target: ATXN1; (+) strand; PAM type: NRG; PAM sequence: GAG
tgagagaggtgaggaacttg

SEQ ID NO: 140598 - DNA, 20 bp, Artificial Sequence
  Description of Artificial Sequence: Synthetic oligonucleotide
  Target: ATXN1; (+) strand; PAM type: NRG; PAM sequence: AAG
gagaggtgaggaacttggag

SEQ ID NO: 140599 - DNA, 20 bp, Artificial Sequence
  Description of Artificial Sequence: Synthetic oligonucleotide
  Target: ATXN1; (+) strand; PAM type: NRG; PAM sequence: AAG
gtgaggaacttggagaagaa

SEQ ID NO: 140600 - DNA, 20 bp, Artificial Sequence
  Description of Artificial Sequence: Synthetic oligonucleotide
  Target: ATXN1; (+) strand; PAM type: NRG; PAM sequence: AAG
acttggagaagaaaagtttg

SEQ ID NO: 140601 - DNA, 20 bp, Artificial Sequence
  Description of Artificial Sequence: Synthetic oligonucleotide
  Target: ATXN1; (+) strand; PAM type: NRG; PAM sequence: TAG
ggagaagaaaagtttgaagc

SEQ ID NO: 140602 - DNA, 20 bp, Artificial Sequence
  Description of Artificial Sequence: Synthetic oligonucleotide
  Target: ATXN1; (+) strand; PAM type: NRG; PAM sequence: CAG
gaagaaaagtttgaagctag

SEQ ID NO: 140603 - DNA, 20 bp, Artificial Sequence
  Description of Artificial Sequence: Synthetic oligonucleotide
  Target: ATXN1; (+) strand; PAM type: NRG; PAM sequence: AAG
gaaaagtttgaagctagcag

SEQ ID NO: 140604 - DNA, 20 bp, Artificial Sequence
  Description of Artificial Sequence: Synthetic oligonucleotide
  Target: ATXN1; (+) strand; PAM type: NRG; PAM sequence: TGG
agtttgaagctagcagaagt

SEQ ID NO: 140605 - DNA, 20 bp, Artificial Sequence
  Description of Artificial Sequence: Synthetic oligonucleotide
  Target: ATXN1; (+) strand; PAM type: NRG; PAM sequence: GAG
gctagcagaagttggttcgt

SEQ ID NO: 140606 - DNA, 20 bp, Artificial Sequence
  Description of Artificial Sequence: Synthetic oligonucleotide
  Target: ATXN1; (+) strand; PAM type: NRG; PAM sequence: AAG
gaagttggttcgtgagattt

SEQ ID NO: 140607 - DNA, 20 bp, Artificial Sequence
  Description of Artificial Sequence: Synthetic oligonucleotide
  Target: ATXN1; (+) strand; PAM type: NRG; PAM sequence: AGG
aagttggttcgtgagattta

SEQ ID NO: 140608 - DNA, 20 bp, Artificial Sequence
  Description of Artificial Sequence: Synthetic oligonucleotide
  Target: ATXN1; (+) strand; PAM type: NRG; PAM sequence: AAG
tggttcgtgagatttaagga

SEQ ID NO: 140609 - DNA, 20 bp, Artificial Sequence
  Description of Artificial Sequence: Synthetic oligonucleotide
  Target: ATXN1; (+) strand; PAM type: NRG; PAM sequence: TAG
atcttctccaaatgctgatg

SEQ ID NO: 140610 - DNA, 20 bp, Artificial Sequence
  Description of Artificial Sequence: Synthetic oligonucleotide
  Target: ATXN1; (+) strand; PAM type: NRG; PAM sequence: AAG
ttctccaaatgctgatgtag

SEQ ID NO: 140611 - DNA, 20 bp, Artificial Sequence
  Description of Artificial Sequence: Synthetic oligonucleotide
  Target: ATXN1; (+) strand; PAM type: NRG; PAM sequence: CAG
aaatgctgatgtagaagctg

SEQ ID NO: 140612 - DNA, 20 bp, Artificial Sequence
  Description of Artificial Sequence: Synthetic oligonucleotide
  Target: ATXN1; (+) strand; PAM type: NRG; PAM sequence: CAG
tgctgatgtagaagctgcag

SEQ ID NO: 140613 - DNA, 20 bp, Artificial Sequence
  Description of Artificial Sequence: Synthetic oligonucleotide
  Target: ATXN1; (+) strand; PAM type: NRG; PAM sequence: AGG
gctgatgtagaagctgcagc

SEQ ID NO: 140614 - DNA, 20 bp, Artificial Sequence
  Description of Artificial Sequence: Synthetic oligonucleotide
  Target: ATXN1; (+) strand; PAM type: NRG; PAM sequence: CAG
agaagctgcagcaggttatc

SEQ ID NO: 140615 - DNA, 20 bp, Artificial Sequence
  Description of Artificial Sequence: Synthetic oligonucleotide
  Target: ATXN1; (+) strand; PAM type: NRG; PAM sequence: AAG
gttatccagaaaatttaact

SEQ ID NO: 140616 - DNA, 20 bp, Artificial Sequence
  Description of Artificial Sequence: Synthetic oligonucleotide
  Target: ATXN1; (+) strand; PAM type: NRG; PAM sequence: AAG
tttaactaagatcattgatg

SEQ ID NO: 140617 - DNA, 20 bp, Artificial Sequence
  Description of Artificial Sequence: Synthetic oligonucleotide
  Target: ATXN1; (+) strand; PAM type: NRG; PAM sequence: AGG
ttaactaagatcattgatga

SEQ ID NO: 140618 - DNA, 20 bp, Artificial Sequence
  Description of Artificial Sequence: Synthetic oligonucleotide
  Target: ATXN1; (+) strand; PAM type: NRG; PAM sequence: CAG
atcattgatgaaggtgacta

SEQ ID NO: 140619 - DNA, 20 bp, Artificial Sequence
  Description of Artificial Sequence: Synthetic oligonucleotide
  Target: ATXN1; (+) strand; PAM type: NRG; PAM sequence: TAG
tgactacagatttttcaacg

SEQ ID NO: 140620 - DNA, 20 bp, Artificial Sequence
  Description of Artificial Sequence: Synthetic oligonucleotide
  Target: ATXN1; (+) strand; PAM type: NRG; PAM sequence: AGG
gactacagatttttcaacgt

SEQ ID NO: 140621 - DNA, 20 bp, Artificial Sequence
  Description of Artificial Sequence: Synthetic oligonucleotide
  Target: ATXN1; (+) strand; PAM type: NRG; PAM sequence: AAG
cagatttttcaacgtaggca

SEQ ID NO: 140622 - DNA, 20 bp, Artificial Sequence
  Description of Artificial Sequence: Synthetic oligonucleotide
  Target: ATXN1; (+) strand; PAM type: NRG; PAM sequence: CAG
atttttcaacgtaggcaaag

SEQ ID NO: 140623 - DNA, 20 bp, Artificial Sequence
  Description of Artificial Sequence: Synthetic oligonucleotide
  Target: ATXN1; (+) strand; PAM type: NRG; PAM sequence: TGG
taggcaaagcagccttctat

SEQ ID NO: 140624 - DNA, 20 bp, Artificial Sequence
  Description of Artificial Sequence: Synthetic oligonucleotide
  Target: ATXN1; (+) strand; PAM type: NRG; PAM sequence: AAG
gcaaagcagccttctattgg

SEQ ID NO: 140625 - DNA, 20 bp, Artificial Sequence
  Description of Artificial Sequence: Synthetic oligonucleotide
  Target: ATXN1; (+) strand; PAM type: NRG; PAM sequence: AAG
attggaagaaaatgccattt

SEQ ID NO: 140626 - DNA, 20 bp, Artificial Sequence
  Description of Artificial Sequence: Synthetic oligonucleotide
  Target: ATXN1; (+) strand; PAM type: NRG; PAM sequence: TAG
aatgccatttaagactttca

SEQ ID NO: 140627 - DNA, 20 bp, Artificial Sequence
  Description of Artificial Sequence: Synthetic oligonucleotide
  Target: ATXN1; (+) strand; PAM type: NRG; PAM sequence: TAG
ccatttaagactttcatagc

SEQ ID NO: 140628 - DNA, 20 bp, Artificial Sequence
  Description of Artificial Sequence: Synthetic oligonucleotide
  Target: ATXN1; (+) strand; PAM type: NRG; PAM sequence: GAG
atttaagactttcatagcta

SEQ ID NO: 140629 - DNA, 20 bp, Artificial Sequence
  Description of Artificial Sequence: Synthetic oligonucleotide
  Target: ATXN1; (+) strand; PAM type: NRG; PAM sequence: GAG
ttaagactttcatagctaga

SEQ ID NO: 140630 - DNA, 20 bp, Artificial Sequence
  Description of Artificial Sequence: Synthetic oligonucleotide
  Target: ATXN1; (+) strand; PAM type: NRG; PAM sequence: AGG
taagactttcatagctagag

SEQ ID NO: 140631 - DNA, 20 bp, Artificial Sequence
  Description of Artificial Sequence: Synthetic oligonucleotide
  Target: ATXN1; (+) strand; PAM type: NRG; PAM sequence: GAG
agactttcatagctagagag

SEQ ID NO: 140632 - DNA, 20 bp, Artificial Sequence
  Description of Artificial Sequence: Synthetic oligonucleotide
  Target: ATXN1; (+) strand; PAM type: NRG; PAM sequence: AAG
ctttcatagctagagaggag

SEQ ID NO: 140633 - DNA, 20 bp, Artificial Sequence
  Description of Artificial Sequence: Synthetic oligonucleotide
  Target: ATXN1; (+) strand; PAM type: NRG; PAM sequence: AAG
gaagtcaatgcttgactaca

SEQ ID NO: 140634 - DNA, 20 bp, Artificial Sequence
  Description of Artificial Sequence: Synthetic oligonucleotide
  Target: ATXN1; (+) strand; PAM type: NRG; PAM sequence: AAG
tgcttgactacaaagcttca

SEQ ID NO: 140635 - DNA, 20 bp, Artificial Sequence
  Description of Artificial Sequence: Synthetic oligonucleotide
  Target: ATXN1; (+) strand; PAM type: NRG; PAM sequence: AGG
gcttgactacaaagcttcaa

SEQ ID NO: 140636 - DNA, 20 bp, Artificial Sequence
  Description of Artificial Sequence: Synthetic oligonucleotide
  Target: ATXN1; (+) strand; PAM type: NRG; PAM sequence: GAG
ttgactacaaagcttcaaag

SEQ ID NO: 140637 - DNA, 20 bp, Artificial Sequence
  Description of Artificial Sequence: Synthetic oligonucleotide
  Target: ATXN1; (+) strand; PAM type: NRG; PAM sequence: GAG
gactacaaagcttcaaagga

SEQ ID NO: 140638 - DNA, 20 bp, Artificial Sequence
  Description of Artificial Sequence: Synthetic oligonucleotide
  Target: ATXN1; (+) strand; PAM type: NRG; PAM sequence: AGG
actacaaagcttcaaaggag

SEQ ID NO: 140639 - DNA, 20 bp, Artificial Sequence
  Description of Artificial Sequence: Synthetic oligonucleotide
  Target: ATXN1; (+) strand; PAM type: NRG; PAM sequence: CGG
agaggctgactctcttgtta

SEQ ID NO: 140640 - DNA, 20 bp, Artificial Sequence
  Description of Artificial Sequence: Synthetic oligonucleotide
  Target: ATXN1; (+) strand; PAM type: NRG; PAM sequence: GGG
gaggctgactctcttgttac

SEQ ID NO: 140641 - DNA, 20 bp, Artificial Sequence
  Description of Artificial Sequence: Synthetic oligonucleotide
  Target: ATXN1; (+) strand; PAM type: NRG; PAM sequence: CAG
tctcttgttacgggcaaatg

SEQ ID NO: 140642 - DNA, 20 bp, Artificial Sequence
  Description of Artificial Sequence: Synthetic oligonucleotide
  Target: ATXN1; (+) strand; PAM type: NRG; PAM sequence: TAG
ttgttacgggcaaatgcagc

SEQ ID NO: 140643 - DNA, 20 bp, Artificial Sequence
  Description of Artificial Sequence: Synthetic oligonucleotide
  Target: ATXN1; (+) strand; PAM type: NRG; PAM sequence: TAG
gcaaatgcagctagtgactt

SEQ ID NO: 140644 - DNA, 20 bp, Artificial Sequence
  Description of Artificial Sequence: Synthetic oligonucleotide
  Target: ATXN1; (+) strand; PAM type: NRG; PAM sequence: AAG
gcagctagtgactttagttg

SEQ ID NO: 140645 - DNA, 20 bp, Artificial Sequence
  Description of Artificial Sequence: Synthetic oligonucleotide
  Target: ATXN1; (+) strand; PAM type: NRG; PAM sequence: TAG
atttaccattccaaaaatcc

SEQ ID NO: 140646 - DNA, 20 bp, Artificial Sequence
  Description of Artificial Sequence: Synthetic oligonucleotide
  Target: ATXN1; (+) strand; PAM type: NRG; PAM sequence: GAG
ttaccattccaaaaatccta

SEQ ID NO: 140647 - DNA, 20 bp, Artificial Sequence
  Description of Artificial Sequence: Synthetic oligonucleotide
  Target: ATXN1; (+) strand; PAM type: NRG; PAM sequence: CAG
ttatgctgaatctactctgc

SEQ ID NO: 140648 - DNA, 20 bp, Artificial Sequence
  Description of Artificial Sequence: Synthetic oligonucleotide
  Target: ATXN1; (+) strand; PAM type: NRG; PAM sequence: TAG
aatctactctgccagtgcta

SEQ ID NO: 140649 - DNA, 20 bp, Artificial Sequence
  Description of Artificial Sequence: Synthetic oligonucleotide
  Target: ATXN1; (+) strand; PAM type: NRG; PAM sequence: TGG
ctctgccagtgctatagaaa

SEQ ID NO: 140650 - DNA, 20 bp, Artificial Sequence
  Description of Artificial Sequence: Synthetic oligonucleotide
  Target: ATXN1; (+) strand; PAM type: NRG; PAM sequence: AAG
gctatagaaatggaacaaca

SEQ ID NO: 140651 - DNA, 20 bp, Artificial Sequence
  Description of Artificial Sequence: Synthetic oligonucleotide
  Target: ATXN1; (+) strand; PAM type: NRG; PAM sequence: TGG
agaaatggaacaacaaagcc

SEQ ID NO: 140652 - DNA, 20 bp, Artificial Sequence
  Description of Artificial Sequence: Synthetic oligonucleotide
  Target: ATXN1; (+) strand; PAM type: NRG; PAM sequence: AAG
gaacaacaaagcctggatga

SEQ ID NO: 140653 - DNA, 20 bp, Artificial Sequence
  Description of Artificial Sequence: Synthetic oligonucleotide
  Target: ATXN1; (+) strand; PAM type: NRG; PAM sequence: TGG
aagcctggatgaaagcacat

SEQ ID NO: 140654 - DNA, 20 bp, Artificial Sequence
  Description of Artificial Sequence: Synthetic oligonucleotide
  Target: ATXN1; (+) strand; PAM type: NRG; PAM sequence: GGG
agcctggatgaaagcacatt

SEQ ID NO: 140655 - DNA, 20 bp, Artificial Sequence
  Description of Artificial Sequence: Synthetic oligonucleotide
  Target: ATXN1; (+) strand; PAM type: NRG; PAM sequence: AAG
attgggttactaaatacttt

SEQ ID NO: 140656 - DNA, 20 bp, Artificial Sequence
  Description of Artificial Sequence: Synthetic oligonucleotide
  Target: ATXN1; (+) strand; PAM type: NRG; PAM sequence: GAG
aatactttaagcccactgtt

SEQ ID NO: 140657 - DNA, 20 bp, Artificial Sequence
  Description of Artificial Sequence: Synthetic oligonucleotide
  Target: ATXN1; (+) strand; PAM type: NRG; PAM sequence: CAG
actgttgagacttaattgct

SEQ ID NO: 140658 - DNA, 20 bp, Artificial Sequence
  Description of Artificial Sequence: Synthetic oligonucleotide
  Target: ATXN1; (+) strand; PAM type: NRG; PAM sequence: AAG
gagacttaattgctcagaaa

SEQ ID NO: 140659 - DNA, 20 bp, Artificial Sequence
  Description of Artificial Sequence: Synthetic oligonucleotide
  Target: ATXN1; (+) strand; PAM type: NRG; PAM sequence: AAG
atgcacttcgtcactcatct

SEQ ID NO: 140660 - DNA, 20 bp, Artificial Sequence
  Description of Artificial Sequence: Synthetic oligonucleotide
  Target: ATXN1; (+) strand; PAM type: NRG; PAM sequence: GAG
gcacttcgtcactcatctaa

SEQ ID NO: 140661 - DNA, 20 bp, Artificial Sequence
  Description of Artificial Sequence: Synthetic oligonucleotide
  Target: ATXN1; (+) strand; PAM type: NRG; PAM sequence: TGG
cactcatctaagagctctga

SEQ ID NO: 140662 - DNA, 20 bp, Artificial Sequence
  Description of Artificial Sequence: Synthetic oligonucleotide
  Target: ATXN1; (+) strand; PAM type: NRG; PAM sequence: AAG
gagctctgatggaaatatac

SEQ ID NO: 140663 - DNA, 20 bp, Artificial Sequence
  Description of Artificial Sequence: Synthetic oligonucleotide
  Target: ATXN1; (+) strand; PAM type: NRG; PAM sequence: AGG
agctctgatggaaatataca

SEQ ID NO: 140664 - DNA, 20 bp, Artificial Sequence
  Description of Artificial Sequence: Synthetic oligonucleotide
  Target: ATXN1; (+) strand; PAM type: NRG; PAM sequence: GAG
ctctgatggaaatatacaag

SEQ ID NO: 140665 - DNA, 20 bp, Artificial Sequence
  Description of Artificial Sequence: Synthetic oligonucleotide
  Target: ATXN1; (+) strand; PAM type: NRG; PAM sequence: TGG
aacacccattctgcaaccca

SEQ ID NO: 140666 - DNA, 20 bp, Artificial Sequence
  Description of Artificial Sequence: Synthetic oligonucleotide
  Target: ATXN1; (+) strand; PAM type: NRG; PAM sequence: AAG
cattctgcaacccatggatc

SEQ ID NO: 140667 - DNA, 20 bp, Artificial Sequence
  Description of Artificial Sequence: Synthetic oligonucleotide
  Target: ATXN1; (+) strand; PAM type: NRG; PAM sequence: AGG
attctgcaacccatggatca

SEQ ID NO: 140668 - DNA, 20 bp, Artificial Sequence
  Description of Artificial Sequence: Synthetic oligonucleotide
  Target: ATXN1; (+) strand; PAM type: NRG; PAM sequence: GAG
tctgcaacccatggatcaag

SEQ ID NO: 140669 - DNA, 20 bp, Artificial Sequence
  Description of Artificial Sequence: Synthetic oligonucleotide
  Target: ATXN1; (+) strand; PAM type: NRG; PAM sequence: AAG
aaggagtaatttttattttc

SEQ ID NO: 140670 - DNA, 20 bp, Artificial Sequence
  Description of Artificial Sequence: Synthetic oligonucleotide
  Target: ATXN1; (+) strand; PAM type: NRG; PAM sequence: AAG
attttcaagtcttcttattt

SEQ ID NO: 140671 - DNA, 20 bp, Artificial Sequence
  Description of Artificial Sequence: Synthetic oligonucleotide
  Target: ATXN1; (+) strand; PAM type: NRG; PAM sequence: AAG
atttaagaaatacattctgt

SEQ ID NO: 140672 - DNA, 20 bp, Artificial Sequence
  Description of Artificial Sequence: Synthetic oligonucleotide
  Target: ATXN1; (+) strand; PAM type: NRG; PAM sequence: AGG
tttaagaaatacattctgta

SEQ ID NO: 140673 - DNA, 20 bp, Artificial Sequence
  Description of Artificial Sequence: Synthetic oligonucleotide
  Target: ATXN1; (+) strand; PAM type: NRG; PAM sequence: CAG
ctgtaaggctatcattgcca

SEQ ID NO: 140674 - DNA, 20 bp, Artificial Sequence
  Description of Artificial Sequence: Synthetic oligonucleotide
  Target: ATXN1; (+) strand; PAM type: NRG; PAM sequence: AAG
aaggctatcattgccacaga

SEQ ID NO: 140675 - DNA, 20 bp, Artificial Sequence
  Description of Artificial Sequence: Synthetic oligonucleotide
  Target: ATXN1; (+) strand; PAM type: NRG; PAM sequence: TGG
acagaaagtaattcctctga

SEQ ID NO: 140676 - DNA, 20 bp, Artificial Sequence
  Description of Artificial Sequence: Synthetic oligonucleotide
  Target: ATXN1; (+) strand; PAM type: NRG; PAM sequence: TGG
agtaattcctctgatggatc

SEQ ID NO: 140677 - DNA, 20 bp, Artificial Sequence
  Description of Artificial Sequence: Synthetic oligonucleotide
  Target: ATXN1; (+) strand; PAM type: NRG; PAM sequence: GGG
gtaattcctctgatggatct

SEQ ID NO: 140678 - DNA, 20 bp, Artificial Sequence
  Description of Artificial Sequence: Synthetic oligonucleotide
  Target: ATXN1; (+) strand; PAM type: NRG; PAM sequence: AAG
tcctctgatggatctgggaa

SEQ ID NO: 140679 - DNA, 20 bp, Artificial Sequence
  Description of Artificial Sequence: Synthetic oligonucleotide
  Target: ATXN1; (+) strand; PAM type: NRG; PAM sequence: TGG
aaagtaaattgaaaacctcc

SEQ ID NO: 140680 - DNA, 20 bp, Artificial Sequence
  Description of Artificial Sequence: Synthetic oligonucleotide
  Target: ATXN1; (+) strand; PAM type: NRG; PAM sequence: AAG
taaattgaaaacctcctgga

SEQ ID NO: 140681 - DNA, 20 bp, Artificial Sequence
  Description of Artificial Sequence: Synthetic oligonucleotide
  Target: ATXN1; (+) strand; PAM type: NRG; PAM sequence: AGG
aaattgaaaacctcctggaa

SEQ ID NO: 140682 - DNA, 20 bp, Artificial Sequence
  Description of Artificial Sequence: Synthetic oligonucleotide
  Target: ATXN1; (+) strand; PAM type: NRG; PAM sequence: TAG
ctggaaaggattcaccattg

SEQ ID NO: 140683 - DNA, 20 bp, Artificial Sequence
  Description of Artificial Sequence: Synthetic oligonucleotide
  Target: ATXN1; (+) strand; PAM type: NRG; PAM sequence: AAG
tcaccattgtagatgtcatt

SEQ ID NO: 140684 - DNA, 20 bp, Artificial Sequence
  Description of Artificial Sequence: Synthetic oligonucleotide
  Target: ATXN1; (+) strand; PAM type: NRG; PAM sequence: TGG
cattaagaacatttgattca

SEQ ID NO: 140685 - DNA, 20 bp, Artificial Sequence
  Description of Artificial Sequence: Synthetic oligonucleotide
  Target: ATXN1; (+) strand; PAM type: NRG; PAM sequence: GGG
attaagaacatttgattcat

SEQ ID NO: 140686 - DNA, 20 bp, Artificial Sequence
  Description of Artificial Sequence: Synthetic oligonucleotide
  Target: ATXN1; (+) strand; PAM type: NRG; PAM sequence: AAG
aagaacatttgattcatggg

SEQ ID NO: 140687 - DNA, 20 bp, Artificial Sequence
  Description of Artificial Sequence: Synthetic oligonucleotide
  Target: ATXN1; (+) strand; PAM type: NRG; PAM sequence: GAG
gaacatttgattcatgggaa

SEQ ID NO: 140688 - DNA, 20 bp, Artificial Sequence
  Description of Artificial Sequence: Synthetic oligonucleotide
  Target: ATXN1; (+) strand; PAM type: NRG; PAM sequence: AGG
aacatttgattcatgggaag

SEQ ID NO: 140689 - DNA, 20 bp, Artificial Sequence
  Description of Artificial Sequence: Synthetic oligonucleotide
  Target: ATXN1; (+) strand; PAM type: NRG; PAM sequence: CAG
caaaatatcaacatgaacat

SEQ ID NO: 140690 - DNA, 20 bp, Artificial Sequence
  Description of Artificial Sequence: Synthetic oligonucleotide
  Target: ATXN1; (+) strand; PAM type: NRG; PAM sequence: TGG
tatcaacatgaacatcagtt

SEQ ID NO: 140691 - DNA, 20 bp, Artificial Sequence
  Description of Artificial Sequence: Synthetic oligonucleotide
  Target: ATXN1; (+) strand; PAM type: NRG; PAM sequence: AAG
caacatgaacatcagtttgg

SEQ ID NO: 140692 - DNA, 20 bp, Artificial Sequence
  Description of Artificial Sequence: Synthetic oligonucleotide
  Target: ATXN1; (+) strand; PAM type: NRG; PAM sequence: AAG
catgaacatcagtttggaag

SEQ ID NO: 140693 - DNA, 20 bp, Artificial Sequence
  Description of Artificial Sequence: Synthetic oligonucleotide
  Target: ATXN1; (+) strand; PAM type: NRG; PAM sequence: TGG
gaagttgattccaaccccca

SEQ ID NO: 140694 - DNA, 20 bp, Artificial Sequence
  Description of Artificial Sequence: Synthetic oligonucleotide
  Target: ATXN1; (+) strand; PAM type: NRG; PAM sequence: GAG
ccaacccccatggatgactt

SEQ ID NO: 140695 - DNA, 20 bp, Artificial Sequence
  Description of Artificial Sequence: Synthetic oligonucleotide
  Target: ATXN1; (+) strand; PAM type: NRG; PAM sequence: AGG
caacccccatggatgacttg

SEQ ID NO: 140696 - DNA, 20 bp, Artificial Sequence
  Description of Artificial Sequence: Synthetic oligonucleotide
  Target: ATXN1; (+) strand; PAM type: NRG; PAM sequence: GGG
aacccccatggatgacttga

SEQ ID NO: 140697 - DNA, 20 bp, Artificial Sequence
  Description of Artificial Sequence: Synthetic oligonucleotide
  Target: ATXN1; (+) strand; PAM type: NRG; PAM sequence: AAG
atggatgacttgagggtttc

SEQ ID NO: 140698 - DNA, 20 bp, Artificial Sequence
  Description of Artificial Sequence: Synthetic oligonucleotide
  Target: ATXN1; (+) strand; PAM type: NRG; PAM sequence: CGG
acttgagggtttcaagactt

SEQ ID NO: 140699 - DNA, 20 bp, Artificial Sequence
  Description of Artificial Sequence: Synthetic oligonucleotide
  Target: ATXN1; (+) strand; PAM type: NRG; PAM sequence: TGG
tgagggtttcaagacttcgg

SEQ ID NO: 140700 - DNA, 20 bp, Artificial Sequence
  Description of Artificial Sequence: Synthetic oligonucleotide
  Target: ATXN1; (+) strand; PAM type: NRG; PAM sequence: GAG
agggtttcaagacttcggtg

SEQ ID NO: 140701 - DNA, 20 bp, Artificial Sequence
  Description of Artificial Sequence: Synthetic oligonucleotide
  Target: ATXN1; (+) strand; PAM type: NRG; PAM sequence: AGG
gggtttcaagacttcggtgg

SEQ ID NO: 140702 - DNA, 20 bp, Artificial Sequence
  Description of Artificial Sequence: Synthetic oligonucleotide
  Target: ATXN1; (+) strand; PAM type: NRG; PAM sequence: AAG
tttcaagacttcggtggagg

SEQ ID NO: 140703 - DNA, 20 bp, Artificial Sequence
  Description of Artificial Sequence: Synthetic oligonucleotide
  Target: ATXN1; (+) strand; PAM type: NRG; PAM sequence: AGG
ttcaagacttcggtggagga

SEQ ID NO: 140704 - DNA, 20 bp, Artificial Sequence
  Description of Artificial Sequence: Synthetic oligonucleotide
  Target: ATXN1; (+) strand; PAM type: NRG; PAM sequence: CAG
ttcggtggaggaaggaactg

SEQ ID NO: 140705 - DNA, 20 bp, Artificial Sequence
  Description of Artificial Sequence: Synthetic oligonucleotide
  Target: ATXN1; (+) strand; PAM type: NRG; PAM sequence: GAG
tggaggaaggaactgcagat

SEQ ID NO: 140706 - DNA, 20 bp, Artificial Sequence
  Description of Artificial Sequence: Synthetic oligonucleotide
  Target: ATXN1; (+) strand; PAM type: NRG; PAM sequence: AGG
ggaggaaggaactgcagatg

SEQ ID NO: 140707 - DNA, 20 bp, Artificial Sequence
  Description of Artificial Sequence: Synthetic oligonucleotide
  Target: ATXN1; (+) strand; PAM type: NRG; PAM sequence: TGG
ggaaggaactgcagatgagg

SEQ ID NO: 140708 - DNA, 20 bp, Artificial Sequence
  Description of Artificial Sequence: Synthetic oligonucleotide
  Target: ATXN1; (+) strand; PAM type: NRG; PAM sequence: CAG
aactgcagatgaggtggaaa

SEQ ID NO: 140709 - DNA, 20 bp, Artificial Sequence
  Description of Artificial Sequence: Synthetic oligonucleotide
  Target: ATXN1; (+) strand; PAM type: NRG; PAM sequence: AAG
gcagatgaggtggaaacagc

SEQ ID NO: 140710 - DNA, 20 bp, Artificial Sequence
  Description of Artificial Sequence: Synthetic oligonucleotide
  Target: ATXN1; (+) strand; PAM type: NRG; PAM sequence: GAG
agatgaggtggaaacagcaa

SEQ ID NO: 140711 - DNA, 20 bp, Artificial Sequence
  Description of Artificial Sequence: Synthetic oligonucleotide
  Target: ATXN1; (+) strand; PAM type: NRG; PAM sequence: CAG
ggtggaaacagcaagagaac

SEQ ID NO: 140712 - DNA, 20 bp, Artificial Sequence
  Description of Artificial Sequence: Synthetic oligonucleotide
  Target: ATXN1; (+) strand; PAM type: NRG; PAM sequence: TAG
aacagcaagagaaccagaat

SEQ ID NO: 140713 - DNA, 20 bp, Artificial Sequence
  Description of Artificial Sequence: Synthetic oligonucleotide
  Target: ATXN1; (+) strand; PAM type: NRG; PAM sequence: TGG
aagagaaccagaattagaaa

SEQ ID NO: 140714 - DNA, 20 bp, Artificial Sequence
  Description of Artificial Sequence: Synthetic oligonucleotide
  Target: ATXN1; (+) strand; PAM type: NRG; PAM sequence: GAG
gagaaccagaattagaaatg

SEQ ID NO: 140715 - DNA, 20 bp, Artificial Sequence
  Description of Artificial Sequence: Synthetic oligonucleotide
  Target: ATXN1; (+) strand; PAM type: NRG; PAM sequence: CAG
gcaatctcatgatcaaactt

SEQ ID NO: 140716 - DNA, 20 bp, Artificial Sequence
  Description of Artificial Sequence: Synthetic oligonucleotide
  Target: ATXN1; (+) strand; PAM type: NRG; PAM sequence: CAG
atctcatgatcaaacttcag

SEQ ID NO: 140717 - DNA, 20 bp, Artificial Sequence
  Description of Artificial Sequence: Synthetic oligonucleotide
  Target: ATXN1; (+) strand; PAM type: NRG; PAM sequence: GAG
atgatcaaacttcagcagat

SEQ ID NO: 140718 - DNA, 20 bp, Artificial Sequence
  Description of Artificial Sequence: Synthetic oligonucleotide
  Target: ATXN1; (+) strand; PAM type: NRG; PAM sequence: AGG
tgatcaaacttcagcagatg

SEQ ID NO: 140719 - DNA, 20 bp, Artificial Sequence
  Description of Artificial Sequence: Synthetic oligonucleotide
  Target: ATXN1; (+) strand; PAM type: NRG; PAM sequence: GAG
atcaaacttcagcagatgag

SEQ ID NO: 140720 - DNA, 20 bp, Artificial Sequence
  Description of Artificial Sequence: Synthetic oligonucleotide
  Target: ATXN1; (+) strand; PAM type: NRG; PAM sequence: TGG
cagatgaggagttgcctcta

SEQ ID NO: 140721 - DNA, 20 bp, Artificial Sequence
  Description of Artificial Sequence: Synthetic oligonucleotide
  Target: ATXN1; (+) strand; PAM type: NRG; PAM sequence: GAG
gatgaggagttgcctctatg

SEQ ID NO: 140722 - DNA, 20 bp, Artificial Sequence
  Description of Artificial Sequence: Synthetic oligonucleotide
  Target: ATXN1; (+) strand; PAM type: NRG; PAM sequence: AGG
atgaggagttgcctctatgg

SEQ ID NO: 140723 - DNA, 20 bp, Artificial Sequence
  Description of Artificial Sequence: Synthetic oligonucleotide
  Target: ATXN1; (+) strand; PAM type: NRG; PAM sequence: GAG
gaggagttgcctctatggag

SEQ ID NO: 140724 - DNA, 20 bp, Artificial Sequence
  Description of Artificial Sequence: Synthetic oligonucleotide
  Target: ATXN1; (+) strand; PAM type: NRG; PAM sequence: AAG
gttgcctctatggaggagca

SEQ ID NO: 140725 - DNA, 20 bp, Artificial Sequence
  Description of Artificial Sequence: Synthetic oligonucleotide
  Target: ATXN1; (+) strand; PAM type: NRG; PAM sequence: AAG
cctctatggaggagcaaaga

SEQ ID NO: 140726 - DNA, 20 bp, Artificial Sequence
  Description of Artificial Sequence: Synthetic oligonucleotide
  Target: ATXN1; (+) strand; PAM type: NRG; PAM sequence: TGG
ctatggaggagcaaagaaag

SEQ ID NO: 140727 - DNA, 20 bp, Artificial Sequence
  Description of Artificial Sequence: Synthetic oligonucleotide
  Target: ATXN1; (+) strand; PAM type: NRG; PAM sequence: TGG
gagcaaagaaagtggtttca

SEQ ID NO: 140728 - DNA, 20 bp, Artificial Sequence
  Description of Artificial Sequence: Synthetic oligonucleotide
  Target: ATXN1; (+) strand; PAM type: NRG; PAM sequence: CGG
aaagaaagtggtttcatggc

SEQ ID NO: 140729 - DNA, 20 bp, Artificial Sequence
  Description of Artificial Sequence: Synthetic oligonucleotide
  Target: ATXN1; (+) strand; PAM type: NRG; PAM sequence: GGG
aagaaagtggtttcatggcc

SEQ ID NO: 140730 - DNA, 20 bp, Artificial Sequence
  Description of Artificial Sequence: Synthetic oligonucleotide
  Target: ATXN1; (+) strand; PAM type: NRG; PAM sequence: CAG
agtggtttcatggccgggca

SEQ ID NO: 140731 - DNA, 20 bp, Artificial Sequence
  Description of Artificial Sequence: Synthetic oligonucleotide
  Target: ATXN1; (+) strand; PAM type: NRG; PAM sequence: TGG
ggtttcatggccgggcacag

SEQ ID NO: 140732 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcttgtaatct

SEQ ID NO: 140733 - DNA, 20 bp, Artificial Sequence
  Description of Artificial Sequence: Synthetic oligonucleotide
  Target: ATXN1; (+) strand; PAM type: NRG; PAM sequence: TGG
cgcttgtaatctcagcactt

SEQ ID NO: 140734 - DNA, 20 bp, Artificial Sequence
  Description of Artificial Sequence: Synthetic oligonucleotide
  Target: ATXN1; (+) strand; PAM type: NRG; PAM sequence: GGG
gcttgtaatctcagcacttt

SEQ ID NO: 140735 - DNA, 20 bp, Artificial Sequence
  Description of Artificial Sequence: Synthetic oligonucleotide
  Target: ATXN1; (+) strand; PAM type: NRG; PAM sequence: GAG
ttgtaatctcagcactttgg

SEQ ID NO: 140736 - DNA, 20 bp, Artificial Sequence
  Description of Artificial Sequence: Synthetic oligonucleotide
  Target: ATXN1; (+) strand; PAM type: NRG; PAM sequence: AGG
tgtaatctcagcactttggg

SEQ ID NO: 140737 - DNA, 20 bp, Artificial Sequence
  Description of Artificial Sequence: Synthetic oligonucleotide
  Target: ATXN1; (+) strand; PAM type: NRG; PAM sequence: GAG
tctcagcactttgggaggcc

SEQ ID NO: 140738 - DNA, 20 bp, Artificial Sequence
  Description of Artificial Sequence: Synthetic oligonucleotide
  Target: ATXN1; (+) strand; PAM type: NRG; PAM sequence: AGG
ctcagcactttgggaggccg

SEQ ID NO: 140739 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggccgagg

SEQ ID NO: 140740 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggccgaggc

SEQ ID NO: 140741 - DNA, 20 bp, Artificial Sequence
  Description of Artificial Sequence: Synthetic oligonucleotide
  Target: ATXN1; (+) strand; PAM type: NRG; PAM sequence: GGG
cactttgggaggccgaggca

SEQ ID NO: 140742 - DNA, 20 bp, Artificial Sequence
  Description of Artificial Sequence: Synthetic oligonucleotide
  Target: ATXN1; (+) strand; PAM type: NRG; PAM sequence: GGG
actttgggaggccgaggcag

SEQ ID NO: 140743 - DNA, 20 bp, Artificial Sequence
  Description of Artificial Sequence: Synthetic oligonucleotide
  Target: ATXN1; (+) strand; PAM type: NRG; PAM sequence: AAG
ggccgaggcaggggaatcac

SEQ ID NO: 140744 - DNA, 20 bp, Artificial Sequence
  Description of Artificial Sequence: Synthetic oligonucleotide
  Target: ATXN1; (+) strand; PAM type: NRG; PAM sequence: AGG
gccgaggcaggggaatcaca

SEQ ID NO: 140745 - DNA, 20 bp, Artificial Sequence
  Description of Artificial Sequence: Synthetic oligonucleotide
  Target: ATXN1; (+) strand; PAM type: NRG; PAM sequence: CGG
ggcaggggaatcacaaggtc

SEQ ID NO: 140746 - DNA, 20 bp, Artificial Sequence
  Description of Artificial Sequence: Synthetic oligonucleotide
  Target: ATXN1; (+) strand; PAM type: NRG; PAM sequence: GAG
caggggaatcacaaggtccg

SEQ ID NO: 140747 - DNA, 20 bp, Artificial Sequence
  Description of Artificial Sequence: Synthetic oligonucleotide
  Target: ATXN1; (+) strand; PAM type: NRG; PAM sequence: TAG
ggaatcacaaggtccggaga

SEQ ID NO: 140748 - DNA, 20 bp, Artificial Sequence
  Description of Artificial Sequence: Synthetic oligonucleotide
  Target: ATXN1; (+) strand; PAM type: NRG; PAM sequence: GAG
aatcacaaggtccggagata

SEQ ID NO: 140749 - DNA, 20 bp, Artificial Sequence
  Description of Artificial Sequence: Synthetic oligonucleotide
  Target: ATXN1; (+) strand; PAM type: NRG; PAM sequence: AGG
atcacaaggtccggagatag

SEQ ID NO: 140750 - DNA, 20 bp, Artificial Sequence
  Description of Artificial Sequence: Synthetic oligonucleotide
  Target: ATXN1; (+) strand; PAM type: NRG; PAM sequence: TGG
tccggagatagaggccatcc

SEQ ID NO: 140751 - DNA, 20 bp, Artificial Sequence
  Description of Artificial Sequence: Synthetic oligonucleotide
  Target: ATXN1; (+) strand; PAM type: NRG; PAM sequence: CAG
agaggccatcctggctaaca

SEQ ID NO: 140752 - DNA, 20 bp, Artificial Sequence
  Description of Artificial Sequence: Synthetic oligonucleotide
  Target: ATXN1; (+) strand; PAM type: NRG; PAM sequence: TAG
ctactaaaaatacaaaaaat

SEQ ID NO: 140753 - DNA, 20 bp, Artificial Sequence
  Description of Artificial Sequence: Synthetic oligonucleotide
  Target: ATXN1; (+) strand; PAM type: NRG; PAM sequence: CAG
aaaaatacaaaaaattagcc

SEQ ID NO: 140754 - DNA, 20 bp, Artificial Sequence
  Description of Artificial Sequence: Synthetic oligonucleotide
  Target: ATXN1; (+) strand; PAM type: NRG; PAM sequence: TGG
tacaaaaaattagcccagcg

SEQ ID NO: 140755 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagcccagcgtgg

SEQ ID NO: 140756 - DNA, 20 bp, Artificial Sequence
  Description of Artificial Sequence: Synthetic oligonucleotide
  Target: ATXN1; (+) strand; PAM type: NRG; PAM sequence: TAG
agcgtggtggtgcgcacctg

SEQ ID NO: 140757 - DNA, 20 bp, Artificial Sequence
  Description of Artificial Sequence: Synthetic oligonucleotide
  Target: ATXN1; (+) strand; PAM type: NRG; PAM sequence: CAG
gtggtgcgcacctgtagtcc

SEQ ID NO: 140758 - DNA, 20 bp, Artificial Sequence
  Description of Artificial Sequence: Synthetic oligonucleotide
  Target: ATXN1; (+) strand; PAM type: NRG; PAM sequence: CAG
cacctgtagtcccagctact

SEQ ID NO: 140759 - DNA, 20 bp, Artificial Sequence
  Description of Artificial Sequence: Synthetic oligonucleotide
  Target: ATXN1; (+) strand; PAM type: NRG; PAM sequence: AGG
acctgtagtcccagctactc

SEQ ID NO: 140760 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctactcag

SEQ ID NO: 140761 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctactcagg

SEQ ID NO: 140762 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcaggaggct

SEQ ID NO: 140763 - DNA, 20 bp, Artificial Sequence
  Description of Artificial Sequence: Synthetic oligonucleotide
  Target: ATXN1; (+) strand; PAM type: NRG; PAM sequence: AGG
cccagctactcaggaggctg

SEQ ID NO: 140764 - DNA, 20 bp, Artificial Sequence
  Description of Artificial Sequence: Synthetic oligonucleotide
  Target: ATXN1; (+) strand; PAM type: NRG; PAM sequence: CAG
agctactcaggaggctgagg

SEQ ID NO: 140765 - DNA, 20 bp, Artificial Sequence
  Description of Artificial Sequence: Synthetic oligonucleotide
  Target: ATXN1; (+) strand; PAM type: NRG; PAM sequence: AGG
gctactcaggaggctgaggc

SEQ ID NO: 140766 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctgaggcag

SEQ ID NO: 140767 - DNA, 20 bp, Artificial Sequence
  Description of Artificial Sequence: Synthetic oligonucleotide
  Target: ATXN1; (+) strand; PAM type: NRG; PAM sequence: TGG
gcaggagaattgtttgaacc

SEQ ID NO: 140768 - DNA, 20 bp, Artificial Sequence
  Description of Artificial Sequence: Synthetic oligonucleotide
  Target: ATXN1; (+) strand; PAM type: NRG; PAM sequence: GGG
caggagaattgtttgaacct

SEQ ID NO: 140769 - DNA, 20 bp, Artificial Sequence
  Description of Artificial Sequence: Synthetic oligonucleotide
  Target: ATXN1; (+) strand; PAM type: NRG; PAM sequence: GAG
ggagaattgtttgaacctgg

SEQ ID NO: 140770 - DNA, 20 bp, Artificial Sequence
  Description of Artificial Sequence: Synthetic oligonucleotide
  Target: ATXN1; (+) strand; PAM type: NRG; PAM sequence: AGG
gagaattgtttgaacctggg

SEQ ID NO: 140771 - DNA, 20 bp, Artificial Sequence
  Description of Artificial Sequence: Synthetic oligonucleotide
  Target: ATXN1; (+) strand; PAM type: NRG; PAM sequence: TGG
aattgtttgaacctgggagg

SEQ ID NO: 140772 - DNA, 20 bp, Artificial Sequence
  Description of Artificial Sequence: Synthetic oligonucleotide
  Target: ATXN1; (+) strand; PAM type: NRG; PAM sequence: GAG
ttgtttgaacctgggaggtg

SEQ ID NO: 140773 - DNA, 20 bp, Artificial Sequence
  Description of Artificial Sequence: Synthetic oligonucleotide
  Target: ATXN1; (+) strand; PAM type: NRG; PAM sequence: AGG
tgtttgaacctgggaggtgg

SEQ ID NO: 140774 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggtggaggttg

SEQ ID NO: 140775 - DNA, 20 bp, Artificial Sequence
  Description of Artificial Sequence: Synthetic oligonucleotide
  Target: ATXN1; (+) strand; PAM type: NRG; PAM sequence: GAG
tgggaggtggaggttgcagt

SEQ ID NO: 140776 - DNA, 20 bp, Artificial Sequence
  Description of Artificial Sequence: Synthetic oligonucleotide
  Target: ATXN1; (+) strand; PAM type: NRG; PAM sequence: GAG
ggtggaggttgcagtgagcc

SEQ ID NO: 140777 - DNA, 20 bp, Artificial Sequence
  Description of Artificial Sequence: Synthetic oligonucleotide
  Target: ATXN1; (+) strand; PAM type: NRG; PAM sequence: CAG
gagatcgcgccactgcactc

SEQ ID NO: 140778 - DNA, 20 bp, Artificial Sequence
  Description of Artificial Sequence: Synthetic oligonucleotide
  Target: ATXN1; (+) strand; PAM type: NRG; PAM sequence: TGG
cgcgccactgcactccagcc

SEQ ID NO: 140779 - DNA, 20 bp, Artificial Sequence
  Description of Artificial Sequence: Synthetic oligonucleotide
  Target: ATXN1; (+) strand; PAM type: NRG; PAM sequence: GGG
gcgccactgcactccagcct

SEQ ID NO: 140780 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggtga

SEQ ID NO: 140781 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggtgacagaac

SEQ ID NO: 140782 - DNA, 20 bp, Artificial Sequence
  Description of Artificial Sequence: Synthetic oligonucleotide
  Target: ATXN1; (+) strand; PAM type: NRG; PAM sequence: CAG
aaacaaacaaacaaaaaaac

SEQ ID NO: 140783 - DNA, 20 bp, Artificial Sequence
  Description of Artificial Sequence: Synthetic oligonucleotide
  Target: ATXN1; (+) strand; PAM type: NRG; PAM sequence: TGG
caaacaaacaaaaaaaccag

SEQ ID NO: 140784 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaccagtggtttcat

SEQ ID NO: 140785 - DNA, 20 bp, Artificial Sequence
  Description of Artificial Sequence: Synthetic oligonucleotide
  Target: ATXN1; (+) strand; PAM type: NRG; PAM sequence: AAG
gatgtaatctactcctgatg

SEQ ID NO: 140786 - DNA, 20 bp, Artificial Sequence
  Description of Artificial Sequence: Synthetic oligonucleotide
  Target: ATXN1; (+) strand; PAM type: NRG; PAM sequence: AAG
acactgttaaaatgacaaca

SEQ ID NO: 140787 - DNA, 20 bp, Artificial Sequence
  Description of Artificial Sequence: Synthetic oligonucleotide
  Target: ATXN1; (+) strand; PAM type: NRG; PAM sequence: AGG
cactgttaaaatgacaacaa

SEQ ID NO: 140788 - DNA, 20 bp, Artificial Sequence
  Description of Artificial Sequence: Synthetic oligonucleotide
  Target: ATXN1; (+) strand; PAM type: NRG; PAM sequence: CAG
ttacataaacttaattgatg

SEQ ID NO: 140789 - DNA, 20 bp, Artificial Sequence
  Description of Artificial Sequence: Synthetic oligonucleotide
  Target: ATXN1; (+) strand; PAM type: NRG; PAM sequence: CAG
aaacttaattgatgcagtga

SEQ ID NO: 140790 - DNA, 20 bp, Artificial Sequence
  Description of Artificial Sequence: Synthetic oligonucleotide
  Target: ATXN1; (+) strand; PAM type: NRG; PAM sequence: AGG
aacttaattgatgcagtgac

SEQ ID NO: 140791 - DNA, 20 bp, Artificial Sequence
  Description of Artificial Sequence: Synthetic oligonucleotide
  Target: ATXN1; (+) strand; PAM type: NRG; PAM sequence: GAG
attgatgcagtgacaggttt

SEQ ID NO: 140792 - DNA, 20 bp, Artificial Sequence
  Description of Artificial Sequence: Synthetic oligonucleotide
  Target: ATXN1; (+) strand; PAM type: NRG; PAM sequence: GAG
tgatgcagtgacaggtttga

SEQ ID NO: 140793 - DNA, 20 bp, Artificial Sequence
  Description of Artificial Sequence: Synthetic oligonucleotide
  Target: ATXN1; (+) strand; PAM type: NRG; PAM sequence: AGG
gatgcagtgacaggtttgag

SEQ ID NO: 140794 - DNA, 20 bp, Artificial Sequence
  Description of Artificial Sequence: Synthetic oligonucleotide
  Target: ATXN1; (+) strand; PAM type: NRG; PAM sequence: AAG
aggactgactctaactttga

SEQ ID NO: 140795 - DNA, 20 bp, Artificial Sequence
  Description of Artificial Sequence: Synthetic oligonucleotide
  Target: ATXN1; (+) strand; PAM type: NRG; PAM sequence: TGG
taactttgaaagttctacta

SEQ ID NO: 140796 - DNA, 20 bp, Artificial Sequence
  Description of Artificial Sequence: Synthetic oligonucleotide
  Target: ATXN1; (+) strand; PAM type: NRG; PAM sequence: GGG
aactttgaaagttctactat

SEQ ID NO: 140797 - DNA, 20 bp, Artificial Sequence
  Description of Artificial Sequence: Synthetic oligonucleotide
  Target: ATXN1; (+) strand; PAM type: NRG; PAM sequence: TGG
ggtaaaatgctctcaaacaa

SEQ ID NO: 140798 - DNA, 20 bp, Artificial Sequence
  Description of Artificial Sequence: Synthetic oligonucleotide
  Target: ATXN1; (+) strand; PAM type: NRG; PAM sequence: CAG
tcaaacaatggtgcatacta

SEQ ID NO: 140799 - DNA, 20 bp, Artificial Sequence
  Description of Artificial Sequence: Synthetic oligonucleotide
  Target: ATXN1; (+) strand; PAM type: NRG; PAM sequence: GAG
aaacaatggtgcatactaca

SEQ ID NO: 140800 - DNA, 20 bp, Artificial Sequence
  Description of Artificial Sequence: Synthetic oligonucleotide
  Target: ATXN1; (+) strand; PAM type: NRG; PAM sequence: AAG
tacagagaaatctttcatga

SEQ ID NO: 140801 - DNA, 20 bp, Artificial Sequence
  Description of Artificial Sequence: Synthetic oligonucleotide
  Target: ATXN1; (+) strand; PAM type: NRG; PAM sequence: AGG
acagagaaatctttcatgaa

SEQ ID NO: 140802 - DNA, 20 bp, Artificial Sequence
  Description of Artificial Sequence: Synthetic oligonucleotide
  Target: ATXN1; (+) strand; PAM type: NRG; PAM sequence: AAG
gagaaatctttcatgaaagg

SEQ ID NO: 140803 - DNA, 20 bp, Artificial Sequence
  Description of Artificial Sequence: Synthetic oligonucleotide
  Target: ATXN1; (+) strand; PAM type: NRG; PAM sequence: GAG
gaaatctttcatgaaaggaa

SEQ ID NO: 140804 - DNA, 20 bp, Artificial Sequence
  Description of Artificial Sequence: Synthetic oligonucleotide
  Target: ATXN1; (+) strand; PAM type: NRG; PAM sequence: TGG
aaaggaagagtcaataaatg

SEQ ID NO: 140805 - DNA, 20 bp, Artificial Sequence
  Description of Artificial Sequence: Synthetic oligonucleotide
  Target: ATXN1; (+) strand; PAM type: NRG; PAM sequence: AAG
cgtcattgttgtctaatttt

SEQ ID NO: 140806 - DNA, 20 bp, Artificial Sequence
  Description of Artificial Sequence: Synthetic oligonucleotide
  Target: ATXN1; (+) strand; PAM type: NRG; PAM sequence: CAG
agaaattgccaccgccaccc

SEQ ID NO: 140807 - DNA, 20 bp, Artificial Sequence
  Description of Artificial Sequence: Synthetic oligonucleotide
  Target: ATXN1; (+) strand; PAM type: NRG; PAM sequence: CAG
gccaccgccaccccagcttt

SEQ ID NO: 140808 - DNA, 20 bp, Artificial Sequence
  Description of Artificial Sequence: Synthetic oligonucleotide
  Target: ATXN1; (+) strand; PAM type: NRG; PAM sequence: CAG
cagcaaccacctccctaaat

SEQ ID NO: 140809 - DNA, 20 bp, Artificial Sequence
  Description of Artificial Sequence: Synthetic oligonucleotide
  Target: ATXN1; (+) strand; PAM type: NRG; PAM sequence: CAG
aaccacctccctaaatcagt

SEQ ID NO: 140810 - DNA, 20 bp, Artificial Sequence
  Description of Artificial Sequence: Synthetic oligonucleotide
  Target: ATXN1; (+) strand; PAM type: NRG; PAM sequence: CAG
cacctccctaaatcagtcag

SEQ ID NO: 140811 - DNA, 20 bp, Artificial Sequence
  Description of Artificial Sequence: Synthetic oligonucleotide
  Target: ATXN1; (+) strand; PAM type: NRG; PAM sequence: AAG
agtcagcagccatcaacgta

SEQ ID NO: 140812 - DNA, 20 bp, Artificial Sequence
  Description of Artificial Sequence: Synthetic oligonucleotide
  Target: ATXN1; (+) strand; PAM type: NRG; PAM sequence: TGG
ctttaccaacaaaacgatta

SEQ ID NO: 140813 - DNA, 20 bp, Artificial Sequence
  Description of Artificial Sequence: Synthetic oligonucleotide
  Target: ATXN1; (+) strand; PAM type: NRG; PAM sequence: AAG
aaaacgattatggttcaatg

SEQ ID NO: 140814 - DNA, 20 bp, Artificial Sequence
  Description of Artificial Sequence: Synthetic oligonucleotide
  Target: ATXN1; (+) strand; PAM type: NRG; PAM sequence: CAG
tcaatgaagatgatcgttaa

SEQ ID NO: 140815 - DNA, 20 bp, Artificial Sequence
  Description of Artificial Sequence: Synthetic oligonucleotide
  Target: ATXN1; (+) strand; PAM type: NRG; PAM sequence: TAG
agatgatcgttaacagtttt

SEQ ID NO: 140816 - DNA, 20 bp, Artificial Sequence
  Description of Artificial Sequence: Synthetic oligonucleotide
  Target: ATXN1; (+) strand; PAM type: NRG; PAM sequence: AAG
gttaacagtttttagcaata

SEQ ID NO: 140817 - DNA, 20 bp, Artificial Sequence
  Description of Artificial Sequence: Synthetic oligonucleotide
  Target: ATXN1; (+) strand; PAM type: NRG; PAM sequence: AAG
caataaagcattttaaaatt

SEQ ID NO: 140818 - DNA, 20 bp, Artificial Sequence
  Description of Artificial Sequence: Synthetic oligonucleotide
  Target: ATXN1; (+) strand; PAM type: NRG; PAM sequence: AGG
aataaagcattttaaaatta

SEQ ID NO: 140819 - DNA, 20 bp, Artificial Sequence
  Description of Artificial Sequence: Synthetic oligonucleotide
  Target: ATXN1; (+) strand; PAM type: NRG; PAM sequence: TAG
ttaaggtatgtacttttgtt

SEQ ID NO: 140820 - DNA, 20 bp, Artificial Sequence
  Description of Artificial Sequence: Synthetic oligonucleotide
  Target: ATXN1; (+) strand; PAM type: NRG; PAM sequence: TGG
ttgtttagacaaaatgttat

SEQ ID NO: 140821 - DNA, 20 bp, Artificial Sequence
  Description of Artificial Sequence: Synthetic oligonucleotide
  Target: ATXN1; (+) strand; PAM type: NRG; PAM sequence: TAG
aaatgttattggataattaa

SEQ ID NO: 140822 - DNA, 20 bp, Artificial Sequence
  Description of Artificial Sequence: Synthetic oligonucleotide
  Target: ATXN1; (+) strand; PAM type: NRG; PAM sequence: TAG
attggataattaatagacta

SEQ ID NO: 140823 - DNA, 20 bp, Artificial Sequence
  Description of Artificial Sequence: Synthetic oligonucleotide
  Target: ATXN1; (+) strand; PAM type: NRG; PAM sequence: TGG
ataattaatagactatagta

SEQ ID NO: 140824 - DNA, 20 bp, Artificial Sequence
  Description of Artificial Sequence: Synthetic oligonucleotide
  Target: ATXN1; (+) strand; PAM type: NRG; PAM sequence: TGG
taaacataacttatatgcac

SEQ ID NO: 140825 - DNA, 20 bp, Artificial Sequence
  Description of Artificial Sequence: Synthetic oligonucleotide
  Target: ATXN1; (+) strand; PAM type: NRG; PAM sequence: TGG
caatacttgctttactgctg

SEQ ID NO: 140826 - DNA, 20 bp, Artificial Sequence
  Description of Artificial Sequence: Synthetic oligonucleotide
  Target: ATXN1; (+) strand; PAM type: NRG; PAM sequence: AAG
gctttactgctgtggtctat

SEQ ID NO: 140827 - DNA, 20 bp, Artificial Sequence
  Description of Artificial Sequence: Synthetic oligonucleotide
  Target: ATXN1; (+) strand; PAM type: NRG; PAM sequence: GAG
agtgaacccaaaatatctct

SEQ ID NO: 140828 - DNA, 20 bp, Artificial Sequence
  Description of Artificial Sequence: Synthetic oligonucleotide
  Target: ATXN1; (+) strand; PAM type: NRG; PAM sequence: CAG
ccaaaatatctctgagtgtc

SEQ ID NO: 140829 - DNA, 20 bp, Artificial Sequence
  Description of Artificial Sequence: Synthetic oligonucleotide
  Target: ATXN1; (+) strand; PAM type: NRG; PAM sequence: AGG
caaaatatctctgagtgtcc

SEQ ID NO: 140830 - DNA, 20 bp, Artificial Sequence
  Description of Artificial Sequence: Synthetic oligonucleotide
  Target: ATXN1; (+) strand; PAM type: NRG; PAM sequence: CAG
tatctctgagtgtccaggca

SEQ ID NO: 140831 - DNA, 20 bp, Artificial Sequence
  Description of Artificial Sequence: Synthetic oligonucleotide
  Target: ATXN1; (+) strand; PAM type: NRG; PAM sequence: TGG
ctctgagtgtccaggcacag

SEQ ID NO: 140832 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatcc

SEQ ID NO: 140833 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 140834 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 140835 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 140836 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 140837 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggct

SEQ ID NO: 140838 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggctg

SEQ ID NO: 140839 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggctgagg

SEQ ID NO: 140840 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggctgaggt

SEQ ID NO: 140841 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggctgaggtggg

SEQ ID NO: 140842 - DNA, 20 bp, Artificial Sequence
  Description of Artificial Sequence: Synthetic oligonucleotide
  Target: ATXN1; (+) strand; PAM type: NRG; PAM sequence: TGG
gctgaggtgggtggatcacc

SEQ ID NO: 140843 - DNA, 20 bp, Artificial Sequence
  Description of Artificial Sequence: Synthetic oligonucleotide
  Target: ATXN1; (+) strand; PAM type: NRG; PAM sequence: GGG
ctgaggtgggtggatcacct

SEQ ID NO: 140844 - DNA, 20 bp, Artificial Sequence
  Description of Artificial Sequence: Synthetic oligonucleotide
  Target: ATXN1; (+) strand; PAM type: NRG; PAM sequence: GGG
tgaggtgggtggatcacctg

SEQ ID NO: 140845 - DNA, 20 bp, Artificial Sequence
  Description of Artificial Sequence: Synthetic oligonucleotide
  Target: ATXN1; (+) strand; PAM type: NRG; PAM sequence: CAG
gtgggtggatcacctggggt

SEQ ID NO: 140846 - DNA, 20 bp, Artificial Sequence
  Description of Artificial Sequence: Synthetic oligonucleotide
  Target: ATXN1; (+) strand; PAM type: NRG; PAM sequence: AGG
tgggtggatcacctggggtc

SEQ ID NO: 140847 - DNA, 20 bp, Artificial Sequence
  Description of Artificial Sequence: Synthetic oligonucleotide
  Target: ATXN1; (+) strand; PAM type: NRG; PAM sequence: GAG
ggtggatcacctggggtcag

SEQ ID NO: 140848 - DNA, 20 bp, Artificial Sequence
  Description of Artificial Sequence: Synthetic oligonucleotide
  Target: ATXN1; (+) strand; PAM type: NRG; PAM sequence: GAG
tcacctggggtcaggagttc

SEQ ID NO: 140849 - DNA, 20 bp, Artificial Sequence
  Description of Artificial Sequence: Synthetic oligonucleotide
  Target: ATXN1; (+) strand; PAM type: NRG; PAM sequence: CAG
tggggtcaggagttcgagac

SEQ ID NO: 140850 - DNA, 20 bp, Artificial Sequence
  Description of Artificial Sequence: Synthetic oligonucleotide
  Target: ATXN1; (+) strand; PAM type: NRG; PAM sequence: TGG
cgagaccagcctcaccaata

SEQ ID NO: 140851 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 140852 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaaattagc

SEQ ID NO: 140853 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattagct

SEQ ID NO: 140854 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagctgggca

SEQ ID NO: 140855 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgggcatgg

SEQ ID NO: 140856 - DNA, 20 bp, Artificial Sequence
  Description of Artificial Sequence: Synthetic oligonucleotide
  Target: ATXN1; (+) strand; PAM type: NRG; PAM sequence: CAG
aaattagctgggcatggtgg

SEQ ID NO: 140857 - DNA, 20 bp, Artificial Sequence
  Description of Artificial Sequence: Synthetic oligonucleotide
  Target: ATXN1; (+) strand; PAM type: NRG; PAM sequence: AGG
aattagctgggcatggtggc

SEQ ID NO: 140858 - DNA, 20 bp, Artificial Sequence
  Description of Artificial Sequence: Synthetic oligonucleotide
  Target: ATXN1; (+) strand; PAM type: NRG; PAM sequence: TAG
ggcatggtggcaggcaccta

SEQ ID NO: 140859 - DNA, 20 bp, Artificial Sequence
  Description of Artificial Sequence: Synthetic oligonucleotide
  Target: ATXN1; (+) strand; PAM type: NRG; PAM sequence: CAG
gtggcaggcacctatagtcc

SEQ ID NO: 140860 - DNA, 20 bp, Artificial Sequence
  Description of Artificial Sequence: Synthetic oligonucleotide
  Target: ATXN1; (+) strand; PAM type: NRG; PAM sequence: TGG
cacctatagtcccagctact

SEQ ID NO: 140861 - DNA, 20 bp, Artificial Sequence
  Description of Artificial Sequence: Synthetic oligonucleotide
  Target: ATXN1; (+) strand; PAM type: NRG; PAM sequence: GGG
acctatagtcccagctactt

SEQ ID NO: 140862 - DNA, 20 bp, Artificial Sequence
  Description of Artificial Sequence: Synthetic oligonucleotide
  Target: ATXN1; (+) strand; PAM type: NRG; PAM sequence: GAG
ctatagtcccagctacttgg

SEQ ID NO: 140863 - DNA, 20 bp, Artificial Sequence
  Description of Artificial Sequence: Synthetic oligonucleotide
  Target: ATXN1; (+) strand; PAM type: NRG; PAM sequence: AGG
tatagtcccagctacttggg

SEQ ID NO: 140864 - DNA, 20 bp, Artificial Sequence
  Description of Artificial Sequence: Synthetic oligonucleotide
  Target: ATXN1; (+) strand; PAM type: NRG; PAM sequence: CAG
ctacttgggaggcttgaacc

SEQ ID NO: 140865 - DNA, 20 bp, Artificial Sequence
  Description of Artificial Sequence: Synthetic oligonucleotide
  Target: ATXN1; (+) strand; PAM type: NRG; PAM sequence: AGG
tacttgggaggcttgaaccc

SEQ ID NO: 140866 - DNA, 20 bp, Artificial Sequence
  Description of Artificial Sequence: Synthetic oligonucleotide
  Target: ATXN1; (+) strand; PAM type: NRG; PAM sequence: GAG
cttgggaggcttgaacccag

SEQ ID NO: 140867 - DNA, 20 bp, Artificial Sequence
  Description of Artificial Sequence: Synthetic oligonucleotide
  Target: ATXN1; (+) strand; PAM type: NRG; PAM sequence: AGG
ttgggaggcttgaacccagg

SEQ ID NO: 140868 - DNA, 20 bp, Artificial Sequence
  Description of Artificial Sequence: Synthetic oligonucleotide
  Target: ATXN1; (+) strand; PAM type: NRG; PAM sequence: CGG
ggaggcttgaacccaggagg

SEQ ID NO: 140869 - DNA, 20 bp, Artificial Sequence
  Description of Artificial Sequence: Synthetic oligonucleotide
  Target: ATXN1; (+) strand; PAM type: NRG; PAM sequence: GAG
aggcttgaacccaggaggcg

SEQ ID NO: 140870 - DNA, 20 bp, Artificial Sequence
  Description of Artificial Sequence: Synthetic oligonucleotide
  Target: ATXN1; (+) strand; PAM type: NRG; PAM sequence: CAG
aacccaggaggcggagcttg

SEQ ID NO: 140871 - DNA, 20 bp, Artificial Sequence
  Description of Artificial Sequence: Synthetic oligonucleotide
  Target: ATXN1; (+) strand; PAM type: NRG; PAM sequence: GAG
caggaggcggagcttgcagt

SEQ ID NO: 140872 - DNA, 20 bp, Artificial Sequence
  Description of Artificial Sequence: Synthetic oligonucleotide
  Target: ATXN1; (+) strand; PAM type: NRG; PAM sequence: CAG
gaggcggagcttgcagtgag

SEQ ID NO: 140873 - DNA, 20 bp, Artificial Sequence
  Description of Artificial Sequence: Synthetic oligonucleotide
  Target: ATXN1; (+) strand; PAM type: NRG; PAM sequence: GAG
ggcggagcttgcagtgagca

SEQ ID NO: 140874 - DNA, 20 bp, Artificial Sequence
  Description of Artificial Sequence: Synthetic oligonucleotide
  Target: ATXN1; (+) strand; PAM type: NRG; PAM sequence: CAG
gagatcgtgccactgcactc

SEQ ID NO: 140875 - DNA, 20 bp, Artificial Sequence
  Description of Artificial Sequence: Synthetic oligonucleotide
  Target: ATXN1; (+) strand; PAM type: NRG; PAM sequence: TGG
cgtgccactgcactccagcc

SEQ ID NO: 140876 - DNA, 20 bp, Artificial Sequence
  Description of Artificial Sequence: Synthetic oligonucleotide
  Target: ATXN1; (+) strand; PAM type: NRG; PAM sequence: AAG
tgcactccagcctggcaaca

SEQ ID NO: 140877 - DNA, 20 bp, Artificial Sequence
  Description of Artificial Sequence: Synthetic oligonucleotide
  Target: ATXN1; (+) strand; PAM type: NRG; PAM sequence: AAG
ctccagcctggcaacaaagc

SEQ ID NO: 140878 - DNA, 20 bp, Artificial Sequence
  Description of Artificial Sequence: Synthetic oligonucleotide
  Target: ATXN1; (+) strand; PAM type: NRG; PAM sequence: AAG
caactcaaaaaaaaaaaaaa

SEQ ID NO: 140879 - DNA, 20 bp, Artificial Sequence
  Description of Artificial Sequence: Synthetic oligonucleotide
  Target: ATXN1; (+) strand; PAM type: NRG; PAM sequence: GAG
aaaaaagacacaatatctct

SEQ ID NO: 140880 - DNA, 20 bp, Artificial Sequence
  Description of Artificial Sequence: Synthetic oligonucleotide
  Target: ATXN1; (+) strand; PAM type: NRG; PAM sequence: CAG
aaattctgaactcttcctaa

SEQ ID NO: 140881 - DNA, 20 bp, Artificial Sequence
  Description of Artificial Sequence: Synthetic oligonucleotide
  Target: ATXN1; (+) strand; PAM type: NRG; PAM sequence: AGG
aattctgaactcttcctaac

SEQ ID NO: 140882 - DNA, 20 bp, Artificial Sequence
  Description of Artificial Sequence: Synthetic oligonucleotide
  Target: ATXN1; (+) strand; PAM type: NRG; PAM sequence: CAG
actcttcctaacaggcacta

SEQ ID NO: 140883 - DNA, 20 bp, Artificial Sequence
  Description of Artificial Sequence: Synthetic oligonucleotide
  Target: ATXN1; (+) strand; PAM type: NRG; PAM sequence: AAG
aacaggcactacagaaatgt

SEQ ID NO: 140884 - DNA, 20 bp, Artificial Sequence
  Description of Artificial Sequence: Synthetic oligonucleotide
  Target: ATXN1; (+) strand; PAM type: NRG; PAM sequence: TGG
gcactacagaaatgtaagcc

SEQ ID NO: 140885 - DNA, 20 bp, Artificial Sequence
  Description of Artificial Sequence: Synthetic oligonucleotide
  Target: ATXN1; (+) strand; PAM type: NRG; PAM sequence: CAG
tacagaaatgtaagcctggc

SEQ ID NO: 140886 - DNA, 20 bp, Artificial Sequence
  Description of Artificial Sequence: Synthetic oligonucleotide
  Target: ATXN1; (+) strand; PAM type: NRG; PAM sequence: CGG
aatgtaagcctggccagctg

SEQ ID NO: 140887 - DNA, 20 bp, Artificial Sequence
  Description of Artificial Sequence: Synthetic oligonucleotide
  Target: ATXN1; (+) strand; PAM type: NRG; PAM sequence: TGG
gtaagcctggccagctgcgg

SEQ ID NO: 140888 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaattc

SEQ ID NO: 140889 - DNA, 20 bp, Artificial Sequence
  Description of Artificial Sequence: Synthetic oligonucleotide
  Target: ATXN1; (+) strand; PAM type: NRG; PAM sequence: GAG
gcctgtaattccagcacttt

SEQ ID NO: 140890 - DNA, 20 bp, Artificial Sequence
  Description of Artificial Sequence: Synthetic oligonucleotide
  Target: ATXN1; (+) strand; PAM type: NRG; PAM sequence: GAG
ctgtaattccagcactttga

SEQ ID NO: 140891 - DNA, 20 bp, Artificial Sequence
  Description of Artificial Sequence: Synthetic oligonucleotide
  Target: ATXN1; (+) strand; PAM type: NRG; PAM sequence: AGG
tgtaattccagcactttgag

SEQ ID NO: 140892 - DNA, 20 bp, Artificial Sequence
  Description of Artificial Sequence: Synthetic oligonucleotide
  Target: ATXN1; (+) strand; PAM type: NRG; PAM sequence: AAG
ttccagcactttgagaggcc

SEQ ID NO: 140893 - DNA, 20 bp, Artificial Sequence
  Description of Artificial Sequence: Synthetic oligonucleotide
  Target: ATXN1; (+) strand; PAM type: NRG; PAM sequence: CGG
agcactttgagaggccaaga

SEQ ID NO: 140894 - DNA, 20 bp, Artificial Sequence
  Description of Artificial Sequence: Synthetic oligonucleotide
  Target: ATXN1; (+) strand; PAM type: NRG; PAM sequence: GGG
gcactttgagaggccaagac

SEQ ID NO: 140895 - DNA, 20 bp, Artificial Sequence
  Description of Artificial Sequence: Synthetic oligonucleotide
  Target: ATXN1; (+) strand; PAM type: NRG; PAM sequence: TAG
ctttgagaggccaagacggg

SEQ ID NO: 140896 - DNA, 20 bp, Artificial Sequence
  Description of Artificial Sequence: Synthetic oligonucleotide
  Target: ATXN1; (+) strand; PAM type: NRG; PAM sequence: GAG
ccaagacgggtagactgctt

SEQ ID NO: 140897 - DNA, 20 bp, Artificial Sequence
  Description of Artificial Sequence: Synthetic oligonucleotide
  Target: ATXN1; (+) strand; PAM type: NRG; PAM sequence: CAG
acgggtagactgcttgagcc

SEQ ID NO: 140898 - DNA, 20 bp, Artificial Sequence
  Description of Artificial Sequence: Synthetic oligonucleotide
  Target: ATXN1; (+) strand; PAM type: NRG; PAM sequence: AGG
cgggtagactgcttgagccc

SEQ ID NO: 140899 - DNA, 20 bp, Artificial Sequence
  Description of Artificial Sequence: Synthetic oligonucleotide
  Target: ATXN1; (+) strand; PAM type: NRG; PAM sequence: GAG
ggtagactgcttgagcccag

SEQ ID NO: 140900 - DNA, 20 bp, Artificial Sequence
  Description of Artificial Sequence: Synthetic oligonucleotide
  Target: ATXN1; (+) strand; PAM type: NRG; PAM sequence: AAG
ctgcttgagcccaggagttt

SEQ ID NO: 140901 - DNA, 20 bp, Artificial Sequence
  Description of Artificial Sequence: Synthetic oligonucleotide
  Target: ATXN1; (+) strand; PAM type: NRG; PAM sequence: AAG
tgagcccaggagtttaagac

SEQ ID NO: 140902 - DNA, 20 bp, Artificial Sequence
  Description of Artificial Sequence: Synthetic oligonucleotide
  Target: ATXN1; (+) strand; PAM type: NRG; PAM sequence: TGG
ccaggagtttaagacaagcc

SEQ ID NO: 140903 - DNA, 20 bp, Artificial Sequence
  Description of Artificial Sequence: Synthetic oligonucleotide
  Target: ATXN1; (+) strand; PAM type: NRG; PAM sequence: GGG
caggagtttaagacaagcct

SEQ ID NO: 140904 - DNA, 20 bp, Artificial Sequence
  Description of Artificial Sequence: Synthetic oligonucleotide
  Target: ATXN1; (+) strand; PAM type: NRG; PAM sequence: TAG
tctacaaaaaatacaaaaat

SEQ ID NO: 140905 - DNA, 20 bp, Artificial Sequence
  Description of Artificial Sequence: Synthetic oligonucleotide
  Target: ATXN1; (+) strand; PAM type: NRG; PAM sequence: CAG
caaaaaatacaaaaattagc

SEQ ID NO: 140906 - DNA, 20 bp, Artificial Sequence
  Description of Artificial Sequence: Synthetic oligonucleotide
  Target: ATXN1; (+) strand; PAM type: NRG; PAM sequence: AGG
aaaaaatacaaaaattagcc

SEQ ID NO: 140907 - DNA, 20 bp, Artificial Sequence
  Description of Artificial Sequence: Synthetic oligonucleotide
  Target: ATXN1; (+) strand; PAM type: NRG; PAM sequence: CAG
gtcgtgcacacatgtaatct

SEQ ID NO: 140908 - DNA, 20 bp, Artificial Sequence
  Description of Artificial Sequence: Synthetic oligonucleotide
  Target: ATXN1; (+) strand; PAM type: NRG; PAM sequence: TGG
cacatgtaatctcagctact

SEQ ID NO: 140909 - DNA, 20 bp, Artificial Sequence
  Description of Artificial Sequence: Synthetic oligonucleotide
  Target: ATXN1; (+) strand; PAM type: NRG; PAM sequence: GGG
acatgtaatctcagctactt

SEQ ID NO: 140910 - DNA, 20 bp, Artificial Sequence
  Description of Artificial Sequence: Synthetic oligonucleotide
  Target: ATXN1; (+) strand; PAM type: NRG; PAM sequence: GAG
atgtaatctcagctacttgg

SEQ ID NO: 140911 - DNA, 20 bp, Artificial Sequence
  Description of Artificial Sequence: Synthetic oligonucleotide
  Target: ATXN1; (+) strand; PAM type: NRG; PAM sequence: AGG
tgtaatctcagctacttggg

SEQ ID NO: 140912 - DNA, 20 bp, Artificial Sequence
  Description of Artificial Sequence: Synthetic oligonucleotide
  Target: ATXN1; (+) strand; PAM type: NRG; PAM sequence: GAG
tctcagctacttgggaggct

SEQ ID NO: 140913 - DNA, 20 bp, Artificial Sequence
  Description of Artificial Sequence: Synthetic oligonucleotide
  Target: ATXN1; (+) strand; PAM type: NRG; PAM sequence: AGG
ctcagctacttgggaggctg

SEQ ID NO: 140914 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgagg

SEQ ID NO: 140915 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggctgaggc

SEQ ID NO: 140916 - DNA, 20 bp, Artificial Sequence
  Description of Artificial Sequence: Synthetic oligonucleotide
  Target: ATXN1; (+) strand; PAM type: NRG; PAM sequence: AAG
acttgggaggctgaggcagg

SEQ ID NO: 140917 - DNA, 20 bp, Artificial Sequence
  Description of Artificial Sequence: Synthetic oligonucleotide
  Target: ATXN1; (+) strand; PAM type: NRG; PAM sequence: GAG
ctgaggcaggaagatcactt

SEQ ID NO: 140918 - DNA, 20 bp, Artificial Sequence
  Description of Artificial Sequence: Synthetic oligonucleotide
  Target: ATXN1; (+) strand; PAM type: NRG; PAM sequence: AGG
tgaggcaggaagatcacttg

SEQ ID NO: 140919 - DNA, 20 bp, Artificial Sequence
  Description of Artificial Sequence: Synthetic oligonucleotide
  Target: ATXN1; (+) strand; PAM type: NRG; PAM sequence: CGG
caggaagatcacttgaggcc

SEQ ID NO: 140920 - DNA, 20 bp, Artificial Sequence
  Description of Artificial Sequence: Synthetic oligonucleotide
  Target: ATXN1; (+) strand; PAM type: NRG; PAM sequence: GAG
ggaagatcacttgaggcccg

SEQ ID NO: 140921 - DNA, 20 bp, Artificial Sequence
  Description of Artificial Sequence: Synthetic oligonucleotide
  Target: ATXN1; (+) strand; PAM type: NRG; PAM sequence: AGG
gaagatcacttgaggcccgg

SEQ ID NO: 140922 - DNA, 20 bp, Artificial Sequence
  Description of Artificial Sequence: Synthetic oligonucleotide
  Target: ATXN1; (+) strand; PAM type: NRG; PAM sequence: GAG
tcacttgaggcccggaggtc

SEQ ID NO: 140923 - DNA, 20 bp, Artificial Sequence
  Description of Artificial Sequence: Synthetic oligonucleotide
  Target: ATXN1; (+) strand; PAM type: NRG; PAM sequence: AGG
cacttgaggcccggaggtcg

SEQ ID NO: 140924 - DNA, 20 bp, Artificial Sequence
  Description of Artificial Sequence: Synthetic oligonucleotide
  Target: ATXN1; (+) strand; PAM type: NRG; PAM sequence: CAG
aggcccggaggtcgaggctg

SEQ ID NO: 140925 - DNA, 20 bp, Artificial Sequence
  Description of Artificial Sequence: Synthetic oligonucleotide
  Target: ATXN1; (+) strand; PAM type: NRG; PAM sequence: GAG
ccggaggtcgaggctgcagt

SEQ ID NO: 140926 - DNA, 20 bp, Artificial Sequence
  Description of Artificial Sequence: Synthetic oligonucleotide
  Target: ATXN1; (+) strand; PAM type: NRG; PAM sequence: GAG
ggtcgaggctgcagtgagct

SEQ ID NO: 140927 - DNA, 20 bp, Artificial Sequence
  Description of Artificial Sequence: Synthetic oligonucleotide
  Target: ATXN1; (+) strand; PAM type: NRG; PAM sequence: CAG
gagattgcaccactgcactc

SEQ ID NO: 140928 - DNA, 20 bp, Artificial Sequence
  Description of Artificial Sequence: Synthetic oligonucleotide
  Target: ATXN1; (+) strand; PAM type: NRG; PAM sequence: TGG
tgcaccactgcactccagcc

SEQ ID NO: 140929 - DNA, 20 bp, Artificial Sequence
  Description of Artificial Sequence: Synthetic oligonucleotide
  Target: ATXN1; (+) strand; PAM type: NRG; PAM sequence: GGG
gcaccactgcactccagcct

SEQ ID NO: 140930 - DNA, 20 bp, Artificial Sequence
  Description of Artificial Sequence: Synthetic oligonucleotide
  Target: ATXN1; (+) strand; PAM type: NRG; PAM sequence: GAG
accactgcactccagcctgg

SEQ ID NO: 140931 - DNA, 20 bp, Artificial Sequence
  Description of Artificial Sequence: Synthetic oligonucleotide
  Target: ATXN1; (+) strand; PAM type: NRG; PAM sequence: AAG
tgcactccagcctgggagac

SEQ ID NO: 140932 - DNA, 20 bp, Artificial Sequence
  Description of Artificial Sequence: Synthetic oligonucleotide
  Target: ATXN1; (+) strand; PAM type: NRG; PAM sequence: GAG
cactccagcctgggagacaa

SEQ ID NO: 140933 - DNA, 20 bp, Artificial Sequence
  Description of Artificial Sequence: Synthetic oligonucleotide
  Target: ATXN1; (+) strand; PAM type: NRG; PAM sequence: GAG
ccagcctgggagacaagagt

SEQ ID NO: 140934 - DNA, 20 bp, Artificial Sequence
  Description of Artificial Sequence: Synthetic oligonucleotide
  Target: ATXN1; (+) strand; PAM type: NRG; PAM sequence: AAG
caaaaaaaaaaaaaaaaaaa

SEQ ID NO: 140935 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaaaaaaaaaa

SEQ ID NO: 140936 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaaaaaagag

SEQ ID NO: 140937 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaaaaagagaa

SEQ ID NO: 140938 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaagagaagag

SEQ ID NO: 140939 - DNA, 20 bp, Artificial Sequence
  Description of Artificial Sequence: Synthetic oligonucleotide
  Target: ATXN1; (+) strand; PAM type: NRG; PAM sequence: CAG
aaaaagagaagagaagaacg

SEQ ID NO: 140940 - DNA, 20 bp, Artificial Sequence
  Description of Artificial Sequence: Synthetic oligonucleotide
  Target: ATXN1; (+) strand; PAM type: NRG; PAM sequence: AGG
aaaagagaagagaagaacgc

SEQ ID NO: 140941 - DNA, 20 bp, Artificial Sequence
  Description of Artificial Sequence: Synthetic oligonucleotide
  Target: ATXN1; (+) strand; PAM type: NRG; PAM sequence: GAG
agagaagaacgcaggactat

SEQ ID NO: 140942 - DNA, 20 bp, Artificial Sequence
  Description of Artificial Sequence: Synthetic oligonucleotide
  Target: ATXN1; (+) strand; PAM type: NRG; PAM sequence: CAG
caggactatgagcctgcttg

SEQ ID NO: 140943 - DNA, 20 bp, Artificial Sequence
  Description of Artificial Sequence: Synthetic oligonucleotide
  Target: ATXN1; (+) strand; PAM type: NRG; PAM sequence: GAG
agcctgcttgcagaaattct

SEQ ID NO: 140944 - DNA, 20 bp, Artificial Sequence
  Description of Artificial Sequence: Synthetic oligonucleotide
  Target: ATXN1; (+) strand; PAM type: NRG; PAM sequence: AAG
ctgcttgcagaaattctgag

SEQ ID NO: 140945 - DNA, 20 bp, Artificial Sequence
  Description of Artificial Sequence: Synthetic oligonucleotide
  Target: ATXN1; (+) strand; PAM type: NRG; PAM sequence: CGG
cagaaattctgagaagaatt

SEQ ID NO: 140946 - DNA, 20 bp, Artificial Sequence
  Description of Artificial Sequence: Synthetic oligonucleotide
  Target: ATXN1; (+) strand; PAM type: NRG; PAM sequence: GGG
agaaattctgagaagaattc

SEQ ID NO: 140947 - DNA, 20 bp, Artificial Sequence
  Description of Artificial Sequence: Synthetic oligonucleotide
  Target: ATXN1; (+) strand; PAM type: NRG; PAM sequence: TAG
tgagaagaattcgggccaaa

SEQ ID NO: 140948 - DNA, 20 bp, Artificial Sequence
  Description of Artificial Sequence: Synthetic oligonucleotide
  Target: ATXN1; (+) strand; PAM type: NRG; PAM sequence: AGG
gagaagaattcgggccaaat

SEQ ID NO: 140949 - DNA, 20 bp, Artificial Sequence
  Description of Artificial Sequence: Synthetic oligonucleotide
  Target: ATXN1; (+) strand; PAM type: NRG; PAM sequence: GAG
gaagaattcgggccaaatag

SEQ ID NO: 140950 - DNA, 20 bp, Artificial Sequence
  Description of Artificial Sequence: Synthetic oligonucleotide
  Target: ATXN1; (+) strand; PAM type: NRG; PAM sequence: AAG
gccaaataggagttaaaata

SEQ ID NO: 140951 - DNA, 20 bp, Artificial Sequence
  Description of Artificial Sequence: Synthetic oligonucleotide
  Target: ATXN1; (+) strand; PAM type: NRG; PAM sequence: GAG
aataggagttaaaataaagt

SEQ ID NO: 140952 - DNA, 20 bp, Artificial Sequence
  Description of Artificial Sequence: Synthetic oligonucleotide
  Target: ATXN1; (+) strand; PAM type: NRG; PAM sequence: AGG
ataggagttaaaataaagtg

SEQ ID NO: 140953 - DNA, 20 bp, Artificial Sequence
  Description of Artificial Sequence: Synthetic oligonucleotide
  Target: ATXN1; (+) strand; PAM type: NRG; PAM sequence: GGG
taggagttaaaataaagtga

SEQ ID NO: 140954 - DNA, 20 bp, Artificial Sequence
  Description of Artificial Sequence: Synthetic oligonucleotide
  Target: ATXN1; (+) strand; PAM type: NRG; PAM sequence: GGG
aggagttaaaataaagtgag

SEQ ID NO: 140955 - DNA, 20 bp, Artificial Sequence
  Description of Artificial Sequence: Synthetic oligonucleotide
  Target: ATXN1; (+) strand; PAM type: NRG; PAM sequence: AAG
gtgaggggaaatcaactcca

SEQ ID NO: 140956 - DNA, 20 bp, Artificial Sequence
  Description of Artificial Sequence: Synthetic oligonucleotide
  Target: ATXN1; (+) strand; PAM type: NRG; PAM sequence: GAG
gaggggaaatcaactccaaa

SEQ ID NO: 140957 - DNA, 20 bp, Artificial Sequence
  Description of Artificial Sequence: Synthetic oligonucleotide
  Target: ATXN1; (+) strand; PAM type: NRG; PAM sequence: AGG
aggggaaatcaactccaaag

SEQ ID NO: 140958 - DNA, 20 bp, Artificial Sequence
  Description of Artificial Sequence: Synthetic oligonucleotide
  Target: ATXN1; (+) strand; PAM type: NRG; PAM sequence: CAG
aggcacatgaaactatgtct

SEQ ID NO: 140959 - DNA, 20 bp, Artificial Sequence
  Description of Artificial Sequence: Synthetic oligonucleotide
  Target: ATXN1; (+) strand; PAM type: NRG; PAM sequence: AAG
acatgaaactatgtctcaga

SEQ ID NO: 140960 - DNA, 20 bp, Artificial Sequence
  Description of Artificial Sequence: Synthetic oligonucleotide
  Target: ATXN1; (+) strand; PAM type: NRG; PAM sequence: GAG
atgaaactatgtctcagaaa

SEQ ID NO: 140961 - DNA, 20 bp, Artificial Sequence
  Description of Artificial Sequence: Synthetic oligonucleotide
  Target: ATXN1; (+) strand; PAM type: NRG; PAM sequence: CAG
ttgataaatgttattctctt

SEQ ID NO: 140962 - DNA, 20 bp, Artificial Sequence
  Description of Artificial Sequence: Synthetic oligonucleotide
  Target: ATXN1; (+) strand; PAM type: NRG; PAM sequence: AAG
tgttattctcttcagttatt

SEQ ID NO: 140963 - DNA, 20 bp, Artificial Sequence
  Description of Artificial Sequence: Synthetic oligonucleotide
  Target: ATXN1; (+) strand; PAM type: NRG; PAM sequence: AAG
tattctcttcagttattaag

SEQ ID NO: 140964 - DNA, 20 bp, Artificial Sequence
  Description of Artificial Sequence: Synthetic oligonucleotide
  Target: ATXN1; (+) strand; PAM type: NRG; PAM sequence: CAG
gcccatattccaatacaacc

SEQ ID NO: 140965 - DNA, 20 bp, Artificial Sequence
  Description of Artificial Sequence: Synthetic oligonucleotide
  Target: ATXN1; (+) strand; PAM type: NRG; PAM sequence: TAG
tacaacccagtttctgaaat

SEQ ID NO: 140966 - DNA, 20 bp, Artificial Sequence
  Description of Artificial Sequence: Synthetic oligonucleotide
  Target: ATXN1; (+) strand; PAM type: NRG; PAM sequence: GAG
ccagtttctgaaattagaat

SEQ ID NO: 140967 - DNA, 20 bp, Artificial Sequence
  Description of Artificial Sequence: Synthetic oligonucleotide
  Target: ATXN1; (+) strand; PAM type: NRG; PAM sequence: AAG
tgataattactgacataata

SEQ ID NO: 140968 - DNA, 20 bp, Artificial Sequence
  Description of Artificial Sequence: Synthetic oligonucleotide
  Target: ATXN1; (+) strand; PAM type: NRG; PAM sequence: TGG
agtattgataacaaatactt

SEQ ID NO: 140969 - DNA, 20 bp, Artificial Sequence
  Description of Artificial Sequence: Synthetic oligonucleotide
  Target: ATXN1; (+) strand; PAM type: NRG; PAM sequence: AAG
tgataacaaatactttggaa

SEQ ID NO: 140970 - DNA, 20 bp, Artificial Sequence
  Description of Artificial Sequence: Synthetic oligonucleotide
  Target: ATXN1; (+) strand; PAM type: NRG; PAM sequence: CAG
acaaatactttggaaaagaa

SEQ ID NO: 140971 - DNA, 20 bp, Artificial Sequence
  Description of Artificial Sequence: Synthetic oligonucleotide
  Target: ATXN1; (+) strand; PAM type: NRG; PAM sequence: TGG
tgttattaaaaattaaatta

SEQ ID NO: 140972 - DNA, 20 bp, Artificial Sequence
  Description of Artificial Sequence: Synthetic oligonucleotide
  Target: ATXN1; (+) strand; PAM type: NRG; PAM sequence: GGG
gttattaaaaattaaattat

SEQ ID NO: 140973 - DNA, 20 bp, Artificial Sequence
  Description of Artificial Sequence: Synthetic oligonucleotide
  Target: ATXN1; (+) strand; PAM type: NRG; PAM sequence: CAG
ttaaaaattaaattatgggc

SEQ ID NO: 140974 - DNA, 20 bp, Artificial Sequence
  Description of Artificial Sequence: Synthetic oligonucleotide
  Target: ATXN1; (+) strand; PAM type: NRG; PAM sequence: AAG
aaattatgggccagacataa

SEQ ID NO: 140975 - DNA, 20 bp, Artificial Sequence
  Description of Artificial Sequence: Synthetic oligonucleotide
  Target: ATXN1; (+) strand; PAM type: NRG; PAM sequence: AGG
aattatgggccagacataaa

SEQ ID NO: 140976 - DNA, 20 bp, Artificial Sequence
  Description of Artificial Sequence: Synthetic oligonucleotide
  Target: ATXN1; (+) strand; PAM type: NRG; PAM sequence: TGG
aaatattgtatgattccatg

SEQ ID NO: 140977 - DNA, 20 bp, Artificial Sequence
  Description of Artificial Sequence: Synthetic oligonucleotide
  Target: ATXN1; (+) strand; PAM type: NRG; PAM sequence: AAG
ttccatgtggtccctaaaat

SEQ ID NO: 140978 - DNA, 20 bp, Artificial Sequence
  Description of Artificial Sequence: Synthetic oligonucleotide
  Target: ATXN1; (+) strand; PAM type: NRG; PAM sequence: TAG
ccctaaaataagaaacttca

SEQ ID NO: 140979 - DNA, 20 bp, Artificial Sequence
  Description of Artificial Sequence: Synthetic oligonucleotide
  Target: ATXN1; (+) strand; PAM type: NRG; PAM sequence: GAG
ctaaaataagaaacttcata

SEQ ID NO: 140980 - DNA, 20 bp, Artificial Sequence
  Description of Artificial Sequence: Synthetic oligonucleotide
  Target: ATXN1; (+) strand; PAM type: NRG; PAM sequence: CAG
taagaaacttcatagagaca

SEQ ID NO: 140981 - DNA, 20 bp, Artificial Sequence
  Description of Artificial Sequence: Synthetic oligonucleotide
  Target: ATXN1; (+) strand; PAM type: NRG; PAM sequence: TAG
catagagacacagtgtacaa

SEQ ID NO: 140982 - DNA, 20 bp, Artificial Sequence
  Description of Artificial Sequence: Synthetic oligonucleotide
  Target: ATXN1; (+) strand; PAM type: NRG; PAM sequence: GAG
tagagacacagtgtacaata

SEQ ID NO: 140983 - DNA, 20 bp, Artificial Sequence
  Description of Artificial Sequence: Synthetic oligonucleotide
  Target: ATXN1; (+) strand; PAM type: NRG; PAM sequence: AGG
agagacacagtgtacaatag

SEQ ID NO: 140984 - DNA, 20 bp, Artificial Sequence
  Description of Artificial Sequence: Synthetic oligonucleotide
  Target: ATXN1; (+) strand; PAM type: NRG; PAM sequence: CAG
cagtgtacaatagaggttac

SEQ ID NO: 140985 - DNA, 20 bp, Artificial Sequence
  Description of Artificial Sequence: Synthetic oligonucleotide
  Target: ATXN1; (+) strand; PAM type: NRG; PAM sequence: AGG
agtgtacaatagaggttacc

SEQ ID NO: 140986 - DNA, 20 bp, Artificial Sequence
  Description of Artificial Sequence: Synthetic oligonucleotide
  Target: ATXN1; (+) strand; PAM type: NRG; PAM sequence: GGG
gtgtacaatagaggttacca

SEQ ID NO: 140987 - DNA, 20 bp, Artificial Sequence
  Description of Artificial Sequence: Synthetic oligonucleotide
  Target: ATXN1; (+) strand; PAM type: NRG; PAM sequence: GGG
tgtacaatagaggttaccag

SEQ ID NO: 140988 - DNA, 20 bp, Artificial Sequence
  Description of Artificial Sequence: Synthetic oligonucleotide
  Target: ATXN1; (+) strand; PAM type: NRG; PAM sequence: TGG
caatagaggttaccaggggc

SEQ ID NO: 140989 - DNA, 20 bp, Artificial Sequence
  Description of Artificial Sequence: Synthetic oligonucleotide
  Target: ATXN1; (+) strand; PAM type: NRG; PAM sequence: GGG
aatagaggttaccaggggct

SEQ ID NO: 140990 - DNA, 20 bp, Artificial Sequence
  Description of Artificial Sequence: Synthetic oligonucleotide
  Target: ATXN1; (+) strand; PAM type: NRG; PAM sequence: GAG
tagaggttaccaggggctgg

SEQ ID NO: 140991 - DNA, 20 bp, Artificial Sequence
  Description of Artificial Sequence: Synthetic oligonucleotide
  Target: ATXN1; (+) strand; PAM type: NRG; PAM sequence: AGG
agaggttaccaggggctggg

SEQ ID NO: 140992 - DNA, 20 bp, Artificial Sequence
  Description of Artificial Sequence: Synthetic oligonucleotide
  Target: ATXN1; (+) strand; PAM type: NRG; PAM sequence: GAG
aggttaccaggggctgggag

SEQ ID NO: 140993 - DNA, 20 bp, Artificial Sequence
  Description of Artificial Sequence: Synthetic oligonucleotide
  Target: ATXN1; (+) strand; PAM type: NRG; PAM sequence: GAG
gttaccaggggctgggagga

SEQ ID NO: 140994 - DNA, 20 bp, Artificial Sequence
  Description of Artificial Sequence: Synthetic oligonucleotide
  Target: ATXN1; (+) strand; PAM type: NRG; PAM sequence: TGG
caggggctgggaggagagaa

SEQ ID NO: 140995 - DNA, 20 bp, Artificial Sequence
  Description of Artificial Sequence: Synthetic oligonucleotide
  Target: ATXN1; (+) strand; PAM type: NRG; PAM sequence: GAG
ggggctgggaggagagaatg

SEQ ID NO: 140996 - DNA, 20 bp, Artificial Sequence
  Description of Artificial Sequence: Synthetic oligonucleotide
  Target: ATXN1; (+) strand; PAM type: NRG; PAM sequence: CAG
gtgttattgtctaatgaatg

SEQ ID NO: 140997 - DNA, 20 bp, Artificial Sequence
  Description of Artificial Sequence: Synthetic oligonucleotide
  Target: ATXN1; (+) strand; PAM type: NRG; PAM sequence: GAG
gttattgtctaatgaatgca

SEQ ID NO: 140998 - DNA, 20 bp, Artificial Sequence
  Description of Artificial Sequence: Synthetic oligonucleotide
  Target: ATXN1; (+) strand; PAM type: NRG; PAM sequence: CGG
atgaatgcagagcttctgtt

SEQ ID NO: 140999 - DNA, 20 bp, Artificial Sequence
  Description of Artificial Sequence: Synthetic oligonucleotide
  Target: ATXN1; (+) strand; PAM type: NRG; PAM sequence: GGG
tgaatgcagagcttctgttc

SEQ ID NO: 141000 - DNA, 20 bp, Artificial Sequence
  Description of Artificial Sequence: Synthetic oligonucleotide
  Target: ATXN1; (+) strand; PAM type: NRG; PAM sequence: AAG
ttctgttcgggatgatgaaa

SEQ ID NO: 141001 - DNA, 20 bp, Artificial Sequence
  Description of Artificial Sequence: Synthetic oligonucleotide
  Target: ATXN1; (+) strand; PAM type: NRG; PAM sequence: TGG
tcgggatgatgaaaaagttc

SEQ ID NO: 141002 - DNA, 20 bp, Artificial Sequence
  Description of Artificial Sequence: Synthetic oligonucleotide
  Target: ATXN1; (+) strand; PAM type: NRG; PAM sequence: TGG
tgatgaaaaagttctggaaa

SEQ ID NO: 141003 - DNA, 20 bp, Artificial Sequence
  Description of Artificial Sequence: Synthetic oligonucleotide
  Target: ATXN1; (+) strand; PAM type: NRG; PAM sequence: TAG
gaaaaagttctggaaatgga

SEQ ID NO: 141004 - DNA, 20 bp, Artificial Sequence
  Description of Artificial Sequence: Synthetic oligonucleotide
  Target: ATXN1; (+) strand; PAM type: NRG; PAM sequence: TGG
aaagttctggaaatggatag

SEQ ID NO: 141005 - DNA, 20 bp, Artificial Sequence
  Description of Artificial Sequence: Synthetic oligonucleotide
  Target: ATXN1; (+) strand; PAM type: NRG; PAM sequence: GAG
agttctggaaatggatagtg

SEQ ID NO: 141006 - DNA, 20 bp, Artificial Sequence
  Description of Artificial Sequence: Synthetic oligonucleotide
  Target: ATXN1; (+) strand; PAM type: NRG; PAM sequence: TGG
tggagatgattgcactacac

SEQ ID NO: 141007 - DNA, 20 bp, Artificial Sequence
  Description of Artificial Sequence: Synthetic oligonucleotide
  Target: ATXN1; (+) strand; PAM type: NRG; PAM sequence: TGG
ctgaattgtacacttaaaaa

SEQ ID NO: 141008 - DNA, 20 bp, Artificial Sequence
  Description of Artificial Sequence: Synthetic oligonucleotide
  Target: ATXN1; (+) strand; PAM type: NRG; PAM sequence: TGG
acacttaaaaatggttaaac

SEQ ID NO: 141009 - DNA, 20 bp, Artificial Sequence
  Description of Artificial Sequence: Synthetic oligonucleotide
  Target: ATXN1; (+) strand; PAM type: NRG; PAM sequence: GGG
cacttaaaaatggttaaact

SEQ ID NO: 141010 - DNA, 20 bp, Artificial Sequence
  Description of Artificial Sequence: Synthetic oligonucleotide
  Target: ATXN1; (+) strand; PAM type: NRG; PAM sequence: CAG
taaaaatggttaaactgggc

SEQ ID NO: 141011 - DNA, 20 bp, Artificial Sequence
  Description of Artificial Sequence: Synthetic oligonucleotide
  Target: ATXN1; (+) strand; PAM type: NRG; PAM sequence: AGG
aaaaatggttaaactgggcc

SEQ ID NO: 141012 - DNA, 20 bp, Artificial Sequence
  Description of Artificial Sequence: Synthetic oligonucleotide
  Target: ATXN1; (+) strand; PAM type: NRG; PAM sequence: TGG
tggttaaactgggccaggtg

SEQ ID NO: 141013 - DNA, 20 bp, Artificial Sequence
  Description of Artificial Sequence: Synthetic oligonucleotide
  Target: ATXN1; (+) strand; PAM type: NRG; PAM sequence: TGG
ttaaactgggccaggtgtgg

SEQ ID NO: 141014 - DNA, 20 bp, Artificial Sequence
  Description of Artificial Sequence: Synthetic oligonucleotide
  Target: ATXN1; (+) strand; PAM type: NRG; PAM sequence: CAG
aggtgtggtggctcacgccc

SEQ ID NO: 141015 - DNA, 20 bp, Artificial Sequence
  Description of Artificial Sequence: Synthetic oligonucleotide
  Target: ATXN1; (+) strand; PAM type: NRG; PAM sequence: TGG
tggctcacgccccagcactt

SEQ ID NO: 141016 - DNA, 20 bp, Artificial Sequence
  Description of Artificial Sequence: Synthetic oligonucleotide
  Target: ATXN1; (+) strand; PAM type: NRG; PAM sequence: GGG
ggctcacgccccagcacttt

SEQ ID NO: 141017 - DNA, 20 bp, Artificial Sequence
  Description of Artificial Sequence: Synthetic oligonucleotide
  Target: ATXN1; (+) strand; PAM type: NRG; PAM sequence: GAG
ctcacgccccagcactttgg

SEQ ID NO: 141018 - DNA, 20 bp, Artificial Sequence
  Description of Artificial Sequence: Synthetic oligonucleotide
  Target: ATXN1; (+) strand; PAM type: NRG; PAM sequence: AGG
tcacgccccagcactttggg

SEQ ID NO: 141019 - DNA, 20 bp, Artificial Sequence
  Description of Artificial Sequence: Synthetic oligonucleotide
  Target: ATXN1; (+) strand; PAM type: NRG; PAM sequence: GAG
ccccagcactttgggaggct

SEQ ID NO: 141020 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggctg

SEQ ID NO: 141021 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggctgagg

SEQ ID NO: 141022 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggctgaggc

SEQ ID NO: 141023 - DNA, 20 bp, Artificial Sequence
  Description of Artificial Sequence: Synthetic oligonucleotide
  Target: ATXN1; (+) strand; PAM type: NRG; PAM sequence: CAG
ctttgggaggctgaggcggg

SEQ ID NO: 141024 - DNA, 20 bp, Artificial Sequence
  Description of Artificial Sequence: Synthetic oligonucleotide
  Target: ATXN1; (+) strand; PAM type: NRG; PAM sequence: GAG
ggctgaggcgggcagatcac

SEQ ID NO: 141025 - DNA, 20 bp, Artificial Sequence
  Description of Artificial Sequence: Synthetic oligonucleotide
  Target: ATXN1; (+) strand; PAM type: NRG; PAM sequence: AGG
gctgaggcgggcagatcacg

SEQ ID NO: 141026 - DNA, 20 bp, Artificial Sequence
  Description of Artificial Sequence: Synthetic oligonucleotide
  Target: ATXN1; (+) strand; PAM type: NRG; PAM sequence: AAG
ggcgggcagatcacgaggtc

SEQ ID NO: 141027 - DNA, 20 bp, Artificial Sequence
  Description of Artificial Sequence: Synthetic oligonucleotide
  Target: ATXN1; (+) strand; PAM type: NRG; PAM sequence: GAG
cgggcagatcacgaggtcaa

SEQ ID NO: 141028 - DNA, 20 bp, Artificial Sequence
  Description of Artificial Sequence: Synthetic oligonucleotide
  Target: ATXN1; (+) strand; PAM type: NRG; PAM sequence: GAG
gatcacgaggtcaagagatc

SEQ ID NO: 141029 - DNA, 20 bp, Artificial Sequence
  Description of Artificial Sequence: Synthetic oligonucleotide
  Target: ATXN1; (+) strand; PAM type: NRG; PAM sequence: TGG
tcaagagatcgagaccatcc

SEQ ID NO: 141030 - DNA, 20 bp, Artificial Sequence
  Description of Artificial Sequence: Synthetic oligonucleotide
  Target: ATXN1; (+) strand; PAM type: NRG; PAM sequence: TGG
cgagaccatcctggccaaca

SEQ ID NO: 141031 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaaattccc

SEQ ID NO: 141032 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattccct

SEQ ID NO: 141033 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattccctgggcg

SEQ ID NO: 141034 - DNA, 20 bp, Artificial Sequence
  Description of Artificial Sequence: Synthetic oligonucleotide
  Target: ATXN1; (+) strand; PAM type: NRG; PAM sequence: CGG
caaaaattccctgggcgtgg

SEQ ID NO: 141035 - DNA, 20 bp, Artificial Sequence
  Description of Artificial Sequence: Synthetic oligonucleotide
  Target: ATXN1; (+) strand; PAM type: NRG; PAM sequence: TAG
ggcgtggcggcatgcgcctg

SEQ ID NO: 141036 - DNA, 20 bp, Artificial Sequence
  Description of Artificial Sequence: Synthetic oligonucleotide
  Target: ATXN1; (+) strand; PAM type: NRG; PAM sequence: CAG
gcggcatgcgcctgtagtcc

SEQ ID NO: 141037 - DNA, 20 bp, Artificial Sequence
  Description of Artificial Sequence: Synthetic oligonucleotide
  Target: ATXN1; (+) strand; PAM type: NRG; PAM sequence: CGG
cgcctgtagtcccagctact

SEQ ID NO: 141038 - DNA, 20 bp, Artificial Sequence
  Description of Artificial Sequence: Synthetic oligonucleotide
  Target: ATXN1; (+) strand; PAM type: NRG; PAM sequence: GGG
gcctgtagtcccagctactc

SEQ ID NO: 141039 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctactcgg

SEQ ID NO: 141040 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctactcggg

SEQ ID NO: 141041 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcgggaggcc

SEQ ID NO: 141042 - DNA, 20 bp, Artificial Sequence
  Description of Artificial Sequence: Synthetic oligonucleotide
  Target: ATXN1; (+) strand; PAM type: NRG; PAM sequence: AGG
cccagctactcgggaggccg

SEQ ID NO: 141043 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggccgagg

SEQ ID NO: 141044 - DNA, 20 bp, Artificial Sequence
  Description of Artificial Sequence: Synthetic oligonucleotide
  Target: ATXN1; (+) strand; PAM type: NRG; PAM sequence: AGG
gctactcgggaggccgaggc

SEQ ID NO: 141045 - DNA, 20 bp, Artificial Sequence
  Description of Artificial Sequence: Synthetic oligonucleotide
  Target: ATXN1; (+) strand; PAM type: NRG; PAM sequence: GAG
tactcgggaggccgaggcag

SEQ ID NO: 141046 - DNA, 20 bp, Artificial Sequence
  Description of Artificial Sequence: Synthetic oligonucleotide
  Target: ATXN1; (+) strand; PAM type: NRG; PAM sequence: CAG
gcaggagaattgcttgaacc

SEQ ID NO: 141047 - DNA, 20 bp, Artificial Sequence
  Description of Artificial Sequence: Synthetic oligonucleotide
  Target: ATXN1; (+) strand; PAM type: NRG; PAM sequence: AGG
caggagaattgcttgaaccc

SEQ ID NO: 141048 - DNA, 20 bp, Artificial Sequence
  Description of Artificial Sequence: Synthetic oligonucleotide
  Target: ATXN1; (+) strand; PAM type: NRG; PAM sequence: GAG
ggagaattgcttgaacccag

SEQ ID NO: 141049 - DNA, 20 bp, Artificial Sequence
  Description of Artificial Sequence: Synthetic oligonucleotide
  Target: ATXN1; (+) strand; PAM type: NRG; PAM sequence: AGG
gagaattgcttgaacccagg

SEQ ID NO: 141050 - DNA, 20 bp, Artificial Sequence
  Description of Artificial Sequence: Synthetic oligonucleotide
  Target: ATXN1; (+) strand; PAM type: NRG; PAM sequence: CGG
aattgcttgaacccaggagg

SEQ ID NO: 141051 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaacccaggaggcg

SEQ ID NO: 141052 - DNA, 20 bp, Artificial Sequence
  Description of Artificial Sequence: Synthetic oligonucleotide
  Target: ATXN1; (+) strand; PAM type: NRG; PAM sequence: AGG
tgcttgaacccaggaggcgg

SEQ ID NO: 141053 - DNA, 20 bp, Artificial Sequence
  Description of Artificial Sequence: Synthetic oligonucleotide
  Target: ATXN1; (+) strand; PAM type: NRG; PAM sequence: CAG
aacccaggaggcggaggctg

SEQ ID NO: 141054 - DNA, 20 bp, Artificial Sequence
  Description of Artificial Sequence: Synthetic oligonucleotide
  Target: ATXN1; (+) strand; PAM type: NRG; PAM sequence: GAG
caggaggcggaggctgcagt

SEQ ID NO: 141055 - DNA, 20 bp, Artificial Sequence
  Description of Artificial Sequence: Synthetic oligonucleotide
  Target: ATXN1; (+) strand; PAM type: NRG; PAM sequence: GAG
ggcggaggctgcagtgagct

SEQ ID NO: 141056 - DNA, 20 bp, Artificial Sequence
  Description of Artificial Sequence: Synthetic oligonucleotide
  Target: ATXN1; (+) strand; PAM type: NRG; PAM sequence: CAG
gagatcatgccactgcactc

SEQ ID NO: 141057 - DNA, 20 bp, Artificial Sequence
  Description of Artificial Sequence: Synthetic oligonucleotide
  Target: ATXN1; (+) strand; PAM type: NRG; PAM sequence: TGG
catgccactgcactccagcc

SEQ ID NO: 141058 - DNA, 20 bp, Artificial Sequence
  Description of Artificial Sequence: Synthetic oligonucleotide
  Target: ATXN1; (+) strand; PAM type: NRG; PAM sequence: CAG
actgcactccagcctggcga

SEQ ID NO: 141059 - DNA, 20 bp, Artificial Sequence
  Description of Artificial Sequence: Synthetic oligonucleotide
  Target: ATXN1; (+) strand; PAM type: NRG; PAM sequence: GAG
tgcactccagcctggcgaca

SEQ ID NO: 141060 - DNA, 20 bp, Artificial Sequence
  Description of Artificial Sequence: Synthetic oligonucleotide
  Target: ATXN1; (+) strand; PAM type: NRG; PAM sequence: AAG
ctccagcctggcgacagagc

SEQ ID NO: 141061 - DNA, 20 bp, Artificial Sequence
  Description of Artificial Sequence: Synthetic oligonucleotide
  Target: ATXN1; (+) strand; PAM type: NRG; PAM sequence: AAG
gtttcaaaaaaaaaaaaaaa

SEQ ID NO: 141062 - DNA, 20 bp, Artificial Sequence
  Description of Artificial Sequence: Synthetic oligonucleotide
  Target: ATXN1; (+) strand; PAM type: NRG; PAM sequence: AGG
tttcaaaaaaaaaaaaaaaa

SEQ ID NO: 141063 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaaaaaggttaaaa

SEQ ID NO: 141064 - DNA, 20 bp, Artificial Sequence
  Description of Artificial Sequence: Synthetic oligonucleotide
  Target: ATXN1; (+) strand; PAM type: NRG; PAM sequence: TGG
aggttaaaatggtaaattta

SEQ ID NO: 141065 - DNA, 20 bp, Artificial Sequence
  Description of Artificial Sequence: Synthetic oligonucleotide
  Target: ATXN1; (+) strand; PAM type: NRG; PAM sequence: TGG
taaatttatggtaaatttta

SEQ ID NO: 141066 - DNA, 20 bp, Artificial Sequence
  Description of Artificial Sequence: Synthetic oligonucleotide
  Target: ATXN1; (+) strand; PAM type: NRG; PAM sequence: AAG
tatattttaaaaatcaaatt

SEQ ID NO: 141067 - DNA, 20 bp, Artificial Sequence
  Description of Artificial Sequence: Synthetic oligonucleotide
  Target: ATXN1; (+) strand; PAM type: NRG; PAM sequence: AGG
atattttaaaaatcaaatta

SEQ ID NO: 141068 - DNA, 20 bp, Artificial Sequence
  Description of Artificial Sequence: Synthetic oligonucleotide
  Target: ATXN1; (+) strand; PAM type: NRG; PAM sequence: CAG
aatcaaattaaggacacttt

SEQ ID NO: 141069 - DNA, 20 bp, Artificial Sequence
  Description of Artificial Sequence: Synthetic oligonucleotide
  Target: ATXN1; (+) strand; PAM type: NRG; PAM sequence: GAG
tcaaattaaggacactttca

SEQ ID NO: 141070 - DNA, 20 bp, Artificial Sequence
  Description of Artificial Sequence: Synthetic oligonucleotide
  Target: ATXN1; (+) strand; PAM type: NRG; PAM sequence: TAG
aattaaggacactttcagag

SEQ ID NO: 141071 - DNA, 20 bp, Artificial Sequence
  Description of Artificial Sequence: Synthetic oligonucleotide
  Target: ATXN1; (+) strand; PAM type: NRG; PAM sequence: AGG
attaaggacactttcagagt

SEQ ID NO: 141072 - DNA, 20 bp, Artificial Sequence
  Description of Artificial Sequence: Synthetic oligonucleotide
  Target: ATXN1; (+) strand; PAM type: NRG; PAM sequence: GGG
ttaaggacactttcagagta

SEQ ID NO: 141073 - DNA, 20 bp, Artificial Sequence
  Description of Artificial Sequence: Synthetic oligonucleotide
  Target: ATXN1; (+) strand; PAM type: NRG; PAM sequence: TGG
tttcagagtagggtatctga

SEQ ID NO: 141074 - DNA, 20 bp, Artificial Sequence
  Description of Artificial Sequence: Synthetic oligonucleotide
  Target: ATXN1; (+) strand; PAM type: NRG; PAM sequence: TAG
agagtagggtatctgatgga

SEQ ID NO: 141075 - DNA, 20 bp, Artificial Sequence
  Description of Artificial Sequence: Synthetic oligonucleotide
  Target: ATXN1; (+) strand; PAM type: NRG; PAM sequence: TGG
agggtatctgatggatagcc

SEQ ID NO: 141076 - DNA, 20 bp, Artificial Sequence
  Description of Artificial Sequence: Synthetic oligonucleotide
  Target: ATXN1; (+) strand; PAM type: NRG; PAM sequence: GAG
tgatggatagcctggtccct

SEQ ID NO: 141077 - DNA, 20 bp, Artificial Sequence
  Description of Artificial Sequence: Synthetic oligonucleotide
  Target: ATXN1; (+) strand; PAM type: NRG; PAM sequence: CAG
atagcctggtccctgagaca

SEQ ID NO: 141078 - DNA, 20 bp, Artificial Sequence
  Description of Artificial Sequence: Synthetic oligonucleotide
  Target: ATXN1; (+) strand; PAM type: NRG; PAM sequence: TGG
cacagcgtgctgctctatgc

SEQ ID NO: 141079 - DNA, 20 bp, Artificial Sequence
  Description of Artificial Sequence: Synthetic oligonucleotide
  Target: ATXN1; (+) strand; PAM type: NRG; PAM sequence: AAG
tgctctatgctggctctcca

SEQ ID NO: 141080 - DNA, 20 bp, Artificial Sequence
  Description of Artificial Sequence: Synthetic oligonucleotide
  Target: ATXN1; (+) strand; PAM type: NRG; PAM sequence: TGG
tctatgctggctctccaaag

SEQ ID NO: 141081 - DNA, 20 bp, Artificial Sequence
  Description of Artificial Sequence: Synthetic oligonucleotide
  Target: ATXN1; (+) strand; PAM type: NRG; PAM sequence: GGG
ctatgctggctctccaaagt

SEQ ID NO: 141082 - DNA, 20 bp, Artificial Sequence
  Description of Artificial Sequence: Synthetic oligonucleotide
  Target: ATXN1; (+) strand; PAM type: NRG; PAM sequence: GAG
gctggctctccaaagtgggt

SEQ ID NO: 141083 - DNA, 20 bp, Artificial Sequence
  Description of Artificial Sequence: Synthetic oligonucleotide
  Target: ATXN1; (+) strand; PAM type: NRG; PAM sequence: GAG
tggctctccaaagtgggtga

SEQ ID NO: 141084 - DNA, 20 bp, Artificial Sequence
  Description of Artificial Sequence: Synthetic oligonucleotide
  Target: ATXN1; (+) strand; PAM type: NRG; PAM sequence: TGG
ctctccaaagtgggtgagag

SEQ ID NO: 141085 - DNA, 20 bp, Artificial Sequence
  Description of Artificial Sequence: Synthetic oligonucleotide
  Target: ATXN1; (+) strand; PAM type: NRG; PAM sequence: CAG
aaagtgggtgagagtggtgc

SEQ ID NO: 141086 - DNA, 20 bp, Artificial Sequence
  Description of Artificial Sequence: Synthetic oligonucleotide
  Target: ATXN1; (+) strand; PAM type: NRG; PAM sequence: AGG
aagtgggtgagagtggtgcc

SEQ ID NO: 141087 - DNA, 20 bp, Artificial Sequence
  Description of Artificial Sequence: Synthetic oligonucleotide
  Target: ATXN1; (+) strand; PAM type: NRG; PAM sequence: CGG
ggtgagagtggtgccaggaa

SEQ ID NO: 141088 - DNA, 20 bp, Artificial Sequence
  Description of Artificial Sequence: Synthetic oligonucleotide
  Target: ATXN1; (+) strand; PAM type: NRG; PAM sequence: GGG
gtgagagtggtgccaggaac

SEQ ID NO: 141089 - DNA, 20 bp, Artificial Sequence
  Description of Artificial Sequence: Synthetic oligonucleotide
  Target: ATXN1; (+) strand; PAM type: NRG; PAM sequence: AAG
agagtggtgccaggaacggg

SEQ ID NO: 141090 - DNA, 20 bp, Artificial Sequence
  Description of Artificial Sequence: Synthetic oligonucleotide
  Target: ATXN1; (+) strand; PAM type: NRG; PAM sequence: AGG
gagtggtgccaggaacggga

SEQ ID NO: 141091 - DNA, 20 bp, Artificial Sequence
  Description of Artificial Sequence: Synthetic oligonucleotide
  Target: ATXN1; (+) strand; PAM type: NRG; PAM sequence: GGG
agtggtgccaggaacgggaa

SEQ ID NO: 141092 - DNA, 20 bp, Artificial Sequence
  Description of Artificial Sequence: Synthetic oligonucleotide
  Target: ATXN1; (+) strand; PAM type: NRG; PAM sequence: TGG
gggaagggatgatactgacg

SEQ ID NO: 141093 - DNA, 20 bp, Artificial Sequence
  Description of Artificial Sequence: Synthetic oligonucleotide
  Target: ATXN1; (+) strand; PAM type: NRG; PAM sequence: CAG
atactgacgtggccactcac

SEQ ID NO: 141094 - DNA, 20 bp, Artificial Sequence
  Description of Artificial Sequence: Synthetic oligonucleotide
  Target: ATXN1; (+) strand; PAM type: NRG; PAM sequence: AGG
tactgacgtggccactcacc

SEQ ID NO: 141095 - DNA, 20 bp, Artificial Sequence
  Description of Artificial Sequence: Synthetic oligonucleotide
  Target: ATXN1; (+) strand; PAM type: NRG; PAM sequence: AAG
gacgtggccactcaccagga

SEQ ID NO: 141096 - DNA, 20 bp, Artificial Sequence
  Description of Artificial Sequence: Synthetic oligonucleotide
  Target: ATXN1; (+) strand; PAM type: NRG; PAM sequence: TAG
gtggccactcaccaggaaag

SEQ ID NO: 141097 - DNA, 20 bp, Artificial Sequence
  Description of Artificial Sequence: Synthetic oligonucleotide
  Target: ATXN1; (+) strand; PAM type: NRG; PAM sequence: GAG
ggccactcaccaggaaagta

SEQ ID NO: 141098 - DNA, 20 bp, Artificial Sequence
  Description of Artificial Sequence: Synthetic oligonucleotide
  Target: ATXN1; (+) strand; PAM type: NRG; PAM sequence: AGG
gccactcaccaggaaagtag

SEQ ID NO: 141099 - DNA, 20 bp, Artificial Sequence
  Description of Artificial Sequence: Synthetic oligonucleotide
  Target: ATXN1; (+) strand; PAM type: NRG; PAM sequence: AAG
tcaccatgtccattttcgca

SEQ ID NO: 141100 - DNA, 20 bp, Artificial Sequence
  Description of Artificial Sequence: Synthetic oligonucleotide
  Target: ATXN1; (+) strand; PAM type: NRG; PAM sequence: GAG
catgtccattttcgcaaagt

SEQ ID NO: 141101 - DNA, 20 bp, Artificial Sequence
  Description of Artificial Sequence: Synthetic oligonucleotide
  Target: ATXN1; (+) strand; PAM type: NRG; PAM sequence: CAG
ccattttcgcaaagtgagca

SEQ ID NO: 141102 - DNA, 20 bp, Artificial Sequence
  Description of Artificial Sequence: Synthetic oligonucleotide
  Target: ATXN1; (+) strand; PAM type: NRG; PAM sequence: CAG
tcgcaaagtgagcacagctg

SEQ ID NO: 141103 - DNA, 20 bp, Artificial Sequence
  Description of Artificial Sequence: Synthetic oligonucleotide
  Target: ATXN1; (+) strand; PAM type: NRG; PAM sequence: AGG
cgcaaagtgagcacagctgc

SEQ ID NO: 141104 - DNA, 20 bp, Artificial Sequence
  Description of Artificial Sequence: Synthetic oligonucleotide
  Target: ATXN1; (+) strand; PAM type: NRG; PAM sequence: GAG
aagtgagcacagctgcaggt

SEQ ID NO: 141105 - DNA, 20 bp, Artificial Sequence
  Description of Artificial Sequence: Synthetic oligonucleotide
  Target: ATXN1; (+) strand; PAM type: NRG; PAM sequence: AAG
agcacagctgcaggtgagca

SEQ ID NO: 141106 - DNA, 20 bp, Artificial Sequence
  Description of Artificial Sequence: Synthetic oligonucleotide
  Target: ATXN1; (+) strand; PAM type: NRG; PAM sequence: CAG
tgagcaaagcctctgaaaat

SEQ ID NO: 141107 - DNA, 20 bp, Artificial Sequence
  Description of Artificial Sequence: Synthetic oligonucleotide
  Target: ATXN1; (+) strand; PAM type: NRG; PAM sequence: TAG
aagcctctgaaaatcagcac

SEQ ID NO: 141108 - DNA, 20 bp, Artificial Sequence
  Description of Artificial Sequence: Synthetic oligonucleotide
  Target: ATXN1; (+) strand; PAM type: NRG; PAM sequence: TGG
tctgaaaatcagcactagca

SEQ ID NO: 141109 - DNA, 20 bp, Artificial Sequence
  Description of Artificial Sequence: Synthetic oligonucleotide
  Target: ATXN1; (+) strand; PAM type: NRG; PAM sequence: AAG
cttcctgatttaaatgcatc

SEQ ID NO: 141110 - DNA, 20 bp, Artificial Sequence
  Description of Artificial Sequence: Synthetic oligonucleotide
  Target: ATXN1; (+) strand; PAM type: NRG; PAM sequence: CAG
cctgatttaaatgcatcaag

SEQ ID NO: 141111 - DNA, 20 bp, Artificial Sequence
  Description of Artificial Sequence: Synthetic oligonucleotide
  Target: ATXN1; (+) strand; PAM type: NRG; PAM sequence: GAG
caagcagacttgatattttt

SEQ ID NO: 141112 - DNA, 20 bp, Artificial Sequence
  Description of Artificial Sequence: Synthetic oligonucleotide
  Target: ATXN1; (+) strand; PAM type: NRG; PAM sequence: CGG
gatatttttgagactcttaa

SEQ ID NO: 141113 - DNA, 20 bp, Artificial Sequence
  Description of Artificial Sequence: Synthetic oligonucleotide
  Target: ATXN1; (+) strand; PAM type: NRG; PAM sequence: TAG
atttttgagactcttaacgg

SEQ ID NO: 141114 - DNA, 20 bp, Artificial Sequence
  Description of Artificial Sequence: Synthetic oligonucleotide
  Target: ATXN1; (+) strand; PAM type: NRG; PAM sequence: TAG
ttaacggtagatcatttttg

SEQ ID NO: 141115 - DNA, 20 bp, Artificial Sequence
  Description of Artificial Sequence: Synthetic oligonucleotide
  Target: ATXN1; (+) strand; PAM type: NRG; PAM sequence: GAG
aacggtagatcatttttgta

SEQ ID NO: 141116 - DNA, 20 bp, Artificial Sequence
  Description of Artificial Sequence: Synthetic oligonucleotide
  Target: ATXN1; (+) strand; PAM type: NRG; PAM sequence: CAG
ggtagatcatttttgtagag

SEQ ID NO: 141117 - DNA, 20 bp, Artificial Sequence
  Description of Artificial Sequence: Synthetic oligonucleotide
  Target: ATXN1; (+) strand; PAM type: NRG; PAM sequence: AAG
taaccactccaaaactgttc

SEQ ID NO: 141118 - DNA, 20 bp, Artificial Sequence
  Description of Artificial Sequence: Synthetic oligonucleotide
  Target: ATXN1; (+) strand; PAM type: NRG; PAM sequence: CAG
actgttcaagctaataaata

SEQ ID NO: 141119 - DNA, 20 bp, Artificial Sequence
  Description of Artificial Sequence: Synthetic oligonucleotide
  Target: ATXN1; (+) strand; PAM type: NRG; PAM sequence: TGG
caagctaataaatacagatt

SEQ ID NO: 141120 - DNA, 20 bp, Artificial Sequence
  Description of Artificial Sequence: Synthetic oligonucleotide
  Target: ATXN1; (+) strand; PAM type: NRG; PAM sequence: GGG
aagctaataaatacagattt

SEQ ID NO: 141121 - DNA, 20 bp, Artificial Sequence
  Description of Artificial Sequence: Synthetic oligonucleotide
  Target: ATXN1; (+) strand; PAM type: NRG; PAM sequence: TAG
atttacataatatgtgcttg

SEQ ID NO: 141122 - DNA, 20 bp, Artificial Sequence
  Description of Artificial Sequence: Synthetic oligonucleotide
  Target: ATXN1; (+) strand; PAM type: NRG; PAM sequence: AGG
tttacataatatgtgcttgt

SEQ ID NO: 141123 - DNA, 20 bp, Artificial Sequence
  Description of Artificial Sequence: Synthetic oligonucleotide
  Target: ATXN1; (+) strand; PAM type: NRG; PAM sequence: TGG
atatgtgcttgtaggttcac

SEQ ID NO: 141124 - DNA, 20 bp, Artificial Sequence
  Description of Artificial Sequence: Synthetic oligonucleotide
  Target: ATXN1; (+) strand; PAM type: NRG; PAM sequence: TAG
tcactggccatgacctttga

SEQ ID NO: 141125 - DNA, 20 bp, Artificial Sequence
  Description of Artificial Sequence: Synthetic oligonucleotide
  Target: ATXN1; (+) strand; PAM type: NRG; PAM sequence: CAG
ctaaatgtcattccaaattc

SEQ ID NO: 141126 - DNA, 20 bp, Artificial Sequence
  Description of Artificial Sequence: Synthetic oligonucleotide
  Target: ATXN1; (+) strand; PAM type: NRG; PAM sequence: AGG
taaatgtcattccaaattcc

SEQ ID NO: 141127 - DNA, 20 bp, Artificial Sequence
  Description of Artificial Sequence: Synthetic oligonucleotide
  Target: ATXN1; (+) strand; PAM type: NRG; PAM sequence: TGG
tccaaattccaggctgtctt

SEQ ID NO: 141128 - DNA, 20 bp, Artificial Sequence
  Description of Artificial Sequence: Synthetic oligonucleotide
  Target: ATXN1; (+) strand; PAM type: NRG; PAM sequence: AAG
aaattccaggctgtctttgg

SEQ ID NO: 141129 - DNA, 20 bp, Artificial Sequence
  Description of Artificial Sequence: Synthetic oligonucleotide
  Target: ATXN1; (+) strand; PAM type: NRG; PAM sequence: TAG
gcctgttgccatgtgtcttt

SEQ ID NO: 141130 - DNA, 20 bp, Artificial Sequence
  Description of Artificial Sequence: Synthetic oligonucleotide
  Target: ATXN1; (+) strand; PAM type: NRG; PAM sequence: TGG
tgtcttttagataataaacg

SEQ ID NO: 141131 - DNA, 20 bp, Artificial Sequence
  Description of Artificial Sequence: Synthetic oligonucleotide
  Target: ATXN1; (+) strand; PAM type: NRG; PAM sequence: GGG
gtcttttagataataaacgt

SEQ ID NO: 141132 - DNA, 20 bp, Artificial Sequence
  Description of Artificial Sequence: Synthetic oligonucleotide
  Target: ATXN1; (+) strand; PAM type: NRG; PAM sequence: CAG
ataataaacgtgggttccac

SEQ ID NO: 141133 - DNA, 20 bp, Artificial Sequence
  Description of Artificial Sequence: Synthetic oligonucleotide
  Target: ATXN1; (+) strand; PAM type: NRG; PAM sequence: TGG
taaacgtgggttccaccaga

SEQ ID NO: 141134 - DNA, 20 bp, Artificial Sequence
  Description of Artificial Sequence: Synthetic oligonucleotide
  Target: ATXN1; (+) strand; PAM type: NRG; PAM sequence: AAG
acgtgggttccaccagatgg

SEQ ID NO: 141135 - DNA, 20 bp, Artificial Sequence
  Description of Artificial Sequence: Synthetic oligonucleotide
  Target: ATXN1; (+) strand; PAM type: NRG; PAM sequence: AAG
tgggttccaccagatggaag

SEQ ID NO: 141136 - DNA, 20 bp, Artificial Sequence
  Description of Artificial Sequence: Synthetic oligonucleotide
  Target: ATXN1; (+) strand; PAM type: NRG; PAM sequence: AAG
tccaccagatggaagaagca

SEQ ID NO: 141137 - DNA, 20 bp, Artificial Sequence
  Description of Artificial Sequence: Synthetic oligonucleotide
  Target: ATXN1; (+) strand; PAM type: NRG; PAM sequence: TAG
aagtgcttgccccaaatatc

SEQ ID NO: 141138 - DNA, 20 bp, Artificial Sequence
  Description of Artificial Sequence: Synthetic oligonucleotide
  Target: ATXN1; (+) strand; PAM type: NRG; PAM sequence: AGG
agtgcttgccccaaatatct

SEQ ID NO: 141139 - DNA, 20 bp, Artificial Sequence
  Description of Artificial Sequence: Synthetic oligonucleotide
  Target: ATXN1; (+) strand; PAM type: NRG; PAM sequence: GGG
gtgcttgccccaaatatcta

SEQ ID NO: 141140 - DNA, 20 bp, Artificial Sequence
  Description of Artificial Sequence: Synthetic oligonucleotide
  Target: ATXN1; (+) strand; PAM type: NRG; PAM sequence: TAG
caaatatctagggttcctgc

SEQ ID NO: 141141 - DNA, 20 bp, Artificial Sequence
  Description of Artificial Sequence: Synthetic oligonucleotide
  Target: ATXN1; (+) strand; PAM type: NRG; PAM sequence: AGG
aaatatctagggttcctgct

SEQ ID NO: 141142 - DNA, 20 bp, Artificial Sequence
  Description of Artificial Sequence: Synthetic oligonucleotide
  Target: ATXN1; (+) strand; PAM type: NRG; PAM sequence: AAG
cccaaactgcatctactgtg

SEQ ID NO: 141143 - DNA, 20 bp, Artificial Sequence
  Description of Artificial Sequence: Synthetic oligonucleotide
  Target: ATXN1; (+) strand; PAM type: NRG; PAM sequence: GAG
caaactgcatctactgtgaa

SEQ ID NO: 141144 - DNA, 20 bp, Artificial Sequence
  Description of Artificial Sequence: Synthetic oligonucleotide
  Target: ATXN1; (+) strand; PAM type: NRG; PAM sequence: TAG
ctgcatctactgtgaagagt

SEQ ID NO: 141145 - DNA, 20 bp, Artificial Sequence
  Description of Artificial Sequence: Synthetic oligonucleotide
  Target: ATXN1; (+) strand; PAM type: NRG; PAM sequence: CAG
ctttgcattctgacccaatg

SEQ ID NO: 141146 - DNA, 20 bp, Artificial Sequence
  Description of Artificial Sequence: Synthetic oligonucleotide
  Target: ATXN1; (+) strand; PAM type: NRG; PAM sequence: AGG
tttgcattctgacccaatgc

SEQ ID NO: 141147 - DNA, 20 bp, Artificial Sequence
  Description of Artificial Sequence: Synthetic oligonucleotide
  Target: ATXN1; (+) strand; PAM type: NRG; PAM sequence: TGG
tctgacccaatgcaggatgc

SEQ ID NO: 141148 - DNA, 20 bp, Artificial Sequence
  Description of Artificial Sequence: Synthetic oligonucleotide
  Target: ATXN1; (+) strand; PAM type: NRG; PAM sequence: GGG
ctgacccaatgcaggatgct

SEQ ID NO: 141149 - DNA, 20 bp, Artificial Sequence
  Description of Artificial Sequence: Synthetic oligonucleotide
  Target: ATXN1; (+) strand; PAM type: NRG; PAM sequence: AAG
gcaggatgctgggctcctac

SEQ ID NO: 141150 - DNA, 20 bp, Artificial Sequence
  Description of Artificial Sequence: Synthetic oligonucleotide
  Target: ATXN1; (+) strand; PAM type: NRG; PAM sequence: TGG
ggatgctgggctcctacaag

SEQ ID NO: 141151 - DNA, 20 bp, Artificial Sequence
  Description of Artificial Sequence: Synthetic oligonucleotide
  Target: ATXN1; (+) strand; PAM type: NRG; PAM sequence: TGG
cctacaagtggtttgtctga

SEQ ID NO: 141152 - DNA, 20 bp, Artificial Sequence
  Description of Artificial Sequence: Synthetic oligonucleotide
  Target: ATXN1; (+) strand; PAM type: NRG; PAM sequence: GGG
ctacaagtggtttgtctgat

SEQ ID NO: 141153 - DNA, 20 bp, Artificial Sequence
  Description of Artificial Sequence: Synthetic oligonucleotide
  Target: ATXN1; (+) strand; PAM type: NRG; PAM sequence: CAG
tggtttgtctgatgggctcc

SEQ ID NO: 141154 - DNA, 20 bp, Artificial Sequence
  Description of Artificial Sequence: Synthetic oligonucleotide
  Target: ATXN1; (+) strand; PAM type: NRG; PAM sequence: GAG
gtttgtctgatgggctccca

SEQ ID NO: 141155 - DNA, 20 bp, Artificial Sequence
  Description of Artificial Sequence: Synthetic oligonucleotide
  Target: ATXN1; (+) strand; PAM type: NRG; PAM sequence: TGG
gtctgatgggctcccagaga

SEQ ID NO: 141156 - DNA, 20 bp, Artificial Sequence
  Description of Artificial Sequence: Synthetic oligonucleotide
  Target: ATXN1; (+) strand; PAM type: NRG; PAM sequence: CAG
gatgggctcccagagatggc

SEQ ID NO: 141157 - DNA, 20 bp, Artificial Sequence
  Description of Artificial Sequence: Synthetic oligonucleotide
  Target: ATXN1; (+) strand; PAM type: NRG; PAM sequence: CAG
tcccagagatggccagctgc

SEQ ID NO: 141158 - DNA, 20 bp, Artificial Sequence
  Description of Artificial Sequence: Synthetic oligonucleotide
  Target: ATXN1; (+) strand; PAM type: NRG; PAM sequence: CAG
cagagatggccagctgccag

SEQ ID NO: 141159 - DNA, 20 bp, Artificial Sequence
  Description of Artificial Sequence: Synthetic oligonucleotide
  Target: ATXN1; (+) strand; PAM type: NRG; PAM sequence: TAG
cagctgccagcagcatcatt

SEQ ID NO: 141160 - DNA, 20 bp, Artificial Sequence
  Description of Artificial Sequence: Synthetic oligonucleotide
  Target: ATXN1; (+) strand; PAM type: NRG; PAM sequence: AAG
ctgccagcagcatcatttag

SEQ ID NO: 141161 - DNA, 20 bp, Artificial Sequence
  Description of Artificial Sequence: Synthetic oligonucleotide
  Target: ATXN1; (+) strand; PAM type: NRG; PAM sequence: TGG
agcatcatttagaagaattc

SEQ ID NO: 141162 - DNA, 20 bp, Artificial Sequence
  Description of Artificial Sequence: Synthetic oligonucleotide
  Target: ATXN1; (+) strand; PAM type: NRG; PAM sequence: GAG
tttagaagaattctggtcct

SEQ ID NO: 141163 - DNA, 20 bp, Artificial Sequence
  Description of Artificial Sequence: Synthetic oligonucleotide
  Target: ATXN1; (+) strand; PAM type: NRG; PAM sequence: AGG
ttagaagaattctggtcctg

SEQ ID NO: 141164 - DNA, 20 bp, Artificial Sequence
  Description of Artificial Sequence: Synthetic oligonucleotide
  Target: ATXN1; (+) strand; PAM type: NRG; PAM sequence: CAG
aagaattctggtcctgagga

SEQ ID NO: 141165 - DNA, 20 bp, Artificial Sequence
  Description of Artificial Sequence: Synthetic oligonucleotide
  Target: ATXN1; (+) strand; PAM type: NRG; PAM sequence: AAG
atttccatttaacctctgca

SEQ ID NO: 141166 - DNA, 20 bp, Artificial Sequence
  Description of Artificial Sequence: Synthetic oligonucleotide
  Target: ATXN1; (+) strand; PAM type: NRG; PAM sequence: TAG
tccatttaacctctgcaaag

SEQ ID NO: 141167 - DNA, 20 bp, Artificial Sequence
  Description of Artificial Sequence: Synthetic oligonucleotide
  Target: ATXN1; (+) strand; PAM type: NRG; PAM sequence: TGG
ttaacctctgcaaagtagac

SEQ ID NO: 141168 - DNA, 20 bp, Artificial Sequence
  Description of Artificial Sequence: Synthetic oligonucleotide
  Target: ATXN1; (+) strand; PAM type: NRG; PAM sequence: GGG
taacctctgcaaagtagact

SEQ ID NO: 141169 - DNA, 20 bp, Artificial Sequence
  Description of Artificial Sequence: Synthetic oligonucleotide
  Target: ATXN1; (+) strand; PAM type: NRG; PAM sequence: TGG
caaagtagactgggtccttg

SEQ ID NO: 141170 - DNA, 20 bp, Artificial Sequence
  Description of Artificial Sequence: Synthetic oligonucleotide
  Target: ATXN1; (+) strand; PAM type: NRG; PAM sequence: GGG
aaagtagactgggtccttgt

SEQ ID NO: 141171 - DNA, 20 bp, Artificial Sequence
  Description of Artificial Sequence: Synthetic oligonucleotide
  Target: ATXN1; (+) strand; PAM type: NRG; PAM sequence: GGG
aagtagactgggtccttgtg

SEQ ID NO: 141172 - DNA, 20 bp, Artificial Sequence
  Description of Artificial Sequence: Synthetic oligonucleotide
  Target: ATXN1; (+) strand; PAM type: NRG; PAM sequence: AAG
tggggctttcgtttccttaa

SEQ ID NO: 141173 - DNA, 20 bp, Artificial Sequence
  Description of Artificial Sequence: Synthetic oligonucleotide
  Target: ATXN1; (+) strand; PAM type: NRG; PAM sequence: TAG
aaagcaactgtgtacttgct

SEQ ID NO: 141174 - DNA, 20 bp, Artificial Sequence
  Description of Artificial Sequence: Synthetic oligonucleotide
  Target: ATXN1; (+) strand; PAM type: NRG; PAM sequence: TGG
tgtgtacttgcttagcaacg

SEQ ID NO: 141175 - DNA, 20 bp, Artificial Sequence
  Description of Artificial Sequence: Synthetic oligonucleotide
  Target: ATXN1; (+) strand; PAM type: NRG; PAM sequence: CAG
ttagcaacgtggacttaaac

SEQ ID NO: 141176 - DNA, 20 bp, Artificial Sequence
  Description of Artificial Sequence: Synthetic oligonucleotide
  Target: ATXN1; (+) strand; PAM type: NRG; PAM sequence: TGG
gcaacgtggacttaaaccag

SEQ ID NO: 141177 - DNA, 20 bp, Artificial Sequence
  Description of Artificial Sequence: Synthetic oligonucleotide
  Target: ATXN1; (+) strand; PAM type: NRG; PAM sequence: AAG
acgtggacttaaaccagtgg

SEQ ID NO: 141178 - DNA, 20 bp, Artificial Sequence
  Description of Artificial Sequence: Synthetic oligonucleotide
  Target: ATXN1; (+) strand; PAM type: NRG; PAM sequence: TAG
aaaccagtggaagaaatact

SEQ ID NO: 141179 - DNA, 20 bp, Artificial Sequence
  Description of Artificial Sequence: Synthetic oligonucleotide
  Target: ATXN1; (+) strand; PAM type: NRG; PAM sequence: TGG
ccagtggaagaaatacttag

SEQ ID NO: 141180 - DNA, 20 bp, Artificial Sequence
  Description of Artificial Sequence: Synthetic oligonucleotide
  Target: ATXN1; (+) strand; PAM type: NRG; PAM sequence: GAG
agtggaagaaatacttagtg

SEQ ID NO: 141181 - DNA, 20 bp, Artificial Sequence
  Description of Artificial Sequence: Synthetic oligonucleotide
  Target: ATXN1; (+) strand; PAM type: NRG; PAM sequence: TGG
aagaaatacttagtggagac

SEQ ID NO: 141182 - DNA, 20 bp, Artificial Sequence
  Description of Artificial Sequence: Synthetic oligonucleotide
  Target: ATXN1; (+) strand; PAM type: NRG; PAM sequence: CAG
acttagtggagactggaaaa

SEQ ID NO: 141183 - DNA, 20 bp, Artificial Sequence
  Description of Artificial Sequence: Synthetic oligonucleotide
  Target: ATXN1; (+) strand; PAM type: NRG; PAM sequence: AAG
agactggaaaacagcaataa

SEQ ID NO: 141184 - DNA, 20 bp, Artificial Sequence
  Description of Artificial Sequence: Synthetic oligonucleotide
  Target: ATXN1; (+) strand; PAM type: NRG; PAM sequence: GAG
actggaaaacagcaataaaa

SEQ ID NO: 141185 - DNA, 20 bp, Artificial Sequence
  Description of Artificial Sequence: Synthetic oligonucleotide
  Target: ATXN1; (+) strand; PAM type: NRG; PAM sequence: GAG
tggaaaacagcaataaaaga

SEQ ID NO: 141186 - DNA, 20 bp, Artificial Sequence
  Description of Artificial Sequence: Synthetic oligonucleotide
  Target: ATXN1; (+) strand; PAM type: NRG; PAM sequence: AGG
ggaaaacagcaataaaagag

SEQ ID NO: 141187 - DNA, 20 bp, Artificial Sequence
  Description of Artificial Sequence: Synthetic oligonucleotide
  Target: ATXN1; (+) strand; PAM type: NRG; PAM sequence: TAG
gcaataaaagagaggttcaa

SEQ ID NO: 141188 - DNA, 20 bp, Artificial Sequence
  Description of Artificial Sequence: Synthetic oligonucleotide
  Target: ATXN1; (+) strand; PAM type: NRG; PAM sequence: GAG
aataaaagagaggttcaata

SEQ ID NO: 141189 - DNA, 20 bp, Artificial Sequence
  Description of Artificial Sequence: Synthetic oligonucleotide
  Target: ATXN1; (+) strand; PAM type: NRG; PAM sequence: AGG
ataaaagagaggttcaatag

SEQ ID NO: 141190 - DNA, 20 bp, Artificial Sequence
  Description of Artificial Sequence: Synthetic oligonucleotide
  Target: ATXN1; (+) strand; PAM type: NRG; PAM sequence: GGG
taaaagagaggttcaataga

SEQ ID NO: 141191 - DNA, 20 bp, Artificial Sequence
  Description of Artificial Sequence: Synthetic oligonucleotide
  Target: ATXN1; (+) strand; PAM type: NRG; PAM sequence: GAG
aaagagaggttcaatagagg

SEQ ID NO: 141192 - DNA, 20 bp, Artificial Sequence
  Description of Artificial Sequence: Synthetic oligonucleotide
  Target: ATXN1; (+) strand; PAM type: NRG; PAM sequence: AGG
aagagaggttcaatagaggg

SEQ ID NO: 141193 - DNA, 20 bp, Artificial Sequence
  Description of Artificial Sequence: Synthetic oligonucleotide
  Target: ATXN1; (+) strand; PAM type: NRG; PAM sequence: GGG
agagaggttcaatagaggga

SEQ ID NO: 141194 - DNA, 20 bp, Artificial Sequence
  Description of Artificial Sequence: Synthetic oligonucleotide
  Target: ATXN1; (+) strand; PAM type: NRG; PAM sequence: GGG
gagaggttcaatagagggag

SEQ ID NO: 141195 - DNA, 20 bp, Artificial Sequence
  Description of Artificial Sequence: Synthetic oligonucleotide
  Target: ATXN1; (+) strand; PAM type: NRG; PAM sequence: TGG
aggttcaatagagggagggg

SEQ ID NO: 141196 - DNA, 20 bp, Artificial Sequence
  Description of Artificial Sequence: Synthetic oligonucleotide
  Target: ATXN1; (+) strand; PAM type: NRG; PAM sequence: TGG
ttcaatagagggaggggtgg

SEQ ID NO: 141197 - DNA, 20 bp, Artificial Sequence
  Description of Artificial Sequence: Synthetic oligonucleotide
  Target: ATXN1; (+) strand; PAM type: NRG; PAM sequence: CAG
ggaggggtggtggccgacta

SEQ ID NO: 141198 - DNA, 20 bp, Artificial Sequence
  Description of Artificial Sequence: Synthetic oligonucleotide
  Target: ATXN1; (+) strand; PAM type: NRG; PAM sequence: AAG
gtggtggccgactacagacc

SEQ ID NO: 141199 - DNA, 20 bp, Artificial Sequence
  Description of Artificial Sequence: Synthetic oligonucleotide
  Target: ATXN1; (+) strand; PAM type: NRG; PAM sequence: AGG
tggtggccgactacagacca

SEQ ID NO: 141200 - DNA, 20 bp, Artificial Sequence
  Description of Artificial Sequence: Synthetic oligonucleotide
  Target: ATXN1; (+) strand; PAM type: NRG; PAM sequence: GGG
ggtggccgactacagaccaa

SEQ ID NO: 141201 - DNA, 20 bp, Artificial Sequence
  Description of Artificial Sequence: Synthetic oligonucleotide
  Target: ATXN1; (+) strand; PAM type: NRG; PAM sequence: GAG
gccgactacagaccaagggt

SEQ ID NO: 141202 - DNA, 20 bp, Artificial Sequence
  Description of Artificial Sequence: Synthetic oligonucleotide
  Target: ATXN1; (+) strand; PAM type: NRG; PAM sequence: AGG
ccgactacagaccaagggtg

SEQ ID NO: 141203 - DNA, 20 bp, Artificial Sequence
  Description of Artificial Sequence: Synthetic oligonucleotide
  Target: ATXN1; (+) strand; PAM type: NRG; PAM sequence: GGG
cgactacagaccaagggtga

SEQ ID NO: 141204 - DNA, 20 bp, Artificial Sequence
  Description of Artificial Sequence: Synthetic oligonucleotide
  Target: ATXN1; (+) strand; PAM type: NRG; PAM sequence: GAG
actacagaccaagggtgagg

SEQ ID NO: 141205 - DNA, 20 bp, Artificial Sequence
  Description of Artificial Sequence: Synthetic oligonucleotide
  Target: ATXN1; (+) strand; PAM type: NRG; PAM sequence: CAG
gaccaagggtgagggagcca

SEQ ID NO: 141206 - DNA, 20 bp, Artificial Sequence
  Description of Artificial Sequence: Synthetic oligonucleotide
  Target: ATXN1; (+) strand; PAM type: NRG; PAM sequence: CAG
gggagccacagattgaatcc

SEQ ID NO: 141207 - DNA, 20 bp, Artificial Sequence
  Description of Artificial Sequence: Synthetic oligonucleotide
  Target: ATXN1; (+) strand; PAM type: NRG; PAM sequence: AAG
atcccagctttaccatctcc

SEQ ID NO: 141208 - DNA, 20 bp, Artificial Sequence
  Description of Artificial Sequence: Synthetic oligonucleotide
  Target: ATXN1; (+) strand; PAM type: NRG; PAM sequence: CAG
ccagctttaccatctccaag

SEQ ID NO: 141209 - DNA, 20 bp, Artificial Sequence
  Description of Artificial Sequence: Synthetic oligonucleotide
  Target: ATXN1; (+) strand; PAM type: NRG; PAM sequence: CAG
ccaagcagcattactttctt

SEQ ID NO: 141210 - DNA, 20 bp, Artificial Sequence
  Description of Artificial Sequence: Synthetic oligonucleotide
  Target: ATXN1; (+) strand; PAM type: NRG; PAM sequence: CAG
agcattactttcttcagtcc

SEQ ID NO: 141211 - DNA, 20 bp, Artificial Sequence
  Description of Artificial Sequence: Synthetic oligonucleotide
  Target: ATXN1; (+) strand; PAM type: NRG; PAM sequence: AAG
aaattacactctctaccttt

SEQ ID NO: 141212 - DNA, 20 bp, Artificial Sequence
  Description of Artificial Sequence: Synthetic oligonucleotide
  Target: ATXN1; (+) strand; PAM type: NRG; PAM sequence: TGG
tctacctttaagatttccta

SEQ ID NO: 141213 - DNA, 20 bp, Artificial Sequence
  Description of Artificial Sequence: Synthetic oligonucleotide
  Target: ATXN1; (+) strand; PAM type: NRG; PAM sequence: GGG
ctacctttaagatttcctat

SEQ ID NO: 141214 - DNA, 20 bp, Artificial Sequence
  Description of Artificial Sequence: Synthetic oligonucleotide
  Target: ATXN1; (+) strand; PAM type: NRG; PAM sequence: GGG
tacctttaagatttcctatg

SEQ ID NO: 141215 - DNA, 20 bp, Artificial Sequence
  Description of Artificial Sequence: Synthetic oligonucleotide
  Target: ATXN1; (+) strand; PAM type: NRG; PAM sequence: GAG
atttcctatggggatcaaat

SEQ ID NO: 141216 - DNA, 20 bp, Artificial Sequence
  Description of Artificial Sequence: Synthetic oligonucleotide
  Target: ATXN1; (+) strand; PAM type: NRG; PAM sequence: CAG
caaatgagatgaaacatgca

SEQ ID NO: 141217 - DNA, 20 bp, Artificial Sequence
  Description of Artificial Sequence: Synthetic oligonucleotide
  Target: ATXN1; (+) strand; PAM type: NRG; PAM sequence: AGG
aaatgagatgaaacatgcac

SEQ ID NO: 141218 - DNA, 20 bp, Artificial Sequence
  Description of Artificial Sequence: Synthetic oligonucleotide
  Target: ATXN1; (+) strand; PAM type: NRG; PAM sequence: AAG
atgaaacatgcacaggcaaa

SEQ ID NO: 141219 - DNA, 20 bp, Artificial Sequence
  Description of Artificial Sequence: Synthetic oligonucleotide
  Target: ATXN1; (+) strand; PAM type: NRG; PAM sequence: AGG
tgaaacatgcacaggcaaaa

SEQ ID NO: 141220 - DNA, 20 bp, Artificial Sequence
  Description of Artificial Sequence: Synthetic oligonucleotide
  Target: ATXN1; (+) strand; PAM type: NRG; PAM sequence: GAG
aaacatgcacaggcaaaaag

SEQ ID NO: 141221 - DNA, 20 bp, Artificial Sequence
  Description of Artificial Sequence: Synthetic oligonucleotide
  Target: ATXN1; (+) strand; PAM type: NRG; PAM sequence: CAG
acaggcaaaaaggagttgct

SEQ ID NO: 141222 - DNA, 20 bp, Artificial Sequence
  Description of Artificial Sequence: Synthetic oligonucleotide
  Target: ATXN1; (+) strand; PAM type: NRG; PAM sequence: CAG
gagttgctcagtaacttaac

SEQ ID NO: 141223 - DNA, 20 bp, Artificial Sequence
  Description of Artificial Sequence: Synthetic oligonucleotide
  Target: ATXN1; (+) strand; PAM type: NRG; PAM sequence: AAG
cagtttatttcttctttaaa

SEQ ID NO: 141224 - DNA, 20 bp, Artificial Sequence
  Description of Artificial Sequence: Synthetic oligonucleotide
  Target: ATXN1; (+) strand; PAM type: NRG; PAM sequence: AGG
agtttatttcttctttaaaa

SEQ ID NO: 141225 - DNA, 20 bp, Artificial Sequence
  Description of Artificial Sequence: Synthetic oligonucleotide
  Target: ATXN1; (+) strand; PAM type: NRG; PAM sequence: CAG
aattgtacaaaacatgtttc

SEQ ID NO: 141226 - DNA, 20 bp, Artificial Sequence
  Description of Artificial Sequence: Synthetic oligonucleotide
  Target: ATXN1; (+) strand; PAM type: NRG; PAM sequence: GAG
ttgtacaaaacatgtttcca

SEQ ID NO: 141227 - DNA, 20 bp, Artificial Sequence
  Description of Artificial Sequence: Synthetic oligonucleotide
  Target: ATXN1; (+) strand; PAM type: NRG; PAM sequence: AAG
catgtttccagagttttgtt

SEQ ID NO: 141228 - DNA, 20 bp, Artificial Sequence
  Description of Artificial Sequence: Synthetic oligonucleotide
  Target: ATXN1; (+) strand; PAM type: NRG; PAM sequence: AGG
atgtttccagagttttgtta

SEQ ID NO: 141229 - DNA, 20 bp, Artificial Sequence
  Description of Artificial Sequence: Synthetic oligonucleotide
  Target: ATXN1; (+) strand; PAM type: NRG; PAM sequence: AAG
tttccagagttttgttaagg

SEQ ID NO: 141230 - DNA, 20 bp, Artificial Sequence
  Description of Artificial Sequence: Synthetic oligonucleotide
  Target: ATXN1; (+) strand; PAM type: NRG; PAM sequence: CAG
tgttaaggaagctttgaaaa

SEQ ID NO: 141231 - DNA, 20 bp, Artificial Sequence
  Description of Artificial Sequence: Synthetic oligonucleotide
  Target: ATXN1; (+) strand; PAM type: NRG; PAM sequence: CAG
gctttgaaaacagactccac

SEQ ID NO: 141232 - DNA, 20 bp, Artificial Sequence
  Description of Artificial Sequence: Synthetic oligonucleotide
  Target: ATXN1; (+) strand; PAM type: NRG; PAM sequence: TGG
acagactccaccagtattta

SEQ ID NO: 141233 - DNA, 20 bp, Artificial Sequence
  Description of Artificial Sequence: Synthetic oligonucleotide
  Target: ATXN1; (+) strand; PAM type: NRG; PAM sequence: GAG
agactccaccagtatttatg

SEQ ID NO: 141234 - DNA, 20 bp, Artificial Sequence
  Description of Artificial Sequence: Synthetic oligonucleotide
  Target: ATXN1; (+) strand; PAM type: NRG; PAM sequence: CAG
tggagtattcaccatactga

SEQ ID NO: 141235 - DNA, 20 bp, Artificial Sequence
  Description of Artificial Sequence: Synthetic oligonucleotide
  Target: ATXN1; (+) strand; PAM type: NRG; PAM sequence: TGG
acagtctaataccactcctc

SEQ ID NO: 141236 - DNA, 20 bp, Artificial Sequence
  Description of Artificial Sequence: Synthetic oligonucleotide
  Target: ATXN1; (+) strand; PAM type: NRG; PAM sequence: GGG
cagtctaataccactcctct

SEQ ID NO: 141237 - DNA, 20 bp, Artificial Sequence
  Description of Artificial Sequence: Synthetic oligonucleotide
  Target: ATXN1; (+) strand; PAM type: NRG; PAM sequence: GGG
agtctaataccactcctctg

SEQ ID NO: 141238 - DNA, 20 bp, Artificial Sequence
  Description of Artificial Sequence: Synthetic oligonucleotide
  Target: ATXN1; (+) strand; PAM type: NRG; PAM sequence: GAG
tctaataccactcctctggg

SEQ ID NO: 141239 - DNA, 20 bp, Artificial Sequence
  Description of Artificial Sequence: Synthetic oligonucleotide
  Target: ATXN1; (+) strand; PAM type: NRG; PAM sequence: CAG
taccactcctctggggagcc

SEQ ID NO: 141240 - DNA, 20 bp, Artificial Sequence
  Description of Artificial Sequence: Synthetic oligonucleotide
  Target: ATXN1; (+) strand; PAM type: NRG; PAM sequence: AGG
accactcctctggggagccc

SEQ ID NO: 141241 - DNA, 20 bp, Artificial Sequence
  Description of Artificial Sequence: Synthetic oligonucleotide
  Target: ATXN1; (+) strand; PAM type: NRG; PAM sequence: TGG
ctcctctggggagcccagga

SEQ ID NO: 141242 - DNA, 20 bp, Artificial Sequence
  Description of Artificial Sequence: Synthetic oligonucleotide
  Target: ATXN1; (+) strand; PAM type: NRG; PAM sequence: AAG
tggggagcccaggatggtgc

SEQ ID NO: 141243 - DNA, 20 bp, Artificial Sequence
  Description of Artificial Sequence: Synthetic oligonucleotide
  Target: ATXN1; (+) strand; PAM type: NRG; PAM sequence: AAG
atggtgcaagatgtatctcc

SEQ ID NO: 141244 - DNA, 20 bp, Artificial Sequence
  Description of Artificial Sequence: Synthetic oligonucleotide
  Target: ATXN1; (+) strand; PAM type: NRG; PAM sequence: AGG
tggtgcaagatgtatctcca

SEQ ID NO: 141245 - DNA, 20 bp, Artificial Sequence
  Description of Artificial Sequence: Synthetic oligonucleotide
  Target: ATXN1; (+) strand; PAM type: NRG; PAM sequence: TGG
tgtatctccaaggctatgtg

SEQ ID NO: 141246 - DNA, 20 bp, Artificial Sequence
  Description of Artificial Sequence: Synthetic oligonucleotide
  Target: ATXN1; (+) strand; PAM type: NRG; PAM sequence: TGG
atctccaaggctatgtgtgg

SEQ ID NO: 141247 - DNA, 20 bp, Artificial Sequence
  Description of Artificial Sequence: Synthetic oligonucleotide
  Target: ATXN1; (+) strand; PAM type: NRG; PAM sequence: CAG
gtggcacatgcccataatcc

SEQ ID NO: 141248 - DNA, 20 bp, Artificial Sequence
  Description of Artificial Sequence: Synthetic oligonucleotide
  Target: ATXN1; (+) strand; PAM type: NRG; PAM sequence: GAG
gcccataatcccagcactct

SEQ ID NO: 141249 - DNA, 20 bp, Artificial Sequence
  Description of Artificial Sequence: Synthetic oligonucleotide
  Target: ATXN1; (+) strand; PAM type: NRG; PAM sequence: GAG
ccataatcccagcactctga

SEQ ID NO: 141250 - DNA, 20 bp, Artificial Sequence
  Description of Artificial Sequence: Synthetic oligonucleotide
  Target: ATXN1; (+) strand; PAM type: NRG; PAM sequence: AGG
cataatcccagcactctgag

SEQ ID NO: 141251 - DNA, 20 bp, Artificial Sequence
  Description of Artificial Sequence: Synthetic oligonucleotide
  Target: ATXN1; (+) strand; PAM type: NRG; PAM sequence: AAG
cccagcactctgagaggcca

SEQ ID NO: 141252 - DNA, 20 bp, Artificial Sequence
  Description of Artificial Sequence: Synthetic oligonucleotide
  Target: ATXN1; (+) strand; PAM type: NRG; PAM sequence: CAG
agcactctgagaggccaaag

SEQ ID NO: 141253 - DNA, 20 bp, Artificial Sequence
  Description of Artificial Sequence: Synthetic oligonucleotide
  Target: ATXN1; (+) strand; PAM type: NRG; PAM sequence: AGG
gcactctgagaggccaaagc

SEQ ID NO: 141254 - DNA, 20 bp, Artificial Sequence
  Description of Artificial Sequence: Synthetic oligonucleotide
  Target: ATXN1; (+) strand; PAM type: NRG; PAM sequence: GAG
actctgagaggccaaagcag

SEQ ID NO: 141255 - DNA, 20 bp, Artificial Sequence
  Description of Artificial Sequence: Synthetic oligonucleotide
  Target: ATXN1; (+) strand; PAM type: NRG; PAM sequence: TGG
ggccaaagcaggagaattgc

SEQ ID NO: 141256 - DNA, 20 bp, Artificial Sequence
  Description of Artificial Sequence: Synthetic oligonucleotide
  Target: ATXN1; (+) strand; PAM type: NRG; PAM sequence: CAG
gcaggagaattgctggaaca

SEQ ID NO: 141257 - DNA, 20 bp, Artificial Sequence
  Description of Artificial Sequence: Synthetic oligonucleotide
  Target: ATXN1; (+) strand; PAM type: NRG; PAM sequence: AGG
caggagaattgctggaacac

SEQ ID NO: 141258 - DNA, 20 bp, Artificial Sequence
  Description of Artificial Sequence: Synthetic oligonucleotide
  Target: ATXN1; (+) strand; PAM type: NRG; PAM sequence: GGG
aggagaattgctggaacaca

SEQ ID NO: 141259 - DNA, 20 bp, Artificial Sequence
  Description of Artificial Sequence: Synthetic oligonucleotide
  Target: ATXN1; (+) strand; PAM type: NRG; PAM sequence: CAG
attgctggaacacagggctc

SEQ ID NO: 141260 - DNA, 20 bp, Artificial Sequence
  Description of Artificial Sequence: Synthetic oligonucleotide
  Target: ATXN1; (+) strand; PAM type: NRG; PAM sequence: CAG
tggaacacagggctccagaa

SEQ ID NO: 141261 - DNA, 20 bp, Artificial Sequence
  Description of Artificial Sequence: Synthetic oligonucleotide
  Target: ATXN1; (+) strand; PAM type: NRG; PAM sequence: TGG
cacagggctccagaacagcc

SEQ ID NO: 141262 - DNA, 20 bp, Artificial Sequence
  Description of Artificial Sequence: Synthetic oligonucleotide
  Target: ATXN1; (+) strand; PAM type: NRG; PAM sequence: GGG
acagggctccagaacagcct

SEQ ID NO: 141263 - DNA, 20 bp, Artificial Sequence
  Description of Artificial Sequence: Synthetic oligonucleotide
  Target: ATXN1; (+) strand; PAM type: NRG; PAM sequence: TAG
ccagaacagcctgggtaaca

SEQ ID NO: 141264 - DNA, 20 bp, Artificial Sequence
  Description of Artificial Sequence: Synthetic oligonucleotide
  Target: ATXN1; (+) strand; PAM type: NRG; PAM sequence: AAG
aacagcctgggtaacatagc

SEQ ID NO: 141265 - DNA, 20 bp, Artificial Sequence
  Description of Artificial Sequence: Synthetic oligonucleotide
  Target: ATXN1; (+) strand; PAM type: NRG; PAM sequence: GAG
acaaaaaaaaaattaaaaat

SEQ ID NO: 141266 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaattaaaaatgagc

SEQ ID NO: 141267 - DNA, 20 bp, Artificial Sequence
  Description of Artificial Sequence: Synthetic oligonucleotide
  Target: ATXN1; (+) strand; PAM type: NRG; PAM sequence: AGG
aaaaaaattaaaaatgagcc

SEQ ID NO: 141268 - DNA, 20 bp, Artificial Sequence
  Description of Artificial Sequence: Synthetic oligonucleotide
  Target: ATXN1; (+) strand; PAM type: NRG; PAM sequence: TGG
aattaaaaatgagccaggtg

SEQ ID NO: 141269 - DNA, 20 bp, Artificial Sequence
  Description of Artificial Sequence: Synthetic oligonucleotide
  Target: ATXN1; (+) strand; PAM type: NRG; PAM sequence: TGG
taaaaatgagccaggtgtgg

SEQ ID NO: 141270 - DNA, 20 bp, Artificial Sequence
  Description of Artificial Sequence: Synthetic oligonucleotide
  Target: ATXN1; (+) strand; PAM type: NRG; PAM sequence: CAG
gtggcacatgcctctaattc

SEQ ID NO: 141271 - DNA, 20 bp, Artificial Sequence
  Description of Artificial Sequence: Synthetic oligonucleotide
  Target: ATXN1; (+) strand; PAM type: NRG; PAM sequence: GAG
ggcacatgcctctaattcca

SEQ ID NO: 141272 - DNA, 20 bp, Artificial Sequence
  Description of Artificial Sequence: Synthetic oligonucleotide
  Target: ATXN1; (+) strand; PAM type: NRG; PAM sequence: TGG
tgcctctaattccagagctc

SEQ ID NO: 141273 - DNA, 20 bp, Artificial Sequence
  Description of Artificial Sequence: Synthetic oligonucleotide
  Target: ATXN1; (+) strand; PAM type: NRG; PAM sequence: GGG
gcctctaattccagagctct

SEQ ID NO: 141274 - DNA, 20 bp, Artificial Sequence
  Description of Artificial Sequence: Synthetic oligonucleotide
  Target: ATXN1; (+) strand; PAM type: NRG; PAM sequence: AAG
tctaattccagagctctggg

SEQ ID NO: 141275 - DNA, 20 bp, Artificial Sequence
  Description of Artificial Sequence: Synthetic oligonucleotide
  Target: ATXN1; (+) strand; PAM type: NRG; PAM sequence: TGG
attccagagctctgggaagt

SEQ ID NO: 141276 - DNA, 20 bp, Artificial Sequence
  Description of Artificial Sequence: Synthetic oligonucleotide
  Target: ATXN1; (+) strand; PAM type: NRG; PAM sequence: GGG
ttccagagctctgggaagtt

SEQ ID NO: 141277 - DNA, 20 bp, Artificial Sequence
  Description of Artificial Sequence: Synthetic oligonucleotide
  Target: ATXN1; (+) strand; PAM type: NRG; PAM sequence: GGG
tccagagctctgggaagttg

SEQ ID NO: 141278 - DNA, 20 bp, Artificial Sequence
  Description of Artificial Sequence: Synthetic oligonucleotide
  Target: ATXN1; (+) strand; PAM type: NRG; PAM sequence: TGG
agagctctgggaagttgggg

SEQ ID NO: 141279 - DNA, 20 bp, Artificial Sequence
  Description of Artificial Sequence: Synthetic oligonucleotide
  Target: ATXN1; (+) strand; PAM type: NRG; PAM sequence: GGG
gagctctgggaagttggggt

SEQ ID NO: 141280 - DNA, 20 bp, Artificial Sequence
  Description of Artificial Sequence: Synthetic oligonucleotide
  Target: ATXN1; (+) strand; PAM type: NRG; PAM sequence: GAG
gctctgggaagttggggtgg

SEQ ID NO: 141281 - DNA, 20 bp, Artificial Sequence
  Description of Artificial Sequence: Synthetic oligonucleotide
  Target: ATXN1; (+) strand; PAM type: NRG; PAM sequence: AGG
ctctgggaagttggggtggg

SEQ ID NO: 141282 - DNA, 20 bp, Artificial Sequence
  Description of Artificial Sequence: Synthetic oligonucleotide
  Target: ATXN1; (+) strand; PAM type: NRG; PAM sequence: TGG
gttggggtgggaggatcacc

SEQ ID NO: 141283 - DNA, 20 bp, Artificial Sequence
  Description of Artificial Sequence: Synthetic oligonucleotide
  Target: ATXN1; (+) strand; PAM type: NRG; PAM sequence: GGG
ttggggtgggaggatcacct

SEQ ID NO: 141284 - DNA, 20 bp, Artificial Sequence
  Description of Artificial Sequence: Synthetic oligonucleotide
  Target: ATXN1; (+) strand; PAM type: NRG; PAM sequence: CAG
gtgggaggatcacctgggct

SEQ ID NO: 141285 - DNA, 20 bp, Artificial Sequence
  Description of Artificial Sequence: Synthetic oligonucleotide
  Target: ATXN1; (+) strand; PAM type: NRG; PAM sequence: AGG
tgggaggatcacctgggctc

SEQ ID NO: 141286 - DNA, 20 bp, Artificial Sequence
  Description of Artificial Sequence: Synthetic oligonucleotide
  Target: ATXN1; (+) strand; PAM type: NRG; PAM sequence: GAG
ggaggatcacctgggctcag

SEQ ID NO: 141287 - DNA, 20 bp, Artificial Sequence
  Description of Artificial Sequence: Synthetic oligonucleotide
  Target: ATXN1; (+) strand; PAM type: NRG; PAM sequence: AGG
gaggatcacctgggctcagg

SEQ ID NO: 141288 - DNA, 20 bp, Artificial Sequence
  Description of Artificial Sequence: Synthetic oligonucleotide
  Target: ATXN1; (+) strand; PAM type: NRG; PAM sequence: AAG
tcacctgggctcaggaggtc

SEQ ID NO: 141289 - DNA, 20 bp, Artificial Sequence
  Description of Artificial Sequence: Synthetic oligonucleotide
  Target: ATXN1; (+) strand; PAM type: NRG; PAM sequence: AGG
cacctgggctcaggaggtca

SEQ ID NO: 141290 - DNA, 20 bp, Artificial Sequence
  Description of Artificial Sequence: Synthetic oligonucleotide
  Target: ATXN1; (+) strand; PAM type: NRG; PAM sequence: CAG
ggctcaggaggtcaaggatg

SEQ ID NO: 141291 - DNA, 20 bp, Artificial Sequence
  Description of Artificial Sequence: Synthetic oligonucleotide
  Target: ATXN1; (+) strand; PAM type: NRG; PAM sequence: GAG
caggaggtcaaggatgcagt

SEQ ID NO: 141292 - DNA, 20 bp, Artificial Sequence
  Description of Artificial Sequence: Synthetic oligonucleotide
  Target: ATXN1; (+) strand; PAM type: NRG; PAM sequence: CAG
tatgatgataccactgtact

SEQ ID NO: 141293 - DNA, 20 bp, Artificial Sequence
  Description of Artificial Sequence: Synthetic oligonucleotide
  Target: ATXN1; (+) strand; PAM type: NRG; PAM sequence: TGG
tgataccactgtactcagcc

SEQ ID NO: 141294 - DNA, 20 bp, Artificial Sequence
  Description of Artificial Sequence: Synthetic oligonucleotide
  Target: ATXN1; (+) strand; PAM type: NRG; PAM sequence: GGG
gataccactgtactcagcct

SEQ ID NO: 141295 - DNA, 20 bp, Artificial Sequence
  Description of Artificial Sequence: Synthetic oligonucleotide
  Target: ATXN1; (+) strand; PAM type: NRG; PAM sequence: CAG
actgtactcagcctgggtga

SEQ ID NO: 141296 - DNA, 20 bp, Artificial Sequence
  Description of Artificial Sequence: Synthetic oligonucleotide
  Target: ATXN1; (+) strand; PAM type: NRG; PAM sequence: GAG
tgtactcagcctgggtgaca

SEQ ID NO: 141297 - DNA, 20 bp, Artificial Sequence
  Description of Artificial Sequence: Synthetic oligonucleotide
  Target: ATXN1; (+) strand; PAM type: NRG; PAM sequence: AAG
ctcagcctgggtgacagagc

SEQ ID NO: 141298 - DNA, 20 bp, Artificial Sequence
  Description of Artificial Sequence: Synthetic oligonucleotide
  Target: ATXN1; (+) strand; PAM type: NRG; PAM sequence: AAG
ctgtctcttaaacaaaacaa

SEQ ID NO: 141299 - DNA, 20 bp, Artificial Sequence
  Description of Artificial Sequence: Synthetic oligonucleotide
  Target: ATXN1; (+) strand; PAM type: NRG; PAM sequence: CAG
aaaagacgtgtctaccactc

SEQ ID NO: 141300 - DNA, 20 bp, Artificial Sequence
  Description of Artificial Sequence: Synthetic oligonucleotide
  Target: ATXN1; (+) strand; PAM type: NRG; PAM sequence: AGG
aaagacgtgtctaccactcc

SEQ ID NO: 141301 - DNA, 20 bp, Artificial Sequence
  Description of Artificial Sequence: Synthetic oligonucleotide
  Target: ATXN1; (+) strand; PAM type: NRG; PAM sequence: GGG
aagacgtgtctaccactcca

SEQ ID NO: 141302 - DNA, 20 bp, Artificial Sequence
  Description of Artificial Sequence: Synthetic oligonucleotide
  Target: ATXN1; (+) strand; PAM type: NRG; PAM sequence: AAG
acgtgtctaccactccaggg

SEQ ID NO: 141303 - DNA, 20 bp, Artificial Sequence
  Description of Artificial Sequence: Synthetic oligonucleotide
  Target: ATXN1; (+) strand; PAM type: NRG; PAM sequence: AAG
accactccagggaagtgaaa

SEQ ID NO: 141304 - DNA, 20 bp, Artificial Sequence
  Description of Artificial Sequence: Synthetic oligonucleotide
  Target: ATXN1; (+) strand; PAM type: NRG; PAM sequence: CAG
actccagggaagtgaaaaag

SEQ ID NO: 141305 - DNA, 20 bp, Artificial Sequence
  Description of Artificial Sequence: Synthetic oligonucleotide
  Target: ATXN1; (+) strand; PAM type: NRG; PAM sequence: AAG
agggaagtgaaaaagcagat

SEQ ID NO: 141306 - DNA, 20 bp, Artificial Sequence
  Description of Artificial Sequence: Synthetic oligonucleotide
  Target: ATXN1; (+) strand; PAM type: NRG; PAM sequence: AAG
cagataagtaaattcctgct

SEQ ID NO: 141307 - DNA, 20 bp, Artificial Sequence
  Description of Artificial Sequence: Synthetic oligonucleotide
  Target: ATXN1; (+) strand; PAM type: NRG; PAM sequence: GAG
gataagtaaattcctgctaa

SEQ ID NO: 141308 - DNA, 20 bp, Artificial Sequence
  Description of Artificial Sequence: Synthetic oligonucleotide
  Target: ATXN1; (+) strand; PAM type: NRG; PAM sequence: CAG
ctctcctattcaacaacctt

SEQ ID NO: 141309 - DNA, 20 bp, Artificial Sequence
  Description of Artificial Sequence: Synthetic oligonucleotide
  Target: ATXN1; (+) strand; PAM type: NRG; PAM sequence: TGG
tcctattcaacaaccttcag

SEQ ID NO: 141310 - DNA, 20 bp, Artificial Sequence
  Description of Artificial Sequence: Synthetic oligonucleotide
  Target: ATXN1; (+) strand; PAM type: NRG; PAM sequence: AAG
tcagtggctctccgccactt

SEQ ID NO: 141311 - DNA, 20 bp, Artificial Sequence
  Description of Artificial Sequence: Synthetic oligonucleotide
  Target: ATXN1; (+) strand; PAM type: NRG; PAM sequence: TGG
ctccgccacttaagaaaaaa

SEQ ID NO: 141312 - DNA, 20 bp, Artificial Sequence
  Description of Artificial Sequence: Synthetic oligonucleotide
  Target: ATXN1; (+) strand; PAM type: NRG; PAM sequence: TGG
attttctcatctgtaaaatg

SEQ ID NO: 141313 - DNA, 20 bp, Artificial Sequence
  Description of Artificial Sequence: Synthetic oligonucleotide
  Target: ATXN1; (+) strand; PAM type: NRG; PAM sequence: TAG
tctcatctgtaaaatgtgga

SEQ ID NO: 141314 - DNA, 20 bp, Artificial Sequence
  Description of Artificial Sequence: Synthetic oligonucleotide
  Target: ATXN1; (+) strand; PAM type: NRG; PAM sequence: AAG
aaatgtggatagctatgttg

SEQ ID NO: 141315 - DNA, 20 bp, Artificial Sequence
  Description of Artificial Sequence: Synthetic oligonucleotide
  Target: ATXN1; (+) strand; PAM type: NRG; PAM sequence: AGG
aatgtggatagctatgttga

SEQ ID NO: 141316 - DNA, 20 bp, Artificial Sequence
  Description of Artificial Sequence: Synthetic oligonucleotide
  Target: ATXN1; (+) strand; PAM type: NRG; PAM sequence: GGG
atgtggatagctatgttgaa

SEQ ID NO: 141317 - DNA, 20 bp, Artificial Sequence
  Description of Artificial Sequence: Synthetic oligonucleotide
  Target: ATXN1; (+) strand; PAM type: NRG; PAM sequence: GAG
gtggatagctatgttgaagg

SEQ ID NO: 141318 - DNA, 20 bp, Artificial Sequence
  Description of Artificial Sequence: Synthetic oligonucleotide
  Target: ATXN1; (+) strand; PAM type: NRG; PAM sequence: CAG
atgttgaagggagttgtaat

SEQ ID NO: 141319 - DNA, 20 bp, Artificial Sequence
  Description of Artificial Sequence: Synthetic oligonucleotide
  Target: ATXN1; (+) strand; PAM type: NRG; PAM sequence: GAG
gttgaagggagttgtaatca

SEQ ID NO: 141320 - DNA, 20 bp, Artificial Sequence
  Description of Artificial Sequence: Synthetic oligonucleotide
  Target: ATXN1; (+) strand; PAM type: NRG; PAM sequence: AAG
aatcagagctaatttatgta

SEQ ID NO: 141321 - DNA, 20 bp, Artificial Sequence
  Description of Artificial Sequence: Synthetic oligonucleotide
  Target: ATXN1; (+) strand; PAM type: NRG; PAM sequence: CAG
tttatgtaaagccccaacca

SEQ ID NO: 141322 - DNA, 20 bp, Artificial Sequence
  Description of Artificial Sequence: Synthetic oligonucleotide
  Target: ATXN1; (+) strand; PAM type: NRG; PAM sequence: TGG
caaccacagaatctgatata

SEQ ID NO: 141323 - DNA, 20 bp, Artificial Sequence
  Description of Artificial Sequence: Synthetic oligonucleotide
  Target: ATXN1; (+) strand; PAM type: NRG; PAM sequence: CAG
atctgatatatggcaccact

SEQ ID NO: 141324 - DNA, 20 bp, Artificial Sequence
  Description of Artificial Sequence: Synthetic oligonucleotide
  Target: ATXN1; (+) strand; PAM type: NRG; PAM sequence: TAG
atatggcaccactcagtgaa

SEQ ID NO: 141325 - DNA, 20 bp, Artificial Sequence
  Description of Artificial Sequence: Synthetic oligonucleotide
  Target: ATXN1; (+) strand; PAM type: NRG; PAM sequence: CAG
tatcatcattatcattaaat

SEQ ID NO: 141326 - DNA, 20 bp, Artificial Sequence
  Description of Artificial Sequence: Synthetic oligonucleotide
  Target: ATXN1; (+) strand; PAM type: NRG; PAM sequence: CAG
aaatcagactatcttcctcc

SEQ ID NO: 141327 - DNA, 20 bp, Artificial Sequence
  Description of Artificial Sequence: Synthetic oligonucleotide
  Target: ATXN1; (+) strand; PAM type: NRG; PAM sequence: TGG
cacctcacacaccttaaccc

SEQ ID NO: 141328 - DNA, 20 bp, Artificial Sequence
  Description of Artificial Sequence: Synthetic oligonucleotide
  Target: ATXN1; (+) strand; PAM type: NRG; PAM sequence: GGG
acctcacacaccttaaccct

SEQ ID NO: 141329 - DNA, 20 bp, Artificial Sequence
  Description of Artificial Sequence: Synthetic oligonucleotide
  Target: ATXN1; (+) strand; PAM type: NRG; PAM sequence: TGG
ccttaaccctgggctcaaac

SEQ ID NO: 141330 - DNA, 20 bp, Artificial Sequence
  Description of Artificial Sequence: Synthetic oligonucleotide
  Target: ATXN1; (+) strand; PAM type: NRG; PAM sequence: CAG
cctgggctcaaactggtcca

SEQ ID NO: 141331 - DNA, 20 bp, Artificial Sequence
  Description of Artificial Sequence: Synthetic oligonucleotide
  Target: ATXN1; (+) strand; PAM type: NRG; PAM sequence: TGG
ctctcccttctccacacctt

SEQ ID NO: 141332 - DNA, 20 bp, Artificial Sequence
  Description of Artificial Sequence: Synthetic oligonucleotide
  Target: ATXN1; (+) strand; PAM type: NRG; PAM sequence: GGG
tctcccttctccacaccttt

SEQ ID NO: 141333 - DNA, 20 bp, Artificial Sequence
  Description of Artificial Sequence: Synthetic oligonucleotide
  Target: ATXN1; (+) strand; PAM type: NRG; PAM sequence: TGG
tgggcacacgccctcccgtg

SEQ ID NO: 141334 - DNA, 20 bp, Artificial Sequence
  Description of Artificial Sequence: Synthetic oligonucleotide
  Target: ATXN1; (+) strand; PAM type: NRG; PAM sequence: CAG
cgtgtggaatgccttgctcc

SEQ ID NO: 141335 - DNA, 20 bp, Artificial Sequence
  Description of Artificial Sequence: Synthetic oligonucleotide
  Target: ATXN1; (+) strand; PAM type: NRG; PAM sequence: CAG
tgccttgctcccagctctgt

SEQ ID NO: 141336 - DNA, 20 bp, Artificial Sequence
  Description of Artificial Sequence: Synthetic oligonucleotide
  Target: ATXN1; (+) strand; PAM type: NRG; PAM sequence: AGG
gccttgctcccagctctgtc

SEQ ID NO: 141337 - DNA, 20 bp, Artificial Sequence
  Description of Artificial Sequence: Synthetic oligonucleotide
  Target: ATXN1; (+) strand; PAM type: NRG; PAM sequence: TGG
ttgctcccagctctgtcagg

SEQ ID NO: 141338 - DNA, 20 bp, Artificial Sequence
  Description of Artificial Sequence: Synthetic oligonucleotide
  Target: ATXN1; (+) strand; PAM type: NRG; PAM sequence: TAG
agctctgtcaggtggaatcc

SEQ ID NO: 141339 - DNA, 20 bp, Artificial Sequence
  Description of Artificial Sequence: Synthetic oligonucleotide
  Target: ATXN1; (+) strand; PAM type: NRG; PAM sequence: AAG
ggaatcctagccattcttcc

SEQ ID NO: 141340 - DNA, 20 bp, Artificial Sequence
  Description of Artificial Sequence: Synthetic oligonucleotide
  Target: ATXN1; (+) strand; PAM type: NRG; PAM sequence: CAG
tcctagccattcttccaagt

SEQ ID NO: 141341 - DNA, 20 bp, Artificial Sequence
  Description of Artificial Sequence: Synthetic oligonucleotide
  Target: ATXN1; (+) strand; PAM type: NRG; PAM sequence: AAG
tcagctctgatgcttcctcc

SEQ ID NO: 141342 - DNA, 20 bp, Artificial Sequence
  Description of Artificial Sequence: Synthetic oligonucleotide
  Target: ATXN1; (+) strand; PAM type: NRG; PAM sequence: CAG
agtcctcaccactcccaaat

SEQ ID NO: 141343 - DNA, 20 bp, Artificial Sequence
  Description of Artificial Sequence: Synthetic oligonucleotide
  Target: ATXN1; (+) strand; PAM type: NRG; PAM sequence: CAG
cccactcctttgtgttccca

SEQ ID NO: 141344 - DNA, 20 bp, Artificial Sequence
  Description of Artificial Sequence: Synthetic oligonucleotide
  Target: ATXN1; (+) strand; PAM type: NRG; PAM sequence: TAG
cagcattgcttcgccttccc

SEQ ID NO: 141345 - DNA, 20 bp, Artificial Sequence
  Description of Artificial Sequence: Synthetic oligonucleotide
  Target: ATXN1; (+) strand; PAM type: NRG; PAM sequence: TGG
attgcttcgccttccctagc

SEQ ID NO: 141346 - DNA, 20 bp, Artificial Sequence
  Description of Artificial Sequence: Synthetic oligonucleotide
  Target: ATXN1; (+) strand; PAM type: NRG; PAM sequence: GGG
ttgcttcgccttccctagct

SEQ ID NO: 141347 - DNA, 20 bp, Artificial Sequence
  Description of Artificial Sequence: Synthetic oligonucleotide
  Target: ATXN1; (+) strand; PAM type: NRG; PAM sequence: CAG
cacctacatgtttcccctaa

SEQ ID NO: 141348 - DNA, 20 bp, Artificial Sequence
  Description of Artificial Sequence: Synthetic oligonucleotide
  Target: ATXN1; (+) strand; PAM type: NRG; PAM sequence: AAG
acagtgtaaattcctaaacc

SEQ ID NO: 141349 - DNA, 20 bp, Artificial Sequence
  Description of Artificial Sequence: Synthetic oligonucleotide
  Target: ATXN1; (+) strand; PAM type: NRG; PAM sequence: TAG
aaattcctaaaccaagtttg

SEQ ID NO: 141350 - DNA, 20 bp, Artificial Sequence
  Description of Artificial Sequence: Synthetic oligonucleotide
  Target: ATXN1; (+) strand; PAM type: NRG; PAM sequence: AGG
aattcctaaaccaagtttgt

SEQ ID NO: 141351 - DNA, 20 bp, Artificial Sequence
  Description of Artificial Sequence: Synthetic oligonucleotide
  Target: ATXN1; (+) strand; PAM type: NRG; PAM sequence: AAG
tcctaaaccaagtttgtagg

SEQ ID NO: 141352 - DNA, 20 bp, Artificial Sequence
  Description of Artificial Sequence: Synthetic oligonucleotide
  Target: ATXN1; (+) strand; PAM type: NRG; PAM sequence: AGG
cctaaaccaagtttgtagga

SEQ ID NO: 141353 - DNA, 20 bp, Artificial Sequence
  Description of Artificial Sequence: Synthetic oligonucleotide
  Target: ATXN1; (+) strand; PAM type: NRG; PAM sequence: AAG
caagtttgtaggaaggcatg

SEQ ID NO: 141354 - DNA, 20 bp, Artificial Sequence
  Description of Artificial Sequence: Synthetic oligonucleotide
  Target: ATXN1; (+) strand; PAM type: NRG; PAM sequence: TGG
aaggcatgaagaataaacac

SEQ ID NO: 141355 - DNA, 20 bp, Artificial Sequence
  Description of Artificial Sequence: Synthetic oligonucleotide
  Target: ATXN1; (+) strand; PAM type: NRG; PAM sequence: GAG
gaaaaattttaccacaaact

SEQ ID NO: 141356 - DNA, 20 bp, Artificial Sequence
  Description of Artificial Sequence: Synthetic oligonucleotide
  Target: ATXN1; (+) strand; PAM type: NRG; PAM sequence: AAG
taactaacgaaattccatga

SEQ ID NO: 141357 - DNA, 20 bp, Artificial Sequence
  Description of Artificial Sequence: Synthetic oligonucleotide
  Target: ATXN1; (+) strand; PAM type: NRG; PAM sequence: TGG
ctaacgaaattccatgaaag

SEQ ID NO: 141358 - DNA, 20 bp, Artificial Sequence
  Description of Artificial Sequence: Synthetic oligonucleotide
  Target: ATXN1; (+) strand; PAM type: NRG; PAM sequence: CAG
tgaaagtggtatgataataa

SEQ ID NO: 141359 - DNA, 20 bp, Artificial Sequence
  Description of Artificial Sequence: Synthetic oligonucleotide
  Target: ATXN1; (+) strand; PAM type: NRG; PAM sequence: AAG
taacagctaccattttttga

SEQ ID NO: 141360 - DNA, 20 bp, Artificial Sequence
  Description of Artificial Sequence: Synthetic oligonucleotide
  Target: ATXN1; (+) strand; PAM type: NRG; PAM sequence: AAG
ttgaaagctttacgtgcatc

SEQ ID NO: 141361 - DNA, 20 bp, Artificial Sequence
  Description of Artificial Sequence: Synthetic oligonucleotide
  Target: ATXN1; (+) strand; PAM type: NRG; PAM sequence: TAG
tacgtgcatcaagactcatt

SEQ ID NO: 141362 - DNA, 20 bp, Artificial Sequence
  Description of Artificial Sequence: Synthetic oligonucleotide
  Target: ATXN1; (+) strand; PAM type: NRG; PAM sequence: AGG
acgtgcatcaagactcattt

SEQ ID NO: 141363 - DNA, 20 bp, Artificial Sequence
  Description of Artificial Sequence: Synthetic oligonucleotide
  Target: ATXN1; (+) strand; PAM type: NRG; PAM sequence: GAG
ttgtttgttttgtttttttt

SEQ ID NO: 141364 - DNA, 20 bp, Artificial Sequence
  Description of Artificial Sequence: Synthetic oligonucleotide
  Target: ATXN1; (+) strand; PAM type: NRG; PAM sequence: AAG
tttgttttgttttttttgag

SEQ ID NO: 141365 - DNA, 20 bp, Artificial Sequence
  Description of Artificial Sequence: Synthetic oligonucleotide
  Target: ATXN1; (+) strand; PAM type: NRG; PAM sequence: AAG
gttttgttttttttgagaag

SEQ ID NO: 141366 - DNA, 20 bp, Artificial Sequence
  Description of Artificial Sequence: Synthetic oligonucleotide
  Target: ATXN1; (+) strand; PAM type: NRG; PAM sequence: CAG
agaagtctcgctctgtcacc

SEQ ID NO: 141367 - DNA, 20 bp, Artificial Sequence
  Description of Artificial Sequence: Synthetic oligonucleotide
  Target: ATXN1; (+) strand; PAM type: NRG; PAM sequence: AGG
gaagtctcgctctgtcaccc

SEQ ID NO: 141368 - DNA, 20 bp, Artificial Sequence
  Description of Artificial Sequence: Synthetic oligonucleotide
  Target: ATXN1; (+) strand; PAM type: NRG; PAM sequence: TGG
tctcgctctgtcacccaggc

SEQ ID NO: 141369 - DNA, 20 bp, Artificial Sequence
  Description of Artificial Sequence: Synthetic oligonucleotide
  Target: ATXN1; (+) strand; PAM type: NRG; PAM sequence: CAG
ctgtcacccaggctggaatg

SEQ ID NO: 141370 - DNA, 20 bp, Artificial Sequence
  Description of Artificial Sequence: Synthetic oligonucleotide
  Target: ATXN1; (+) strand; PAM type: NRG; PAM sequence: TGG
tcacccaggctggaatgcag

SEQ ID NO: 141371 - DNA, 20 bp, Artificial Sequence
  Description of Artificial Sequence: Synthetic oligonucleotide
  Target: ATXN1; (+) strand; PAM type: NRG; PAM sequence: CGG
ggaatgcagtggcaccatct

SEQ ID NO: 141372 - DNA, 20 bp, Artificial Sequence
  Description of Artificial Sequence: Synthetic oligonucleotide
  Target: ATXN1; (+) strand; PAM type: NRG; PAM sequence: CAG
tcactgcaacctccacctcc

SEQ ID NO: 141373 - DNA, 20 bp, Artificial Sequence
  Description of Artificial Sequence: Synthetic oligonucleotide
  Target: ATXN1; (+) strand; PAM type: NRG; PAM sequence: AGG
cactgcaacctccacctccc

SEQ ID NO: 141374 - DNA, 20 bp, Artificial Sequence
  Description of Artificial Sequence: Synthetic oligonucleotide
  Target: ATXN1; (+) strand; PAM type: NRG; PAM sequence: AAG
aacctccacctcccaggttc

SEQ ID NO: 141375 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaattctcctgtct

SEQ ID NO: 141376 - DNA, 20 bp, Artificial Sequence
  Description of Artificial Sequence: Synthetic oligonucleotide
  Target: ATXN1; (+) strand; PAM type: NRG; PAM sequence: AAG
ttctcctgtctcagacgccc

SEQ ID NO: 141377 - DNA, 20 bp, Artificial Sequence
  Description of Artificial Sequence: Synthetic oligonucleotide
  Target: ATXN1; (+) strand; PAM type: NRG; PAM sequence: TAG
tcctgtctcagacgcccaag

SEQ ID NO: 141378 - DNA, 20 bp, Artificial Sequence
  Description of Artificial Sequence: Synthetic oligonucleotide
  Target: ATXN1; (+) strand; PAM type: NRG; PAM sequence: TGG
gtctcagacgcccaagtagc

SEQ ID NO: 141379 - DNA, 20 bp, Artificial Sequence
  Description of Artificial Sequence: Synthetic oligonucleotide
  Target: ATXN1; (+) strand; PAM type: NRG; PAM sequence: GGG
tctcagacgcccaagtagct

SEQ ID NO: 141380 - DNA, 20 bp, Artificial Sequence
  Description of Artificial Sequence: Synthetic oligonucleotide
  Target: ATXN1; (+) strand; PAM type: NRG; PAM sequence: CAG
cgcccaagtagctgggacta

SEQ ID NO: 141381 - DNA, 20 bp, Artificial Sequence
  Description of Artificial Sequence: Synthetic oligonucleotide
  Target: ATXN1; (+) strand; PAM type: NRG; PAM sequence: AGG
gcccaagtagctgggactac

SEQ ID NO: 141382 - DNA, 20 bp, Artificial Sequence
  Description of Artificial Sequence: Synthetic oligonucleotide
  Target: ATXN1; (+) strand; PAM type: NRG; PAM sequence: CGG
caggcacctgccaccacgcc

SEQ ID NO: 141383 - DNA, 20 bp, Artificial Sequence
  Description of Artificial Sequence: Synthetic oligonucleotide
  Target: ATXN1; (+) strand; PAM type: NRG; PAM sequence: TAG
ccggctaatttttatatttt

SEQ ID NO: 141384 - DNA, 20 bp, Artificial Sequence
  Description of Artificial Sequence: Synthetic oligonucleotide
  Target: ATXN1; (+) strand; PAM type: NRG; PAM sequence: TAG
gctaatttttatatttttag

SEQ ID NO: 141385 - DNA, 20 bp, Artificial Sequence
  Description of Artificial Sequence: Synthetic oligonucleotide
  Target: ATXN1; (+) strand; PAM type: NRG; PAM sequence: GAG
taatttttatatttttagta

SEQ ID NO: 141386 - DNA, 20 bp, Artificial Sequence
  Description of Artificial Sequence: Synthetic oligonucleotide
  Target: ATXN1; (+) strand; PAM type: NRG; PAM sequence: TGG
ttttatatttttagtagaga

SEQ ID NO: 141387 - DNA, 20 bp, Artificial Sequence
  Description of Artificial Sequence: Synthetic oligonucleotide
  Target: ATXN1; (+) strand; PAM type: NRG; PAM sequence: GGG
tttatatttttagtagagat

SEQ ID NO: 141388 - DNA, 20 bp, Artificial Sequence
  Description of Artificial Sequence: Synthetic oligonucleotide
  Target: ATXN1; (+) strand; PAM type: NRG; PAM sequence: GGG
ttatatttttagtagagatg

SEQ ID NO: 141389 - DNA, 20 bp, Artificial Sequence
  Description of Artificial Sequence: Synthetic oligonucleotide
  Target: ATXN1; (+) strand; PAM type: NRG; PAM sequence: TGG
gagatggggtttcaccatat

SEQ ID NO: 141390 - DNA, 20 bp, Artificial Sequence
  Description of Artificial Sequence: Synthetic oligonucleotide
  Target: ATXN1; (+) strand; PAM type: NRG; PAM sequence: CAG
tggggtttcaccatattggc

SEQ ID NO: 141391 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccatattggcc

SEQ ID NO: 141392 - DNA, 20 bp, Artificial Sequence
  Description of Artificial Sequence: Synthetic oligonucleotide
  Target: ATXN1; (+) strand; PAM type: NRG; PAM sequence: GGG
gggtttcaccatattggcca

SEQ ID NO: 141393 - DNA, 20 bp, Artificial Sequence
  Description of Artificial Sequence: Synthetic oligonucleotide
  Target: ATXN1; (+) strand; PAM type: NRG; PAM sequence: TGG
tttcaccatattggccaggg

SEQ ID NO: 141394 - DNA, 20 bp, Artificial Sequence
  Description of Artificial Sequence: Synthetic oligonucleotide
  Target: ATXN1; (+) strand; PAM type: NRG; PAM sequence: TGG
accttgtgatccacccacca

SEQ ID NO: 141395 - DNA, 20 bp, Artificial Sequence
  Description of Artificial Sequence: Synthetic oligonucleotide
  Target: ATXN1; (+) strand; PAM type: NRG; PAM sequence: AAG
ccacccaccatggcctccca

SEQ ID NO: 141396 - DNA, 20 bp, Artificial Sequence
  Description of Artificial Sequence: Synthetic oligonucleotide
  Target: ATXN1; (+) strand; PAM type: NRG; PAM sequence: TGG
accatggcctcccaaagtgc

SEQ ID NO: 141397 - DNA, 20 bp, Artificial Sequence
  Description of Artificial Sequence: Synthetic oligonucleotide
  Target: ATXN1; (+) strand; PAM type: NRG; PAM sequence: GGG
ccatggcctcccaaagtgct

SEQ ID NO: 141398 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 141399 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 141400 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggcgt

SEQ ID NO: 141401 - DNA, 20 bp, Artificial Sequence
  Description of Artificial Sequence: Synthetic oligonucleotide
  Target: ATXN1; (+) strand; PAM type: NRG; PAM sequence: TGG
caggcgtgagccaccgtgcc

SEQ ID NO: 141402 - DNA, 20 bp, Artificial Sequence
  Description of Artificial Sequence: Synthetic oligonucleotide
  Target: ATXN1; (+) strand; PAM type: NRG; PAM sequence: TGG
gttttatttttcttatttca

SEQ ID NO: 141403 - DNA, 20 bp, Artificial Sequence
  Description of Artificial Sequence: Synthetic oligonucleotide
  Target: ATXN1; (+) strand; PAM type: NRG; PAM sequence: GAG
atttcatggattgataaact

SEQ ID NO: 141404 - DNA, 20 bp, Artificial Sequence
  Description of Artificial Sequence: Synthetic oligonucleotide
  Target: ATXN1; (+) strand; PAM type: NRG; PAM sequence: AAG
gattgataaactgagaccca

SEQ ID NO: 141405 - DNA, 20 bp, Artificial Sequence
  Description of Artificial Sequence: Synthetic oligonucleotide
  Target: ATXN1; (+) strand; PAM type: NRG; PAM sequence: GAG
ttgataaactgagacccaaa

SEQ ID NO: 141406 - DNA, 20 bp, Artificial Sequence
  Description of Artificial Sequence: Synthetic oligonucleotide
  Target: ATXN1; (+) strand; PAM type: NRG; PAM sequence: AAG
aactgagacccaaagagatt

SEQ ID NO: 141407 - DNA, 20 bp, Artificial Sequence
  Description of Artificial Sequence: Synthetic oligonucleotide
  Target: ATXN1; (+) strand; PAM type: NRG; PAM sequence: CAG
gtcacttgctcaacattaca

SEQ ID NO: 141408 - DNA, 20 bp, Artificial Sequence
  Description of Artificial Sequence: Synthetic oligonucleotide
  Target: ATXN1; (+) strand; PAM type: NRG; PAM sequence: AAG
ctcaacattacacagccatt

SEQ ID NO: 141409 - DNA, 20 bp, Artificial Sequence
  Description of Artificial Sequence: Synthetic oligonucleotide
  Target: ATXN1; (+) strand; PAM type: NRG; PAM sequence: TGG
aacattacacagccattaag

SEQ ID NO: 141410 - DNA, 20 bp, Artificial Sequence
  Description of Artificial Sequence: Synthetic oligonucleotide
  Target: ATXN1; (+) strand; PAM type: NRG; PAM sequence: AAG
attacacagccattaagtgg

SEQ ID NO: 141411 - DNA, 20 bp, Artificial Sequence
  Description of Artificial Sequence: Synthetic oligonucleotide
  Target: ATXN1; (+) strand; PAM type: NRG; PAM sequence: CGG
acagccattaagtggaagtt

SEQ ID NO: 141412 - DNA, 20 bp, Artificial Sequence
  Description of Artificial Sequence: Synthetic oligonucleotide
  Target: ATXN1; (+) strand; PAM type: NRG; PAM sequence: CAG
ggaagttcggtattcaaacc

SEQ ID NO: 141413 - DNA, 20 bp, Artificial Sequence
  Description of Artificial Sequence: Synthetic oligonucleotide
  Target: ATXN1; (+) strand; PAM type: NRG; PAM sequence: AGG
gaagttcggtattcaaaccc

SEQ ID NO: 141414 - DNA, 20 bp, Artificial Sequence
  Description of Artificial Sequence: Synthetic oligonucleotide
  Target: ATXN1; (+) strand; PAM type: NRG; PAM sequence: AAG
gttcggtattcaaacccagg

SEQ ID NO: 141415 - DNA, 20 bp, Artificial Sequence
  Description of Artificial Sequence: Synthetic oligonucleotide
  Target: ATXN1; (+) strand; PAM type: NRG; PAM sequence: AAG
aaacccaggaagtttgcctc

SEQ ID NO: 141416 - DNA, 20 bp, Artificial Sequence
  Description of Artificial Sequence: Synthetic oligonucleotide
  Target: ATXN1; (+) strand; PAM type: NRG; PAM sequence: CAG
caacacatcatactgtttct

SEQ ID NO: 141417 - DNA, 20 bp, Artificial Sequence
  Description of Artificial Sequence: Synthetic oligonucleotide
  Target: ATXN1; (+) strand; PAM type: NRG; PAM sequence: CAG
cacatcatactgtttctcag

SEQ ID NO: 141418 - DNA, 20 bp, Artificial Sequence
  Description of Artificial Sequence: Synthetic oligonucleotide
  Target: ATXN1; (+) strand; PAM type: NRG; PAM sequence: AAG
ctatttattgtgaactacct

SEQ ID NO: 141419 - DNA, 20 bp, Artificial Sequence
  Description of Artificial Sequence: Synthetic oligonucleotide
  Target: ATXN1; (+) strand; PAM type: NRG; PAM sequence: TGG
gaactacctaagaaaacata

SEQ ID NO: 141420 - DNA, 20 bp, Artificial Sequence
  Description of Artificial Sequence: Synthetic oligonucleotide
  Target: ATXN1; (+) strand; PAM type: NRG; PAM sequence: TGG
ctacctaagaaaacatatgg

SEQ ID NO: 141421 - DNA, 20 bp, Artificial Sequence
  Description of Artificial Sequence: Synthetic oligonucleotide
  Target: ATXN1; (+) strand; PAM type: NRG; PAM sequence: CAG
aaacatatggtggctgtaat

SEQ ID NO: 141422 - DNA, 20 bp, Artificial Sequence
  Description of Artificial Sequence: Synthetic oligonucleotide
  Target: ATXN1; (+) strand; PAM type: NRG; PAM sequence: CAG
gtggctgtaatcagttgtct

SEQ ID NO: 141423 - DNA, 20 bp, Artificial Sequence
  Description of Artificial Sequence: Synthetic oligonucleotide
  Target: ATXN1; (+) strand; PAM type: NRG; PAM sequence: AGG
tggctgtaatcagttgtctc

SEQ ID NO: 141424 - DNA, 20 bp, Artificial Sequence
  Description of Artificial Sequence: Synthetic oligonucleotide
  Target: ATXN1; (+) strand; PAM type: NRG; PAM sequence: GGG
ggctgtaatcagttgtctca

SEQ ID NO: 141425 - DNA, 20 bp, Artificial Sequence
  Description of Artificial Sequence: Synthetic oligonucleotide
  Target: ATXN1; (+) strand; PAM type: NRG; PAM sequence: TAG
gtaatcagttgtctcagggc

SEQ ID NO: 141426 - DNA, 20 bp, Artificial Sequence
  Description of Artificial Sequence: Synthetic oligonucleotide
  Target: ATXN1; (+) strand; PAM type: NRG; PAM sequence: GAG
gggctagattttaaatcttt

SEQ ID NO: 141427 - DNA, 20 bp, Artificial Sequence
  Description of Artificial Sequence: Synthetic oligonucleotide
  Target: ATXN1; (+) strand; PAM type: NRG; PAM sequence: TGG
gattttaaatctttgagatc

SEQ ID NO: 141428 - DNA, 20 bp, Artificial Sequence
  Description of Artificial Sequence: Synthetic oligonucleotide
  Target: ATXN1; (+) strand; PAM type: NRG; PAM sequence: GGG
attttaaatctttgagatct

SEQ ID NO: 141429 - DNA, 20 bp, Artificial Sequence
  Description of Artificial Sequence: Synthetic oligonucleotide
  Target: ATXN1; (+) strand; PAM type: NRG; PAM sequence: GGG
ttttaaatctttgagatctg

SEQ ID NO: 141430 - DNA, 20 bp, Artificial Sequence
  Description of Artificial Sequence: Synthetic oligonucleotide
  Target: ATXN1; (+) strand; PAM type: NRG; PAM sequence: CAG
agatctggggattgaatata

SEQ ID NO: 141431 - DNA, 20 bp, Artificial Sequence
  Description of Artificial Sequence: Synthetic oligonucleotide
  Target: ATXN1; (+) strand; PAM type: NRG; PAM sequence: CAG
tggggattgaatatacagca

SEQ ID NO: 141432 - DNA, 20 bp, Artificial Sequence
  Description of Artificial Sequence: Synthetic oligonucleotide
  Target: ATXN1; (+) strand; PAM type: NRG; PAM sequence: TGG
aatatacagcacagtgacta

SEQ ID NO: 141433 - DNA, 20 bp, Artificial Sequence
  Description of Artificial Sequence: Synthetic oligonucleotide
  Target: ATXN1; (+) strand; PAM type: NRG; PAM sequence: GAG
ttgtacacttgaaatttgct

SEQ ID NO: 141434 - DNA, 20 bp, Artificial Sequence
  Description of Artificial Sequence: Synthetic oligonucleotide
  Target: ATXN1; (+) strand; PAM type: NRG; PAM sequence: CAG
acacttgaaatttgctgaga

SEQ ID NO: 141435 - DNA, 20 bp, Artificial Sequence
  Description of Artificial Sequence: Synthetic oligonucleotide
  Target: ATXN1; (+) strand; PAM type: NRG; PAM sequence: AAG
cttaaatgttctcaccatgc

SEQ ID NO: 141436 - DNA, 20 bp, Artificial Sequence
  Description of Artificial Sequence: Synthetic oligonucleotide
  Target: ATXN1; (+) strand; PAM type: NRG; PAM sequence: GAG
gcaagaaaaaataactatgt

SEQ ID NO: 141437 - DNA, 20 bp, Artificial Sequence
  Description of Artificial Sequence: Synthetic oligonucleotide
  Target: ATXN1; (+) strand; PAM type: NRG; PAM sequence: AGG
caagaaaaaataactatgtg

SEQ ID NO: 141438 - DNA, 20 bp, Artificial Sequence
  Description of Artificial Sequence: Synthetic oligonucleotide
  Target: ATXN1; (+) strand; PAM type: NRG; PAM sequence: AAG
ataactatgtgaggtgatga

SEQ ID NO: 141439 - DNA, 20 bp, Artificial Sequence
  Description of Artificial Sequence: Synthetic oligonucleotide
  Target: ATXN1; (+) strand; PAM type: NRG; PAM sequence: AAG
cacaatatatatgtatatca

SEQ ID NO: 141440 - DNA, 20 bp, Artificial Sequence
  Description of Artificial Sequence: Synthetic oligonucleotide
  Target: ATXN1; (+) strand; PAM type: NRG; PAM sequence: TGG
caatcataactcaataatgc

SEQ ID NO: 141441 - DNA, 20 bp, Artificial Sequence
  Description of Artificial Sequence: Synthetic oligonucleotide
  Target: ATXN1; (+) strand; PAM type: NRG; PAM sequence: AAG
taatgctggaaaaataaaat

SEQ ID NO: 141442 - DNA, 20 bp, Artificial Sequence
  Description of Artificial Sequence: Synthetic oligonucleotide
  Target: ATXN1; (+) strand; PAM type: NRG; PAM sequence: AGG
aatgctggaaaaataaaata

SEQ ID NO: 141443 - DNA, 20 bp, Artificial Sequence
  Description of Artificial Sequence: Synthetic oligonucleotide
  Target: ATXN1; (+) strand; PAM type: NRG; PAM sequence: CGG
ctggaaaaataaaataaggc

SEQ ID NO: 141444 - DNA, 20 bp, Artificial Sequence
  Description of Artificial Sequence: Synthetic oligonucleotide
  Target: ATXN1; (+) strand; PAM type: NRG; PAM sequence: GGG
tggaaaaataaaataaggcc

SEQ ID NO: 141445 - DNA, 20 bp, Artificial Sequence
  Description of Artificial Sequence: Synthetic oligonucleotide
  Target: ATXN1; (+) strand; PAM type: NRG; PAM sequence: CAG
aaataaaataaggccgggcg

SEQ ID NO: 141446 - DNA, 20 bp, Artificial Sequence
  Description of Artificial Sequence: Synthetic oligonucleotide
  Target: ATXN1; (+) strand; PAM type: NRG; PAM sequence: TGG
taaaataaggccgggcgcag

SEQ ID NO: 141447 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 141448 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 141449 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 141450 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 141451 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 141452 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggct

SEQ ID NO: 141453 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggctgaga

SEQ ID NO: 141454 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggctgagac

SEQ ID NO: 141455 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggctgagacggg

SEQ ID NO: 141456 - DNA, 20 bp, Artificial Sequence
  Description of Artificial Sequence: Synthetic oligonucleotide
  Target: ATXN1; (+) strand; PAM type: NRG; PAM sequence: GAG
ctgagacgggtggatcatct

SEQ ID NO: 141457 - DNA, 20 bp, Artificial Sequence
  Description of Artificial Sequence: Synthetic oligonucleotide
  Target: ATXN1; (+) strand; PAM type: NRG; PAM sequence: AGG
tgagacgggtggatcatctg

SEQ ID NO: 141458 - DNA, 20 bp, Artificial Sequence
  Description of Artificial Sequence: Synthetic oligonucleotide
  Target: ATXN1; (+) strand; PAM type: NRG; PAM sequence: CAG
acgggtggatcatctgaggt

SEQ ID NO: 141459 - DNA, 20 bp, Artificial Sequence
  Description of Artificial Sequence: Synthetic oligonucleotide
  Target: ATXN1; (+) strand; PAM type: NRG; PAM sequence: AGG
cgggtggatcatctgaggtc

SEQ ID NO: 141460 - DNA, 20 bp, Artificial Sequence
  Description of Artificial Sequence: Synthetic oligonucleotide
  Target: ATXN1; (+) strand; PAM type: NRG; PAM sequence: GAG
ggtggatcatctgaggtcag

SEQ ID NO: 141461 - DNA, 20 bp, Artificial Sequence
  Description of Artificial Sequence: Synthetic oligonucleotide
  Target: ATXN1; (+) strand; PAM type: NRG; PAM sequence: GAG
tcatctgaggtcaggagttt

SEQ ID NO: 141462 - DNA, 20 bp, Artificial Sequence
  Description of Artificial Sequence: Synthetic oligonucleotide
  Target: ATXN1; (+) strand; PAM type: NRG; PAM sequence: AGG
catctgaggtcaggagtttg

SEQ ID NO: 141463 - DNA, 20 bp, Artificial Sequence
  Description of Artificial Sequence: Synthetic oligonucleotide
  Target: ATXN1; (+) strand; PAM type: NRG; PAM sequence: TGG
tcaggagtttgaggccatcc

SEQ ID NO: 141464 - DNA, 20 bp, Artificial Sequence
  Description of Artificial Sequence: Synthetic oligonucleotide
  Target: ATXN1; (+) strand; PAM type: NRG; PAM sequence: CGG
tgaggccatcctggccaata

SEQ ID NO: 141465 - DNA, 20 bp, Artificial Sequence
  Description of Artificial Sequence: Synthetic oligonucleotide
  Target: ATXN1; (+) strand; PAM type: NRG; PAM sequence: GAG
gccatcctggccaatacggt

SEQ ID NO: 141466 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaaattatc

SEQ ID NO: 141467 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattatct

SEQ ID NO: 141468 - DNA, 20 bp, Artificial Sequence
  Description of Artificial Sequence: Synthetic oligonucleotide
  Target: ATXN1; (+) strand; PAM type: NRG; PAM sequence: TAG
atacaaaaattatctgggtg

SEQ ID NO: 141469 - DNA, 20 bp, Artificial Sequence
  Description of Artificial Sequence: Synthetic oligonucleotide
  Target: ATXN1; (+) strand; PAM type: NRG; PAM sequence: TGG
caaaaattatctgggtgtag

SEQ ID NO: 141470 - DNA, 20 bp, Artificial Sequence
  Description of Artificial Sequence: Synthetic oligonucleotide
  Target: ATXN1; (+) strand; PAM type: NRG; PAM sequence: CAG
aaattatctgggtgtagtgg

SEQ ID NO: 141471 - DNA, 20 bp, Artificial Sequence
  Description of Artificial Sequence: Synthetic oligonucleotide
  Target: ATXN1; (+) strand; PAM type: NRG; PAM sequence: AGG
aattatctgggtgtagtggc

SEQ ID NO: 141472 - DNA, 20 bp, Artificial Sequence
  Description of Artificial Sequence: Synthetic oligonucleotide
  Target: ATXN1; (+) strand; PAM type: NRG; PAM sequence: CAG
gtggcaggtgcctgtaatcc

SEQ ID NO: 141473 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagctact

SEQ ID NO: 141474 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagctactt

SEQ ID NO: 141475 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctacttgg

SEQ ID NO: 141476 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctacttggg

SEQ ID NO: 141477 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 141478 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggctg

SEQ ID NO: 141479 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgagg

SEQ ID NO: 141480 - DNA, 20 bp, Artificial Sequence
  Description of Artificial Sequence: Synthetic oligonucleotide
  Target: ATXN1; (+) strand; PAM type: NRG; PAM sequence: AAG
tacttgggaggctgaggcag

SEQ ID NO: 141481 - DNA, 20 bp, Artificial Sequence
  Description of Artificial Sequence: Synthetic oligonucleotide
  Target: ATXN1; (+) strand; PAM type: NRG; PAM sequence: CAG
ggcagaagatctcttgaacc

SEQ ID NO: 141482 - DNA, 20 bp, Artificial Sequence
  Description of Artificial Sequence: Synthetic oligonucleotide
  Target: ATXN1; (+) strand; PAM type: NRG; PAM sequence: AGG
gcagaagatctcttgaaccc

SEQ ID NO: 141483 - DNA, 20 bp, Artificial Sequence
  Description of Artificial Sequence: Synthetic oligonucleotide
  Target: ATXN1; (+) strand; PAM type: NRG; PAM sequence: GAG
agaagatctcttgaacccag

SEQ ID NO: 141484 - DNA, 20 bp, Artificial Sequence
  Description of Artificial Sequence: Synthetic oligonucleotide
  Target: ATXN1; (+) strand; PAM type: NRG; PAM sequence: AGG
gaagatctcttgaacccagg

SEQ ID NO: 141485 - DNA, 20 bp, Artificial Sequence
  Description of Artificial Sequence: Synthetic oligonucleotide
  Target: ATXN1; (+) strand; PAM type: NRG; PAM sequence: CGG
gatctcttgaacccaggagg

SEQ ID NO: 141486 - DNA, 20 bp, Artificial Sequence
  Description of Artificial Sequence: Synthetic oligonucleotide
  Target: ATXN1; (+) strand; PAM type: NRG; PAM sequence: GAG
tctcttgaacccaggaggcg

SEQ ID NO: 141487 - DNA, 20 bp, Artificial Sequence
  Description of Artificial Sequence: Synthetic oligonucleotide
  Target: ATXN1; (+) strand; PAM type: NRG; PAM sequence: AGG
ctcttgaacccaggaggcgg

SEQ ID NO: 141488 - DNA, 20 bp, Artificial Sequence
  Description of Artificial Sequence: Synthetic oligonucleotide
  Target: ATXN1; (+) strand; PAM type: NRG; PAM sequence: CAG
aacccaggaggcggaggctg

SEQ ID NO: 141489 - DNA, 20 bp, Artificial Sequence
  Description of Artificial Sequence: Synthetic oligonucleotide
  Target: ATXN1; (+) strand; PAM type: NRG; PAM sequence: GAG
caggaggcggaggctgcagt

SEQ ID NO: 141490 - DNA, 20 bp, Artificial Sequence
  Description of Artificial Sequence: Synthetic oligonucleotide
  Target: ATXN1; (+) strand; PAM type: NRG; PAM sequence: CAG
gaaattgcgctattgcactc

SEQ ID NO: 141491 - DNA, 20 bp, Artificial Sequence
  Description of Artificial Sequence: Synthetic oligonucleotide
  Target: ATXN1; (+) strand; PAM type: NRG; PAM sequence: TGG
tgcgctattgcactccagcc

SEQ ID NO: 141492 - DNA, 20 bp, Artificial Sequence
  Description of Artificial Sequence: Synthetic oligonucleotide
  Target: ATXN1; (+) strand; PAM type: NRG; PAM sequence: GGG
gcgctattgcactccagcct

SEQ ID NO: 141493 - DNA, 20 bp, Artificial Sequence
  Description of Artificial Sequence: Synthetic oligonucleotide
  Target: ATXN1; (+) strand; PAM type: NRG; PAM sequence: AAG
tgcactccagcctgggcaac

SEQ ID NO: 141494 - DNA, 20 bp, Artificial Sequence
  Description of Artificial Sequence: Synthetic oligonucleotide
  Target: ATXN1; (+) strand; PAM type: NRG; PAM sequence: TGG
aataaaataaaataaaactt

SEQ ID NO: 141495 - DNA, 20 bp, Artificial Sequence
  Description of Artificial Sequence: Synthetic oligonucleotide
  Target: ATXN1; (+) strand; PAM type: NRG; PAM sequence: GGG
ataaaataaaataaaacttt

SEQ ID NO: 141496 - DNA, 20 bp, Artificial Sequence
  Description of Artificial Sequence: Synthetic oligonucleotide
  Target: ATXN1; (+) strand; PAM type: NRG; PAM sequence: AAG
ataaaactttgggatccatc

SEQ ID NO: 141497 - DNA, 20 bp, Artificial Sequence
  Description of Artificial Sequence: Synthetic oligonucleotide
  Target: ATXN1; (+) strand; PAM type: NRG; PAM sequence: AGG
taaaactttgggatccatca

SEQ ID NO: 141498 - DNA, 20 bp, Artificial Sequence
  Description of Artificial Sequence: Synthetic oligonucleotide
  Target: ATXN1; (+) strand; PAM type: NRG; PAM sequence: TGG
tgggatccatcaaggtactc

SEQ ID NO: 141499 - DNA, 20 bp, Artificial Sequence
  Description of Artificial Sequence: Synthetic oligonucleotide
  Target: ATXN1; (+) strand; PAM type: NRG; PAM sequence: TAG
aaggtactctggtctgtatg

SEQ ID NO: 141500 - DNA, 20 bp, Artificial Sequence
  Description of Artificial Sequence: Synthetic oligonucleotide
  Target: ATXN1; (+) strand; PAM type: NRG; PAM sequence: AAG
tggtctgtatgtagatcctt

SEQ ID NO: 141501 - DNA, 20 bp, Artificial Sequence
  Description of Artificial Sequence: Synthetic oligonucleotide
  Target: ATXN1; (+) strand; PAM type: NRG; PAM sequence: CAG
tatgtagatccttaagattt

SEQ ID NO: 141502 - DNA, 20 bp, Artificial Sequence
  Description of Artificial Sequence: Synthetic oligonucleotide
  Target: ATXN1; (+) strand; PAM type: NRG; PAM sequence: AGG
atgtagatccttaagatttc

SEQ ID NO: 141503 - DNA, 20 bp, Artificial Sequence
  Description of Artificial Sequence: Synthetic oligonucleotide
  Target: ATXN1; (+) strand; PAM type: NRG; PAM sequence: TAG
gatccttaagatttcaggac

SEQ ID NO: 141504 - DNA, 20 bp, Artificial Sequence
  Description of Artificial Sequence: Synthetic oligonucleotide
  Target: ATXN1; (+) strand; PAM type: NRG; PAM sequence: AAG
ttttatatccttcctcattg

SEQ ID NO: 141505 - DNA, 20 bp, Artificial Sequence
  Description of Artificial Sequence: Synthetic oligonucleotide
  Target: ATXN1; (+) strand; PAM type: NRG; PAM sequence: CAG
attgaagctactattgctta

SEQ ID NO: 141506 - DNA, 20 bp, Artificial Sequence
  Description of Artificial Sequence: Synthetic oligonucleotide
  Target: ATXN1; (+) strand; PAM type: NRG; PAM sequence: CAG
agacacttcctttcctgcta

SEQ ID NO: 141507 - DNA, 20 bp, Artificial Sequence
  Description of Artificial Sequence: Synthetic oligonucleotide
  Target: ATXN1; (+) strand; PAM type: NRG; PAM sequence: TAG
tttcctgctacagccaacac

SEQ ID NO: 141508 - DNA, 20 bp, Artificial Sequence
  Description of Artificial Sequence: Synthetic oligonucleotide
  Target: ATXN1; (+) strand; PAM type: NRG; PAM sequence: AGG
ttcctgctacagccaacact

SEQ ID NO: 141509 - DNA, 20 bp, Artificial Sequence
  Description of Artificial Sequence: Synthetic oligonucleotide
  Target: ATXN1; (+) strand; PAM type: NRG; PAM sequence: TGG
cagccaacactaggcaacct

SEQ ID NO: 141510 - DNA, 20 bp, Artificial Sequence
  Description of Artificial Sequence: Synthetic oligonucleotide
  Target: ATXN1; (+) strand; PAM type: NRG; PAM sequence: GAG
gccaacactaggcaaccttg

SEQ ID NO: 141511 - DNA, 20 bp, Artificial Sequence
  Description of Artificial Sequence: Synthetic oligonucleotide
  Target: ATXN1; (+) strand; PAM type: NRG; PAM sequence: GAG
caacactaggcaaccttgga

SEQ ID NO: 141512 - DNA, 20 bp, Artificial Sequence
  Description of Artificial Sequence: Synthetic oligonucleotide
  Target: ATXN1; (+) strand; PAM type: NRG; PAM sequence: AGG
aacactaggcaaccttggag

SEQ ID NO: 141513 - DNA, 20 bp, Artificial Sequence
  Description of Artificial Sequence: Synthetic oligonucleotide
  Target: ATXN1; (+) strand; PAM type: NRG; PAM sequence: GGG
acactaggcaaccttggaga

SEQ ID NO: 141514 - DNA, 20 bp, Artificial Sequence
  Description of Artificial Sequence: Synthetic oligonucleotide
  Target: ATXN1; (+) strand; PAM type: NRG; PAM sequence: CAG
aggcaaccttggagagggta

SEQ ID NO: 141515 - DNA, 20 bp, Artificial Sequence
  Description of Artificial Sequence: Synthetic oligonucleotide
  Target: ATXN1; (+) strand; PAM type: NRG; PAM sequence: TGG
acagccacaatatcaccaca

SEQ ID NO: 141516 - DNA, 20 bp, Artificial Sequence
  Description of Artificial Sequence: Synthetic oligonucleotide
  Target: ATXN1; (+) strand; PAM type: NRG; PAM sequence: CAG
accacatggacccacacata

SEQ ID NO: 141517 - DNA, 20 bp, Artificial Sequence
  Description of Artificial Sequence: Synthetic oligonucleotide
  Target: ATXN1; (+) strand; PAM type: NRG; PAM sequence: CAG
ggacccacacatacagtctg

SEQ ID NO: 141518 - DNA, 20 bp, Artificial Sequence
  Description of Artificial Sequence: Synthetic oligonucleotide
  Target: ATXN1; (+) strand; PAM type: NRG; PAM sequence: GAG
acccacacatacagtctgca

SEQ ID NO: 141519 - DNA, 20 bp, Artificial Sequence
  Description of Artificial Sequence: Synthetic oligonucleotide
  Target: ATXN1; (+) strand; PAM type: NRG; PAM sequence: AGG
cccacacatacagtctgcag

SEQ ID NO: 141520 - DNA, 20 bp, Artificial Sequence
  Description of Artificial Sequence: Synthetic oligonucleotide
  Target: ATXN1; (+) strand; PAM type: NRG; PAM sequence: GGG
ccacacatacagtctgcaga

SEQ ID NO: 141521 - DNA, 20 bp, Artificial Sequence
  Description of Artificial Sequence: Synthetic oligonucleotide
  Target: ATXN1; (+) strand; PAM type: NRG; PAM sequence: CAG
cacatacagtctgcagaggg

SEQ ID NO: 141522 - DNA, 20 bp, Artificial Sequence
  Description of Artificial Sequence: Synthetic oligonucleotide
  Target: ATXN1; (+) strand; PAM type: NRG; PAM sequence: AAG
tgcagagggcagttcaacat

SEQ ID NO: 141523 - DNA, 20 bp, Artificial Sequence
  Description of Artificial Sequence: Synthetic oligonucleotide
  Target: ATXN1; (+) strand; PAM type: NRG; PAM sequence: GAG
acataagcacctactatatt

SEQ ID NO: 141524 - DNA, 20 bp, Artificial Sequence
  Description of Artificial Sequence: Synthetic oligonucleotide
  Target: ATXN1; (+) strand; PAM type: NRG; PAM sequence: GAG
ataagcacctactatattga

SEQ ID NO: 141525 - DNA, 20 bp, Artificial Sequence
  Description of Artificial Sequence: Synthetic oligonucleotide
  Target: ATXN1; (+) strand; PAM type: NRG; PAM sequence: AGG
taagcacctactatattgag

SEQ ID NO: 141526 - DNA, 20 bp, Artificial Sequence
  Description of Artificial Sequence: Synthetic oligonucleotide
  Target: ATXN1; (+) strand; PAM type: NRG; PAM sequence: TAG
tactatattgagaggcacct

SEQ ID NO: 141527 - DNA, 20 bp, Artificial Sequence
  Description of Artificial Sequence: Synthetic oligonucleotide
  Target: ATXN1; (+) strand; PAM type: NRG; PAM sequence: AGG
actatattgagaggcacctt

SEQ ID NO: 141528 - DNA, 20 bp, Artificial Sequence
  Description of Artificial Sequence: Synthetic oligonucleotide
  Target: ATXN1; (+) strand; PAM type: NRG; PAM sequence: AAG
gcaccttaggttgtaatgaa

SEQ ID NO: 141529 - DNA, 20 bp, Artificial Sequence
  Description of Artificial Sequence: Synthetic oligonucleotide
  Target: ATXN1; (+) strand; PAM type: NRG; PAM sequence: TAG
ggttgtaatgaaaagcgtca

SEQ ID NO: 141530 - DNA, 20 bp, Artificial Sequence
  Description of Artificial Sequence: Synthetic oligonucleotide
  Target: ATXN1; (+) strand; PAM type: NRG; PAM sequence: GAG
catagtctaattgccttcct

SEQ ID NO: 141531 - DNA, 20 bp, Artificial Sequence
  Description of Artificial Sequence: Synthetic oligonucleotide
  Target: ATXN1; (+) strand; PAM type: NRG; PAM sequence: TAG
ccttcctgagtttttgtcac

SEQ ID NO: 141532 - DNA, 20 bp, Artificial Sequence
  Description of Artificial Sequence: Synthetic oligonucleotide
  Target: ATXN1; (+) strand; PAM type: NRG; PAM sequence: AGG
cttcctgagtttttgtcact

SEQ ID NO: 141533 - DNA, 20 bp, Artificial Sequence
  Description of Artificial Sequence: Synthetic oligonucleotide
  Target: ATXN1; (+) strand; PAM type: NRG; PAM sequence: TAG
agtttttgtcactaggtact

SEQ ID NO: 141534 - DNA, 20 bp, Artificial Sequence
  Description of Artificial Sequence: Synthetic oligonucleotide
  Target: ATXN1; (+) strand; PAM type: NRG; PAM sequence: AGG
gtttttgtcactaggtactt

SEQ ID NO: 141535 - DNA, 20 bp, Artificial Sequence
  Description of Artificial Sequence: Synthetic oligonucleotide
  Target: ATXN1; (+) strand; PAM type: NRG; PAM sequence: GAG
taggtacttaggatgcttct

SEQ ID NO: 141536 - DNA, 20 bp, Artificial Sequence
  Description of Artificial Sequence: Synthetic oligonucleotide
  Target: ATXN1; (+) strand; PAM type: NRG; PAM sequence: TGG
cttaggatgcttctgagccc

SEQ ID NO: 141537 - DNA, 20 bp, Artificial Sequence
  Description of Artificial Sequence: Synthetic oligonucleotide
  Target: ATXN1; (+) strand; PAM type: NRG; PAM sequence: AAG
ctgagccctggctctcatga

SEQ ID NO: 141538 - DNA, 20 bp, Artificial Sequence
  Description of Artificial Sequence: Synthetic oligonucleotide
  Target: ATXN1; (+) strand; PAM type: NRG; PAM sequence: TAG
catgaaagtgcaacaaaata

SEQ ID NO: 141539 - DNA, 20 bp, Artificial Sequence
  Description of Artificial Sequence: Synthetic oligonucleotide
  Target: ATXN1; (+) strand; PAM type: NRG; PAM sequence: CAG
aaagtgcaacaaaatatagt

SEQ ID NO: 141540 - DNA, 20 bp, Artificial Sequence
  Description of Artificial Sequence: Synthetic oligonucleotide
  Target: ATXN1; (+) strand; PAM type: NRG; PAM sequence: CAG
tcctgatgaatgaactgtaa

SEQ ID NO: 141541 - DNA, 20 bp, Artificial Sequence
  Description of Artificial Sequence: Synthetic oligonucleotide
  Target: ATXN1; (+) strand; PAM type: NRG; PAM sequence: AAG
aactgtaacagtcaccaaaa

SEQ ID NO: 141542 - DNA, 20 bp, Artificial Sequence
  Description of Artificial Sequence: Synthetic oligonucleotide
  Target: ATXN1; (+) strand; PAM type: NRG; PAM sequence: TGG
caaaaaagtttgcaacccca

SEQ ID NO: 141543 - DNA, 20 bp, Artificial Sequence
  Description of Artificial Sequence: Synthetic oligonucleotide
  Target: ATXN1; (+) strand; PAM type: NRG; PAM sequence: TAG
aaagtttgcaaccccatggc

SEQ ID NO: 141544 - DNA, 20 bp, Artificial Sequence
  Description of Artificial Sequence: Synthetic oligonucleotide
  Target: ATXN1; (+) strand; PAM type: NRG; PAM sequence: CAG
caaccccatggctagtgcaa

SEQ ID NO: 141545 - DNA, 20 bp, Artificial Sequence
  Description of Artificial Sequence: Synthetic oligonucleotide
  Target: ATXN1; (+) strand; PAM type: NRG; PAM sequence: TAG
ccatggctagtgcaacagaa

SEQ ID NO: 141546 - DNA, 20 bp, Artificial Sequence
  Description of Artificial Sequence: Synthetic oligonucleotide
  Target: ATXN1; (+) strand; PAM type: NRG; PAM sequence: AAG
ctagtgcaacagaatagcta

SEQ ID NO: 141547 - DNA, 20 bp, Artificial Sequence
  Description of Artificial Sequence: Synthetic oligonucleotide
  Target: ATXN1; (+) strand; PAM type: NRG; PAM sequence: AGG
tagtgcaacagaatagctaa

SEQ ID NO: 141548 - DNA, 20 bp, Artificial Sequence
  Description of Artificial Sequence: Synthetic oligonucleotide
  Target: ATXN1; (+) strand; PAM type: NRG; PAM sequence: GGG
agtgcaacagaatagctaaa

SEQ ID NO: 141549 - DNA, 20 bp, Artificial Sequence
  Description of Artificial Sequence: Synthetic oligonucleotide
  Target: ATXN1; (+) strand; PAM type: NRG; PAM sequence: TGG
cagaatagctaaagggaaac

SEQ ID NO: 141550 - DNA, 20 bp, Artificial Sequence
  Description of Artificial Sequence: Synthetic oligonucleotide
  Target: ATXN1; (+) strand; PAM type: NRG; PAM sequence: GGG
agaatagctaaagggaaact

SEQ ID NO: 141551 - DNA, 20 bp, Artificial Sequence
  Description of Artificial Sequence: Synthetic oligonucleotide
  Target: ATXN1; (+) strand; PAM type: NRG; PAM sequence: GAG
aatagctaaagggaaactgg

SEQ ID NO: 141552 - DNA, 20 bp, Artificial Sequence
  Description of Artificial Sequence: Synthetic oligonucleotide
  Target: ATXN1; (+) strand; PAM type: NRG; PAM sequence: TAG
gggagtctgcacattcacct

SEQ ID NO: 141553 - DNA, 20 bp, Artificial Sequence
  Description of Artificial Sequence: Synthetic oligonucleotide
  Target: ATXN1; (+) strand; PAM type: NRG; PAM sequence: TGG
ctgcacattcaccttagcca

SEQ ID NO: 141554 - DNA, 20 bp, Artificial Sequence
  Description of Artificial Sequence: Synthetic oligonucleotide
  Target: ATXN1; (+) strand; PAM type: NRG; PAM sequence: TGG
agccatggtatatttcatga

SEQ ID NO: 141555 - DNA, 20 bp, Artificial Sequence
  Description of Artificial Sequence: Synthetic oligonucleotide
  Target: ATXN1; (+) strand; PAM type: NRG; PAM sequence: CAG
ttcatgatggatcttgtaaa

SEQ ID NO: 141556 - DNA, 20 bp, Artificial Sequence
  Description of Artificial Sequence: Synthetic oligonucleotide
  Target: ATXN1; (+) strand; PAM type: NRG; PAM sequence: AAG
atggatcttgtaaacagctg

SEQ ID NO: 141557 - DNA, 20 bp, Artificial Sequence
  Description of Artificial Sequence: Synthetic oligonucleotide
  Target: ATXN1; (+) strand; PAM type: NRG; PAM sequence: AGG
tggatcttgtaaacagctga

SEQ ID NO: 141558 - DNA, 20 bp, Artificial Sequence
  Description of Artificial Sequence: Synthetic oligonucleotide
  Target: ATXN1; (+) strand; PAM type: NRG; PAM sequence: GGG
ggatcttgtaaacagctgaa

SEQ ID NO: 141559 - DNA, 20 bp, Artificial Sequence
  Description of Artificial Sequence: Synthetic oligonucleotide
  Target: ATXN1; (+) strand; PAM type: NRG; PAM sequence: CAG
cttgtaaacagctgaagggt

SEQ ID NO: 141560 - DNA, 20 bp, Artificial Sequence
  Description of Artificial Sequence: Synthetic oligonucleotide
  Target: ATXN1; (+) strand; PAM type: NRG; PAM sequence: AGG
ttgtaaacagctgaagggtc

SEQ ID NO: 141561 - DNA, 20 bp, Artificial Sequence
  Description of Artificial Sequence: Synthetic oligonucleotide
  Target: ATXN1; (+) strand; PAM type: NRG; PAM sequence: AAG
caggtttttaaatgaatgca

SEQ ID NO: 141562 - DNA, 20 bp, Artificial Sequence
  Description of Artificial Sequence: Synthetic oligonucleotide
  Target: ATXN1; (+) strand; PAM type: NRG; PAM sequence: CAG
ttttaaatgaatgcaaagat

SEQ ID NO: 141563 - DNA, 20 bp, Artificial Sequence
  Description of Artificial Sequence: Synthetic oligonucleotide
  Target: ATXN1; (+) strand; PAM type: NRG; PAM sequence: AGG
tttaaatgaatgcaaagatc

SEQ ID NO: 141564 - DNA, 20 bp, Artificial Sequence
  Description of Artificial Sequence: Synthetic oligonucleotide
  Target: ATXN1; (+) strand; PAM type: NRG; PAM sequence: CAG
aatgaatgcaaagatcagga

SEQ ID NO: 141565 - DNA, 20 bp, Artificial Sequence
  Description of Artificial Sequence: Synthetic oligonucleotide
  Target: ATXN1; (+) strand; PAM type: NRG; PAM sequence: CAG
ggacagacaaaaatgaaatt

SEQ ID NO: 141566 - DNA, 20 bp, Artificial Sequence
  Description of Artificial Sequence: Synthetic oligonucleotide
  Target: ATXN1; (+) strand; PAM type: NRG; PAM sequence: AAG
gacaaaaatgaaattcagct

SEQ ID NO: 141567 - DNA, 20 bp, Artificial Sequence
  Description of Artificial Sequence: Synthetic oligonucleotide
  Target: ATXN1; (+) strand; PAM type: NRG; PAM sequence: AGG
acaaaaatgaaattcagcta

SEQ ID NO: 141568 - DNA, 20 bp, Artificial Sequence
  Description of Artificial Sequence: Synthetic oligonucleotide
  Target: ATXN1; (+) strand; PAM type: NRG; PAM sequence: CAG
aggttctttactctgcaaaa

SEQ ID NO: 141569 - DNA, 20 bp, Artificial Sequence
  Description of Artificial Sequence: Synthetic oligonucleotide
  Target: ATXN1; (+) strand; PAM type: NRG; PAM sequence: AAG
ctttactctgcaaaacagac

SEQ ID NO: 141570 - DNA, 20 bp, Artificial Sequence
  Description of Artificial Sequence: Synthetic oligonucleotide
  Target: ATXN1; (+) strand; PAM type: NRG; PAM sequence: AGG
tttactctgcaaaacagaca

SEQ ID NO: 141571 - DNA, 20 bp, Artificial Sequence
  Description of Artificial Sequence: Synthetic oligonucleotide
  Target: ATXN1; (+) strand; PAM type: NRG; PAM sequence: TGG
tgaaatgctaaaaaatgatg

SEQ ID NO: 141572 - DNA, 20 bp, Artificial Sequence
  Description of Artificial Sequence: Synthetic oligonucleotide
  Target: ATXN1; (+) strand; PAM type: NRG; PAM sequence: GGG
gaaatgctaaaaaatgatgt

SEQ ID NO: 141573 - DNA, 20 bp, Artificial Sequence
  Description of Artificial Sequence: Synthetic oligonucleotide
  Target: ATXN1; (+) strand; PAM type: NRG; PAM sequence: CAG
gggtatttaatgtttccaat

SEQ ID NO: 141574 - DNA, 20 bp, Artificial Sequence
  Description of Artificial Sequence: Synthetic oligonucleotide
  Target: ATXN1; (+) strand; PAM type: NRG; PAM sequence: TGG
tatttaatgtttccaatcag

SEQ ID NO: 141575 - DNA, 20 bp, Artificial Sequence
  Description of Artificial Sequence: Synthetic oligonucleotide
  Target: ATXN1; (+) strand; PAM type: NRG; PAM sequence: TAG
agtggtcaatcaataaatgt

SEQ ID NO: 141576 - DNA, 20 bp, Artificial Sequence
  Description of Artificial Sequence: Synthetic oligonucleotide
  Target: ATXN1; (+) strand; PAM type: NRG; PAM sequence: TAG
tgactgactaatttcttaat

SEQ ID NO: 141577 - DNA, 20 bp, Artificial Sequence
  Description of Artificial Sequence: Synthetic oligonucleotide
  Target: ATXN1; (+) strand; PAM type: NRG; PAM sequence: CAG
aatttcttaattagttaatc

SEQ ID NO: 141578 - DNA, 20 bp, Artificial Sequence
  Description of Artificial Sequence: Synthetic oligonucleotide
  Target: ATXN1; (+) strand; PAM type: NRG; PAM sequence: CAG
ttaattagttaatccagtga

SEQ ID NO: 141579 - DNA, 20 bp, Artificial Sequence
  Description of Artificial Sequence: Synthetic oligonucleotide
  Target: ATXN1; (+) strand; PAM type: NRG; PAM sequence: TGG
tccagtgacagttcaccttt

SEQ ID NO: 141580 - DNA, 20 bp, Artificial Sequence
  Description of Artificial Sequence: Synthetic oligonucleotide
  Target: ATXN1; (+) strand; PAM type: NRG; PAM sequence: AAG
tttggcatgactttataaac

SEQ ID NO: 141581 - DNA, 20 bp, Artificial Sequence
  Description of Artificial Sequence: Synthetic oligonucleotide
  Target: ATXN1; (+) strand; PAM type: NRG; PAM sequence: AAG
ctttataaacaagaaaactg

SEQ ID NO: 141582 - DNA, 20 bp, Artificial Sequence
  Description of Artificial Sequence: Synthetic oligonucleotide
  Target: ATXN1; (+) strand; PAM type: NRG; PAM sequence: AGG
tttataaacaagaaaactga

SEQ ID NO: 141583 - DNA, 20 bp, Artificial Sequence
  Description of Artificial Sequence: Synthetic oligonucleotide
  Target: ATXN1; (+) strand; PAM type: NRG; PAM sequence: TGG
taaacaagaaaactgaaggc

SEQ ID NO: 141584 - DNA, 20 bp, Artificial Sequence
  Description of Artificial Sequence: Synthetic oligonucleotide
  Target: ATXN1; (+) strand; PAM type: NRG; PAM sequence: GGG
aaacaagaaaactgaaggct

SEQ ID NO: 141585 - DNA, 20 bp, Artificial Sequence
  Description of Artificial Sequence: Synthetic oligonucleotide
  Target: ATXN1; (+) strand; PAM type: NRG; PAM sequence: AAG
aagaaaactgaaggctgggc

SEQ ID NO: 141586 - DNA, 20 bp, Artificial Sequence
  Description of Artificial Sequence: Synthetic oligonucleotide
  Target: ATXN1; (+) strand; PAM type: NRG; PAM sequence: AGG
agaaaactgaaggctgggca

SEQ ID NO: 141587 - DNA, 20 bp, Artificial Sequence
  Description of Artificial Sequence: Synthetic oligonucleotide
  Target: ATXN1; (+) strand; PAM type: NRG; PAM sequence: AAG
attacaacttattgactcta

SEQ ID NO: 141588 - DNA, 20 bp, Artificial Sequence
  Description of Artificial Sequence: Synthetic oligonucleotide
  Target: ATXN1; (+) strand; PAM type: NRG; PAM sequence: TAG
tattgactctaaagcattaa

SEQ ID NO: 141589 - DNA, 20 bp, Artificial Sequence
  Description of Artificial Sequence: Synthetic oligonucleotide
  Target: ATXN1; (+) strand; PAM type: NRG; PAM sequence: AGG
attgactctaaagcattaat

SEQ ID NO: 141590 - DNA, 20 bp, Artificial Sequence
  Description of Artificial Sequence: Synthetic oligonucleotide
  Target: ATXN1; (+) strand; PAM type: NRG; PAM sequence: TAG
atataatataaaataatata

SEQ ID NO: 141591 - DNA, 20 bp, Artificial Sequence
  Description of Artificial Sequence: Synthetic oligonucleotide
  Target: ATXN1; (+) strand; PAM type: NRG; PAM sequence: AAG
atatcaaaatattattttaa

SEQ ID NO: 141592 - DNA, 20 bp, Artificial Sequence
  Description of Artificial Sequence: Synthetic oligonucleotide
  Target: ATXN1; (+) strand; PAM type: NRG; PAM sequence: GAG
aatattattttaaaagatgt

SEQ ID NO: 141593 - DNA, 20 bp, Artificial Sequence
  Description of Artificial Sequence: Synthetic oligonucleotide
  Target: ATXN1; (+) strand; PAM type: NRG; PAM sequence: CAG
attattttaaaagatgtgag

SEQ ID NO: 141594 - DNA, 20 bp, Artificial Sequence
  Description of Artificial Sequence: Synthetic oligonucleotide
  Target: ATXN1; (+) strand; PAM type: NRG; PAM sequence: TAG
gagcagcgtgcctcacacac

SEQ ID NO: 141595 - DNA, 20 bp, Artificial Sequence
  Description of Artificial Sequence: Synthetic oligonucleotide
  Target: ATXN1; (+) strand; PAM type: NRG; PAM sequence: TAG
acaaatgatgattttctttt

SEQ ID NO: 141596 - DNA, 20 bp, Artificial Sequence
  Description of Artificial Sequence: Synthetic oligonucleotide
  Target: ATXN1; (+) strand; PAM type: NRG; PAM sequence: TGG
aatgatgattttctttttag

SEQ ID NO: 141597 - DNA, 20 bp, Artificial Sequence
  Description of Artificial Sequence: Synthetic oligonucleotide
  Target: ATXN1; (+) strand; PAM type: NRG; PAM sequence: TAG
ttttgacatgtaatattaaa

SEQ ID NO: 141598 - DNA, 20 bp, Artificial Sequence
  Description of Artificial Sequence: Synthetic oligonucleotide
  Target: ATXN1; (+) strand; PAM type: NRG; PAM sequence: TGG
tagcatcctattccttcctt

SEQ ID NO: 141599 - DNA, 20 bp, Artificial Sequence
  Description of Artificial Sequence: Synthetic oligonucleotide
  Target: ATXN1; (+) strand; PAM type: NRG; PAM sequence: AAG
atcctattccttcctttgga

SEQ ID NO: 141600 - DNA, 20 bp, Artificial Sequence
  Description of Artificial Sequence: Synthetic oligonucleotide
  Target: ATXN1; (+) strand; PAM type: NRG; PAM sequence: GAG
ttcctttggaaagaactttt

SEQ ID NO: 141601 - DNA, 20 bp, Artificial Sequence
  Description of Artificial Sequence: Synthetic oligonucleotide
  Target: ATXN1; (+) strand; PAM type: NRG; PAM sequence: AGG
tcctttggaaagaacttttg

SEQ ID NO: 141602 - DNA, 20 bp, Artificial Sequence
  Description of Artificial Sequence: Synthetic oligonucleotide
  Target: ATXN1; (+) strand; PAM type: NRG; PAM sequence: GAG
ctttggaaagaacttttgag

SEQ ID NO: 141603 - DNA, 20 bp, Artificial Sequence
  Description of Artificial Sequence: Synthetic oligonucleotide
  Target: ATXN1; (+) strand; PAM type: NRG; PAM sequence: TGG
ttgaggagccgaattaattt

SEQ ID NO: 141604 - DNA, 20 bp, Artificial Sequence
  Description of Artificial Sequence: Synthetic oligonucleotide
  Target: ATXN1; (+) strand; PAM type: NRG; PAM sequence: GAG
gaggagccgaattaattttg

SEQ ID NO: 141605 - DNA, 20 bp, Artificial Sequence
  Description of Artificial Sequence: Synthetic oligonucleotide
  Target: ATXN1; (+) strand; PAM type: NRG; PAM sequence: AAG
gatgacttttcattttattt

SEQ ID NO: 141606 - DNA, 20 bp, Artificial Sequence
  Description of Artificial Sequence: Synthetic oligonucleotide
  Target: ATXN1; (+) strand; PAM type: NRG; PAM sequence: AAG
cttttcattttatttaagcc

SEQ ID NO: 141607 - DNA, 20 bp, Artificial Sequence
  Description of Artificial Sequence: Synthetic oligonucleotide
  Target: ATXN1; (+) strand; PAM type: NRG; PAM sequence: TGG
caagttatttttttctcttt

SEQ ID NO: 141608 - DNA, 20 bp, Artificial Sequence
  Description of Artificial Sequence: Synthetic oligonucleotide
  Target: ATXN1; (+) strand; PAM type: NRG; PAM sequence: TAG
ttttttctcttttggtattt

SEQ ID NO: 141609 - DNA, 20 bp, Artificial Sequence
  Description of Artificial Sequence: Synthetic oligonucleotide
  Target: ATXN1; (+) strand; PAM type: NRG; PAM sequence: CAG
cttttggtattttagccaaa

SEQ ID NO: 141610 - DNA, 20 bp, Artificial Sequence
  Description of Artificial Sequence: Synthetic oligonucleotide
  Target: ATXN1; (+) strand; PAM type: NRG; PAM sequence: TAG
ttttagccaaacagaattct

SEQ ID NO: 141611 - DNA, 20 bp, Artificial Sequence
  Description of Artificial Sequence: Synthetic oligonucleotide
  Target: ATXN1; (+) strand; PAM type: NRG; PAM sequence: TAG
cttagaaatgaaaaaaaaaa

SEQ ID NO: 141612 - DNA, 20 bp, Artificial Sequence
  Description of Artificial Sequence: Synthetic oligonucleotide
  Target: ATXN1; (+) strand; PAM type: NRG; PAM sequence: AAG
atgaaaaaaaaaatagtaac

SEQ ID NO: 141613 - DNA, 20 bp, Artificial Sequence
  Description of Artificial Sequence: Synthetic oligonucleotide
  Target: ATXN1; (+) strand; PAM type: NRG; PAM sequence: TAG
aatagtaacaagtatattcc

SEQ ID NO: 141614 - DNA, 20 bp, Artificial Sequence
  Description of Artificial Sequence: Synthetic oligonucleotide
  Target: ATXN1; (+) strand; PAM type: NRG; PAM sequence: GAG
tagtaacaagtatattccta

SEQ ID NO: 141615 - DNA, 20 bp, Artificial Sequence
  Description of Artificial Sequence: Synthetic oligonucleotide
  Target: ATXN1; (+) strand; PAM type: NRG; PAM sequence: CAG
taacaagtatattcctagag

SEQ ID NO: 141616 - DNA, 20 bp, Artificial Sequence
  Description of Artificial Sequence: Synthetic oligonucleotide
  Target: ATXN1; (+) strand; PAM type: NRG; PAM sequence: GAG
acaagtatattcctagagca

SEQ ID NO: 141617 - DNA, 20 bp, Artificial Sequence
  Description of Artificial Sequence: Synthetic oligonucleotide
  Target: ATXN1; (+) strand; PAM type: NRG; PAM sequence: TAG
agtatattcctagagcagag

SEQ ID NO: 141618 - DNA, 20 bp, Artificial Sequence
  Description of Artificial Sequence: Synthetic oligonucleotide
  Target: ATXN1; (+) strand; PAM type: NRG; PAM sequence: CAG
cctagagcagagtagccttt

SEQ ID NO: 141619 - DNA, 20 bp, Artificial Sequence
  Description of Artificial Sequence: Synthetic oligonucleotide
  Target: ATXN1; (+) strand; PAM type: NRG; PAM sequence: CAG
atcaaccctttaatgttacc

SEQ ID NO: 141620 - DNA, 20 bp, Artificial Sequence
  Description of Artificial Sequence: Synthetic oligonucleotide
  Target: ATXN1; (+) strand; PAM type: NRG; PAM sequence: AAG
cagtctttttaaattccctt

SEQ ID NO: 141621 - DNA, 20 bp, Artificial Sequence
  Description of Artificial Sequence: Synthetic oligonucleotide
  Target: ATXN1; (+) strand; PAM type: NRG; PAM sequence: CAG
ttcccttaagaaaaaaatac

SEQ ID NO: 141622 - DNA, 20 bp, Artificial Sequence
  Description of Artificial Sequence: Synthetic oligonucleotide
  Target: ATXN1; (+) strand; PAM type: NRG; PAM sequence: TGG
taccagatattcacaaaatg

SEQ ID NO: 141623 - DNA, 20 bp, Artificial Sequence
  Description of Artificial Sequence: Synthetic oligonucleotide
  Target: ATXN1; (+) strand; PAM type: NRG; PAM sequence: CAG
agatattcacaaaatgtggc

SEQ ID NO: 141624 - DNA, 20 bp, Artificial Sequence
  Description of Artificial Sequence: Synthetic oligonucleotide
  Target: ATXN1; (+) strand; PAM type: NRG; PAM sequence: TGG
tcacaaaatgtggccagaac

SEQ ID NO: 141625 - DNA, 20 bp, Artificial Sequence
  Description of Artificial Sequence: Synthetic oligonucleotide
  Target: ATXN1; (+) strand; PAM type: NRG; PAM sequence: TGG
aactggatgtgtcatttatt

SEQ ID NO: 141626 - DNA, 20 bp, Artificial Sequence
  Description of Artificial Sequence: Synthetic oligonucleotide
  Target: ATXN1; (+) strand; PAM type: NRG; PAM sequence: TGG
atttatttggatttctgatt

SEQ ID NO: 141627 - DNA, 20 bp, Artificial Sequence
  Description of Artificial Sequence: Synthetic oligonucleotide
  Target: ATXN1; (+) strand; PAM type: NRG; PAM sequence: TGG
gatttctgatttggccgaca

SEQ ID NO: 141628 - DNA, 20 bp, Artificial Sequence
  Description of Artificial Sequence: Synthetic oligonucleotide
  Target: ATXN1; (+) strand; PAM type: NRG; PAM sequence: CAG
tggttatgcatgacataaaa

SEQ ID NO: 141629 - DNA, 20 bp, Artificial Sequence
  Description of Artificial Sequence: Synthetic oligonucleotide
  Target: ATXN1; (+) strand; PAM type: NRG; PAM sequence: TGG
cataaaacagtttaaaaaaa

SEQ ID NO: 141630 - DNA, 20 bp, Artificial Sequence
  Description of Artificial Sequence: Synthetic oligonucleotide
  Target: ATXN1; (+) strand; PAM type: NRG; PAM sequence: TAG
cagtttaaaaaaatggtttt

SEQ ID NO: 141631 - DNA, 20 bp, Artificial Sequence
  Description of Artificial Sequence: Synthetic oligonucleotide
  Target: ATXN1; (+) strand; PAM type: NRG; PAM sequence: TGG
ttttagtaacttcataaata

SEQ ID NO: 141632 - DNA, 20 bp, Artificial Sequence
  Description of Artificial Sequence: Synthetic oligonucleotide
  Target: ATXN1; (+) strand; PAM type: NRG; PAM sequence: CAG
aacttcataaatatggctta

SEQ ID NO: 141633 - DNA, 20 bp, Artificial Sequence
  Description of Artificial Sequence: Synthetic oligonucleotide
  Target: ATXN1; (+) strand; PAM type: NRG; PAM sequence: AAG
cataaatatggcttacagtg

SEQ ID NO: 141634 - DNA, 20 bp, Artificial Sequence
  Description of Artificial Sequence: Synthetic oligonucleotide
  Target: ATXN1; (+) strand; PAM type: NRG; PAM sequence: AAG
tatggcttacagtgaagctg

SEQ ID NO: 141635 - DNA, 20 bp, Artificial Sequence
  Description of Artificial Sequence: Synthetic oligonucleotide
  Target: ATXN1; (+) strand; PAM type: NRG; PAM sequence: TAG
gaagcaattctatctgatgt

SEQ ID NO: 141636 - DNA, 20 bp, Artificial Sequence
  Description of Artificial Sequence: Synthetic oligonucleotide
  Target: ATXN1; (+) strand; PAM type: NRG; PAM sequence: AAG
gttagaattttctaatgcca

SEQ ID NO: 141637 - DNA, 20 bp, Artificial Sequence
  Description of Artificial Sequence: Synthetic oligonucleotide
  Target: ATXN1; (+) strand; PAM type: NRG; PAM sequence: CAG
ctaatgccaaagatatacgc

SEQ ID NO: 141638 - DNA, 20 bp, Artificial Sequence
  Description of Artificial Sequence: Synthetic oligonucleotide
  Target: ATXN1; (+) strand; PAM type: NRG; PAM sequence: TAG
atgccaaagatatacgccag

SEQ ID NO: 141639 - DNA, 20 bp, Artificial Sequence
  Description of Artificial Sequence: Synthetic oligonucleotide
  Target: ATXN1; (+) strand; PAM type: NRG; PAM sequence: TAG
aaagatatacgccagtagtt

SEQ ID NO: 141640 - DNA, 20 bp, Artificial Sequence
  Description of Artificial Sequence: Synthetic oligonucleotide
  Target: ATXN1; (+) strand; PAM type: NRG; PAM sequence: GAG
tagtttagtttaaatgatgt

SEQ ID NO: 141641 - DNA, 20 bp, Artificial Sequence
  Description of Artificial Sequence: Synthetic oligonucleotide
  Target: ATXN1; (+) strand; PAM type: NRG; PAM sequence: AGG
agtttagtttaaatgatgtg

SEQ ID NO: 141642 - DNA, 20 bp, Artificial Sequence
  Description of Artificial Sequence: Synthetic oligonucleotide
  Target: ATXN1; (+) strand; PAM type: NRG; PAM sequence: TAG
tttttgtaatttttatgaaa

SEQ ID NO: 141643 - DNA, 20 bp, Artificial Sequence
  Description of Artificial Sequence: Synthetic oligonucleotide
  Target: ATXN1; (+) strand; PAM type: NRG; PAM sequence: TAG
aatttttatgaaatagtaat

SEQ ID NO: 141644 - DNA, 20 bp, Artificial Sequence
  Description of Artificial Sequence: Synthetic oligonucleotide
  Target: ATXN1; (+) strand; PAM type: NRG; PAM sequence: AAG
atgaaatagtaattagtact

SEQ ID NO: 141645 - DNA, 20 bp, Artificial Sequence
  Description of Artificial Sequence: Synthetic oligonucleotide
  Target: ATXN1; (+) strand; PAM type: NRG; PAM sequence: AAG
catttttaatatcttacctg

SEQ ID NO: 141646 - DNA, 20 bp, Artificial Sequence
  Description of Artificial Sequence: Synthetic oligonucleotide
  Target: ATXN1; (+) strand; PAM type: NRG; PAM sequence: AGG
atttttaatatcttacctga

SEQ ID NO: 141647 - DNA, 20 bp, Artificial Sequence
  Description of Artificial Sequence: Synthetic oligonucleotide
  Target: ATXN1; (+) strand; PAM type: NRG; PAM sequence: TGG
attatttctgtatttctaaa

SEQ ID NO: 141648 - DNA, 20 bp, Artificial Sequence
  Description of Artificial Sequence: Synthetic oligonucleotide
  Target: ATXN1; (+) strand; PAM type: NRG; PAM sequence: GGG
ttatttctgtatttctaaat

SEQ ID NO: 141649 - DNA, 20 bp, Artificial Sequence
  Description of Artificial Sequence: Synthetic oligonucleotide
  Target: ATXN1; (+) strand; PAM type: NRG; PAM sequence: CAG
ttattaaactgtattatatg

SEQ ID NO: 141650 - DNA, 20 bp, Artificial Sequence
  Description of Artificial Sequence: Synthetic oligonucleotide
  Target: ATXN1; (+) strand; PAM type: NRG; PAM sequence: AGG
tattaaactgtattatatgc

SEQ ID NO: 141651 - DNA, 20 bp, Artificial Sequence
  Description of Artificial Sequence: Synthetic oligonucleotide
  Target: ATXN1; (+) strand; PAM type: NRG; PAM sequence: TGG
aactgtattatatgcaggaa

SEQ ID NO: 141652 - DNA, 20 bp, Artificial Sequence
  Description of Artificial Sequence: Synthetic oligonucleotide
  Target: ATXN1; (+) strand; PAM type: NRG; PAM sequence: GGG
actgtattatatgcaggaat

SEQ ID NO: 141653 - DNA, 20 bp, Artificial Sequence
  Description of Artificial Sequence: Synthetic oligonucleotide
  Target: ATXN1; (+) strand; PAM type: NRG; PAM sequence: TGG
gcaggaatgggcttaacact

SEQ ID NO: 141654 - DNA, 20 bp, Artificial Sequence
  Description of Artificial Sequence: Synthetic oligonucleotide
  Target: ATXN1; (+) strand; PAM type: NRG; PAM sequence: AAG
gggcttaacacttggaatac

SEQ ID NO: 141655 - DNA, 20 bp, Artificial Sequence
  Description of Artificial Sequence: Synthetic oligonucleotide
  Target: ATXN1; (+) strand; PAM type: NRG; PAM sequence: AGG
ggcttaacacttggaataca

SEQ ID NO: 141656 - DNA, 20 bp, Artificial Sequence
  Description of Artificial Sequence: Synthetic oligonucleotide
  Target: ATXN1; (+) strand; PAM type: NRG; PAM sequence: AAG
acacttggaatacaaggttt

SEQ ID NO: 141657 - DNA, 20 bp, Artificial Sequence
  Description of Artificial Sequence: Synthetic oligonucleotide
  Target: ATXN1; (+) strand; PAM type: NRG; PAM sequence: AAG
tggaatacaaggtttaagat

SEQ ID NO: 141658 - DNA, 20 bp, Artificial Sequence
  Description of Artificial Sequence: Synthetic oligonucleotide
  Target: ATXN1; (+) strand; PAM type: NRG; PAM sequence: AAG
gtcttcatgaatcatttacc

SEQ ID NO: 141659 - DNA, 20 bp, Artificial Sequence
  Description of Artificial Sequence: Synthetic oligonucleotide
  Target: ATXN1; (+) strand; PAM type: NRG; PAM sequence: TAG
tcatgaatcatttaccaaga

SEQ ID NO: 141660 - DNA, 20 bp, Artificial Sequence
  Description of Artificial Sequence: Synthetic oligonucleotide
  Target: ATXN1; (+) strand; PAM type: NRG; PAM sequence: GAG
atttaccaagatagctatat

SEQ ID NO: 141661 - DNA, 20 bp, Artificial Sequence
  Description of Artificial Sequence: Synthetic oligonucleotide
  Target: ATXN1; (+) strand; PAM type: NRG; PAM sequence: CAG
taccaagatagctatatgag

SEQ ID NO: 141662 - DNA, 20 bp, Artificial Sequence
  Description of Artificial Sequence: Synthetic oligonucleotide
  Target: ATXN1; (+) strand; PAM type: NRG; PAM sequence: TAG
agcagaaaattgcaatataa

SEQ ID NO: 141663 - DNA, 20 bp, Artificial Sequence
  Description of Artificial Sequence: Synthetic oligonucleotide
  Target: ATXN1; (+) strand; PAM type: NRG; PAM sequence: CGG
agaaaattgcaatataatag

SEQ ID NO: 141664 - DNA, 20 bp, Artificial Sequence
  Description of Artificial Sequence: Synthetic oligonucleotide
  Target: ATXN1; (+) strand; PAM type: NRG; PAM sequence: CAG
gcaatataatagcggtaaca

SEQ ID NO: 141665 - DNA, 20 bp, Artificial Sequence
  Description of Artificial Sequence: Synthetic oligonucleotide
  Target: ATXN1; (+) strand; PAM type: NRG; PAM sequence: AAG
tataatagcggtaacacagc

SEQ ID NO: 141666 - DNA, 20 bp, Artificial Sequence
  Description of Artificial Sequence: Synthetic oligonucleotide
  Target: ATXN1; (+) strand; PAM type: NRG; PAM sequence: GAG
taatagcggtaacacagcaa

SEQ ID NO: 141667 - DNA, 20 bp, Artificial Sequence
  Description of Artificial Sequence: Synthetic oligonucleotide
  Target: ATXN1; (+) strand; PAM type: NRG; PAM sequence: AGG
aatagcggtaacacagcaag

SEQ ID NO: 141668 - DNA, 20 bp, Artificial Sequence
  Description of Artificial Sequence: Synthetic oligonucleotide
  Target: ATXN1; (+) strand; PAM type: NRG; PAM sequence: GAG
ttttgtttttttttttcctt

SEQ ID NO: 141669 - DNA, 20 bp, Artificial Sequence
  Description of Artificial Sequence: Synthetic oligonucleotide
  Target: ATXN1; (+) strand; PAM type: NRG; PAM sequence: GAG
tttttttttttccttgagac

SEQ ID NO: 141670 - DNA, 20 bp, Artificial Sequence
  Description of Artificial Sequence: Synthetic oligonucleotide
  Target: ATXN1; (+) strand; PAM type: NRG; PAM sequence: CAG
cgagctctctatctgttgcc

SEQ ID NO: 141671 - DNA, 20 bp, Artificial Sequence
  Description of Artificial Sequence: Synthetic oligonucleotide
  Target: ATXN1; (+) strand; PAM type: NRG; PAM sequence: AGG
gagctctctatctgttgccc

SEQ ID NO: 141672 - DNA, 20 bp, Artificial Sequence
  Description of Artificial Sequence: Synthetic oligonucleotide
  Target: ATXN1; (+) strand; PAM type: NRG; PAM sequence: TGG
tctctatctgttgcccaggc

SEQ ID NO: 141673 - DNA, 20 bp, Artificial Sequence
  Description of Artificial Sequence: Synthetic oligonucleotide
  Target: ATXN1; (+) strand; PAM type: NRG; PAM sequence: GAG
tctatctgttgcccaggctg

SEQ ID NO: 141674 - DNA, 20 bp, Artificial Sequence
  Description of Artificial Sequence: Synthetic oligonucleotide
  Target: ATXN1; (+) strand; PAM type: NRG; PAM sequence: TGG
atctgttgcccaggctggag

SEQ ID NO: 141675 - DNA, 20 bp, Artificial Sequence
  Description of Artificial Sequence: Synthetic oligonucleotide
  Target: ATXN1; (+) strand; PAM type: NRG; PAM sequence: TGG
ttgcccaggctggagtggaa

SEQ ID NO: 141676 - DNA, 20 bp, Artificial Sequence
  Description of Artificial Sequence: Synthetic oligonucleotide
  Target: ATXN1; (+) strand; PAM type: NRG; PAM sequence: CAG
caggctggagtggaatggtg

SEQ ID NO: 141677 - DNA, 20 bp, Artificial Sequence
  Description of Artificial Sequence: Synthetic oligonucleotide
  Target: ATXN1; (+) strand; PAM type: NRG; PAM sequence: TGG
atggtgcagtctaaactttc

SEQ ID NO: 141678 - DNA, 20 bp, Artificial Sequence
  Description of Artificial Sequence: Synthetic oligonucleotide
  Target: ATXN1; (+) strand; PAM type: NRG; PAM sequence: GGG
tggtgcagtctaaactttct

SEQ ID NO: 141679 - DNA, 20 bp, Artificial Sequence
  Description of Artificial Sequence: Synthetic oligonucleotide
  Target: ATXN1; (+) strand; PAM type: NRG; PAM sequence: AAG
agtctaaactttctgggctc

SEQ ID NO: 141680 - DNA, 20 bp, Artificial Sequence
  Description of Artificial Sequence: Synthetic oligonucleotide
  Target: ATXN1; (+) strand; PAM type: NRG; PAM sequence: CAG
ctcaagaaatcctcttccct

SEQ ID NO: 141681 - DNA, 20 bp, Artificial Sequence
  Description of Artificial Sequence: Synthetic oligonucleotide
  Target: ATXN1; (+) strand; PAM type: NRG; PAM sequence: CAG
ctctcaaaatgctgacatta

SEQ ID NO: 141682 - DNA, 20 bp, Artificial Sequence
  Description of Artificial Sequence: Synthetic oligonucleotide
  Target: ATXN1; (+) strand; PAM type: NRG; PAM sequence: GAG
aatgctgacattacagatgt

SEQ ID NO: 141683 - DNA, 20 bp, Artificial Sequence
  Description of Artificial Sequence: Synthetic oligonucleotide
  Target: ATXN1; (+) strand; PAM type: NRG; PAM sequence: TGG
cagatgtgagacaccatgct

SEQ ID NO: 141684 - DNA, 20 bp, Artificial Sequence
  Description of Artificial Sequence: Synthetic oligonucleotide
  Target: ATXN1; (+) strand; PAM type: NRG; PAM sequence: CAG
tgtgagacaccatgcttggc

SEQ ID NO: 141685 - DNA, 20 bp, Artificial Sequence
  Description of Artificial Sequence: Synthetic oligonucleotide
  Target: ATXN1; (+) strand; PAM type: NRG; PAM sequence: AGG
gtgagacaccatgcttggcc

SEQ ID NO: 141686 - DNA, 20 bp, Artificial Sequence
  Description of Artificial Sequence: Synthetic oligonucleotide
  Target: ATXN1; (+) strand; PAM type: NRG; PAM sequence: TAG
gcttggccaggaatttcaat

SEQ ID NO: 141687 - DNA, 20 bp, Artificial Sequence
  Description of Artificial Sequence: Synthetic oligonucleotide
  Target: ATXN1; (+) strand; PAM type: NRG; PAM sequence: AGG
cttggccaggaatttcaatt

SEQ ID NO: 141688 - DNA, 20 bp, Artificial Sequence
  Description of Artificial Sequence: Synthetic oligonucleotide
  Target: ATXN1; (+) strand; PAM type: NRG; PAM sequence: GAG
tcaattaggcctcaacgaat

SEQ ID NO: 141689 - DNA, 20 bp, Artificial Sequence
  Description of Artificial Sequence: Synthetic oligonucleotide
  Target: ATXN1; (+) strand; PAM type: NRG; PAM sequence: TGG
attaggcctcaacgaatgag

SEQ ID NO: 141690 - DNA, 20 bp, Artificial Sequence
  Description of Artificial Sequence: Synthetic oligonucleotide
  Target: ATXN1; (+) strand; PAM type: NRG; PAM sequence: GGG
ttaggcctcaacgaatgagt

SEQ ID NO: 141691 - DNA, 20 bp, Artificial Sequence
  Description of Artificial Sequence: Synthetic oligonucleotide
  Target: ATXN1; (+) strand; PAM type: NRG; PAM sequence: GAG
aggcctcaacgaatgagtgg

SEQ ID NO: 141692 - DNA, 20 bp, Artificial Sequence
  Description of Artificial Sequence: Synthetic oligonucleotide
  Target: ATXN1; (+) strand; PAM type: NRG; PAM sequence: CAG
acgaatgagtgggagtttac

SEQ ID NO: 141693 - DNA, 20 bp, Artificial Sequence
  Description of Artificial Sequence: Synthetic oligonucleotide
  Target: ATXN1; (+) strand; PAM type: NRG; PAM sequence: AGG
cgaatgagtgggagtttacc

SEQ ID NO: 141694 - DNA, 20 bp, Artificial Sequence
  Description of Artificial Sequence: Synthetic oligonucleotide
  Target: ATXN1; (+) strand; PAM type: NRG; PAM sequence: CAG
atgagtgggagtttaccagg

SEQ ID NO: 141695 - DNA, 20 bp, Artificial Sequence
  Description of Artificial Sequence: Synthetic oligonucleotide
  Target: ATXN1; (+) strand; PAM type: NRG; PAM sequence: GAG
gagtgggagtttaccaggca

SEQ ID NO: 141696 - DNA, 20 bp, Artificial Sequence
  Description of Artificial Sequence: Synthetic oligonucleotide
  Target: ATXN1; (+) strand; PAM type: NRG; PAM sequence: AAG
gagtttaccaggcagagaac

SEQ ID NO: 141697 - DNA, 20 bp, Artificial Sequence
  Description of Artificial Sequence: Synthetic oligonucleotide
  Target: ATXN1; (+) strand; PAM type: NRG; PAM sequence: GAG
gtttaccaggcagagaacaa

SEQ ID NO: 141698 - DNA, 20 bp, Artificial Sequence
  Description of Artificial Sequence: Synthetic oligonucleotide
  Target: ATXN1; (+) strand; PAM type: NRG; PAM sequence: GAG
agagaacaagagtctcatgc

SEQ ID NO: 141699 - DNA, 20 bp, Artificial Sequence
  Description of Artificial Sequence: Synthetic oligonucleotide
  Target: ATXN1; (+) strand; PAM type: NRG; PAM sequence: AAG
gaacaagagtctcatgcgag

SEQ ID NO: 141700 - DNA, 20 bp, Artificial Sequence
  Description of Artificial Sequence: Synthetic oligonucleotide
  Target: ATXN1; (+) strand; PAM type: NRG; PAM sequence: CAG
tctcatgcgagaagaaacaa

SEQ ID NO: 141701 - DNA, 20 bp, Artificial Sequence
  Description of Artificial Sequence: Synthetic oligonucleotide
  Target: ATXN1; (+) strand; PAM type: NRG; PAM sequence: AGG
ctcatgcgagaagaaacaac

SEQ ID NO: 141702 - DNA, 20 bp, Artificial Sequence
  Description of Artificial Sequence: Synthetic oligonucleotide
  Target: ATXN1; (+) strand; PAM type: NRG; PAM sequence: GGG
tcatgcgagaagaaacaaca

SEQ ID NO: 141703 - DNA, 20 bp, Artificial Sequence
  Description of Artificial Sequence: Synthetic oligonucleotide
  Target: ATXN1; (+) strand; PAM type: NRG; PAM sequence: CAG
gcgagaagaaacaacaggga

SEQ ID NO: 141704 - DNA, 20 bp, Artificial Sequence
  Description of Artificial Sequence: Synthetic oligonucleotide
  Target: ATXN1; (+) strand; PAM type: NRG; PAM sequence: AGG
cgagaagaaacaacagggac

SEQ ID NO: 141705 - DNA, 20 bp, Artificial Sequence
  Description of Artificial Sequence: Synthetic oligonucleotide
  Target: ATXN1; (+) strand; PAM type: NRG; PAM sequence: TGG
aaacaacagggacaggtgca

SEQ ID NO: 141706 - DNA, 20 bp, Artificial Sequence
  Description of Artificial Sequence: Synthetic oligonucleotide
  Target: ATXN1; (+) strand; PAM type: NRG; PAM sequence: TAG
gtgcatggttattatataca

SEQ ID NO: 141707 - DNA, 20 bp, Artificial Sequence
  Description of Artificial Sequence: Synthetic oligonucleotide
  Target: ATXN1; (+) strand; PAM type: NRG; PAM sequence: AAG
attatatacatagtatgttt

SEQ ID NO: 141708 - DNA, 20 bp, Artificial Sequence
  Description of Artificial Sequence: Synthetic oligonucleotide
  Target: ATXN1; (+) strand; PAM type: NRG; PAM sequence: AAG
atatacatagtatgtttaag

SEQ ID NO: 141709 - DNA, 20 bp, Artificial Sequence
  Description of Artificial Sequence: Synthetic oligonucleotide
  Target: ATXN1; (+) strand; PAM type: NRG; PAM sequence: TGG
agaagaaaacaaatattata

SEQ ID NO: 141710 - DNA, 20 bp, Artificial Sequence
  Description of Artificial Sequence: Synthetic oligonucleotide
  Target: ATXN1; (+) strand; PAM type: NRG; PAM sequence: GAG
aagaaaacaaatattatatg

SEQ ID NO: 141711 - DNA, 20 bp, Artificial Sequence
  Description of Artificial Sequence: Synthetic oligonucleotide
  Target: ATXN1; (+) strand; PAM type: NRG; PAM sequence: GAG
gaaaacaaatattatatgga

SEQ ID NO: 141712 - DNA, 20 bp, Artificial Sequence
  Description of Artificial Sequence: Synthetic oligonucleotide
  Target: ATXN1; (+) strand; PAM type: NRG; PAM sequence: TGG
acaaatattatatggagaga

SEQ ID NO: 141713 - DNA, 20 bp, Artificial Sequence
  Description of Artificial Sequence: Synthetic oligonucleotide
  Target: ATXN1; (+) strand; PAM type: NRG; PAM sequence: AAG
aatattatatggagagatgg

SEQ ID NO: 141714 - DNA, 20 bp, Artificial Sequence
  Description of Artificial Sequence: Synthetic oligonucleotide
  Target: ATXN1; (+) strand; PAM type: NRG; PAM sequence: AGG
atattatatggagagatgga

SEQ ID NO: 141715 - DNA, 20 bp, Artificial Sequence
  Description of Artificial Sequence: Synthetic oligonucleotide
  Target: ATXN1; (+) strand; PAM type: NRG; PAM sequence: GGG
tattatatggagagatggaa

SEQ ID NO: 141716 - DNA, 20 bp, Artificial Sequence
  Description of Artificial Sequence: Synthetic oligonucleotide
  Target: ATXN1; (+) strand; PAM type: NRG; PAM sequence: TGG
atatggagagatggaaggga

SEQ ID NO: 141717 - DNA, 20 bp, Artificial Sequence
  Description of Artificial Sequence: Synthetic oligonucleotide
  Target: ATXN1; (+) strand; PAM type: NRG; PAM sequence: GGG
tatggagagatggaagggat

SEQ ID NO: 141718 - DNA, 20 bp, Artificial Sequence
  Description of Artificial Sequence: Synthetic oligonucleotide
  Target: ATXN1; (+) strand; PAM type: NRG; PAM sequence: GAG
tggagagatggaagggatgg

SEQ ID NO: 141719 - DNA, 20 bp, Artificial Sequence
  Description of Artificial Sequence: Synthetic oligonucleotide
  Target: ATXN1; (+) strand; PAM type: NRG; PAM sequence: CGG
gatggaagggatgggagtca

SEQ ID NO: 141720 - DNA, 20 bp, Artificial Sequence
  Description of Artificial Sequence: Synthetic oligonucleotide
  Target: ATXN1; (+) strand; PAM type: NRG; PAM sequence: GGG
atggaagggatgggagtcac

SEQ ID NO: 141721 - DNA, 20 bp, Artificial Sequence
  Description of Artificial Sequence: Synthetic oligonucleotide
  Target: ATXN1; (+) strand; PAM type: NRG; PAM sequence: GAG
ggaagggatgggagtcacgg

SEQ ID NO: 141722 - DNA, 20 bp, Artificial Sequence
  Description of Artificial Sequence: Synthetic oligonucleotide
  Target: ATXN1; (+) strand; PAM type: NRG; PAM sequence: GAG
ggatgggagtcacgggagat

SEQ ID NO: 141723 - DNA, 20 bp, Artificial Sequence
  Description of Artificial Sequence: Synthetic oligonucleotide
  Target: ATXN1; (+) strand; PAM type: NRG; PAM sequence: TGG
cacgggagatgagatttaaa

SEQ ID NO: 141724 - DNA, 20 bp, Artificial Sequence
  Description of Artificial Sequence: Synthetic oligonucleotide
  Target: ATXN1; (+) strand; PAM type: NRG; PAM sequence: AAG
ggagatgagatttaaatggt

SEQ ID NO: 141725 - DNA, 20 bp, Artificial Sequence
  Description of Artificial Sequence: Synthetic oligonucleotide
  Target: ATXN1; (+) strand; PAM type: NRG; PAM sequence: AAG
gatttaaatggtaagttgat

SEQ ID NO: 141726 - DNA, 20 bp, Artificial Sequence
  Description of Artificial Sequence: Synthetic oligonucleotide
  Target: ATXN1; (+) strand; PAM type: NRG; PAM sequence: AGG
atttaaatggtaagttgata

SEQ ID NO: 141727 - DNA, 20 bp, Artificial Sequence
  Description of Artificial Sequence: Synthetic oligonucleotide
  Target: ATXN1; (+) strand; PAM type: NRG; PAM sequence: TAG
gtaagttgataaggaattcc

SEQ ID NO: 141728 - DNA, 20 bp, Artificial Sequence
  Description of Artificial Sequence: Synthetic oligonucleotide
  Target: ATXN1; (+) strand; PAM type: NRG; PAM sequence: AGG
taagttgataaggaattcct

SEQ ID NO: 141729 - DNA, 20 bp, Artificial Sequence
  Description of Artificial Sequence: Synthetic oligonucleotide
  Target: ATXN1; (+) strand; PAM type: NRG; PAM sequence: GGG
aagttgataaggaattccta

SEQ ID NO: 141730 - DNA, 20 bp, Artificial Sequence
  Description of Artificial Sequence: Synthetic oligonucleotide
  Target: ATXN1; (+) strand; PAM type: NRG; PAM sequence: GGG
agttgataaggaattcctag

SEQ ID NO: 141731 - DNA, 20 bp, Artificial Sequence
  Description of Artificial Sequence: Synthetic oligonucleotide
  Target: ATXN1; (+) strand; PAM type: NRG; PAM sequence: TAG
taaggaattcctaggggcct

SEQ ID NO: 141732 - DNA, 20 bp, Artificial Sequence
  Description of Artificial Sequence: Synthetic oligonucleotide
  Target: ATXN1; (+) strand; PAM type: NRG; PAM sequence: GAG
aggaattcctaggggcctta

SEQ ID NO: 141733 - DNA, 20 bp, Artificial Sequence
  Description of Artificial Sequence: Synthetic oligonucleotide
  Target: ATXN1; (+) strand; PAM type: NRG; PAM sequence: AGG
ggaattcctaggggccttag

SEQ ID NO: 141734 - DNA, 20 bp, Artificial Sequence
  Description of Artificial Sequence: Synthetic oligonucleotide
  Target: ATXN1; (+) strand; PAM type: NRG; PAM sequence: CAG
taggggccttagaggccatg

SEQ ID NO: 141735 - DNA, 20 bp, Artificial Sequence
  Description of Artificial Sequence: Synthetic oligonucleotide
  Target: ATXN1; (+) strand; PAM type: NRG; PAM sequence: CAG
aaattcacattttaccttat

SEQ ID NO: 141736 - DNA, 20 bp, Artificial Sequence
  Description of Artificial Sequence: Synthetic oligonucleotide
  Target: ATXN1; (+) strand; PAM type: NRG; PAM sequence: AGG
aattcacattttaccttatc

SEQ ID NO: 141737 - DNA, 20 bp, Artificial Sequence
  Description of Artificial Sequence: Synthetic oligonucleotide
  Target: ATXN1; (+) strand; PAM type: NRG; PAM sequence: GAG
ttcacattttaccttatcag

SEQ ID NO: 141738 - DNA, 20 bp, Artificial Sequence
  Description of Artificial Sequence: Synthetic oligonucleotide
  Target: ATXN1; (+) strand; PAM type: NRG; PAM sequence: CAG
acattttaccttatcaggag

SEQ ID NO: 141739 - DNA, 20 bp, Artificial Sequence
  Description of Artificial Sequence: Synthetic oligonucleotide
  Target: ATXN1; (+) strand; PAM type: NRG; PAM sequence: AAG
tttaccttatcaggagcaga

SEQ ID NO: 141740 - DNA, 20 bp, Artificial Sequence
  Description of Artificial Sequence: Synthetic oligonucleotide
  Target: ATXN1; (+) strand; PAM type: NRG; PAM sequence: AAG
accatattcatttgctacca

SEQ ID NO: 141741 - DNA, 20 bp, Artificial Sequence
  Description of Artificial Sequence: Synthetic oligonucleotide
  Target: ATXN1; (+) strand; PAM type: NRG; PAM sequence: AGG
ccatattcatttgctaccaa

SEQ ID NO: 141742 - DNA, 20 bp, Artificial Sequence
  Description of Artificial Sequence: Synthetic oligonucleotide
  Target: ATXN1; (+) strand; PAM type: NRG; PAM sequence: GAG
atattcatttgctaccaaag

SEQ ID NO: 141743 - DNA, 20 bp, Artificial Sequence
  Description of Artificial Sequence: Synthetic oligonucleotide
  Target: ATXN1; (+) strand; PAM type: NRG; PAM sequence: TAG
attcttgttttctttacttc

SEQ ID NO: 141744 - DNA, 20 bp, Artificial Sequence
  Description of Artificial Sequence: Synthetic oligonucleotide
  Target: ATXN1; (+) strand; PAM type: NRG; PAM sequence: TGG
ttctttacttctagcctttg

SEQ ID NO: 141745 - DNA, 20 bp, Artificial Sequence
  Description of Artificial Sequence: Synthetic oligonucleotide
  Target: ATXN1; (+) strand; PAM type: NRG; PAM sequence: TAG
ttacttctagcctttgtgga

SEQ ID NO: 141746 - DNA, 20 bp, Artificial Sequence
  Description of Artificial Sequence: Synthetic oligonucleotide
  Target: ATXN1; (+) strand; PAM type: NRG; PAM sequence: AGG
tacttctagcctttgtggat

SEQ ID NO: 141747 - DNA, 20 bp, Artificial Sequence
  Description of Artificial Sequence: Synthetic oligonucleotide
  Target: ATXN1; (+) strand; PAM type: NRG; PAM sequence: TAG
ctagcctttgtggataggca

SEQ ID NO: 141748 - DNA, 20 bp, Artificial Sequence
  Description of Artificial Sequence: Synthetic oligonucleotide
  Target: ATXN1; (+) strand; PAM type: NRG; PAM sequence: TGG
attttatacttaacatttgt

SEQ ID NO: 141749 - DNA, 20 bp, Artificial Sequence
  Description of Artificial Sequence: Synthetic oligonucleotide
  Target: ATXN1; (+) strand; PAM type: NRG; PAM sequence: GGG
ttttatacttaacatttgtt

SEQ ID NO: 141750 - DNA, 20 bp, Artificial Sequence
  Description of Artificial Sequence: Synthetic oligonucleotide
  Target: ATXN1; (+) strand; PAM type: NRG; PAM sequence: TAG
tacttaacatttgttgggtt

SEQ ID NO: 141751 - DNA, 20 bp, Artificial Sequence
  Description of Artificial Sequence: Synthetic oligonucleotide
  Target: ATXN1; (+) strand; PAM type: NRG; PAM sequence: AAG
catttgttgggtttagccga

SEQ ID NO: 141752 - DNA, 20 bp, Artificial Sequence
  Description of Artificial Sequence: Synthetic oligonucleotide
  Target: ATXN1; (+) strand; PAM type: NRG; PAM sequence: AAG
gctgccttcttccatatttt

SEQ ID NO: 141753 - DNA, 20 bp, Artificial Sequence
  Description of Artificial Sequence: Synthetic oligonucleotide
  Target: ATXN1; (+) strand; PAM type: NRG; PAM sequence: TGG
cttcttccatattttaagtt

SEQ ID NO: 141754 - DNA, 20 bp, Artificial Sequence
  Description of Artificial Sequence: Synthetic oligonucleotide
  Target: ATXN1; (+) strand; PAM type: NRG; PAM sequence: AAG
catattttaagtttggccta

SEQ ID NO: 141755 - DNA, 20 bp, Artificial Sequence
  Description of Artificial Sequence: Synthetic oligonucleotide
  Target: ATXN1; (+) strand; PAM type: NRG; PAM sequence: AGG
atattttaagtttggcctaa

SEQ ID NO: 141756 - DNA, 20 bp, Artificial Sequence
  Description of Artificial Sequence: Synthetic oligonucleotide
  Target: ATXN1; (+) strand; PAM type: NRG; PAM sequence: CAG
cctaaaggtttctccgcatg

SEQ ID NO: 141757 - DNA, 20 bp, Artificial Sequence
  Description of Artificial Sequence: Synthetic oligonucleotide
  Target: ATXN1; (+) strand; PAM type: NRG; PAM sequence: TGG
gcagtgaaccgtaacctacc

SEQ ID NO: 141758 - DNA, 20 bp, Artificial Sequence
  Description of Artificial Sequence: Synthetic oligonucleotide
  Target: ATXN1; (+) strand; PAM type: NRG; PAM sequence: CAG
aacctacctggatgtgtaaa

SEQ ID NO: 141759 - DNA, 20 bp, Artificial Sequence
  Description of Artificial Sequence: Synthetic oligonucleotide
  Target: ATXN1; (+) strand; PAM type: NRG; PAM sequence: AGG
acctacctggatgtgtaaac

SEQ ID NO: 141760 - DNA, 20 bp, Artificial Sequence
  Description of Artificial Sequence: Synthetic oligonucleotide
  Target: ATXN1; (+) strand; PAM type: NRG; PAM sequence: TGG
cctattcttgtaccaatctc

SEQ ID NO: 141761 - DNA, 20 bp, Artificial Sequence
  Description of Artificial Sequence: Synthetic oligonucleotide
  Target: ATXN1; (+) strand; PAM type: NRG; PAM sequence: GGG
ctattcttgtaccaatctct

SEQ ID NO: 141762 - DNA, 20 bp, Artificial Sequence
  Description of Artificial Sequence: Synthetic oligonucleotide
  Target: ATXN1; (+) strand; PAM type: NRG; PAM sequence: CGG
ttgtaccaatctctgggttt

SEQ ID NO: 141763 - DNA, 20 bp, Artificial Sequence
  Description of Artificial Sequence: Synthetic oligonucleotide
  Target: ATXN1; (+) strand; PAM type: NRG; PAM sequence: CAG
ctctgggtttcggcgaatca

SEQ ID NO: 141764 - DNA, 20 bp, Artificial Sequence
  Description of Artificial Sequence: Synthetic oligonucleotide
  Target: ATXN1; (+) strand; PAM type: NRG; PAM sequence: AGG
tctgggtttcggcgaatcac

SEQ ID NO: 141765 - DNA, 20 bp, Artificial Sequence
  Description of Artificial Sequence: Synthetic oligonucleotide
  Target: ATXN1; (+) strand; PAM type: NRG; PAM sequence: CAG
gggtttcggcgaatcacagg

SEQ ID NO: 141766 - DNA, 20 bp, Artificial Sequence
  Description of Artificial Sequence: Synthetic oligonucleotide
  Target: ATXN1; (+) strand; PAM type: NRG; PAM sequence: AAG
cgttcaaaccctgttcaaat

SEQ ID NO: 141767 - DNA, 20 bp, Artificial Sequence
  Description of Artificial Sequence: Synthetic oligonucleotide
  Target: ATXN1; (+) strand; PAM type: NRG; PAM sequence: AGG
gttcaaaccctgttcaaata

SEQ ID NO: 141768 - DNA, 20 bp, Artificial Sequence
  Description of Artificial Sequence: Synthetic oligonucleotide
  Target: ATXN1; (+) strand; PAM type: NRG; PAM sequence: GAG
gttcaaataaggcgaacgct

SEQ ID NO: 141769 - DNA, 20 bp, Artificial Sequence
  Description of Artificial Sequence: Synthetic oligonucleotide
  Target: ATXN1; (+) strand; PAM type: NRG; PAM sequence: TGG
acgctgagctgaaaccaatc

SEQ ID NO: 141770 - DNA, 20 bp, Artificial Sequence
  Description of Artificial Sequence: Synthetic oligonucleotide
  Target: ATXN1; (+) strand; PAM type: NRG; PAM sequence: CAG
aatcctctccaaccacacaa

SEQ ID NO: 141771 - DNA, 20 bp, Artificial Sequence
  Description of Artificial Sequence: Synthetic oligonucleotide
  Target: ATXN1; (+) strand; PAM type: NRG; PAM sequence: CAG
ccaaccacacaacagcatgt

SEQ ID NO: 141772 - DNA, 20 bp, Artificial Sequence
  Description of Artificial Sequence: Synthetic oligonucleotide
  Target: ATXN1; (+) strand; PAM type: NRG; PAM sequence: TAG
gaaatgccctgaatctattc

SEQ ID NO: 141773 - DNA, 20 bp, Artificial Sequence
  Description of Artificial Sequence: Synthetic oligonucleotide
  Target: ATXN1; (+) strand; PAM type: NRG; PAM sequence: CGG
gccctgaatctattctagtt

SEQ ID NO: 141774 - DNA, 20 bp, Artificial Sequence
  Description of Artificial Sequence: Synthetic oligonucleotide
  Target: ATXN1; (+) strand; PAM type: NRG; PAM sequence: GGG
ccctgaatctattctagttc

SEQ ID NO: 141775 - DNA, 20 bp, Artificial Sequence
  Description of Artificial Sequence: Synthetic oligonucleotide
  Target: ATXN1; (+) strand; PAM type: NRG; PAM sequence: GAG
ctgaatctattctagttcgg

SEQ ID NO: 141776 - DNA, 20 bp, Artificial Sequence
  Description of Artificial Sequence: Synthetic oligonucleotide
  Target: ATXN1; (+) strand; PAM type: NRG; PAM sequence: AGG
tgaatctattctagttcggg

SEQ ID NO: 141777 - DNA, 20 bp, Artificial Sequence
  Description of Artificial Sequence: Synthetic oligonucleotide
  Target: ATXN1; (+) strand; PAM type: NRG; PAM sequence: AAG
tctattctagttcgggagga

SEQ ID NO: 141778 - DNA, 20 bp, Artificial Sequence
  Description of Artificial Sequence: Synthetic oligonucleotide
  Target: ATXN1; (+) strand; PAM type: NRG; PAM sequence: AGG
ctattctagttcgggaggaa

SEQ ID NO: 141779 - DNA, 20 bp, Artificial Sequence
  Description of Artificial Sequence: Synthetic oligonucleotide
  Target: ATXN1; (+) strand; PAM type: NRG; PAM sequence: GAG
attctagttcgggaggaaag

SEQ ID NO: 141780 - DNA, 20 bp, Artificial Sequence
  Description of Artificial Sequence: Synthetic oligonucleotide
  Target: ATXN1; (+) strand; PAM type: NRG; PAM sequence: TAG
ctagttcgggaggaaaggag

SEQ ID NO: 141781 - DNA, 20 bp, Artificial Sequence
  Description of Artificial Sequence: Synthetic oligonucleotide
  Target: ATXN1; (+) strand; PAM type: NRG; PAM sequence: GAG
agttcgggaggaaaggagta

SEQ ID NO: 141782 - DNA, 20 bp, Artificial Sequence
  Description of Artificial Sequence: Synthetic oligonucleotide
  Target: ATXN1; (+) strand; PAM type: NRG; PAM sequence: GAG
ttcgggaggaaaggagtaga

SEQ ID NO: 141783 - DNA, 20 bp, Artificial Sequence
  Description of Artificial Sequence: Synthetic oligonucleotide
  Target: ATXN1; (+) strand; PAM type: NRG; PAM sequence: AGG
tcgggaggaaaggagtagag

SEQ ID NO: 141784 - DNA, 20 bp, Artificial Sequence
  Description of Artificial Sequence: Synthetic oligonucleotide
  Target: ATXN1; (+) strand; PAM type: NRG; PAM sequence: GAG
gggaggaaaggagtagagag

SEQ ID NO: 141785 - DNA, 20 bp, Artificial Sequence
  Description of Artificial Sequence: Synthetic oligonucleotide
  Target: ATXN1; (+) strand; PAM type: NRG; PAM sequence: TAG
ggagctgcctgatttgcaaa

SEQ ID NO: 141786 - DNA, 20 bp, Artificial Sequence
  Description of Artificial Sequence: Synthetic oligonucleotide
  Target: ATXN1; (+) strand; PAM type: NRG; PAM sequence: AAG
tgttaaatttaatttgtcta

SEQ ID NO: 141787 - DNA, 20 bp, Artificial Sequence
  Description of Artificial Sequence: Synthetic oligonucleotide
  Target: ATXN1; (+) strand; PAM type: NRG; PAM sequence: TAG
aagtttttcttttaacacat

SEQ ID NO: 141788 - DNA, 20 bp, Artificial Sequence
  Description of Artificial Sequence: Synthetic oligonucleotide
  Target: ATXN1; (+) strand; PAM type: NRG; PAM sequence: GAG
cttttaacacattagattat

SEQ ID NO: 141789 - DNA, 20 bp, Artificial Sequence
  Description of Artificial Sequence: Synthetic oligonucleotide
  Target: ATXN1; (+) strand; PAM type: NRG; PAM sequence: AAG
ccatatttccacatactacc

SEQ ID NO: 141790 - DNA, 20 bp, Artificial Sequence
  Description of Artificial Sequence: Synthetic oligonucleotide
  Target: ATXN1; (+) strand; PAM type: NRG; PAM sequence: AGG
catatttccacatactacca

SEQ ID NO: 141791 - DNA, 20 bp, Artificial Sequence
  Description of Artificial Sequence: Synthetic oligonucleotide
  Target: ATXN1; (+) strand; PAM type: NRG; PAM sequence: AAG
acatactaccaaggattttc

SEQ ID NO: 141792 - DNA, 20 bp, Artificial Sequence
  Description of Artificial Sequence: Synthetic oligonucleotide
  Target: ATXN1; (+) strand; PAM type: NRG; PAM sequence: TAG
ctaccaaggattttcaagtg

SEQ ID NO: 141793 - DNA, 20 bp, Artificial Sequence
  Description of Artificial Sequence: Synthetic oligonucleotide
  Target: ATXN1; (+) strand; PAM type: NRG; PAM sequence: AGG
taccaaggattttcaagtgt

SEQ ID NO: 141794 - DNA, 20 bp, Artificial Sequence
  Description of Artificial Sequence: Synthetic oligonucleotide
  Target: ATXN1; (+) strand; PAM type: NRG; PAM sequence: GAG
ccaaggattttcaagtgtag

SEQ ID NO: 141795 - DNA, 20 bp, Artificial Sequence
  Description of Artificial Sequence: Synthetic oligonucleotide
  Target: ATXN1; (+) strand; PAM type: NRG; PAM sequence: CAG
aagtgtaggagtaattcaat

SEQ ID NO: 141796 - DNA, 20 bp, Artificial Sequence
  Description of Artificial Sequence: Synthetic oligonucleotide
  Target: ATXN1; (+) strand; PAM type: NRG; PAM sequence: GAG
tcagaccctttctttcatat

SEQ ID NO: 141797 - DNA, 20 bp, Artificial Sequence
  Description of Artificial Sequence: Synthetic oligonucleotide
  Target: ATXN1; (+) strand; PAM type: NRG; PAM sequence: AAG
tttcatatgagaattctcaa

SEQ ID NO: 141798 - DNA, 20 bp, Artificial Sequence
  Description of Artificial Sequence: Synthetic oligonucleotide
  Target: ATXN1; (+) strand; PAM type: NRG; PAM sequence: GAG
tcatatgagaattctcaaaa

SEQ ID NO: 141799 - DNA, 20 bp, Artificial Sequence
  Description of Artificial Sequence: Synthetic oligonucleotide
  Target: ATXN1; (+) strand; PAM type: NRG; PAM sequence: TAG
tatgagaattctcaaaagag

SEQ ID NO: 141800 - DNA, 20 bp, Artificial Sequence
  Description of Artificial Sequence: Synthetic oligonucleotide
  Target: ATXN1; (+) strand; PAM type: NRG; PAM sequence: TGG
tctcaaaagagtagaataaa

SEQ ID NO: 141801 - DNA, 20 bp, Artificial Sequence
  Description of Artificial Sequence: Synthetic oligonucleotide
  Target: ATXN1; (+) strand; PAM type: NRG; PAM sequence: CAG
agagtagaataaatggaaca

SEQ ID NO: 141802 - DNA, 20 bp, Artificial Sequence
  Description of Artificial Sequence: Synthetic oligonucleotide
  Target: ATXN1; (+) strand; PAM type: NRG; PAM sequence: AAG
tagaataaatggaacacaga

SEQ ID NO: 141803 - DNA, 20 bp, Artificial Sequence
  Description of Artificial Sequence: Synthetic oligonucleotide
  Target: ATXN1; (+) strand; PAM type: NRG; PAM sequence: AAG
taaatggaacacagaaagaa

SEQ ID NO: 141804 - DNA, 20 bp, Artificial Sequence
  Description of Artificial Sequence: Synthetic oligonucleotide
  Target: ATXN1; (+) strand; PAM type: NRG; PAM sequence: AAG
acacagaaagaaaagacttt

SEQ ID NO: 141805 - DNA, 20 bp, Artificial Sequence
  Description of Artificial Sequence: Synthetic oligonucleotide
  Target: ATXN1; (+) strand; PAM type: NRG; PAM sequence: AAG
agaaagaaaagactttaagc

SEQ ID NO: 141806 - DNA, 20 bp, Artificial Sequence
  Description of Artificial Sequence: Synthetic oligonucleotide
  Target: ATXN1; (+) strand; PAM type: NRG; PAM sequence: AGG
gaaagaaaagactttaagca

SEQ ID NO: 141807 - DNA, 20 bp, Artificial Sequence
  Description of Artificial Sequence: Synthetic oligonucleotide
  Target: ATXN1; (+) strand; PAM type: NRG; PAM sequence: GGG
aaagaaaagactttaagcaa

SEQ ID NO: 141808 - DNA, 20 bp, Artificial Sequence
  Description of Artificial Sequence: Synthetic oligonucleotide
  Target: ATXN1; (+) strand; PAM type: NRG; PAM sequence: GGG
aagaaaagactttaagcaag

SEQ ID NO: 141809 - DNA, 20 bp, Artificial Sequence
  Description of Artificial Sequence: Synthetic oligonucleotide
  Target: ATXN1; (+) strand; PAM type: NRG; PAM sequence: TGG
actttaagcaaggggcttct

SEQ ID NO: 141810 - DNA, 20 bp, Artificial Sequence
  Description of Artificial Sequence: Synthetic oligonucleotide
  Target: ATXN1; (+) strand; PAM type: NRG; PAM sequence: AAG
ttaagcaaggggcttcttgg

SEQ ID NO: 141811 - DNA, 20 bp, Artificial Sequence
  Description of Artificial Sequence: Synthetic oligonucleotide
  Target: ATXN1; (+) strand; PAM type: NRG; PAM sequence: CAG
gggcttcttggaagccactg

SEQ ID NO: 141812 - DNA, 20 bp, Artificial Sequence
  Description of Artificial Sequence: Synthetic oligonucleotide
  Target: ATXN1; (+) strand; PAM type: NRG; PAM sequence: CAG
cttcttggaagccactgcag

SEQ ID NO: 141813 - DNA, 20 bp, Artificial Sequence
  Description of Artificial Sequence: Synthetic oligonucleotide
  Target: ATXN1; (+) strand; PAM type: NRG; PAM sequence: CAG
tggaagccactgcagcagtc

SEQ ID NO: 141814 - DNA, 20 bp, Artificial Sequence
  Description of Artificial Sequence: Synthetic oligonucleotide
  Target: ATXN1; (+) strand; PAM type: NRG; PAM sequence: AGG
ggaagccactgcagcagtcc

SEQ ID NO: 141815 - DNA, 20 bp, Artificial Sequence
  Description of Artificial Sequence: Synthetic oligonucleotide
  Target: ATXN1; (+) strand; PAM type: NRG; PAM sequence: AAG
gccactgcagcagtccaggc

SEQ ID NO: 141816 - DNA, 20 bp, Artificial Sequence
  Description of Artificial Sequence: Synthetic oligonucleotide
  Target: ATXN1; (+) strand; PAM type: NRG; PAM sequence: AAG
agtccaggcaagtgatgctg

SEQ ID NO: 141817 - DNA, 20 bp, Artificial Sequence
  Description of Artificial Sequence: Synthetic oligonucleotide
  Target: ATXN1; (+) strand; PAM type: NRG; PAM sequence: AGG
gtccaggcaagtgatgctga

SEQ ID NO: 141818 - DNA, 20 bp, Artificial Sequence
  Description of Artificial Sequence: Synthetic oligonucleotide
  Target: ATXN1; (+) strand; PAM type: NRG; PAM sequence: CAG
gtgatgctgaaggtctgcaa

SEQ ID NO: 141819 - DNA, 20 bp, Artificial Sequence
  Description of Artificial Sequence: Synthetic oligonucleotide
  Target: ATXN1; (+) strand; PAM type: NRG; PAM sequence: CAG
gctgaaggtctgcaacagaa

SEQ ID NO: 141820 - DNA, 20 bp, Artificial Sequence
  Description of Artificial Sequence: Synthetic oligonucleotide
  Target: ATXN1; (+) strand; PAM type: NRG; PAM sequence: AGG
ctgaaggtctgcaacagaac

SEQ ID NO: 141821 - DNA, 20 bp, Artificial Sequence
  Description of Artificial Sequence: Synthetic oligonucleotide
  Target: ATXN1; (+) strand; PAM type: NRG; PAM sequence: GGG
tgaaggtctgcaacagaaca

SEQ ID NO: 141822 - DNA, 20 bp, Artificial Sequence
  Description of Artificial Sequence: Synthetic oligonucleotide
  Target: ATXN1; (+) strand; PAM type: NRG; PAM sequence: GGG
gaaggtctgcaacagaacag

SEQ ID NO: 141823 - DNA, 20 bp, Artificial Sequence
  Description of Artificial Sequence: Synthetic oligonucleotide
  Target: ATXN1; (+) strand; PAM type: NRG; PAM sequence: GAG
ctgcaacagaacaggggccc

SEQ ID NO: 141824 - DNA, 20 bp, Artificial Sequence
  Description of Artificial Sequence: Synthetic oligonucleotide
  Target: ATXN1; (+) strand; PAM type: NRG; PAM sequence: GAG
gcaacagaacaggggcccga

SEQ ID NO: 141825 - DNA, 20 bp, Artificial Sequence
  Description of Artificial Sequence: Synthetic oligonucleotide
  Target: ATXN1; (+) strand; PAM type: NRG; PAM sequence: TGG
acagaacaggggcccgagag

SEQ ID NO: 141826 - DNA, 20 bp, Artificial Sequence
  Description of Artificial Sequence: Synthetic oligonucleotide
  Target: ATXN1; (+) strand; PAM type: NRG; PAM sequence: GAG
agaacaggggcccgagagtg

SEQ ID NO: 141827 - DNA, 20 bp, Artificial Sequence
  Description of Artificial Sequence: Synthetic oligonucleotide
  Target: ATXN1; (+) strand; PAM type: NRG; PAM sequence: AAG
acaggggcccgagagtggag

SEQ ID NO: 141828 - DNA, 20 bp, Artificial Sequence
  Description of Artificial Sequence: Synthetic oligonucleotide
  Target: ATXN1; (+) strand; PAM type: NRG; PAM sequence: GAG
aggggcccgagagtggagaa

SEQ ID NO: 141829 - DNA, 20 bp, Artificial Sequence
  Description of Artificial Sequence: Synthetic oligonucleotide
  Target: ATXN1; (+) strand; PAM type: NRG; PAM sequence: TGG
ggcccgagagtggagaagag

SEQ ID NO: 141830 - DNA, 20 bp, Artificial Sequence
  Description of Artificial Sequence: Synthetic oligonucleotide
  Target: ATXN1; (+) strand; PAM type: NRG; PAM sequence: GGG
gcccgagagtggagaagagt

SEQ ID NO: 141831 - DNA, 20 bp, Artificial Sequence
  Description of Artificial Sequence: Synthetic oligonucleotide
  Target: ATXN1; (+) strand; PAM type: NRG; PAM sequence: AAG
gtgggtaaactatcatatta

SEQ ID NO: 141832 - DNA, 20 bp, Artificial Sequence
  Description of Artificial Sequence: Synthetic oligonucleotide
  Target: ATXN1; (+) strand; PAM type: NRG; PAM sequence: GAG
gggtaaactatcatattaaa

SEQ ID NO: 141833 - DNA, 20 bp, Artificial Sequence
  Description of Artificial Sequence: Synthetic oligonucleotide
  Target: ATXN1; (+) strand; PAM type: NRG; PAM sequence: AGG
ggtaaactatcatattaaag

SEQ ID NO: 141834 - DNA, 20 bp, Artificial Sequence
  Description of Artificial Sequence: Synthetic oligonucleotide
  Target: ATXN1; (+) strand; PAM type: NRG; PAM sequence: CAG
catattaaagaggccaaact

SEQ ID NO: 141835 - DNA, 20 bp, Artificial Sequence
  Description of Artificial Sequence: Synthetic oligonucleotide
  Target: ATXN1; (+) strand; PAM type: NRG; PAM sequence: TGG
taaagaggccaaactcagac

SEQ ID NO: 141836 - DNA, 20 bp, Artificial Sequence
  Description of Artificial Sequence: Synthetic oligonucleotide
  Target: ATXN1; (+) strand; PAM type: NRG; PAM sequence: GGG
aaagaggccaaactcagact

SEQ ID NO: 141837 - DNA, 20 bp, Artificial Sequence
  Description of Artificial Sequence: Synthetic oligonucleotide
  Target: ATXN1; (+) strand; PAM type: NRG; PAM sequence: GGG
aagaggccaaactcagactg

SEQ ID NO: 141838 - DNA, 20 bp, Artificial Sequence
  Description of Artificial Sequence: Synthetic oligonucleotide
  Target: ATXN1; (+) strand; PAM type: NRG; PAM sequence: GGG
agaggccaaactcagactgg

SEQ ID NO: 141839 - DNA, 20 bp, Artificial Sequence
  Description of Artificial Sequence: Synthetic oligonucleotide
  Target: ATXN1; (+) strand; PAM type: NRG; PAM sequence: CAG
ggccaaactcagactggggg

SEQ ID NO: 141840 - DNA, 20 bp, Artificial Sequence
  Description of Artificial Sequence: Synthetic oligonucleotide
  Target: ATXN1; (+) strand; PAM type: NRG; PAM sequence: TGG
caaactcagactgggggcag

SEQ ID NO: 141841 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccaacactt

SEQ ID NO: 141842 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccaacacttt

SEQ ID NO: 141843 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccaacactttgg

SEQ ID NO: 141844 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccaacactttggg

SEQ ID NO: 141845 - DNA, 20 bp, Artificial Sequence
  Description of Artificial Sequence: Synthetic oligonucleotide
  Target: ATXN1; (+) strand; PAM type: NRG; PAM sequence: TAG
tcccaacactttgggaggct

SEQ ID NO: 141846 - DNA, 20 bp, Artificial Sequence
  Description of Artificial Sequence: Synthetic oligonucleotide
  Target: ATXN1; (+) strand; PAM type: NRG; PAM sequence: AGG
cccaacactttgggaggctt

SEQ ID NO: 141847 - DNA, 20 bp, Artificial Sequence
  Description of Artificial Sequence: Synthetic oligonucleotide
  Target: ATXN1; (+) strand; PAM type: NRG; PAM sequence: CAG
aacactttgggaggcttagg

SEQ ID NO: 141848 - DNA, 20 bp, Artificial Sequence
  Description of Artificial Sequence: Synthetic oligonucleotide
  Target: ATXN1; (+) strand; PAM type: NRG; PAM sequence: AGG
acactttgggaggcttaggc

SEQ ID NO: 141849 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggcttaggcagg

SEQ ID NO: 141850 - DNA, 20 bp, Artificial Sequence
  Description of Artificial Sequence: Synthetic oligonucleotide
  Target: ATXN1; (+) strand; PAM type: NRG; PAM sequence: GAG
ggcttaggcaggcggatcat

SEQ ID NO: 141851 - DNA, 20 bp, Artificial Sequence
  Description of Artificial Sequence: Synthetic oligonucleotide
  Target: ATXN1; (+) strand; PAM type: NRG; PAM sequence: AGG
gcttaggcaggcggatcatg

SEQ ID NO: 141852 - DNA, 20 bp, Artificial Sequence
  Description of Artificial Sequence: Synthetic oligonucleotide
  Target: ATXN1; (+) strand; PAM type: NRG; PAM sequence: CAG
aggcaggcggatcatgaggt

SEQ ID NO: 141853 - DNA, 20 bp, Artificial Sequence
  Description of Artificial Sequence: Synthetic oligonucleotide
  Target: ATXN1; (+) strand; PAM type: NRG; PAM sequence: AGG
ggcaggcggatcatgaggtc

SEQ ID NO: 141854 - DNA, 20 bp, Artificial Sequence
  Description of Artificial Sequence: Synthetic oligonucleotide
  Target: ATXN1; (+) strand; PAM type: NRG; PAM sequence: GAG
caggcggatcatgaggtcag

SEQ ID NO: 141855 - DNA, 20 bp, Artificial Sequence
  Description of Artificial Sequence: Synthetic oligonucleotide
  Target: ATXN1; (+) strand; PAM type: NRG; PAM sequence: GAG
gatcatgaggtcaggagttt

SEQ ID NO: 141856 - DNA, 20 bp, Artificial Sequence
  Description of Artificial Sequence: Synthetic oligonucleotide
  Target: ATXN1; (+) strand; PAM type: NRG; PAM sequence: TGG
tgagaccaacctgaccaaca

SEQ ID NO: 141857 - DNA, 20 bp, Artificial Sequence
  Description of Artificial Sequence: Synthetic oligonucleotide
  Target: ATXN1; (+) strand; PAM type: NRG; PAM sequence: TAG
ctaccaaaaatacaaaaaat

SEQ ID NO: 141858 - DNA, 20 bp, Artificial Sequence
  Description of Artificial Sequence: Synthetic oligonucleotide
  Target: ATXN1; (+) strand; PAM type: NRG; PAM sequence: CAG
caaaaatacaaaaaattagc

SEQ ID NO: 141859 - DNA, 20 bp, Artificial Sequence
  Description of Artificial Sequence: Synthetic oligonucleotide
  Target: ATXN1; (+) strand; PAM type: NRG; PAM sequence: AGG
aaaaatacaaaaaattagcc

SEQ ID NO: 141860 - DNA, 20 bp, Artificial Sequence
  Description of Artificial Sequence: Synthetic oligonucleotide
  Target: ATXN1; (+) strand; PAM type: NRG; PAM sequence: TGG
tacaaaaaattagccaggtg

SEQ ID NO: 141861 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccaggtgtgg

SEQ ID NO: 141862 - DNA, 20 bp, Artificial Sequence
  Description of Artificial Sequence: Synthetic oligonucleotide
  Target: ATXN1; (+) strand; PAM type: NRG; PAM sequence: AAG
gtggtgcgcacctgtaatcc

SEQ ID NO: 141863 - DNA, 20 bp, Artificial Sequence
  Description of Artificial Sequence: Synthetic oligonucleotide
  Target: ATXN1; (+) strand; PAM type: NRG; PAM sequence: CAG
cacctgtaatccaagctact

SEQ ID NO: 141864 - DNA, 20 bp, Artificial Sequence
  Description of Artificial Sequence: Synthetic oligonucleotide
  Target: ATXN1; (+) strand; PAM type: NRG; PAM sequence: AGG
acctgtaatccaagctactc

SEQ ID NO: 141865 - DNA, 20 bp, Artificial Sequence
  Description of Artificial Sequence: Synthetic oligonucleotide
  Target: ATXN1; (+) strand; PAM type: NRG; PAM sequence: GAG
ctgtaatccaagctactcag

SEQ ID NO: 141866 - DNA, 20 bp, Artificial Sequence
  Description of Artificial Sequence: Synthetic oligonucleotide
  Target: ATXN1; (+) strand; PAM type: NRG; PAM sequence: AGG
tgtaatccaagctactcagg

SEQ ID NO: 141867 - DNA, 20 bp, Artificial Sequence
  Description of Artificial Sequence: Synthetic oligonucleotide
  Target: ATXN1; (+) strand; PAM type: NRG; PAM sequence: GAG
tccaagctactcaggaggct

SEQ ID NO: 141868 - DNA, 20 bp, Artificial Sequence
  Description of Artificial Sequence: Synthetic oligonucleotide
  Target: ATXN1; (+) strand; PAM type: NRG; PAM sequence: AGG
ccaagctactcaggaggctg

SEQ ID NO: 141869 - DNA, 20 bp, Artificial Sequence
  Description of Artificial Sequence: Synthetic oligonucleotide
  Target: ATXN1; (+) strand; PAM type: NRG; PAM sequence: CAG
agctactcaggaggctgagg

SEQ ID NO: 141870 - DNA, 20 bp, Artificial Sequence
  Description of Artificial Sequence: Synthetic oligonucleotide
  Target: ATXN1; (+) strand; PAM type: NRG; PAM sequence: AGG
gctactcaggaggctgaggc

SEQ ID NO: 141871 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctgaggcag

SEQ ID NO: 141872 - DNA, 20 bp, Artificial Sequence
  Description of Artificial Sequence: Synthetic oligonucleotide
  Target: ATXN1; (+) strand; PAM type: NRG; PAM sequence: TGG
gcaggagaatcccttgaacc

SEQ ID NO: 141873 - DNA, 20 bp, Artificial Sequence
  Description of Artificial Sequence: Synthetic oligonucleotide
  Target: ATXN1; (+) strand; PAM type: NRG; PAM sequence: GGG
caggagaatcccttgaacct

SEQ ID NO: 141874 - DNA, 20 bp, Artificial Sequence
  Description of Artificial Sequence: Synthetic oligonucleotide
  Target: ATXN1; (+) strand; PAM type: NRG; PAM sequence: AAG
gagaatcccttgaacctggg

SEQ ID NO: 141875 - DNA, 20 bp, Artificial Sequence
  Description of Artificial Sequence: Synthetic oligonucleotide
  Target: ATXN1; (+) strand; PAM type: NRG; PAM sequence: CAG
aatcccttgaacctgggaag

SEQ ID NO: 141876 - DNA, 20 bp, Artificial Sequence
  Description of Artificial Sequence: Synthetic oligonucleotide
  Target: ATXN1; (+) strand; PAM type: NRG; PAM sequence: GAG
tcccttgaacctgggaagca

SEQ ID NO: 141877 - DNA, 20 bp, Artificial Sequence
  Description of Artificial Sequence: Synthetic oligonucleotide
  Target: ATXN1; (+) strand; PAM type: NRG; PAM sequence: AGG
cccttgaacctgggaagcag

SEQ ID NO: 141878 - DNA, 20 bp, Artificial Sequence
  Description of Artificial Sequence: Synthetic oligonucleotide
  Target: ATXN1; (+) strand; PAM type: NRG; PAM sequence: CAG
aacctgggaagcagaggttg

SEQ ID NO: 141879 - DNA, 20 bp, Artificial Sequence
  Description of Artificial Sequence: Synthetic oligonucleotide
  Target: ATXN1; (+) strand; PAM type: NRG; PAM sequence: AAG
tgggaagcagaggttgcagt

SEQ ID NO: 141880 - DNA, 20 bp, Artificial Sequence
  Description of Artificial Sequence: Synthetic oligonucleotide
  Target: ATXN1; (+) strand; PAM type: NRG; PAM sequence: GAG
agcagaggttgcagtaagct

SEQ ID NO: 141881 - DNA, 20 bp, Artificial Sequence
  Description of Artificial Sequence: Synthetic oligonucleotide
  Target: ATXN1; (+) strand; PAM type: NRG; PAM sequence: TGG
gaggttgcagtaagctgaga

SEQ ID NO: 141882 - DNA, 20 bp, Artificial Sequence
  Description of Artificial Sequence: Synthetic oligonucleotide
  Target: ATXN1; (+) strand; PAM type: NRG; PAM sequence: CAG
gagatggtgccactgcactc

SEQ ID NO: 141883 - DNA, 20 bp, Artificial Sequence
  Description of Artificial Sequence: Synthetic oligonucleotide
  Target: ATXN1; (+) strand; PAM type: NRG; PAM sequence: TGG
ggtgccactgcactccagcg

SEQ ID NO: 141884 - DNA, 20 bp, Artificial Sequence
  Description of Artificial Sequence: Synthetic oligonucleotide
  Target: ATXN1; (+) strand; PAM type: NRG; PAM sequence: GGG
gtgccactgcactccagcgt

SEQ ID NO: 141885 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcgtgggtga

SEQ ID NO: 141886 - DNA, 20 bp, Artificial Sequence
  Description of Artificial Sequence: Synthetic oligonucleotide
  Target: ATXN1; (+) strand; PAM type: NRG; PAM sequence: GAG
gcactccagcgtgggtgaca

SEQ ID NO: 141887 - DNA, 20 bp, Artificial Sequence
  Description of Artificial Sequence: Synthetic oligonucleotide
  Target: ATXN1; (+) strand; PAM type: NRG; PAM sequence: GAG
actccagcgtgggtgacaga

SEQ ID NO: 141888 - DNA, 20 bp, Artificial Sequence
  Description of Artificial Sequence: Synthetic oligonucleotide
  Target: ATXN1; (+) strand; PAM type: NRG; PAM sequence: GAG
tccagcgtgggtgacagaga

SEQ ID NO: 141889 - DNA, 20 bp, Artificial Sequence
  Description of Artificial Sequence: Synthetic oligonucleotide
  Target: ATXN1; (+) strand; PAM type: NRG; PAM sequence: AAG
tctgtctcaaaaaaaaaaaa

SEQ ID NO: 141890 - DNA, 20 bp, Artificial Sequence
  Description of Artificial Sequence: Synthetic oligonucleotide
  Target: ATXN1; (+) strand; PAM type: NRG; PAM sequence: AGG
ctgtctcaaaaaaaaaaaaa

SEQ ID NO: 141891 - DNA, 20 bp, Artificial Sequence
  Description of Artificial Sequence: Synthetic oligonucleotide
  Target: ATXN1; (+) strand; PAM type: NRG; PAM sequence: CAG
tctcaaaaaaaaaaaaaagg

SEQ ID NO: 141892 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaaaaggcagaactc

SEQ ID NO: 141893 - DNA, 20 bp, Artificial Sequence
  Description of Artificial Sequence: Synthetic oligonucleotide
  Target: ATXN1; (+) strand; PAM type: NRG; PAM sequence: GAG
aaggcagaactccagcatat

SEQ ID NO: 141894 - DNA, 20 bp, Artificial Sequence
  Description of Artificial Sequence: Synthetic oligonucleotide
  Target: ATXN1; (+) strand; PAM type: NRG; PAM sequence: TAG
cagaactccagcatatgagc

SEQ ID NO: 141895 - DNA, 20 bp, Artificial Sequence
  Description of Artificial Sequence: Synthetic oligonucleotide
  Target: ATXN1; (+) strand; PAM type: NRG; PAM sequence: AGG
agaactccagcatatgagct

SEQ ID NO: 141896 - DNA, 20 bp, Artificial Sequence
  Description of Artificial Sequence: Synthetic oligonucleotide
  Target: ATXN1; (+) strand; PAM type: NRG; PAM sequence: GGG
gaactccagcatatgagcta

SEQ ID NO: 141897 - DNA, 20 bp, Artificial Sequence
  Description of Artificial Sequence: Synthetic oligonucleotide
  Target: ATXN1; (+) strand; PAM type: NRG; PAM sequence: AAG
cagcatatgagctagggatg

SEQ ID NO: 141898 - DNA, 20 bp, Artificial Sequence
  Description of Artificial Sequence: Synthetic oligonucleotide
  Target: ATXN1; (+) strand; PAM type: NRG; PAM sequence: CAG
catatgagctagggatgaag

SEQ ID NO: 141899 - DNA, 20 bp, Artificial Sequence
  Description of Artificial Sequence: Synthetic oligonucleotide
  Target: ATXN1; (+) strand; PAM type: NRG; PAM sequence: GAG
tatgagctagggatgaagca

SEQ ID NO: 141900 - DNA, 20 bp, Artificial Sequence
  Description of Artificial Sequence: Synthetic oligonucleotide
  Target: ATXN1; (+) strand; PAM type: NRG; PAM sequence: AGG
atgagctagggatgaagcag

SEQ ID NO: 141901 - DNA, 20 bp, Artificial Sequence
  Description of Artificial Sequence: Synthetic oligonucleotide
  Target: ATXN1; (+) strand; PAM type: NRG; PAM sequence: AAG
agctagggatgaagcagagg

SEQ ID NO: 141902 - DNA, 20 bp, Artificial Sequence
  Description of Artificial Sequence: Synthetic oligonucleotide
  Target: ATXN1; (+) strand; PAM type: NRG; PAM sequence: GAG
ctagggatgaagcagaggaa

SEQ ID NO: 141903 - DNA, 20 bp, Artificial Sequence
  Description of Artificial Sequence: Synthetic oligonucleotide
  Target: ATXN1; (+) strand; PAM type: NRG; PAM sequence: AGG
tagggatgaagcagaggaag

SEQ ID NO: 141904 - DNA, 20 bp, Artificial Sequence
  Description of Artificial Sequence: Synthetic oligonucleotide
  Target: ATXN1; (+) strand; PAM type: NRG; PAM sequence: GAG
gggatgaagcagaggaagag

SEQ ID NO: 141905 - DNA, 20 bp, Artificial Sequence
  Description of Artificial Sequence: Synthetic oligonucleotide
  Target: ATXN1; (+) strand; PAM type: NRG; PAM sequence: AGG
ggatgaagcagaggaagagg

SEQ ID NO: 141906 - DNA, 20 bp, Artificial Sequence
  Description of Artificial Sequence: Synthetic oligonucleotide
  Target: ATXN1; (+) strand; PAM type: NRG; PAM sequence: CAG
gcagaggaagaggaggtgtc

SEQ ID NO: 141907 - DNA, 20 bp, Artificial Sequence
  Description of Artificial Sequence: Synthetic oligonucleotide
  Target: ATXN1; (+) strand; PAM type: NRG; PAM sequence: TGG
aggtgtccagcatcaacaaa

SEQ ID NO: 141908 - DNA, 20 bp, Artificial Sequence
  Description of Artificial Sequence: Synthetic oligonucleotide
  Target: ATXN1; (+) strand; PAM type: NRG; PAM sequence: GAG
gtccagcatcaacaaatggt

SEQ ID NO: 141909 - DNA, 20 bp, Artificial Sequence
  Description of Artificial Sequence: Synthetic oligonucleotide
  Target: ATXN1; (+) strand; PAM type: NRG; PAM sequence: TAG
agcatcaacaaatggtgagc

SEQ ID NO: 141910 - DNA, 20 bp, Artificial Sequence
  Description of Artificial Sequence: Synthetic oligonucleotide
  Target: ATXN1; (+) strand; PAM type: NRG; PAM sequence: TGG
aaatggtgagctagtgaccc

SEQ ID NO: 141911 - DNA, 20 bp, Artificial Sequence
  Description of Artificial Sequence: Synthetic oligonucleotide
  Target: ATXN1; (+) strand; PAM type: NRG; PAM sequence: GAG
atggtgagctagtgaccctg

SEQ ID NO: 141912 - DNA, 20 bp, Artificial Sequence
  Description of Artificial Sequence: Synthetic oligonucleotide
  Target: ATXN1; (+) strand; PAM type: NRG; PAM sequence: TAG
gaccctggagcccataaacg

SEQ ID NO: 141913 - DNA, 20 bp, Artificial Sequence
  Description of Artificial Sequence: Synthetic oligonucleotide
  Target: ATXN1; (+) strand; PAM type: NRG; PAM sequence: AGG
accctggagcccataaacgt

SEQ ID NO: 141914 - DNA, 20 bp, Artificial Sequence
  Description of Artificial Sequence: Synthetic oligonucleotide
  Target: ATXN1; (+) strand; PAM type: NRG; PAM sequence: AAG
ataaacgtaggacaatgaca

SEQ ID NO: 141915 - DNA, 20 bp, Artificial Sequence
  Description of Artificial Sequence: Synthetic oligonucleotide
  Target: ATXN1; (+) strand; PAM type: NRG; PAM sequence: CAG
acgtaggacaatgacaaagt

SEQ ID NO: 141916 - DNA, 20 bp, Artificial Sequence
  Description of Artificial Sequence: Synthetic oligonucleotide
  Target: ATXN1; (+) strand; PAM type: NRG; PAM sequence: AGG
cgtaggacaatgacaaagtc

SEQ ID NO: 141917 - DNA, 20 bp, Artificial Sequence
  Description of Artificial Sequence: Synthetic oligonucleotide
  Target: ATXN1; (+) strand; PAM type: NRG; PAM sequence: TAG
gacaatgacaaagtcaggtt

SEQ ID NO: 141918 - DNA, 20 bp, Artificial Sequence
  Description of Artificial Sequence: Synthetic oligonucleotide
  Target: ATXN1; (+) strand; PAM type: NRG; PAM sequence: AAG
tcaggtttagattcaaattg

SEQ ID NO: 141919 - DNA, 20 bp, Artificial Sequence
  Description of Artificial Sequence: Synthetic oligonucleotide
  Target: ATXN1; (+) strand; PAM type: NRG; PAM sequence: CAG
gaagacacctatgtgatatc

SEQ ID NO: 141920 - DNA, 20 bp, Artificial Sequence
  Description of Artificial Sequence: Synthetic oligonucleotide
  Target: ATXN1; (+) strand; PAM type: NRG; PAM sequence: TGG
acacctatgtgatatccagc

SEQ ID NO: 141921 - DNA, 20 bp, Artificial Sequence
  Description of Artificial Sequence: Synthetic oligonucleotide
  Target: ATXN1; (+) strand; PAM type: NRG; PAM sequence: GAG
acctatgtgatatccagctg

SEQ ID NO: 141922 - DNA, 20 bp, Artificial Sequence
  Description of Artificial Sequence: Synthetic oligonucleotide
  Target: ATXN1; (+) strand; PAM type: NRG; PAM sequence: TGG
gatatccagctggagtcatg

SEQ ID NO: 141923 - DNA, 20 bp, Artificial Sequence
  Description of Artificial Sequence: Synthetic oligonucleotide
  Target: ATXN1; (+) strand; PAM type: NRG; PAM sequence: GGG
atatccagctggagtcatgt

SEQ ID NO: 141924 - DNA, 20 bp, Artificial Sequence
  Description of Artificial Sequence: Synthetic oligonucleotide
  Target: ATXN1; (+) strand; PAM type: NRG; PAM sequence: GAG
atccagctggagtcatgtgg

SEQ ID NO: 141925 - DNA, 20 bp, Artificial Sequence
  Description of Artificial Sequence: Synthetic oligonucleotide
  Target: ATXN1; (+) strand; PAM type: NRG; PAM sequence: AGG
tccagctggagtcatgtggg

SEQ ID NO: 141926 - DNA, 20 bp, Artificial Sequence
  Description of Artificial Sequence: Synthetic oligonucleotide
  Target: ATXN1; (+) strand; PAM type: NRG; PAM sequence: AAG
agctggagtcatgtgggagg

SEQ ID NO: 141927 - DNA, 20 bp, Artificial Sequence
  Description of Artificial Sequence: Synthetic oligonucleotide
  Target: ATXN1; (+) strand; PAM type: NRG; PAM sequence: TGG
ggagtcatgtgggaggaagt

SEQ ID NO: 141928 - DNA, 20 bp, Artificial Sequence
  Description of Artificial Sequence: Synthetic oligonucleotide
  Target: ATXN1; (+) strand; PAM type: NRG; PAM sequence: GAG
ggaggaagttggaaatcatt

SEQ ID NO: 141929 - DNA, 20 bp, Artificial Sequence
  Description of Artificial Sequence: Synthetic oligonucleotide
  Target: ATXN1; (+) strand; PAM type: NRG; PAM sequence: AAG
atcattgagcttaaactctg

SEQ ID NO: 141930 - DNA, 20 bp, Artificial Sequence
  Description of Artificial Sequence: Synthetic oligonucleotide
  Target: ATXN1; (+) strand; PAM type: NRG; PAM sequence: GAG
cattgagcttaaactctgaa

SEQ ID NO: 141931 - DNA, 20 bp, Artificial Sequence
  Description of Artificial Sequence: Synthetic oligonucleotide
  Target: ATXN1; (+) strand; PAM type: NRG; PAM sequence: AAG
gagcttaaactctgaagaga

SEQ ID NO: 141932 - DNA, 20 bp, Artificial Sequence
  Description of Artificial Sequence: Synthetic oligonucleotide
  Target: ATXN1; (+) strand; PAM type: NRG; PAM sequence: GAG
gcttaaactctgaagagaaa

SEQ ID NO: 141933 - DNA, 20 bp, Artificial Sequence
  Description of Artificial Sequence: Synthetic oligonucleotide
  Target: ATXN1; (+) strand; PAM type: NRG; PAM sequence: CAG
aaactctgaagagaaagaga

SEQ ID NO: 141934 - DNA, 20 bp, Artificial Sequence
  Description of Artificial Sequence: Synthetic oligonucleotide
  Target: ATXN1; (+) strand; PAM type: NRG; PAM sequence: TAG
agagaaagagacagaaatac

SEQ ID NO: 141935 - DNA, 20 bp, Artificial Sequence
  Description of Artificial Sequence: Synthetic oligonucleotide
  Target: ATXN1; (+) strand; PAM type: NRG; PAM sequence: CAG
agaaatactagttgtgtgtg

SEQ ID NO: 141936 - DNA, 20 bp, Artificial Sequence
  Description of Artificial Sequence: Synthetic oligonucleotide
  Target: ATXN1; (+) strand; PAM type: NRG; PAM sequence: GAG
aaatactagttgtgtgtgca

SEQ ID NO: 141937 - DNA, 20 bp, Artificial Sequence
  Description of Artificial Sequence: Synthetic oligonucleotide
  Target: ATXN1; (+) strand; PAM type: NRG; PAM sequence: GAG
gttgtgtgtgcagagttgat

SEQ ID NO: 141938 - DNA, 20 bp, Artificial Sequence
  Description of Artificial Sequence: Synthetic oligonucleotide
  Target: ATXN1; (+) strand; PAM type: NRG; PAM sequence: AGG
ttgtgtgtgcagagttgatg

SEQ ID NO: 141939 - DNA, 20 bp, Artificial Sequence
  Description of Artificial Sequence: Synthetic oligonucleotide
  Target: ATXN1; (+) strand; PAM type: NRG; PAM sequence: TGG
agttgatgaggacatcatga

SEQ ID NO: 141940 - DNA, 20 bp, Artificial Sequence
  Description of Artificial Sequence: Synthetic oligonucleotide
  Target: ATXN1; (+) strand; PAM type: NRG; PAM sequence: CAG
atgaggacatcatgatggtg

SEQ ID NO: 141941 - DNA, 20 bp, Artificial Sequence
  Description of Artificial Sequence: Synthetic oligonucleotide
  Target: ATXN1; (+) strand; PAM type: NRG; PAM sequence: CAG
catgatggtgcagatgcctt

SEQ ID NO: 141942 - DNA, 20 bp, Artificial Sequence
  Description of Artificial Sequence: Synthetic oligonucleotide
  Target: ATXN1; (+) strand; PAM type: NRG; PAM sequence: AGG
atgatggtgcagatgccttc

SEQ ID NO: 141943 - DNA, 20 bp, Artificial Sequence
  Description of Artificial Sequence: Synthetic oligonucleotide
  Target: ATXN1; (+) strand; PAM type: NRG; PAM sequence: GGG
tgatggtgcagatgccttca

SEQ ID NO: 141944 - DNA, 20 bp, Artificial Sequence
  Description of Artificial Sequence: Synthetic oligonucleotide
  Target: ATXN1; (+) strand; PAM type: NRG; PAM sequence: AAG
ggtgcagatgccttcaggga

SEQ ID NO: 141945 - DNA, 20 bp, Artificial Sequence
  Description of Artificial Sequence: Synthetic oligonucleotide
  Target: ATXN1; (+) strand; PAM type: NRG; PAM sequence: CGG
gccttcagggaaagcatgtg

SEQ ID NO: 141946 - DNA, 20 bp, Artificial Sequence
  Description of Artificial Sequence: Synthetic oligonucleotide
  Target: ATXN1; (+) strand; PAM type: NRG; PAM sequence: TAG
gcatgtgcggtaacaaactc

SEQ ID NO: 141947 - DNA, 20 bp, Artificial Sequence
  Description of Artificial Sequence: Synthetic oligonucleotide
  Target: ATXN1; (+) strand; PAM type: NRG; PAM sequence: AGG
catgtgcggtaacaaactct

SEQ ID NO: 141948 - DNA, 20 bp, Artificial Sequence
  Description of Artificial Sequence: Synthetic oligonucleotide
  Target: ATXN1; (+) strand; PAM type: NRG; PAM sequence: CAG
ccaacaatgtgcacgtgtgc

SEQ ID NO: 141949 - DNA, 20 bp, Artificial Sequence
  Description of Artificial Sequence: Synthetic oligonucleotide
  Target: ATXN1; (+) strand; PAM type: NRG; PAM sequence: CGG
ttctgatttcttctgatgca

SEQ ID NO: 141950 - DNA, 20 bp, Artificial Sequence
  Description of Artificial Sequence: Synthetic oligonucleotide
  Target: ATXN1; (+) strand; PAM type: NRG; PAM sequence: AAG
acggcaaatgcctcccttca

SEQ ID NO: 141951 - DNA, 20 bp, Artificial Sequence
  Description of Artificial Sequence: Synthetic oligonucleotide
  Target: ATXN1; (+) strand; PAM type: NRG; PAM sequence: AAG
aagctctcaaattgtcacta

SEQ ID NO: 141952 - DNA, 20 bp, Artificial Sequence
  Description of Artificial Sequence: Synthetic oligonucleotide
  Target: ATXN1; (+) strand; PAM type: NRG; PAM sequence: AAG
ctctcaaattgtcactaaag

SEQ ID NO: 141953 - DNA, 20 bp, Artificial Sequence
  Description of Artificial Sequence: Synthetic oligonucleotide
  Target: ATXN1; (+) strand; PAM type: NRG; PAM sequence: AGG
tctcaaattgtcactaaaga

SEQ ID NO: 141954 - DNA, 20 bp, Artificial Sequence
  Description of Artificial Sequence: Synthetic oligonucleotide
  Target: ATXN1; (+) strand; PAM type: NRG; PAM sequence: GGG
ctcaaattgtcactaaagaa

SEQ ID NO: 141955 - DNA, 20 bp, Artificial Sequence
  Description of Artificial Sequence: Synthetic oligonucleotide
  Target: ATXN1; (+) strand; PAM type: NRG; PAM sequence: GGG
tcaaattgtcactaaagaag

SEQ ID NO: 141956 - DNA, 20 bp, Artificial Sequence
  Description of Artificial Sequence: Synthetic oligonucleotide
  Target: ATXN1; (+) strand; PAM type: NRG; PAM sequence: CAG
aggggacctaccatgtaaat

SEQ ID NO: 141957 - DNA, 20 bp, Artificial Sequence
  Description of Artificial Sequence: Synthetic oligonucleotide
  Target: ATXN1; (+) strand; PAM type: NRG; PAM sequence: TAG
tctgttttgatgatgcctgt

SEQ ID NO: 141958 - DNA, 20 bp, Artificial Sequence
  Description of Artificial Sequence: Synthetic oligonucleotide
  Target: ATXN1; (+) strand; PAM type: NRG; PAM sequence: AAG
gttttgatgatgcctgttag

SEQ ID NO: 141959 - DNA, 20 bp, Artificial Sequence
  Description of Artificial Sequence: Synthetic oligonucleotide
  Target: ATXN1; (+) strand; PAM type: NRG; PAM sequence: AAG
tgatgatgcctgttagaaga

SEQ ID NO: 141960 - DNA, 20 bp, Artificial Sequence
  Description of Artificial Sequence: Synthetic oligonucleotide
  Target: ATXN1; (+) strand; PAM type: NRG; PAM sequence: TGG
agtacattgcatttcctgaa

SEQ ID NO: 141961 - DNA, 20 bp, Artificial Sequence
  Description of Artificial Sequence: Synthetic oligonucleotide
  Target: ATXN1; (+) strand; PAM type: NRG; PAM sequence: GGG
gtacattgcatttcctgaat

SEQ ID NO: 141962 - DNA, 20 bp, Artificial Sequence
  Description of Artificial Sequence: Synthetic oligonucleotide
  Target: ATXN1; (+) strand; PAM type: NRG; PAM sequence: TGG
ttgcatttcctgaatgggtg

SEQ ID NO: 141963 - DNA, 20 bp, Artificial Sequence
  Description of Artificial Sequence: Synthetic oligonucleotide
  Target: ATXN1; (+) strand; PAM type: NRG; PAM sequence: CAG
aatgggtgtggttttactca

SEQ ID NO: 141964 - DNA, 20 bp, Artificial Sequence
  Description of Artificial Sequence: Synthetic oligonucleotide
  Target: ATXN1; (+) strand; PAM type: NRG; PAM sequence: CAG
cacagctatacaaaaccaca

SEQ ID NO: 141965 - DNA, 20 bp, Artificial Sequence
  Description of Artificial Sequence: Synthetic oligonucleotide
  Target: ATXN1; (+) strand; PAM type: NRG; PAM sequence: AAG
aaaaccacacagcttctctg

SEQ ID NO: 141966 - DNA, 20 bp, Artificial Sequence
  Description of Artificial Sequence: Synthetic oligonucleotide
  Target: ATXN1; (+) strand; PAM type: NRG; PAM sequence: AGG
aaaccacacagcttctctga

SEQ ID NO: 141967 - DNA, 20 bp, Artificial Sequence
  Description of Artificial Sequence: Synthetic oligonucleotide
  Target: ATXN1; (+) strand; PAM type: NRG; PAM sequence: TAG
cacagcttctctgaaggact

SEQ ID NO: 141968 - DNA, 20 bp, Artificial Sequence
  Description of Artificial Sequence: Synthetic oligonucleotide
  Target: ATXN1; (+) strand; PAM type: NRG; PAM sequence: TAG
tgaaggacttagacaatcat

SEQ ID NO: 141969 - DNA, 20 bp, Artificial Sequence
  Description of Artificial Sequence: Synthetic oligonucleotide
  Target: ATXN1; (+) strand; PAM type: NRG; PAM sequence: TAG
agacaatcattagcctgtga

SEQ ID NO: 141970 - DNA, 20 bp, Artificial Sequence
  Description of Artificial Sequence: Synthetic oligonucleotide
  Target: ATXN1; (+) strand; PAM type: NRG; PAM sequence: CAG
tcattagcctgtgatagcat

SEQ ID NO: 141971 - DNA, 20 bp, Artificial Sequence
  Description of Artificial Sequence: Synthetic oligonucleotide
  Target: ATXN1; (+) strand; PAM type: NRG; PAM sequence: AAG
tagcctgtgatagcatcagc

SEQ ID NO: 141972 - DNA, 20 bp, Artificial Sequence
  Description of Artificial Sequence: Synthetic oligonucleotide
  Target: ATXN1; (+) strand; PAM type: NRG; PAM sequence: GAG
gcctgtgatagcatcagcaa

SEQ ID NO: 141973 - DNA, 20 bp, Artificial Sequence
  Description of Artificial Sequence: Synthetic oligonucleotide
  Target: ATXN1; (+) strand; PAM type: NRG; PAM sequence: AGG
cctgtgatagcatcagcaag

SEQ ID NO: 141974 - DNA, 20 bp, Artificial Sequence
  Description of Artificial Sequence: Synthetic oligonucleotide
  Target: ATXN1; (+) strand; PAM type: NRG; PAM sequence: GAG
atagcatcagcaagaggaac

SEQ ID NO: 141975 - DNA, 20 bp, Artificial Sequence
  Description of Artificial Sequence: Synthetic oligonucleotide
  Target: ATXN1; (+) strand; PAM type: NRG; PAM sequence: TAG
catcagcaagaggaacgagt

SEQ ID NO: 141976 - DNA, 20 bp, Artificial Sequence
  Description of Artificial Sequence: Synthetic oligonucleotide
  Target: ATXN1; (+) strand; PAM type: NRG; PAM sequence: AAG
agttagaacacatttaacaa

SEQ ID NO: 141977 - DNA, 20 bp, Artificial Sequence
  Description of Artificial Sequence: Synthetic oligonucleotide
  Target: ATXN1; (+) strand; PAM type: NRG; PAM sequence: AGG
gttagaacacatttaacaaa

SEQ ID NO: 141978 - DNA, 20 bp, Artificial Sequence
  Description of Artificial Sequence: Synthetic oligonucleotide
  Target: ATXN1; (+) strand; PAM type: NRG; PAM sequence: TGG
acatttaacaaaaggcattt

SEQ ID NO: 141979 - DNA, 20 bp, Artificial Sequence
  Description of Artificial Sequence: Synthetic oligonucleotide
  Target: ATXN1; (+) strand; PAM type: NRG; PAM sequence: GGG
catttaacaaaaggcatttt

SEQ ID NO: 141980 - DNA, 20 bp, Artificial Sequence
  Description of Artificial Sequence: Synthetic oligonucleotide
  Target: ATXN1; (+) strand; PAM type: NRG; PAM sequence: TGG
ggtgctgctttaccgaacac

SEQ ID NO: 141981 - DNA, 20 bp, Artificial Sequence
  Description of Artificial Sequence: Synthetic oligonucleotide
  Target: ATXN1; (+) strand; PAM type: NRG; PAM sequence: AAG
gctttaccgaacactggctt

SEQ ID NO: 141982 - DNA, 20 bp, Artificial Sequence
  Description of Artificial Sequence: Synthetic oligonucleotide
  Target: ATXN1; (+) strand; PAM type: NRG; PAM sequence: AAG
aacactggcttaagtacctg

SEQ ID NO: 141983 - DNA, 20 bp, Artificial Sequence
  Description of Artificial Sequence: Synthetic oligonucleotide
  Target: ATXN1; (+) strand; PAM type: NRG; PAM sequence: AGG
acactggcttaagtacctga

SEQ ID NO: 141984 - DNA, 20 bp, Artificial Sequence
  Description of Artificial Sequence: Synthetic oligonucleotide
  Target: ATXN1; (+) strand; PAM type: NRG; PAM sequence: GGG
cactggcttaagtacctgaa

SEQ ID NO: 141985 - DNA, 20 bp, Artificial Sequence
  Description of Artificial Sequence: Synthetic oligonucleotide
  Target: ATXN1; (+) strand; PAM type: NRG; PAM sequence: AAG
gaagggaactacactcctct

SEQ ID NO: 141986 - DNA, 20 bp, Artificial Sequence
  Description of Artificial Sequence: Synthetic oligonucleotide
  Target: ATXN1; (+) strand; PAM type: NRG; PAM sequence: TGG
ggaactacactcctctaagc

SEQ ID NO: 141987 - DNA, 20 bp, Artificial Sequence
  Description of Artificial Sequence: Synthetic oligonucleotide
  Target: ATXN1; (+) strand; PAM type: NRG; PAM sequence: AAG
ctacactcctctaagctgga

SEQ ID NO: 141988 - DNA, 20 bp, Artificial Sequence
  Description of Artificial Sequence: Synthetic oligonucleotide
  Target: ATXN1; (+) strand; PAM type: NRG; PAM sequence: GAG
tctaagctggaaagcactgc

SEQ ID NO: 141989 - DNA, 20 bp, Artificial Sequence
  Description of Artificial Sequence: Synthetic oligonucleotide
  Target: ATXN1; (+) strand; PAM type: NRG; PAM sequence: GAG
taagctggaaagcactgcga

SEQ ID NO: 141990 - DNA, 20 bp, Artificial Sequence
  Description of Artificial Sequence: Synthetic oligonucleotide
  Target: ATXN1; (+) strand; PAM type: NRG; PAM sequence: TGG
ctgcgagagctttctaacga

SEQ ID NO: 141991 - DNA, 20 bp, Artificial Sequence
  Description of Artificial Sequence: Synthetic oligonucleotide
  Target: ATXN1; (+) strand; PAM type: NRG; PAM sequence: TAG
agctttctaacgatggtctt

SEQ ID NO: 141992 - DNA, 20 bp, Artificial Sequence
  Description of Artificial Sequence: Synthetic oligonucleotide
  Target: ATXN1; (+) strand; PAM type: NRG; PAM sequence: TGG
tttctaacgatggtctttag

SEQ ID NO: 141993 - DNA, 20 bp, Artificial Sequence
  Description of Artificial Sequence: Synthetic oligonucleotide
  Target: ATXN1; (+) strand; PAM type: NRG; PAM sequence: GGG
ttctaacgatggtctttagt

SEQ ID NO: 141994 - DNA, 20 bp, Artificial Sequence
  Description of Artificial Sequence: Synthetic oligonucleotide
  Target: ATXN1; (+) strand; PAM type: NRG; PAM sequence: GGG
tctaacgatggtctttagtg

SEQ ID NO: 141995 - DNA, 20 bp, Artificial Sequence
  Description of Artificial Sequence: Synthetic oligonucleotide
  Target: ATXN1; (+) strand; PAM type: NRG; PAM sequence: GGG
ctaacgatggtctttagtgg

SEQ ID NO: 141996 - DNA, 20 bp, Artificial Sequence
  Description of Artificial Sequence: Synthetic oligonucleotide
  Target: ATXN1; (+) strand; PAM type: NRG; PAM sequence: TGG
atggtctttagtgggggtac

SEQ ID NO: 141997 - DNA, 20 bp, Artificial Sequence
  Description of Artificial Sequence: Synthetic oligonucleotide
  Target: ATXN1; (+) strand; PAM type: NRG; PAM sequence: TGG
ctttagtgggggtactggac

SEQ ID NO: 141998 - DNA, 20 bp, Artificial Sequence
  Description of Artificial Sequence: Synthetic oligonucleotide
  Target: ATXN1; (+) strand; PAM type: NRG; PAM sequence: AAG
cctatttacatctgttccaa

SEQ ID NO: 141999 - DNA, 20 bp, Artificial Sequence
  Description of Artificial Sequence: Synthetic oligonucleotide
  Target: ATXN1; (+) strand; PAM type: NRG; PAM sequence: CAG
atttacatctgttccaaaag

SEQ ID NO: 142000 - DNA, 20 bp, Artificial Sequence
  Description of Artificial Sequence: Synthetic oligonucleotide
  Target: ATXN1; (+) strand; PAM type: NRG; PAM sequence: TAG
caaaagcagtacctatgatt

SEQ ID NO: 142001 - DNA, 20 bp, Artificial Sequence
  Description of Artificial Sequence: Synthetic oligonucleotide
  Target: ATXN1; (+) strand; PAM type: NRG; PAM sequence: AGG
aaaagcagtacctatgattt

SEQ ID NO: 142002 - DNA, 20 bp, Artificial Sequence
  Description of Artificial Sequence: Synthetic oligonucleotide
  Target: ATXN1; (+) strand; PAM type: NRG; PAM sequence: TGG
agcagtacctatgatttagg

SEQ ID NO: 142003 - DNA, 20 bp, Artificial Sequence
  Description of Artificial Sequence: Synthetic oligonucleotide
  Target: ATXN1; (+) strand; PAM type: NRG; PAM sequence: TGG
ctatgatttaggtggctgtt

SEQ ID NO: 142004 - DNA, 20 bp, Artificial Sequence
  Description of Artificial Sequence: Synthetic oligonucleotide
  Target: ATXN1; (+) strand; PAM type: NRG; PAM sequence: AAG
ttggaaatcatgtacctctc

SEQ ID NO: 142005 - DNA, 20 bp, Artificial Sequence
  Description of Artificial Sequence: Synthetic oligonucleotide
  Target: ATXN1; (+) strand; PAM type: NRG; PAM sequence: AGG
tggaaatcatgtacctctca

SEQ ID NO: 142006 - DNA, 20 bp, Artificial Sequence
  Description of Artificial Sequence: Synthetic oligonucleotide
  Target: ATXN1; (+) strand; PAM type: NRG; PAM sequence: CGG
tacctctcaaggatgcctca

SEQ ID NO: 142007 - DNA, 20 bp, Artificial Sequence
  Description of Artificial Sequence: Synthetic oligonucleotide
  Target: ATXN1; (+) strand; PAM type: NRG; PAM sequence: AAG
tgcctcacggtaaacgatac

SEQ ID NO: 142008 - DNA, 20 bp, Artificial Sequence
  Description of Artificial Sequence: Synthetic oligonucleotide
  Target: ATXN1; (+) strand; PAM type: NRG; PAM sequence: CAG
ggtaaacgatacaagtgaca

SEQ ID NO: 142009 - DNA, 20 bp, Artificial Sequence
  Description of Artificial Sequence: Synthetic oligonucleotide
  Target: ATXN1; (+) strand; PAM type: NRG; PAM sequence: TAG
caagtgacacagtttctaac

SEQ ID NO: 142010 - DNA, 20 bp, Artificial Sequence
  Description of Artificial Sequence: Synthetic oligonucleotide
  Target: ATXN1; (+) strand; PAM type: NRG; PAM sequence: TAG
taactagacaaatgctcttt

SEQ ID NO: 142011 - DNA, 20 bp, Artificial Sequence
  Description of Artificial Sequence: Synthetic oligonucleotide
  Target: ATXN1; (+) strand; PAM type: NRG; PAM sequence: TGG
ttttttctgttttcctacca

SEQ ID NO: 142012 - DNA, 20 bp, Artificial Sequence
  Description of Artificial Sequence: Synthetic oligonucleotide
  Target: ATXN1; (+) strand; PAM type: NRG; PAM sequence: TGG
ttctgttttcctaccatgga

SEQ ID NO: 142013 - DNA, 20 bp, Artificial Sequence
  Description of Artificial Sequence: Synthetic oligonucleotide
  Target: ATXN1; (+) strand; PAM type: NRG; PAM sequence: AAG
taccatggatggttacttgc

SEQ ID NO: 142014 - DNA, 20 bp, Artificial Sequence
  Description of Artificial Sequence: Synthetic oligonucleotide
  Target: ATXN1; (+) strand; PAM type: NRG; PAM sequence: AGG
accatggatggttacttgca

SEQ ID NO: 142015 - DNA, 20 bp, Artificial Sequence
  Description of Artificial Sequence: Synthetic oligonucleotide
  Target: ATXN1; (+) strand; PAM type: NRG; PAM sequence: TAG
gatggttacttgcaaggaaa

SEQ ID NO: 142016 - DNA, 20 bp, Artificial Sequence
  Description of Artificial Sequence: Synthetic oligonucleotide
  Target: ATXN1; (+) strand; PAM type: NRG; PAM sequence: TGG
ttgcaaggaaatagtttaca

SEQ ID NO: 142017 - DNA, 20 bp, Artificial Sequence
  Description of Artificial Sequence: Synthetic oligonucleotide
  Target: ATXN1; (+) strand; PAM type: NRG; PAM sequence: AAG
atagtttacatggaccacta

SEQ ID NO: 142018 - DNA, 20 bp, Artificial Sequence
  Description of Artificial Sequence: Synthetic oligonucleotide
  Target: ATXN1; (+) strand; PAM type: NRG; PAM sequence: CAG
accactaaagacctccaaaa

SEQ ID NO: 142019 - DNA, 20 bp, Artificial Sequence
  Description of Artificial Sequence: Synthetic oligonucleotide
  Target: ATXN1; (+) strand; PAM type: NRG; PAM sequence: TGG
aaaacagaaatgccaacatc

SEQ ID NO: 142020 - DNA, 20 bp, Artificial Sequence
  Description of Artificial Sequence: Synthetic oligonucleotide
  Target: ATXN1; (+) strand; PAM type: NRG; PAM sequence: TAG
tcctccacctgacatccttt

SEQ ID NO: 142021 - DNA, 20 bp, Artificial Sequence
  Description of Artificial Sequence: Synthetic oligonucleotide
  Target: ATXN1; (+) strand; PAM type: NRG; PAM sequence: AAG
acctgacatccttttagaca

SEQ ID NO: 142022 - DNA, 20 bp, Artificial Sequence
  Description of Artificial Sequence: Synthetic oligonucleotide
  Target: ATXN1; (+) strand; PAM type: NRG; PAM sequence: AGG
cctgacatccttttagacaa

SEQ ID NO: 142023 - DNA, 20 bp, Artificial Sequence
  Description of Artificial Sequence: Synthetic oligonucleotide
  Target: ATXN1; (+) strand; PAM type: NRG; PAM sequence: AAG
tccttttagacaaaggctca

SEQ ID NO: 142024 - DNA, 20 bp, Artificial Sequence
  Description of Artificial Sequence: Synthetic oligonucleotide
  Target: ATXN1; (+) strand; PAM type: NRG; PAM sequence: CAG
aaggctcaaagtcaattatg

SEQ ID NO: 142025 - DNA, 20 bp, Artificial Sequence
  Description of Artificial Sequence: Synthetic oligonucleotide
  Target: ATXN1; (+) strand; PAM type: NRG; PAM sequence: TGG
aaagtcaattatgcagacaa

SEQ ID NO: 142026 - DNA, 20 bp, Artificial Sequence
  Description of Artificial Sequence: Synthetic oligonucleotide
  Target: ATXN1; (+) strand; PAM type: NRG; PAM sequence: TAG
aatggcacctttctcttctg

SEQ ID NO: 142027 - DNA, 20 bp, Artificial Sequence
  Description of Artificial Sequence: Synthetic oligonucleotide
  Target: ATXN1; (+) strand; PAM type: NRG; PAM sequence: TGG
ctcttctgtagctgacaacc

SEQ ID NO: 142028 - DNA, 20 bp, Artificial Sequence
  Description of Artificial Sequence: Synthetic oligonucleotide
  Target: ATXN1; (+) strand; PAM type: NRG; PAM sequence: CAG
tgccttctgcaacccaaaaa

SEQ ID NO: 142029 - DNA, 20 bp, Artificial Sequence
  Description of Artificial Sequence: Synthetic oligonucleotide
  Target: ATXN1; (+) strand; PAM type: NRG; PAM sequence: CAG
aaaacagccctcgctcccat

SEQ ID NO: 142030 - DNA, 20 bp, Artificial Sequence
  Description of Artificial Sequence: Synthetic oligonucleotide
  Target: ATXN1; (+) strand; PAM type: NRG; PAM sequence: TGG
cagccctcgctcccatcaga

SEQ ID NO: 142031 - DNA, 20 bp, Artificial Sequence
  Description of Artificial Sequence: Synthetic oligonucleotide
  Target: ATXN1; (+) strand; PAM type: NRG; PAM sequence: AAG
cctcgctcccatcagatgga

SEQ ID NO: 142032 - DNA, 20 bp, Artificial Sequence
  Description of Artificial Sequence: Synthetic oligonucleotide
  Target: ATXN1; (+) strand; PAM type: NRG; PAM sequence: CAG
atcagatggaaagaactacg

SEQ ID NO: 142033 - DNA, 20 bp, Artificial Sequence
  Description of Artificial Sequence: Synthetic oligonucleotide
  Target: ATXN1; (+) strand; PAM type: NRG; PAM sequence: GAG
cagatggaaagaactacgca

SEQ ID NO: 142034 - DNA, 20 bp, Artificial Sequence
  Description of Artificial Sequence: Synthetic oligonucleotide
  Target: ATXN1; (+) strand; PAM type: NRG; PAM sequence: AGG
agatggaaagaactacgcag

SEQ ID NO: 142035 - DNA, 20 bp, Artificial Sequence
  Description of Artificial Sequence: Synthetic oligonucleotide
  Target: ATXN1; (+) strand; PAM type: NRG; PAM sequence: TAG
gaactacgcagaggaaaatc

SEQ ID NO: 142036 - DNA, 20 bp, Artificial Sequence
  Description of Artificial Sequence: Synthetic oligonucleotide
  Target: ATXN1; (+) strand; PAM type: NRG; PAM sequence: AAG
tacgcagaggaaaatctagt

SEQ ID NO: 142037 - DNA, 20 bp, Artificial Sequence
  Description of Artificial Sequence: Synthetic oligonucleotide
  Target: ATXN1; (+) strand; PAM type: NRG; PAM sequence: AGG
acgcagaggaaaatctagta

SEQ ID NO: 142038 - DNA, 20 bp, Artificial Sequence
  Description of Artificial Sequence: Synthetic oligonucleotide
  Target: ATXN1; (+) strand; PAM type: NRG; PAM sequence: AAG
aatctagtaaggtctccatg

SEQ ID NO: 142039 - DNA, 20 bp, Artificial Sequence
  Description of Artificial Sequence: Synthetic oligonucleotide
  Target: ATXN1; (+) strand; PAM type: NRG; PAM sequence: AAG
ctccatgaagcacatattaa

SEQ ID NO: 142040 - DNA, 20 bp, Artificial Sequence
  Description of Artificial Sequence: Synthetic oligonucleotide
  Target: ATXN1; (+) strand; PAM type: NRG; PAM sequence: TGG
agcctaatgtgcccttaaca

SEQ ID NO: 142041 - DNA, 20 bp, Artificial Sequence
  Description of Artificial Sequence: Synthetic oligonucleotide
  Target: ATXN1; (+) strand; PAM type: NRG; PAM sequence: CAG
atgtgcccttaacatggctt

SEQ ID NO: 142042 - DNA, 20 bp, Artificial Sequence
  Description of Artificial Sequence: Synthetic oligonucleotide
  Target: ATXN1; (+) strand; PAM type: NRG; PAM sequence: TGG
ttaacatggcttcagcaaac

SEQ ID NO: 142043 - DNA, 20 bp, Artificial Sequence
  Description of Artificial Sequence: Synthetic oligonucleotide
  Target: ATXN1; (+) strand; PAM type: NRG; PAM sequence: GGG
taacatggcttcagcaaact

SEQ ID NO: 142044 - DNA, 20 bp, Artificial Sequence
  Description of Artificial Sequence: Synthetic oligonucleotide
  Target: ATXN1; (+) strand; PAM type: NRG; PAM sequence: TAG
ctgggcttttttccttcact

SEQ ID NO: 142045 - DNA, 20 bp, Artificial Sequence
  Description of Artificial Sequence: Synthetic oligonucleotide
  Target: ATXN1; (+) strand; PAM type: NRG; PAM sequence: GAG
cttttttccttcacttagat

SEQ ID NO: 142046 - DNA, 20 bp, Artificial Sequence
  Description of Artificial Sequence: Synthetic oligonucleotide
  Target: ATXN1; (+) strand; PAM type: NRG; PAM sequence: GAG
cttcacttagatgagaattt

SEQ ID NO: 142047 - DNA, 20 bp, Artificial Sequence
  Description of Artificial Sequence: Synthetic oligonucleotide
  Target: ATXN1; (+) strand; PAM type: NRG; PAM sequence: AAG
cacttagatgagaatttgag

SEQ ID NO: 142048 - DNA, 20 bp, Artificial Sequence
  Description of Artificial Sequence: Synthetic oligonucleotide
  Target: ATXN1; (+) strand; PAM type: NRG; PAM sequence: CGG
gaatttgagaagaatccact

SEQ ID NO: 142049 - DNA, 20 bp, Artificial Sequence
  Description of Artificial Sequence: Synthetic oligonucleotide
  Target: ATXN1; (+) strand; PAM type: NRG; PAM sequence: TAG
tctgctcgccaaacctcctt

SEQ ID NO: 142050 - DNA, 20 bp, Artificial Sequence
  Description of Artificial Sequence: Synthetic oligonucleotide
  Target: ATXN1; (+) strand; PAM type: NRG; PAM sequence: TAG
ctcctttagtcaaaactgaa

SEQ ID NO: 142051 - DNA, 20 bp, Artificial Sequence
  Description of Artificial Sequence: Synthetic oligonucleotide
  Target: ATXN1; (+) strand; PAM type: NRG; PAM sequence: GAG
cctttagtcaaaactgaata

SEQ ID NO: 142052 - DNA, 20 bp, Artificial Sequence
  Description of Artificial Sequence: Synthetic oligonucleotide
  Target: ATXN1; (+) strand; PAM type: NRG; PAM sequence: TGG
gtcaaaactgaatagagacc

SEQ ID NO: 142053 - DNA, 20 bp, Artificial Sequence
  Description of Artificial Sequence: Synthetic oligonucleotide
  Target: ATXN1; (+) strand; PAM type: NRG; PAM sequence: GGG
tcaaaactgaatagagacct

SEQ ID NO: 142054 - DNA, 20 bp, Artificial Sequence
  Description of Artificial Sequence: Synthetic oligonucleotide
  Target: ATXN1; (+) strand; PAM type: NRG; PAM sequence: GAG
aaaactgaatagagacctgg

SEQ ID NO: 142055 - DNA, 20 bp, Artificial Sequence
  Description of Artificial Sequence: Synthetic oligonucleotide
  Target: ATXN1; (+) strand; PAM type: NRG; PAM sequence: AAG
actgaatagagacctgggag

SEQ ID NO: 142056 - DNA, 20 bp, Artificial Sequence
  Description of Artificial Sequence: Synthetic oligonucleotide
  Target: ATXN1; (+) strand; PAM type: NRG; PAM sequence: TGG
agaagatacttctccaacac

SEQ ID NO: 142057 - DNA, 20 bp, Artificial Sequence
  Description of Artificial Sequence: Synthetic oligonucleotide
  Target: ATXN1; (+) strand; PAM type: NRG; PAM sequence: GGG
gaagatacttctccaacact

SEQ ID NO: 142058 - DNA, 20 bp, Artificial Sequence
  Description of Artificial Sequence: Synthetic oligonucleotide
  Target: ATXN1; (+) strand; PAM type: NRG; PAM sequence: AAG
cttctccaacactgggcttg

SEQ ID NO: 142059 - DNA, 20 bp, Artificial Sequence
  Description of Artificial Sequence: Synthetic oligonucleotide
  Target: ATXN1; (+) strand; PAM type: NRG; PAM sequence: AGG
ttctccaacactgggcttga

SEQ ID NO: 142060 - DNA, 20 bp, Artificial Sequence
  Description of Artificial Sequence: Synthetic oligonucleotide
  Target: ATXN1; (+) strand; PAM type: NRG; PAM sequence: CAG
tttttcacacaaactgaatt

SEQ ID NO: 142061 - DNA, 20 bp, Artificial Sequence
  Description of Artificial Sequence: Synthetic oligonucleotide
  Target: ATXN1; (+) strand; PAM type: NRG; PAM sequence: AGG
ttttcacacaaactgaattc

SEQ ID NO: 142062 - DNA, 20 bp, Artificial Sequence
  Description of Artificial Sequence: Synthetic oligonucleotide
  Target: ATXN1; (+) strand; PAM type: NRG; PAM sequence: AAG
aggattgccacaacttctcc

SEQ ID NO: 142063 - DNA, 20 bp, Artificial Sequence
  Description of Artificial Sequence: Synthetic oligonucleotide
  Target: ATXN1; (+) strand; PAM type: NRG; PAM sequence: AAG
tctccaagcaaaactgaact

SEQ ID NO: 142064 - DNA, 20 bp, Artificial Sequence
  Description of Artificial Sequence: Synthetic oligonucleotide
  Target: ATXN1; (+) strand; PAM type: NRG; PAM sequence: CAG
agcaaaactgaactaagcaa

SEQ ID NO: 142065 - DNA, 20 bp, Artificial Sequence
  Description of Artificial Sequence: Synthetic oligonucleotide
  Target: ATXN1; (+) strand; PAM type: NRG; PAM sequence: AAG
actaagcaacagccaaataa

SEQ ID NO: 142066 - DNA, 20 bp, Artificial Sequence
  Description of Artificial Sequence: Synthetic oligonucleotide
  Target: ATXN1; (+) strand; PAM type: NRG; PAM sequence: GAG
taagcaacagccaaataaaa

SEQ ID NO: 142067 - DNA, 20 bp, Artificial Sequence
  Description of Artificial Sequence: Synthetic oligonucleotide
  Target: ATXN1; (+) strand; PAM type: NRG; PAM sequence: AAG
acagccaaataaaagagaaa

SEQ ID NO: 142068 - DNA, 20 bp, Artificial Sequence
  Description of Artificial Sequence: Synthetic oligonucleotide
  Target: ATXN1; (+) strand; PAM type: NRG; PAM sequence: TGG
aaaaaatgtgttaatgcatt

SEQ ID NO: 142069 - DNA, 20 bp, Artificial Sequence
  Description of Artificial Sequence: Synthetic oligonucleotide
  Target: ATXN1; (+) strand; PAM type: NRG; PAM sequence: TAG
aaatgtgttaatgcatttgg

SEQ ID NO: 142070 - DNA, 20 bp, Artificial Sequence
  Description of Artificial Sequence: Synthetic oligonucleotide
  Target: ATXN1; (+) strand; PAM type: NRG; PAM sequence: TGG
tgtgttaatgcatttggtag

SEQ ID NO: 142071 - DNA, 20 bp, Artificial Sequence
  Description of Artificial Sequence: Synthetic oligonucleotide
  Target: ATXN1; (+) strand; PAM type: NRG; PAM sequence: TAG
ttaatgcatttggtagtggt

SEQ ID NO: 142072 - DNA, 20 bp, Artificial Sequence
  Description of Artificial Sequence: Synthetic oligonucleotide
  Target: ATXN1; (+) strand; PAM type: NRG; PAM sequence: CAG
tttggtagtggttagattaa

SEQ ID NO: 142073 - DNA, 20 bp, Artificial Sequence
  Description of Artificial Sequence: Synthetic oligonucleotide
  Target: ATXN1; (+) strand; PAM type: NRG; PAM sequence: TGG
acagctaataaatgtcctga

SEQ ID NO: 142074 - DNA, 20 bp, Artificial Sequence
  Description of Artificial Sequence: Synthetic oligonucleotide
  Target: ATXN1; (+) strand; PAM type: NRG; PAM sequence: TGG
aaatgtcctgatggccacgc

SEQ ID NO: 142075 - DNA, 20 bp, Artificial Sequence
  Description of Artificial Sequence: Synthetic oligonucleotide
  Target: ATXN1; (+) strand; PAM type: NRG; PAM sequence: TAG
tggccacgctggttcctttc

SEQ ID NO: 142076 - DNA, 20 bp, Artificial Sequence
  Description of Artificial Sequence: Synthetic oligonucleotide
  Target: ATXN1; (+) strand; PAM type: NRG; PAM sequence: AGG
ggccacgctggttcctttct

SEQ ID NO: 142077 - DNA, 20 bp, Artificial Sequence
  Description of Artificial Sequence: Synthetic oligonucleotide
  Target: ATXN1; (+) strand; PAM type: NRG; PAM sequence: TAG
acgctggttcctttctaggc

SEQ ID NO: 142078 - DNA, 20 bp, Artificial Sequence
  Description of Artificial Sequence: Synthetic oligonucleotide
  Target: ATXN1; (+) strand; PAM type: NRG; PAM sequence: AAG
ggttcctttctaggctagct

SEQ ID NO: 142079 - DNA, 20 bp, Artificial Sequence
  Description of Artificial Sequence: Synthetic oligonucleotide
  Target: ATXN1; (+) strand; PAM type: NRG; PAM sequence: GAG
taggctagctaagcttctgt

SEQ ID NO: 142080 - DNA, 20 bp, Artificial Sequence
  Description of Artificial Sequence: Synthetic oligonucleotide
  Target: ATXN1; (+) strand; PAM type: NRG; PAM sequence: TGG
cttctgtgagttcttctgtt

SEQ ID NO: 142081 - DNA, 20 bp, Artificial Sequence
  Description of Artificial Sequence: Synthetic oligonucleotide
  Target: ATXN1; (+) strand; PAM type: NRG; PAM sequence: CAG
tctgtttggattccatctac

SEQ ID NO: 142082 - DNA, 20 bp, Artificial Sequence
  Description of Artificial Sequence: Synthetic oligonucleotide
  Target: ATXN1; (+) strand; PAM type: NRG; PAM sequence: AGG
ctgtttggattccatctacc

SEQ ID NO: 142083 - DNA, 20 bp, Artificial Sequence
  Description of Artificial Sequence: Synthetic oligonucleotide
  Target: ATXN1; (+) strand; PAM type: NRG; PAM sequence: GGG
tgtttggattccatctacca

SEQ ID NO: 142084 - DNA, 20 bp, Artificial Sequence
  Description of Artificial Sequence: Synthetic oligonucleotide
  Target: ATXN1; (+) strand; PAM type: NRG; PAM sequence: TGG
tggattccatctaccagggc

SEQ ID NO: 142085 - DNA, 20 bp, Artificial Sequence
  Description of Artificial Sequence: Synthetic oligonucleotide
  Target: ATXN1; (+) strand; PAM type: NRG; PAM sequence: GAG
gattccatctaccagggctg

SEQ ID NO: 142086 - DNA, 20 bp, Artificial Sequence
  Description of Artificial Sequence: Synthetic oligonucleotide
  Target: ATXN1; (+) strand; PAM type: NRG; PAM sequence: CAG
tctaccagggctggagccac

SEQ ID NO: 142087 - DNA, 20 bp, Artificial Sequence
  Description of Artificial Sequence: Synthetic oligonucleotide
  Target: ATXN1; (+) strand; PAM type: NRG; PAM sequence: AAG
ccagggctggagccaccagc

SEQ ID NO: 142088 - DNA, 20 bp, Artificial Sequence
  Description of Artificial Sequence: Synthetic oligonucleotide
  Target: ATXN1; (+) strand; PAM type: NRG; PAM sequence: AGG
cagggctggagccaccagca

SEQ ID NO: 142089 - DNA, 20 bp, Artificial Sequence
  Description of Artificial Sequence: Synthetic oligonucleotide
  Target: ATXN1; (+) strand; PAM type: NRG; PAM sequence: GGG
agggctggagccaccagcaa

SEQ ID NO: 142090 - DNA, 20 bp, Artificial Sequence
  Description of Artificial Sequence: Synthetic oligonucleotide
  Target: ATXN1; (+) strand; PAM type: NRG; PAM sequence: CAG
gagccaccagcaagggcatt

SEQ ID NO: 142091 - DNA, 20 bp, Artificial Sequence
  Description of Artificial Sequence: Synthetic oligonucleotide
  Target: ATXN1; (+) strand; PAM type: NRG; PAM sequence: AGG
agccaccagcaagggcattc

SEQ ID NO: 142092 - DNA, 20 bp, Artificial Sequence
  Description of Artificial Sequence: Synthetic oligonucleotide
  Target: ATXN1; (+) strand; PAM type: NRG; PAM sequence: GAG
ccaccagcaagggcattcag

SEQ ID NO: 142093 - DNA, 20 bp, Artificial Sequence
  Description of Artificial Sequence: Synthetic oligonucleotide
  Target: ATXN1; (+) strand; PAM type: NRG; PAM sequence: AGG
caccagcaagggcattcagg

SEQ ID NO: 142094 - DNA, 20 bp, Artificial Sequence
  Description of Artificial Sequence: Synthetic oligonucleotide
  Target: ATXN1; (+) strand; PAM type: NRG; PAM sequence: CAG
agggcattcaggaggtgcac

SEQ ID NO: 142095 - DNA, 20 bp, Artificial Sequence
  Description of Artificial Sequence: Synthetic oligonucleotide
  Target: ATXN1; (+) strand; PAM type: NRG; PAM sequence: AAG
gcattcaggaggtgcaccag

SEQ ID NO: 142096 - DNA, 20 bp, Artificial Sequence
  Description of Artificial Sequence: Synthetic oligonucleotide
  Target: ATXN1; (+) strand; PAM type: NRG; PAM sequence: CAG
ttcaggaggtgcaccagaag

SEQ ID NO: 142097 - DNA, 20 bp, Artificial Sequence
  Description of Artificial Sequence: Synthetic oligonucleotide
  Target: ATXN1; (+) strand; PAM type: NRG; PAM sequence: TGG
aacgccctgcaaatctctcc

SEQ ID NO: 142098 - DNA, 20 bp, Artificial Sequence
  Description of Artificial Sequence: Synthetic oligonucleotide
  Target: ATXN1; (+) strand; PAM type: NRG; PAM sequence: AAG
aaatctctcctggatcatcc

SEQ ID NO: 142099 - DNA, 20 bp, Artificial Sequence
  Description of Artificial Sequence: Synthetic oligonucleotide
  Target: ATXN1; (+) strand; PAM type: NRG; PAM sequence: CAG
tctcctggatcatccaagac

SEQ ID NO: 142100 - DNA, 20 bp, Artificial Sequence
  Description of Artificial Sequence: Synthetic oligonucleotide
  Target: ATXN1; (+) strand; PAM type: NRG; PAM sequence: AGG
ctcctggatcatccaagacc

SEQ ID NO: 142101 - DNA, 20 bp, Artificial Sequence
  Description of Artificial Sequence: Synthetic oligonucleotide
  Target: ATXN1; (+) strand; PAM type: NRG; PAM sequence: TGG
aagaccaggcatgcccttgc

SEQ ID NO: 142102 - DNA, 20 bp, Artificial Sequence
  Description of Artificial Sequence: Synthetic oligonucleotide
  Target: ATXN1; (+) strand; PAM type: NRG; PAM sequence: AAG
aggcatgcccttgctggaac

SEQ ID NO: 142103 - DNA, 20 bp, Artificial Sequence
  Description of Artificial Sequence: Synthetic oligonucleotide
  Target: ATXN1; (+) strand; PAM type: NRG; PAM sequence: GAG
gcatgcccttgctggaacaa

SEQ ID NO: 142104 - DNA, 20 bp, Artificial Sequence
  Description of Artificial Sequence: Synthetic oligonucleotide
  Target: ATXN1; (+) strand; PAM type: NRG; PAM sequence: AGG
catgcccttgctggaacaag

SEQ ID NO: 142105 - DNA, 20 bp, Artificial Sequence
  Description of Artificial Sequence: Synthetic oligonucleotide
  Target: ATXN1; (+) strand; PAM type: NRG; PAM sequence: CGG
gcccttgctggaacaagagg

SEQ ID NO: 142106 - DNA, 20 bp, Artificial Sequence
  Description of Artificial Sequence: Synthetic oligonucleotide
  Target: ATXN1; (+) strand; PAM type: NRG; PAM sequence: CGG
ttgctggaacaagaggcgga

SEQ ID NO: 142107 - DNA, 20 bp, Artificial Sequence
  Description of Artificial Sequence: Synthetic oligonucleotide
  Target: ATXN1; (+) strand; PAM type: NRG; PAM sequence: AAG
ctggaacaagaggcggacgg

SEQ ID NO: 142108 - DNA, 20 bp, Artificial Sequence
  Description of Artificial Sequence: Synthetic oligonucleotide
  Target: ATXN1; (+) strand; PAM type: NRG; PAM sequence: AGG
tggaacaagaggcggacgga

SEQ ID NO: 142109 - DNA, 20 bp, Artificial Sequence
  Description of Artificial Sequence: Synthetic oligonucleotide
  Target: ATXN1; (+) strand; PAM type: NRG; PAM sequence: GAG
gaacaagaggcggacggaag

SEQ ID NO: 142110 - DNA, 20 bp, Artificial Sequence
  Description of Artificial Sequence: Synthetic oligonucleotide
  Target: ATXN1; (+) strand; PAM type: NRG; PAM sequence: GAG
acaagaggcggacggaagga

SEQ ID NO: 142111 - DNA, 20 bp, Artificial Sequence
  Description of Artificial Sequence: Synthetic oligonucleotide
  Target: ATXN1; (+) strand; PAM type: NRG; PAM sequence: AGG
caagaggcggacggaaggag

SEQ ID NO: 142112 - DNA, 20 bp, Artificial Sequence
  Description of Artificial Sequence: Synthetic oligonucleotide
  Target: ATXN1; (+) strand; PAM type: NRG; PAM sequence: GGG
aagaggcggacggaaggaga

SEQ ID NO: 142113 - DNA, 20 bp, Artificial Sequence
  Description of Artificial Sequence: Synthetic oligonucleotide
  Target: ATXN1; (+) strand; PAM type: NRG; PAM sequence: AAG
gcggacggaaggagagggcc

SEQ ID NO: 142114 - DNA, 20 bp, Artificial Sequence
  Description of Artificial Sequence: Synthetic oligonucleotide
  Target: ATXN1; (+) strand; PAM type: NRG; PAM sequence: CAG
agggccaagtgtcaccactg

SEQ ID NO: 142115 - DNA, 20 bp, Artificial Sequence
  Description of Artificial Sequence: Synthetic oligonucleotide
  Target: ATXN1; (+) strand; PAM type: NRG; PAM sequence: TGG
ccactgcagtctgctaacat

SEQ ID NO: 142116 - DNA, 20 bp, Artificial Sequence
  Description of Artificial Sequence: Synthetic oligonucleotide
  Target: ATXN1; (+) strand; PAM type: NRG; PAM sequence: TAG
gaatccaccactgtgcactg

SEQ ID NO: 142117 - DNA, 20 bp, Artificial Sequence
  Description of Artificial Sequence: Synthetic oligonucleotide
  Target: ATXN1; (+) strand; PAM type: NRG; PAM sequence: AGG
aatccaccactgtgcactgt

SEQ ID NO: 142118 - DNA, 20 bp, Artificial Sequence
  Description of Artificial Sequence: Synthetic oligonucleotide
  Target: ATXN1; (+) strand; PAM type: NRG; PAM sequence: TAG
gtgctttgatgtgcgtccac

SEQ ID NO: 142119 - DNA, 20 bp, Artificial Sequence
  Description of Artificial Sequence: Synthetic oligonucleotide
  Target: ATXN1; (+) strand; PAM type: NRG; PAM sequence: GAG
gctttgatgtgcgtccacta

SEQ ID NO: 142120 - DNA, 20 bp, Artificial Sequence
  Description of Artificial Sequence: Synthetic oligonucleotide
  Target: ATXN1; (+) strand; PAM type: NRG; PAM sequence: CAG
gagctaaacttgatcctttt

SEQ ID NO: 142121 - DNA, 20 bp, Artificial Sequence
  Description of Artificial Sequence: Synthetic oligonucleotide
  Target: ATXN1; (+) strand; PAM type: NRG; PAM sequence: CAG
ctaaacttgatccttttcag

SEQ ID NO: 142122 - DNA, 20 bp, Artificial Sequence
  Description of Artificial Sequence: Synthetic oligonucleotide
  Target: ATXN1; (+) strand; PAM type: NRG; PAM sequence: CGG
aacttgatccttttcagcag

SEQ ID NO: 142123 - DNA, 20 bp, Artificial Sequence
  Description of Artificial Sequence: Synthetic oligonucleotide
  Target: ATXN1; (+) strand; PAM type: NRG; PAM sequence: GGG
acttgatccttttcagcagc

SEQ ID NO: 142124 - DNA, 20 bp, Artificial Sequence
  Description of Artificial Sequence: Synthetic oligonucleotide
  Target: ATXN1; (+) strand; PAM type: NRG; PAM sequence: GAG
caccaaaactgacaacctgc

SEQ ID NO: 142125 - DNA, 20 bp, Artificial Sequence
  Description of Artificial Sequence: Synthetic oligonucleotide
  Target: ATXN1; (+) strand; PAM type: NRG; PAM sequence: AGG
accaaaactgacaacctgcg

SEQ ID NO: 142126 - DNA, 20 bp, Artificial Sequence
  Description of Artificial Sequence: Synthetic oligonucleotide
  Target: ATXN1; (+) strand; PAM type: NRG; PAM sequence: CAG
tgacaacctgcgaggcctaa

SEQ ID NO: 142127 - DNA, 20 bp, Artificial Sequence
  Description of Artificial Sequence: Synthetic oligonucleotide
  Target: ATXN1; (+) strand; PAM type: NRG; PAM sequence: AAG
ctgcgaggcctaacagctga

SEQ ID NO: 142128 - DNA, 20 bp, Artificial Sequence
  Description of Artificial Sequence: Synthetic oligonucleotide
  Target: ATXN1; (+) strand; PAM type: NRG; PAM sequence: CAG
cagctgaaagaaataccact

SEQ ID NO: 142129 - DNA, 20 bp, Artificial Sequence
  Description of Artificial Sequence: Synthetic oligonucleotide
  Target: ATXN1; (+) strand; PAM type: NRG; PAM sequence: AAG
accactcagaataaactgcc

SEQ ID NO: 142130 - DNA, 20 bp, Artificial Sequence
  Description of Artificial Sequence: Synthetic oligonucleotide
  Target: ATXN1; (+) strand; PAM type: NRG; PAM sequence: AGG
ccactcagaataaactgcca

SEQ ID NO: 142131 - DNA, 20 bp, Artificial Sequence
  Description of Artificial Sequence: Synthetic oligonucleotide
  Target: ATXN1; (+) strand; PAM type: NRG; PAM sequence: GGG
cactcagaataaactgccaa

SEQ ID NO: 142132 - DNA, 20 bp, Artificial Sequence
  Description of Artificial Sequence: Synthetic oligonucleotide
  Target: ATXN1; (+) strand; PAM type: NRG; PAM sequence: TAG
tcagaataaactgccaaggg

SEQ ID NO: 142133 - DNA, 20 bp, Artificial Sequence
  Description of Artificial Sequence: Synthetic oligonucleotide
  Target: ATXN1; (+) strand; PAM type: NRG; PAM sequence: CAG
gaataaactgccaagggtag

SEQ ID NO: 142134 - DNA, 20 bp, Artificial Sequence
  Description of Artificial Sequence: Synthetic oligonucleotide
  Target: ATXN1; (+) strand; PAM type: NRG; PAM sequence: AGG
aataaactgccaagggtagc

SEQ ID NO: 142135 - DNA, 20 bp, Artificial Sequence
  Description of Artificial Sequence: Synthetic oligonucleotide
  Target: ATXN1; (+) strand; PAM type: NRG; PAM sequence: TGG
actgccaagggtagcaggtg

SEQ ID NO: 142136 - DNA, 20 bp, Artificial Sequence
  Description of Artificial Sequence: Synthetic oligonucleotide
  Target: ATXN1; (+) strand; PAM type: NRG; PAM sequence: TGG
aagggtagcaggtgtggctt

SEQ ID NO: 142137 - DNA, 20 bp, Artificial Sequence
  Description of Artificial Sequence: Synthetic oligonucleotide
  Target: ATXN1; (+) strand; PAM type: NRG; PAM sequence: GGG
agggtagcaggtgtggcttt

SEQ ID NO: 142138 - DNA, 20 bp, Artificial Sequence
  Description of Artificial Sequence: Synthetic oligonucleotide
  Target: ATXN1; (+) strand; PAM type: NRG; PAM sequence: GAG
ggtagcaggtgtggctttgg

SEQ ID NO: 142139 - DNA, 20 bp, Artificial Sequence
  Description of Artificial Sequence: Synthetic oligonucleotide
  Target: ATXN1; (+) strand; PAM type: NRG; PAM sequence: AAG
caggtgtggctttgggagcc

SEQ ID NO: 142140 - DNA, 20 bp, Artificial Sequence
  Description of Artificial Sequence: Synthetic oligonucleotide
  Target: ATXN1; (+) strand; PAM type: NRG; PAM sequence: AGG
aggtgtggctttgggagcca

SEQ ID NO: 142141 - DNA, 20 bp, Artificial Sequence
  Description of Artificial Sequence: Synthetic oligonucleotide
  Target: ATXN1; (+) strand; PAM type: NRG; PAM sequence: AAG
ggctttgggagccaaggata

SEQ ID NO: 142142 - DNA, 20 bp, Artificial Sequence
  Description of Artificial Sequence: Synthetic oligonucleotide
  Target: ATXN1; (+) strand; PAM type: NRG; PAM sequence: TAG
ggagccaaggataaagcttc

SEQ ID NO: 142143 - DNA, 20 bp, Artificial Sequence
  Description of Artificial Sequence: Synthetic oligonucleotide
  Target: ATXN1; (+) strand; PAM type: NRG; PAM sequence: TAG
caaggataaagcttctagtt

SEQ ID NO: 142144 - DNA, 20 bp, Artificial Sequence
  Description of Artificial Sequence: Synthetic oligonucleotide
  Target: ATXN1; (+) strand; PAM type: NRG; PAM sequence: CAG
ataaagcttctagtttagca

SEQ ID NO: 142145 - DNA, 20 bp, Artificial Sequence
  Description of Artificial Sequence: Synthetic oligonucleotide
  Target: ATXN1; (+) strand; PAM type: NRG; PAM sequence: CGG
gcttctagtttagcacagtc

SEQ ID NO: 142146 - DNA, 20 bp, Artificial Sequence
  Description of Artificial Sequence: Synthetic oligonucleotide
  Target: ATXN1; (+) strand; PAM type: NRG; PAM sequence: CAG
cacagtccggttcctatcct

SEQ ID NO: 142147 - DNA, 20 bp, Artificial Sequence
  Description of Artificial Sequence: Synthetic oligonucleotide
  Target: ATXN1; (+) strand; PAM type: NRG; PAM sequence: TAG
ctatcctcagatctttctcc

SEQ ID NO: 142148 - DNA, 20 bp, Artificial Sequence
  Description of Artificial Sequence: Synthetic oligonucleotide
  Target: ATXN1; (+) strand; PAM type: NRG; PAM sequence: CAG
tttctcctagcctgctgctc

SEQ ID NO: 142149 - DNA, 20 bp, Artificial Sequence
  Description of Artificial Sequence: Synthetic oligonucleotide
  Target: ATXN1; (+) strand; PAM type: NRG; PAM sequence: CAG
cctagcctgctgctccagcc

SEQ ID NO: 142150 - DNA, 20 bp, Artificial Sequence
  Description of Artificial Sequence: Synthetic oligonucleotide
  Target: ATXN1; (+) strand; PAM type: NRG; PAM sequence: TAG
tgctccagcccagctcctca

SEQ ID NO: 142151 - DNA, 20 bp, Artificial Sequence
  Description of Artificial Sequence: Synthetic oligonucleotide
  Target: ATXN1; (+) strand; PAM type: NRG; PAM sequence: TAG
tgtccccactatcccaatct

SEQ ID NO: 142152 - DNA, 20 bp, Artificial Sequence
  Description of Artificial Sequence: Synthetic oligonucleotide
  Target: ATXN1; (+) strand; PAM type: NRG; PAM sequence: CAG
cccactatcccaatcttagt

SEQ ID NO: 142153 - DNA, 20 bp, Artificial Sequence
  Description of Artificial Sequence: Synthetic oligonucleotide
  Target: ATXN1; (+) strand; PAM type: NRG; PAM sequence: AGG
ccactatcccaatcttagtc

SEQ ID NO: 142154 - DNA, 20 bp, Artificial Sequence
  Description of Artificial Sequence: Synthetic oligonucleotide
  Target: ATXN1; (+) strand; PAM type: NRG; PAM sequence: GGG
cactatcccaatcttagtca

SEQ ID NO: 142155 - DNA, 20 bp, Artificial Sequence
  Description of Artificial Sequence: Synthetic oligonucleotide
  Target: ATXN1; (+) strand; PAM type: NRG; PAM sequence: GGG
actatcccaatcttagtcag

SEQ ID NO: 142156 - DNA, 20 bp, Artificial Sequence
  Description of Artificial Sequence: Synthetic oligonucleotide
  Target: ATXN1; (+) strand; PAM type: NRG; PAM sequence: CAG
gctcctgtcattaccaccaa

SEQ ID NO: 142157 - DNA, 20 bp, Artificial Sequence
  Description of Artificial Sequence: Synthetic oligonucleotide
  Target: ATXN1; (+) strand; PAM type: NRG; PAM sequence: GAG
tcctgtcattaccaccaaca

SEQ ID NO: 142158 - DNA, 20 bp, Artificial Sequence
  Description of Artificial Sequence: Synthetic oligonucleotide
  Target: ATXN1; (+) strand; PAM type: NRG; PAM sequence: TAG
gtcattaccaccaacagagt

SEQ ID NO: 142159 - DNA, 20 bp, Artificial Sequence
  Description of Artificial Sequence: Synthetic oligonucleotide
  Target: ATXN1; (+) strand; PAM type: NRG; PAM sequence: AAG
aacagagttagtgattacaa

SEQ ID NO: 142160 - DNA, 20 bp, Artificial Sequence
  Description of Artificial Sequence: Synthetic oligonucleotide
  Target: ATXN1; (+) strand; PAM type: NRG; PAM sequence: AAG
gttagtgattacaaaagata

SEQ ID NO: 142161 - DNA, 20 bp, Artificial Sequence
  Description of Artificial Sequence: Synthetic oligonucleotide
  Target: ATXN1; (+) strand; PAM type: NRG; PAM sequence: GAG
tagtgattacaaaagataaa

SEQ ID NO: 142162 - DNA, 20 bp, Artificial Sequence
  Description of Artificial Sequence: Synthetic oligonucleotide
  Target: ATXN1; (+) strand; PAM type: NRG; PAM sequence: AAG
aaaagataaagagacaaaaa

SEQ ID NO: 142163 - DNA, 20 bp, Artificial Sequence
  Description of Artificial Sequence: Synthetic oligonucleotide
  Target: ATXN1; (+) strand; PAM type: NRG; PAM sequence: AAG
agacaaaaaaagatttccaa

SEQ ID NO: 142164 - DNA, 20 bp, Artificial Sequence
  Description of Artificial Sequence: Synthetic oligonucleotide
  Target: ATXN1; (+) strand; PAM type: NRG; PAM sequence: GAG
acaaaaaaagatttccaaaa

SEQ ID NO: 142165 - DNA, 20 bp, Artificial Sequence
  Description of Artificial Sequence: Synthetic oligonucleotide
  Target: ATXN1; (+) strand; PAM type: NRG; PAM sequence: TAG
ttccaaaagagcctctgccc

SEQ ID NO: 142166 - DNA, 20 bp, Artificial Sequence
  Description of Artificial Sequence: Synthetic oligonucleotide
  Target: ATXN1; (+) strand; PAM type: NRG; PAM sequence: AGG
tccaaaagagcctctgccct

SEQ ID NO: 142167 - DNA, 20 bp, Artificial Sequence
  Description of Artificial Sequence: Synthetic oligonucleotide
  Target: ATXN1; (+) strand; PAM type: NRG; PAM sequence: GGG
ccaaaagagcctctgcccta

SEQ ID NO: 142168 - DNA, 20 bp, Artificial Sequence
  Description of Artificial Sequence: Synthetic oligonucleotide
  Target: ATXN1; (+) strand; PAM type: NRG; PAM sequence: GGG
caaaagagcctctgccctag

SEQ ID NO: 142169 - DNA, 20 bp, Artificial Sequence
  Description of Artificial Sequence: Synthetic oligonucleotide
  Target: ATXN1; (+) strand; PAM type: NRG; PAM sequence: TGG
aggggaacactttacgtatt

SEQ ID NO: 142170 - DNA, 20 bp, Artificial Sequence
  Description of Artificial Sequence: Synthetic oligonucleotide
  Target: ATXN1; (+) strand; PAM type: NRG; PAM sequence: AAG
ggaacactttacgtatttgg

SEQ ID NO: 142171 - DNA, 20 bp, Artificial Sequence
  Description of Artificial Sequence: Synthetic oligonucleotide
  Target: ATXN1; (+) strand; PAM type: NRG; PAM sequence: AAG
cactttacgtatttggaaga

SEQ ID NO: 142172 - DNA, 20 bp, Artificial Sequence
  Description of Artificial Sequence: Synthetic oligonucleotide
  Target: ATXN1; (+) strand; PAM type: NRG; PAM sequence: TGG
tttacgtatttggaagaaag

SEQ ID NO: 142173 - DNA, 20 bp, Artificial Sequence
  Description of Artificial Sequence: Synthetic oligonucleotide
  Target: ATXN1; (+) strand; PAM type: NRG; PAM sequence: GGG
ttacgtatttggaagaaagt

SEQ ID NO: 142174 - DNA, 20 bp, Artificial Sequence
  Description of Artificial Sequence: Synthetic oligonucleotide
  Target: ATXN1; (+) strand; PAM type: NRG; PAM sequence: AAG
tggaagaaagtgggtttcta

SEQ ID NO: 142175 - DNA, 20 bp, Artificial Sequence
  Description of Artificial Sequence: Synthetic oligonucleotide
  Target: ATXN1; (+) strand; PAM type: NRG; PAM sequence: AGG
ggaagaaagtgggtttctaa

SEQ ID NO: 142176 - DNA, 20 bp, Artificial Sequence
  Description of Artificial Sequence: Synthetic oligonucleotide
  Target: ATXN1; (+) strand; PAM type: NRG; PAM sequence: CAG
aaagtgggtttctaaaggtt

SEQ ID NO: 142177 - DNA, 20 bp, Artificial Sequence
  Description of Artificial Sequence: Synthetic oligonucleotide
  Target: ATXN1; (+) strand; PAM type: NRG; PAM sequence: GAG
agtgggtttctaaaggttca

SEQ ID NO: 142178 - DNA, 20 bp, Artificial Sequence
  Description of Artificial Sequence: Synthetic oligonucleotide
  Target: ATXN1; (+) strand; PAM type: NRG; PAM sequence: AAG
gctgacctcacatcctgaaa

SEQ ID NO: 142179 - DNA, 20 bp, Artificial Sequence
  Description of Artificial Sequence: Synthetic oligonucleotide
  Target: ATXN1; (+) strand; PAM type: NRG; PAM sequence: TGG
cctcacatcctgaaaaagct

SEQ ID NO: 142180 - DNA, 20 bp, Artificial Sequence
  Description of Artificial Sequence: Synthetic oligonucleotide
  Target: ATXN1; (+) strand; PAM type: NRG; PAM sequence: AAG
ctgaaaaagcttggcaactg

SEQ ID NO: 142181 - DNA, 20 bp, Artificial Sequence
  Description of Artificial Sequence: Synthetic oligonucleotide
  Target: ATXN1; (+) strand; PAM type: NRG; PAM sequence: GAG
gaaaaagcttggcaactgaa

SEQ ID NO: 142182 - DNA, 20 bp, Artificial Sequence
  Description of Artificial Sequence: Synthetic oligonucleotide
  Target: ATXN1; (+) strand; PAM type: NRG; PAM sequence: AGG
aaaaagcttggcaactgaag

SEQ ID NO: 142183 - DNA, 20 bp, Artificial Sequence
  Description of Artificial Sequence: Synthetic oligonucleotide
  Target: ATXN1; (+) strand; PAM type: NRG; PAM sequence: GGG
aaaagcttggcaactgaaga

SEQ ID NO: 142184 - DNA, 20 bp, Artificial Sequence
  Description of Artificial Sequence: Synthetic oligonucleotide
  Target: ATXN1; (+) strand; PAM type: NRG; PAM sequence: TGG
aagagggaatgcaaccctca

SEQ ID NO: 142185 - DNA, 20 bp, Artificial Sequence
  Description of Artificial Sequence: Synthetic oligonucleotide
  Target: ATXN1; (+) strand; PAM type: NRG; PAM sequence: TAG
cctcatggcttgatgttgct

SEQ ID NO: 142186 - DNA, 20 bp, Artificial Sequence
  Description of Artificial Sequence: Synthetic oligonucleotide
  Target: ATXN1; (+) strand; PAM type: NRG; PAM sequence: AGG
ctcatggcttgatgttgctt

SEQ ID NO: 142187 - DNA, 20 bp, Artificial Sequence
  Description of Artificial Sequence: Synthetic oligonucleotide
  Target: ATXN1; (+) strand; PAM type: NRG; PAM sequence: AAG
ttgatgttgcttaggtcaac

SEQ ID NO: 142188 - DNA, 20 bp, Artificial Sequence
  Description of Artificial Sequence: Synthetic oligonucleotide
  Target: ATXN1; (+) strand; PAM type: NRG; PAM sequence: TGG
gtcaacaagcaaatatttcc

SEQ ID NO: 142189 - DNA, 20 bp, Artificial Sequence
  Description of Artificial Sequence: Synthetic oligonucleotide
  Target: ATXN1; (+) strand; PAM type: NRG; PAM sequence: TAG
tatttcctggacacctacca

SEQ ID NO: 142190 - DNA, 20 bp, Artificial Sequence
  Description of Artificial Sequence: Synthetic oligonucleotide
  Target: ATXN1; (+) strand; PAM type: NRG; PAM sequence: AGG
atttcctggacacctaccat

SEQ ID NO: 142191 - DNA, 20 bp, Artificial Sequence
  Description of Artificial Sequence: Synthetic oligonucleotide
  Target: ATXN1; (+) strand; PAM type: NRG; PAM sequence: CAG
ctggacacctaccataggct

SEQ ID NO: 142192 - DNA, 20 bp, Artificial Sequence
  Description of Artificial Sequence: Synthetic oligonucleotide
  Target: ATXN1; (+) strand; PAM type: NRG; PAM sequence: TGG
acctaccataggctcagacc

SEQ ID NO: 142193 - DNA, 20 bp, Artificial Sequence
  Description of Artificial Sequence: Synthetic oligonucleotide
  Target: ATXN1; (+) strand; PAM type: NRG; PAM sequence: TGG
cagacctggaccctttgctg

SEQ ID NO: 142194 - DNA, 20 bp, Artificial Sequence
  Description of Artificial Sequence: Synthetic oligonucleotide
  Target: ATXN1; (+) strand; PAM type: NRG; PAM sequence: GGG
agacctggaccctttgctgt

SEQ ID NO: 142195 - DNA, 20 bp, Artificial Sequence
  Description of Artificial Sequence: Synthetic oligonucleotide
  Target: ATXN1; (+) strand; PAM type: NRG; PAM sequence: GAG
acctggaccctttgctgtgg

SEQ ID NO: 142196 - DNA, 20 bp, Artificial Sequence
  Description of Artificial Sequence: Synthetic oligonucleotide
  Target: ATXN1; (+) strand; PAM type: NRG; PAM sequence: GAG
ctggaccctttgctgtggga

SEQ ID NO: 142197 - DNA, 20 bp, Artificial Sequence
  Description of Artificial Sequence: Synthetic oligonucleotide
  Target: ATXN1; (+) strand; PAM type: NRG; PAM sequence: AGG
tggaccctttgctgtgggag

SEQ ID NO: 142198 - DNA, 20 bp, Artificial Sequence
  Description of Artificial Sequence: Synthetic oligonucleotide
  Target: ATXN1; (+) strand; PAM type: NRG; PAM sequence: GAG
gaccctttgctgtgggagag

SEQ ID NO: 142199 - DNA, 20 bp, Artificial Sequence
  Description of Artificial Sequence: Synthetic oligonucleotide
  Target: ATXN1; (+) strand; PAM type: NRG; PAM sequence: AGG
accctttgctgtgggagagg

SEQ ID NO: 142200 - DNA, 20 bp, Artificial Sequence
  Description of Artificial Sequence: Synthetic oligonucleotide
  Target: ATXN1; (+) strand; PAM type: NRG; PAM sequence: AAG
ttgctgtgggagaggaggca

SEQ ID NO: 142201 - DNA, 20 bp, Artificial Sequence
  Description of Artificial Sequence: Synthetic oligonucleotide
  Target: ATXN1; (+) strand; PAM type: NRG; PAM sequence: GAG
gctgtgggagaggaggcaaa

SEQ ID NO: 142202 - DNA, 20 bp, Artificial Sequence
  Description of Artificial Sequence: Synthetic oligonucleotide
  Target: ATXN1; (+) strand; PAM type: NRG; PAM sequence: AGG
ctgtgggagaggaggcaaag

SEQ ID NO: 142203 - DNA, 20 bp, Artificial Sequence
  Description of Artificial Sequence: Synthetic oligonucleotide
  Target: ATXN1; (+) strand; PAM type: NRG; PAM sequence: GAG
gtgggagaggaggcaaagag

SEQ ID NO: 142204 - DNA, 20 bp, Artificial Sequence
  Description of Artificial Sequence: Synthetic oligonucleotide
  Target: ATXN1; (+) strand; PAM type: NRG; PAM sequence: AGG
tgggagaggaggcaaagagg

SEQ ID NO: 142205 - DNA, 20 bp, Artificial Sequence
  Description of Artificial Sequence: Synthetic oligonucleotide
  Target: ATXN1; (+) strand; PAM type: NRG; PAM sequence: CAG
ggaggatgcacaattatttt

SEQ ID NO: 142206 - DNA, 20 bp, Artificial Sequence
  Description of Artificial Sequence: Synthetic oligonucleotide
  Target: ATXN1; (+) strand; PAM type: NRG; PAM sequence: TAG
gatgcacaattattttcaga

SEQ ID NO: 142207 - DNA, 20 bp, Artificial Sequence
  Description of Artificial Sequence: Synthetic oligonucleotide
  Target: ATXN1; (+) strand; PAM type: NRG; PAM sequence: CAG
agatagttattctcaaacct

SEQ ID NO: 142208 - DNA, 20 bp, Artificial Sequence
  Description of Artificial Sequence: Synthetic oligonucleotide
  Target: ATXN1; (+) strand; PAM type: NRG; PAM sequence: AAG
tctcaaacctcagtgtgcaa

SEQ ID NO: 142209 - DNA, 20 bp, Artificial Sequence
  Description of Artificial Sequence: Synthetic oligonucleotide
  Target: ATXN1; (+) strand; PAM type: NRG; PAM sequence: AAG
tcagtgtgcaaaagttaact

SEQ ID NO: 142210 - DNA, 20 bp, Artificial Sequence
  Description of Artificial Sequence: Synthetic oligonucleotide
  Target: ATXN1; (+) strand; PAM type: NRG; PAM sequence: AGG
cagtgtgcaaaagttaacta

SEQ ID NO: 142211 - DNA, 20 bp, Artificial Sequence
  Description of Artificial Sequence: Synthetic oligonucleotide
  Target: ATXN1; (+) strand; PAM type: NRG; PAM sequence: GAG
gtgcaaaagttaactaaggt

SEQ ID NO: 142212 - DNA, 20 bp, Artificial Sequence
  Description of Artificial Sequence: Synthetic oligonucleotide
  Target: ATXN1; (+) strand; PAM type: NRG; PAM sequence: TGG
gttaactaaggtgagtttcc

SEQ ID NO: 142213 - DNA, 20 bp, Artificial Sequence
  Description of Artificial Sequence: Synthetic oligonucleotide
  Target: ATXN1; (+) strand; PAM type: NRG; PAM sequence: GGG
ttaactaaggtgagtttcct

SEQ ID NO: 142214 - DNA, 20 bp, Artificial Sequence
  Description of Artificial Sequence: Synthetic oligonucleotide
  Target: ATXN1; (+) strand; PAM type: NRG; PAM sequence: CAG
tttcctgggttctacatccc

SEQ ID NO: 142215 - DNA, 20 bp, Artificial Sequence
  Description of Artificial Sequence: Synthetic oligonucleotide
  Target: ATXN1; (+) strand; PAM type: NRG; PAM sequence: AAG
ccccagaacttctgattcat

SEQ ID NO: 142216 - DNA, 20 bp, Artificial Sequence
  Description of Artificial Sequence: Synthetic oligonucleotide
  Target: ATXN1; (+) strand; PAM type: NRG; PAM sequence: TGG
gaacttctgattcataagcc

SEQ ID NO: 142217 - DNA, 20 bp, Artificial Sequence
  Description of Artificial Sequence: Synthetic oligonucleotide
  Target: ATXN1; (+) strand; PAM type: NRG; PAM sequence: AAG
caactttaataaacatatcc

SEQ ID NO: 142218 - DNA, 20 bp, Artificial Sequence
  Description of Artificial Sequence: Synthetic oligonucleotide
  Target: ATXN1; (+) strand; PAM type: NRG; PAM sequence: GAG
actttaataaacatatccaa

SEQ ID NO: 142219 - DNA, 20 bp, Artificial Sequence
  Description of Artificial Sequence: Synthetic oligonucleotide
  Target: ATXN1; (+) strand; PAM type: NRG; PAM sequence: CGG
ataaacatatccaagagatt

SEQ ID NO: 142220 - DNA, 20 bp, Artificial Sequence
  Description of Artificial Sequence: Synthetic oligonucleotide
  Target: ATXN1; (+) strand; PAM type: NRG; PAM sequence: AAG
aacatatccaagagattcgg

SEQ ID NO: 142221 - DNA, 20 bp, Artificial Sequence
  Description of Artificial Sequence: Synthetic oligonucleotide
  Target: ATXN1; (+) strand; PAM type: NRG; PAM sequence: CAG
atatccaagagattcggaag

SEQ ID NO: 142222 - DNA, 20 bp, Artificial Sequence
  Description of Artificial Sequence: Synthetic oligonucleotide
  Target: ATXN1; (+) strand; PAM type: NRG; PAM sequence: AGG
tatccaagagattcggaagc

SEQ ID NO: 142223 - DNA, 20 bp, Artificial Sequence
  Description of Artificial Sequence: Synthetic oligonucleotide
  Target: ATXN1; (+) strand; PAM type: NRG; PAM sequence: GAG
tccaagagattcggaagcag

SEQ ID NO: 142224 - DNA, 20 bp, Artificial Sequence
  Description of Artificial Sequence: Synthetic oligonucleotide
  Target: ATXN1; (+) strand; PAM type: NRG; PAM sequence: AGG
ccaagagattcggaagcagg

SEQ ID NO: 142225 - DNA, 20 bp, Artificial Sequence
  Description of Artificial Sequence: Synthetic oligonucleotide
  Target: ATXN1; (+) strand; PAM type: NRG; PAM sequence: TGG
gattcggaagcaggaggtac

SEQ ID NO: 142226 - DNA, 20 bp, Artificial Sequence
  Description of Artificial Sequence: Synthetic oligonucleotide
  Target: ATXN1; (+) strand; PAM type: NRG; PAM sequence: GGG
attcggaagcaggaggtact

SEQ ID NO: 142227 - DNA, 20 bp, Artificial Sequence
  Description of Artificial Sequence: Synthetic oligonucleotide
  Target: ATXN1; (+) strand; PAM type: NRG; PAM sequence: TAG
gaagcaggaggtactgggat

SEQ ID NO: 142228 - DNA, 20 bp, Artificial Sequence
  Description of Artificial Sequence: Synthetic oligonucleotide
  Target: ATXN1; (+) strand; PAM type: NRG; PAM sequence: TGG
tactgggattagaccaccct

SEQ ID NO: 142229 - DNA, 20 bp, Artificial Sequence
  Description of Artificial Sequence: Synthetic oligonucleotide
  Target: ATXN1; (+) strand; PAM type: NRG; PAM sequence: GGG
actgggattagaccaccctt

SEQ ID NO: 142230 - DNA, 20 bp, Artificial Sequence
  Description of Artificial Sequence: Synthetic oligonucleotide
  Target: ATXN1; (+) strand; PAM type: NRG; PAM sequence: TGG
agaccacccttgggaaacac

SEQ ID NO: 142231 - DNA, 20 bp, Artificial Sequence
  Description of Artificial Sequence: Synthetic oligonucleotide
  Target: ATXN1; (+) strand; PAM type: NRG; PAM sequence: AAG
gtgatttgattcctgccttg

SEQ ID NO: 142232 - DNA, 20 bp, Artificial Sequence
  Description of Artificial Sequence: Synthetic oligonucleotide
  Target: ATXN1; (+) strand; PAM type: NRG; PAM sequence: TGG
cccatgtgcaattgtgctga

SEQ ID NO: 142233 - DNA, 20 bp, Artificial Sequence
  Description of Artificial Sequence: Synthetic oligonucleotide
  Target: ATXN1; (+) strand; PAM type: NRG; PAM sequence: CAG
gtgctgatggcaaacactca

SEQ ID NO: 142234 - DNA, 20 bp, Artificial Sequence
  Description of Artificial Sequence: Synthetic oligonucleotide
  Target: ATXN1; (+) strand; PAM type: NRG; PAM sequence: GAG
gctgatggcaaacactcaca

SEQ ID NO: 142235 - DNA, 20 bp, Artificial Sequence
  Description of Artificial Sequence: Synthetic oligonucleotide
  Target: ATXN1; (+) strand; PAM type: NRG; PAM sequence: CAG
aacactcacagagtaatgca

SEQ ID NO: 142236 - DNA, 20 bp, Artificial Sequence
  Description of Artificial Sequence: Synthetic oligonucleotide
  Target: ATXN1; (+) strand; PAM type: NRG; PAM sequence: CAG
actcacagagtaatgcacag

SEQ ID NO: 142237 - DNA, 20 bp, Artificial Sequence
  Description of Artificial Sequence: Synthetic oligonucleotide
  Target: ATXN1; (+) strand; PAM type: NRG; PAM sequence: AAG
tgcacagcagtacattctgt

SEQ ID NO: 142238 - DNA, 20 bp, Artificial Sequence
  Description of Artificial Sequence: Synthetic oligonucleotide
  Target: ATXN1; (+) strand; PAM type: NRG; PAM sequence: AAG
acagcagtacattctgtaag

SEQ ID NO: 142239 - DNA, 20 bp, Artificial Sequence
  Description of Artificial Sequence: Synthetic oligonucleotide
  Target: ATXN1; (+) strand; PAM type: NRG; PAM sequence: CAG
gcagtacattctgtaagaag

SEQ ID NO: 142240 - DNA, 20 bp, Artificial Sequence
  Description of Artificial Sequence: Synthetic oligonucleotide
  Target: ATXN1; (+) strand; PAM type: NRG; PAM sequence: AGG
cagtacattctgtaagaagc

SEQ ID NO: 142241 - DNA, 20 bp, Artificial Sequence
  Description of Artificial Sequence: Synthetic oligonucleotide
  Target: ATXN1; (+) strand; PAM type: NRG; PAM sequence: TAG
gaagcaggccctaaatgtga

SEQ ID NO: 142242 - DNA, 20 bp, Artificial Sequence
  Description of Artificial Sequence: Synthetic oligonucleotide
  Target: ATXN1; (+) strand; PAM type: NRG; PAM sequence: AAG
gcaggccctaaatgtgatag

SEQ ID NO: 142243 - DNA, 20 bp, Artificial Sequence
  Description of Artificial Sequence: Synthetic oligonucleotide
  Target: ATXN1; (+) strand; PAM type: NRG; PAM sequence: AAG
aaatgtgatagaagttcata

SEQ ID NO: 142244 - DNA, 20 bp, Artificial Sequence
  Description of Artificial Sequence: Synthetic oligonucleotide
  Target: ATXN1; (+) strand; PAM type: NRG; PAM sequence: GAG
atgtgatagaagttcataaa

SEQ ID NO: 142245 - DNA, 20 bp, Artificial Sequence
  Description of Artificial Sequence: Synthetic oligonucleotide
  Target: ATXN1; (+) strand; PAM type: NRG; PAM sequence: GAG
gtgatagaagttcataaaga

SEQ ID NO: 142246 - DNA, 20 bp, Artificial Sequence
  Description of Artificial Sequence: Synthetic oligonucleotide
  Target: ATXN1; (+) strand; PAM type: NRG; PAM sequence: CAG
gttcataaagagagactgct

SEQ ID NO: 142247 - DNA, 20 bp, Artificial Sequence
  Description of Artificial Sequence: Synthetic oligonucleotide
  Target: ATXN1; (+) strand; PAM type: NRG; PAM sequence: AGG
ttcataaagagagactgctc

SEQ ID NO: 142248 - DNA, 20 bp, Artificial Sequence
  Description of Artificial Sequence: Synthetic oligonucleotide
  Target: ATXN1; (+) strand; PAM type: NRG; PAM sequence: GGG
tcataaagagagactgctca

SEQ ID NO: 142249 - DNA, 20 bp, Artificial Sequence
  Description of Artificial Sequence: Synthetic oligonucleotide
  Target: ATXN1; (+) strand; PAM type: NRG; PAM sequence: CGG
aaagagagactgctcagggc

SEQ ID NO: 142250 - DNA, 20 bp, Artificial Sequence
  Description of Artificial Sequence: Synthetic oligonucleotide
  Target: ATXN1; (+) strand; PAM type: NRG; PAM sequence: GGG
aagagagactgctcagggcc

SEQ ID NO: 142251 - DNA, 20 bp, Artificial Sequence
  Description of Artificial Sequence: Synthetic oligonucleotide
  Target: ATXN1; (+) strand; PAM type: NRG; PAM sequence: CAG
agactgctcagggccgggcg

SEQ ID NO: 142252 - DNA, 20 bp, Artificial Sequence
  Description of Artificial Sequence: Synthetic oligonucleotide
  Target: ATXN1; (+) strand; PAM type: NRG; PAM sequence: TGG
ctgctcagggccgggcgcag

SEQ ID NO: 142253 - DNA, 20 bp, Artificial Sequence
  Description of Artificial Sequence: Synthetic oligonucleotide
  Target: ATXN1; (+) strand; PAM type: NRG; PAM sequence: CAG
gtggcttacacctgtaatct

SEQ ID NO: 142254 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatctcagcactt

SEQ ID NO: 142255 - DNA, 20 bp, Artificial Sequence
  Description of Artificial Sequence: Synthetic oligonucleotide
  Target: ATXN1; (+) strand; PAM type: NRG; PAM sequence: AAG
ctgtaatctcagcactttgg

SEQ ID NO: 142256 - DNA, 20 bp, Artificial Sequence
  Description of Artificial Sequence: Synthetic oligonucleotide
  Target: ATXN1; (+) strand; PAM type: NRG; PAM sequence: AGG
tgtaatctcagcactttgga

SEQ ID NO: 142257 - DNA, 20 bp, Artificial Sequence
  Description of Artificial Sequence: Synthetic oligonucleotide
  Target: ATXN1; (+) strand; PAM type: NRG; PAM sequence: AAG
tctcagcactttggaaggcc

SEQ ID NO: 142258 - DNA, 20 bp, Artificial Sequence
  Description of Artificial Sequence: Synthetic oligonucleotide
  Target: ATXN1; (+) strand; PAM type: NRG; PAM sequence: AGG
ctcagcactttggaaggcca

SEQ ID NO: 142259 - DNA, 20 bp, Artificial Sequence
  Description of Artificial Sequence: Synthetic oligonucleotide
  Target: ATXN1; (+) strand; PAM type: NRG; PAM sequence: CAG
agcactttggaaggccaagg

SEQ ID NO: 142260 - DNA, 20 bp, Artificial Sequence
  Description of Artificial Sequence: Synthetic oligonucleotide
  Target: ATXN1; (+) strand; PAM type: NRG; PAM sequence: TGG
ctttggaaggccaaggcaga

SEQ ID NO: 142261 - DNA, 20 bp, Artificial Sequence
  Description of Artificial Sequence: Synthetic oligonucleotide
  Target: ATXN1; (+) strand; PAM type: NRG; PAM sequence: GAG
ggccaaggcagatggatcat

SEQ ID NO: 142262 - DNA, 20 bp, Artificial Sequence
  Description of Artificial Sequence: Synthetic oligonucleotide
  Target: ATXN1; (+) strand; PAM type: NRG; PAM sequence: AAG
ggcagatggatcatgagatc

SEQ ID NO: 142263 - DNA, 20 bp, Artificial Sequence
  Description of Artificial Sequence: Synthetic oligonucleotide
  Target: ATXN1; (+) strand; PAM type: NRG; PAM sequence: GAG
cagatggatcatgagatcaa

SEQ ID NO: 142264 - DNA, 20 bp, Artificial Sequence
  Description of Artificial Sequence: Synthetic oligonucleotide
  Target: ATXN1; (+) strand; PAM type: NRG; PAM sequence: AAG
gatcatgagatcaagagatc

SEQ ID NO: 142265 - DNA, 20 bp, Artificial Sequence
  Description of Artificial Sequence: Synthetic oligonucleotide
  Target: ATXN1; (+) strand; PAM type: NRG; PAM sequence: TGG
tcaagagatcaagaccatcc

SEQ ID NO: 142266 - DNA, 20 bp, Artificial Sequence
  Description of Artificial Sequence: Synthetic oligonucleotide
  Target: ATXN1; (+) strand; PAM type: NRG; PAM sequence: TGG
caagaccatcctggccaaca

SEQ ID NO: 142267 - DNA, 20 bp, Artificial Sequence
  Description of Artificial Sequence: Synthetic oligonucleotide
  Target: ATXN1; (+) strand; PAM type: NRG; PAM sequence: TAG
aaccccatttctactaaaaa

SEQ ID NO: 142268 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatagaaaaat

SEQ ID NO: 142269 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatagaaaaattagc

SEQ ID NO: 142270 - DNA, 20 bp, Artificial Sequence
  Description of Artificial Sequence: Synthetic oligonucleotide
  Target: ATXN1; (+) strand; PAM type: NRG; PAM sequence: GGG
taaaaatagaaaaattagct

SEQ ID NO: 142271 - DNA, 20 bp, Artificial Sequence
  Description of Artificial Sequence: Synthetic oligonucleotide
  Target: ATXN1; (+) strand; PAM type: NRG; PAM sequence: CGG
atagaaaaattagctgggca

SEQ ID NO: 142272 - DNA, 20 bp, Artificial Sequence
  Description of Artificial Sequence: Synthetic oligonucleotide
  Target: ATXN1; (+) strand; PAM type: NRG; PAM sequence: TGG
gaaaaattagctgggcacgg

SEQ ID NO: 142273 - DNA, 20 bp, Artificial Sequence
  Description of Artificial Sequence: Synthetic oligonucleotide
  Target: ATXN1; (+) strand; PAM type: NRG; PAM sequence: CAG
gtggcgcatgcctgtaatcc

SEQ ID NO: 142274 - DNA, 20 bp, Artificial Sequence
  Description of Artificial Sequence: Synthetic oligonucleotide
  Target: ATXN1; (+) strand; PAM type: NRG; PAM sequence: CAG
tgcctgtaatcccagctact

SEQ ID NO: 142275 - DNA, 20 bp, Artificial Sequence
  Description of Artificial Sequence: Synthetic oligonucleotide
  Target: ATXN1; (+) strand; PAM type: NRG; PAM sequence: AGG
gcctgtaatcccagctactc

SEQ ID NO: 142276 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctactcag

SEQ ID NO: 142277 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctactcagg

SEQ ID NO: 142278 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcaggaggct

SEQ ID NO: 142279 - DNA, 20 bp, Artificial Sequence
  Description of Artificial Sequence: Synthetic oligonucleotide
  Target: ATXN1; (+) strand; PAM type: NRG; PAM sequence: AGG
cccagctactcaggaggctg

SEQ ID NO: 142280 - DNA, 20 bp, Artificial Sequence
  Description of Artificial Sequence: Synthetic oligonucleotide
  Target: ATXN1; (+) strand; PAM type: NRG; PAM sequence: AAG
gctactcaggaggctgaggc

SEQ ID NO: 142281 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctgaggcaa

SEQ ID NO: 142282 - DNA, 20 bp, Artificial Sequence
  Description of Artificial Sequence: Synthetic oligonucleotide
  Target: ATXN1; (+) strand; PAM type: NRG; PAM sequence: TGG
gcaagagaattgcttgaacc

SEQ ID NO: 142283 - DNA, 20 bp, Artificial Sequence
  Description of Artificial Sequence: Synthetic oligonucleotide
  Target: ATXN1; (+) strand; PAM type: NRG; PAM sequence: GGG
caagagaattgcttgaacct

SEQ ID NO: 142284 - DNA, 20 bp, Artificial Sequence
  Description of Artificial Sequence: Synthetic oligonucleotide
  Target: ATXN1; (+) strand; PAM type: NRG; PAM sequence: GAG
agagaattgcttgaacctgg

SEQ ID NO: 142285 - DNA, 20 bp, Artificial Sequence
  Description of Artificial Sequence: Synthetic oligonucleotide
  Target: ATXN1; (+) strand; PAM type: NRG; PAM sequence: AGG
gagaattgcttgaacctggg

SEQ ID NO: 142286 - DNA, 20 bp, Artificial Sequence
  Description of Artificial Sequence: Synthetic oligonucleotide
  Target: ATXN1; (+) strand; PAM type: NRG; PAM sequence: AAG
ttgcttgaacctgggaggcg

SEQ ID NO: 142287 - DNA, 20 bp, Artificial Sequence
  Description of Artificial Sequence: Synthetic oligonucleotide
  Target: ATXN1; (+) strand; PAM type: NRG; PAM sequence: AGG
tgcttgaacctgggaggcga

SEQ ID NO: 142288 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggcgaaggttg

SEQ ID NO: 142289 - DNA, 20 bp, Artificial Sequence
  Description of Artificial Sequence: Synthetic oligonucleotide
  Target: ATXN1; (+) strand; PAM type: NRG; PAM sequence: GAG
tgggaggcgaaggttgcagt

SEQ ID NO: 142290 - DNA, 20 bp, Artificial Sequence
  Description of Artificial Sequence: Synthetic oligonucleotide
  Target: ATXN1; (+) strand; PAM type: NRG; PAM sequence: AAG
ggcgaaggttgcagtgagcc

SEQ ID NO: 142291 - DNA, 20 bp, Artificial Sequence
  Description of Artificial Sequence: Synthetic oligonucleotide
  Target: ATXN1; (+) strand; PAM type: NRG; PAM sequence: CAG
ccaagattgccactgcactc

SEQ ID NO: 142292 - DNA, 20 bp, Artificial Sequence
  Description of Artificial Sequence: Synthetic oligonucleotide
  Target: ATXN1; (+) strand; PAM type: NRG; PAM sequence: TAG
attgccactgcactccagcc

SEQ ID NO: 142293 - DNA, 20 bp, Artificial Sequence
  Description of Artificial Sequence: Synthetic oligonucleotide
  Target: ATXN1; (+) strand; PAM type: NRG; PAM sequence: CAG
actgcactccagcctagcaa

SEQ ID NO: 142294 - DNA, 20 bp, Artificial Sequence
  Description of Artificial Sequence: Synthetic oligonucleotide
  Target: ATXN1; (+) strand; PAM type: NRG; PAM sequence: AAG
tccagcctagcaacagaccc

SEQ ID NO: 142295 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaaaaaaaaa

SEQ ID NO: 142296 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaaaaaaaaaa

SEQ ID NO: 142297 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaaaaaaaaga

SEQ ID NO: 142298 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaaaaaagaga

SEQ ID NO: 142299 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaaaagagaga

SEQ ID NO: 142300 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaagagagaga

SEQ ID NO: 142301 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaagagagagaga

SEQ ID NO: 142302 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaagagagagagaga

SEQ ID NO: 142303 - DNA, 20 bp, Artificial Sequence
  Description of Artificial Sequence: Synthetic oligonucleotide
  Target: ATXN1; (+) strand; PAM type: NRG; PAM sequence: CAG
aaagagagagagagagagac

SEQ ID NO: 142304 - DNA, 20 bp, Artificial Sequence
  Description of Artificial Sequence: Synthetic oligonucleotide
  Target: ATXN1; (+) strand; PAM type: NRG; PAM sequence: CAG
agagagagagagagaccagt

SEQ ID NO: 142305 - DNA, 20 bp, Artificial Sequence
  Description of Artificial Sequence: Synthetic oligonucleotide
  Target: ATXN1; (+) strand; PAM type: NRG; PAM sequence: AAG
gagagagagaccagtcagtg

SEQ ID NO: 142306 - DNA, 20 bp, Artificial Sequence
  Description of Artificial Sequence: Synthetic oligonucleotide
  Target: ATXN1; (+) strand; PAM type: NRG; PAM sequence: GAG
agaccagtcagtgaagtcct

SEQ ID NO: 142307 - DNA, 20 bp, Artificial Sequence
  Description of Artificial Sequence: Synthetic oligonucleotide
  Target: ATXN1; (+) strand; PAM type: NRG; PAM sequence: AGG
gaccagtcagtgaagtcctg

SEQ ID NO: 142308 - DNA, 20 bp, Artificial Sequence
  Description of Artificial Sequence: Synthetic oligonucleotide
  Target: ATXN1; (+) strand; PAM type: NRG; PAM sequence: CAG
tcagtgaagtcctgaggatt

SEQ ID NO: 142309 - DNA, 20 bp, Artificial Sequence
  Description of Artificial Sequence: Synthetic oligonucleotide
  Target: ATXN1; (+) strand; PAM type: NRG; PAM sequence: AGG
cagtgaagtcctgaggattc

SEQ ID NO: 142310 - DNA, 20 bp, Artificial Sequence
  Description of Artificial Sequence: Synthetic oligonucleotide
  Target: ATXN1; (+) strand; PAM type: NRG; PAM sequence: GGG
agtgaagtcctgaggattca

SEQ ID NO: 142311 - DNA, 20 bp, Artificial Sequence
  Description of Artificial Sequence: Synthetic oligonucleotide
  Target: ATXN1; (+) strand; PAM type: NRG; PAM sequence: AAG
gaagtcctgaggattcaggg

SEQ ID NO: 142312 - DNA, 20 bp, Artificial Sequence
  Description of Artificial Sequence: Synthetic oligonucleotide
  Target: ATXN1; (+) strand; PAM type: NRG; PAM sequence: AAG
ggattcagggaagactttgt

SEQ ID NO: 142313 - DNA, 20 bp, Artificial Sequence
  Description of Artificial Sequence: Synthetic oligonucleotide
  Target: ATXN1; (+) strand; PAM type: NRG; PAM sequence: CAG
agggaagactttgtaagtga

SEQ ID NO: 142314 - DNA, 20 bp, Artificial Sequence
  Description of Artificial Sequence: Synthetic oligonucleotide
  Target: ATXN1; (+) strand; PAM type: NRG; PAM sequence: CAG
aagactttgtaagtgacagc

SEQ ID NO: 142315 - DNA, 20 bp, Artificial Sequence
  Description of Artificial Sequence: Synthetic oligonucleotide
  Target: ATXN1; (+) strand; PAM type: NRG; PAM sequence: AGG
agactttgtaagtgacagcc

SEQ ID NO: 142316 - DNA, 20 bp, Artificial Sequence
  Description of Artificial Sequence: Synthetic oligonucleotide
  Target: ATXN1; (+) strand; PAM type: NRG; PAM sequence: TGG
taagtgacagccaggatttg

SEQ ID NO: 142317 - DNA, 20 bp, Artificial Sequence
  Description of Artificial Sequence: Synthetic oligonucleotide
  Target: ATXN1; (+) strand; PAM type: NRG; PAM sequence: GAG
tgacagccaggatttgtggt

SEQ ID NO: 142318 - DNA, 20 bp, Artificial Sequence
  Description of Artificial Sequence: Synthetic oligonucleotide
  Target: ATXN1; (+) strand; PAM type: NRG; PAM sequence: AGG
gacagccaggatttgtggtg

SEQ ID NO: 142319 - DNA, 20 bp, Artificial Sequence
  Description of Artificial Sequence: Synthetic oligonucleotide
  Target: ATXN1; (+) strand; PAM type: NRG; PAM sequence: CAG
agccaggatttgtggtgagg

SEQ ID NO: 142320 - DNA, 20 bp, Artificial Sequence
  Description of Artificial Sequence: Synthetic oligonucleotide
  Target: ATXN1; (+) strand; PAM type: NRG; PAM sequence: TAG
gtggtgaggcagaactttga

SEQ ID NO: 142321 - DNA, 20 bp, Artificial Sequence
  Description of Artificial Sequence: Synthetic oligonucleotide
  Target: ATXN1; (+) strand; PAM type: NRG; PAM sequence: GAG
ggtgaggcagaactttgata

SEQ ID NO: 142322 - DNA, 20 bp, Artificial Sequence
  Description of Artificial Sequence: Synthetic oligonucleotide
  Target: ATXN1; (+) strand; PAM type: NRG; PAM sequence: TAG
aggcagaactttgatagaga

SEQ ID NO: 142323 - DNA, 20 bp, Artificial Sequence
  Description of Artificial Sequence: Synthetic oligonucleotide
  Target: ATXN1; (+) strand; PAM type: NRG; PAM sequence: AAG
ctttgatagagatagtcccc

SEQ ID NO: 142324 - DNA, 20 bp, Artificial Sequence
  Description of Artificial Sequence: Synthetic oligonucleotide
  Target: ATXN1; (+) strand; PAM type: NRG; PAM sequence: CAG
cttaatcaaacctcccgatt

SEQ ID NO: 142325 - DNA, 20 bp, Artificial Sequence
  Description of Artificial Sequence: Synthetic oligonucleotide
  Target: ATXN1; (+) strand; PAM type: NRG; PAM sequence: AAG
cctcccgattcagcatgaca

SEQ ID NO: 142326 - DNA, 20 bp, Artificial Sequence
  Description of Artificial Sequence: Synthetic oligonucleotide
  Target: ATXN1; (+) strand; PAM type: NRG; PAM sequence: TGG
cccgattcagcatgacaaag

SEQ ID NO: 142327 - DNA, 20 bp, Artificial Sequence
  Description of Artificial Sequence: Synthetic oligonucleotide
  Target: ATXN1; (+) strand; PAM type: NRG; PAM sequence: TGG
tcagcatgacaaagtggcca

SEQ ID NO: 142328 - DNA, 20 bp, Artificial Sequence
  Description of Artificial Sequence: Synthetic oligonucleotide
  Target: ATXN1; (+) strand; PAM type: NRG; PAM sequence: CAG
gacaaagtggccatggcata

SEQ ID NO: 142329 - DNA, 20 bp, Artificial Sequence
  Description of Artificial Sequence: Synthetic oligonucleotide
  Target: ATXN1; (+) strand; PAM type: NRG; PAM sequence: TGG
gccatggcatacagcataaa

SEQ ID NO: 142330 - DNA, 20 bp, Artificial Sequence
  Description of Artificial Sequence: Synthetic oligonucleotide
  Target: ATXN1; (+) strand; PAM type: NRG; PAM sequence: GAG
catggcatacagcataaatg

SEQ ID NO: 142331 - DNA, 20 bp, Artificial Sequence
  Description of Artificial Sequence: Synthetic oligonucleotide
  Target: ATXN1; (+) strand; PAM type: NRG; PAM sequence: GAG
tggcatacagcataaatgga

SEQ ID NO: 142332 - DNA, 20 bp, Artificial Sequence
  Description of Artificial Sequence: Synthetic oligonucleotide
  Target: ATXN1; (+) strand; PAM type: NRG; PAM sequence: AGG
ggcatacagcataaatggag

SEQ ID NO: 142333 - DNA, 20 bp, Artificial Sequence
  Description of Artificial Sequence: Synthetic oligonucleotide
  Target: ATXN1; (+) strand; PAM type: NRG; PAM sequence: AAG
atacagcataaatggagagg

SEQ ID NO: 142334 - DNA, 20 bp, Artificial Sequence
  Description of Artificial Sequence: Synthetic oligonucleotide
  Target: ATXN1; (+) strand; PAM type: NRG; PAM sequence: CAG
cataaatggagaggaagata

SEQ ID NO: 142335 - DNA, 20 bp, Artificial Sequence
  Description of Artificial Sequence: Synthetic oligonucleotide
  Target: ATXN1; (+) strand; PAM type: NRG; PAM sequence: AGG
ataaatggagaggaagatac

SEQ ID NO: 142336 - DNA, 20 bp, Artificial Sequence
  Description of Artificial Sequence: Synthetic oligonucleotide
  Target: ATXN1; (+) strand; PAM type: NRG; PAM sequence: TAG
atggagaggaagatacagga

SEQ ID NO: 142337 - DNA, 20 bp, Artificial Sequence
  Description of Artificial Sequence: Synthetic oligonucleotide
  Target: ATXN1; (+) strand; PAM type: NRG; PAM sequence: CAG
gatacaggatagaaaaccac

SEQ ID NO: 142338 - DNA, 20 bp, Artificial Sequence
  Description of Artificial Sequence: Synthetic oligonucleotide
  Target: ATXN1; (+) strand; PAM type: NRG; PAM sequence: CAG
gatagaaaaccaccagcaaa

SEQ ID NO: 142339 - DNA, 20 bp, Artificial Sequence
  Description of Artificial Sequence: Synthetic oligonucleotide
  Target: ATXN1; (+) strand; PAM type: NRG; PAM sequence: AGG
atagaaaaccaccagcaaac

SEQ ID NO: 142340 - DNA, 20 bp, Artificial Sequence
  Description of Artificial Sequence: Synthetic oligonucleotide
  Target: ATXN1; (+) strand; PAM type: NRG; PAM sequence: AAG
aaaccaccagcaaacaggta

SEQ ID NO: 142341 - DNA, 20 bp, Artificial Sequence
  Description of Artificial Sequence: Synthetic oligonucleotide
  Target: ATXN1; (+) strand; PAM type: NRG; PAM sequence: GAG
accaccagcaaacaggtaaa

SEQ ID NO: 142342 - DNA, 20 bp, Artificial Sequence
  Description of Artificial Sequence: Synthetic oligonucleotide
  Target: ATXN1; (+) strand; PAM type: NRG; PAM sequence: AGG
ccaccagcaaacaggtaaag

SEQ ID NO: 142343 - DNA, 20 bp, Artificial Sequence
  Description of Artificial Sequence: Synthetic oligonucleotide
  Target: ATXN1; (+) strand; PAM type: NRG; PAM sequence: GGG
caccagcaaacaggtaaaga

SEQ ID NO: 142344 - DNA, 20 bp, Artificial Sequence
  Description of Artificial Sequence: Synthetic oligonucleotide
  Target: ATXN1; (+) strand; PAM type: NRG; PAM sequence: CAG
gagggttcctatgttgatta

SEQ ID NO: 142345 - DNA, 20 bp, Artificial Sequence
  Description of Artificial Sequence: Synthetic oligonucleotide
  Target: ATXN1; (+) strand; PAM type: NRG; PAM sequence: AGG
agggttcctatgttgattac

SEQ ID NO: 142346 - DNA, 20 bp, Artificial Sequence
  Description of Artificial Sequence: Synthetic oligonucleotide
  Target: ATXN1; (+) strand; PAM type: NRG; PAM sequence: AAG
gttcctatgttgattacagg

SEQ ID NO: 142347 - DNA, 20 bp, Artificial Sequence
  Description of Artificial Sequence: Synthetic oligonucleotide
  Target: ATXN1; (+) strand; PAM type: NRG; PAM sequence: AGG
ttcctatgttgattacagga

SEQ ID NO: 142348 - DNA, 20 bp, Artificial Sequence
  Description of Artificial Sequence: Synthetic oligonucleotide
  Target: ATXN1; (+) strand; PAM type: NRG; PAM sequence: CAG
tacaggaaggatactgtcac

SEQ ID NO: 142349 - DNA, 20 bp, Artificial Sequence
  Description of Artificial Sequence: Synthetic oligonucleotide
  Target: ATXN1; (+) strand; PAM type: NRG; PAM sequence: AGG
acaggaaggatactgtcacc

SEQ ID NO: 142350 - DNA, 20 bp, Artificial Sequence
  Description of Artificial Sequence: Synthetic oligonucleotide
  Target: ATXN1; (+) strand; PAM type: NRG; PAM sequence: GAG
aggaaggatactgtcaccag

SEQ ID NO: 142351 - DNA, 20 bp, Artificial Sequence
  Description of Artificial Sequence: Synthetic oligonucleotide
  Target: ATXN1; (+) strand; PAM type: NRG; PAM sequence: TAG
caccaggagaatcacaaaac

SEQ ID NO: 142352 - DNA, 20 bp, Artificial Sequence
  Description of Artificial Sequence: Synthetic oligonucleotide
  Target: ATXN1; (+) strand; PAM type: NRG; PAM sequence: CAG
aatcacaaaactagcacttc

SEQ ID NO: 142353 - DNA, 20 bp, Artificial Sequence
  Description of Artificial Sequence: Synthetic oligonucleotide
  Target: ATXN1; (+) strand; PAM type: NRG; PAM sequence: TGG
tgctttctaccacattcatg

SEQ ID NO: 142354 - DNA, 20 bp, Artificial Sequence
  Description of Artificial Sequence: Synthetic oligonucleotide
  Target: ATXN1; (+) strand; PAM type: NRG; PAM sequence: AAG
cttcataatttaatatttgt

SEQ ID NO: 142355 - DNA, 20 bp, Artificial Sequence
  Description of Artificial Sequence: Synthetic oligonucleotide
  Target: ATXN1; (+) strand; PAM type: NRG; PAM sequence: GAG
tcataatttaatatttgtaa

SEQ ID NO: 142356 - DNA, 20 bp, Artificial Sequence
  Description of Artificial Sequence: Synthetic oligonucleotide
  Target: ATXN1; (+) strand; PAM type: NRG; PAM sequence: AAG
ccccaataatgcatcacttg

SEQ ID NO: 142357 - DNA, 20 bp, Artificial Sequence
  Description of Artificial Sequence: Synthetic oligonucleotide
  Target: ATXN1; (+) strand; PAM type: NRG; PAM sequence: AGG
cccaataatgcatcacttga

SEQ ID NO: 142358 - DNA, 20 bp, Artificial Sequence
  Description of Artificial Sequence: Synthetic oligonucleotide
  Target: ATXN1; (+) strand; PAM type: NRG; PAM sequence: CAG
aataatgcatcacttgaagg

SEQ ID NO: 142359 - DNA, 20 bp, Artificial Sequence
  Description of Artificial Sequence: Synthetic oligonucleotide
  Target: ATXN1; (+) strand; PAM type: NRG; PAM sequence: AAG
atgcatcacttgaaggcaga

SEQ ID NO: 142360 - DNA, 20 bp, Artificial Sequence
  Description of Artificial Sequence: Synthetic oligonucleotide
  Target: ATXN1; (+) strand; PAM type: NRG; PAM sequence: CAG
atcacttgaaggcagaaagc

SEQ ID NO: 142361 - DNA, 20 bp, Artificial Sequence
  Description of Artificial Sequence: Synthetic oligonucleotide
  Target: ATXN1; (+) strand; PAM type: NRG; PAM sequence: AAG
gcagaaagccagctgctaac

SEQ ID NO: 142362 - DNA, 20 bp, Artificial Sequence
  Description of Artificial Sequence: Synthetic oligonucleotide
  Target: ATXN1; (+) strand; PAM type: NRG; PAM sequence: GAG
agaaagccagctgctaacaa

SEQ ID NO: 142363 - DNA, 20 bp, Artificial Sequence
  Description of Artificial Sequence: Synthetic oligonucleotide
  Target: ATXN1; (+) strand; PAM type: NRG; PAM sequence: GAG
tgctaacaagagtgacatct

SEQ ID NO: 142364 - DNA, 20 bp, Artificial Sequence
  Description of Artificial Sequence: Synthetic oligonucleotide
  Target: ATXN1; (+) strand; PAM type: NRG; PAM sequence: AAG
acatctgagcatcatttctg

SEQ ID NO: 142365 - DNA, 20 bp, Artificial Sequence
  Description of Artificial Sequence: Synthetic oligonucleotide
  Target: ATXN1; (+) strand; PAM type: NRG; PAM sequence: CAG
tcatttctgaagctctgctt

SEQ ID NO: 142366 - DNA, 20 bp, Artificial Sequence
  Description of Artificial Sequence: Synthetic oligonucleotide
  Target: ATXN1; (+) strand; PAM type: NRG; PAM sequence: AAG
ttctgaagctctgcttcaga

SEQ ID NO: 142367 - DNA, 20 bp, Artificial Sequence
  Description of Artificial Sequence: Synthetic oligonucleotide
  Target: ATXN1; (+) strand; PAM type: NRG; PAM sequence: AGG
tctgaagctctgcttcagaa

SEQ ID NO: 142368 - DNA, 20 bp, Artificial Sequence
  Description of Artificial Sequence: Synthetic oligonucleotide
  Target: ATXN1; (+) strand; PAM type: NRG; PAM sequence: GGG
ctgaagctctgcttcagaaa

SEQ ID NO: 142369 - DNA, 20 bp, Artificial Sequence
  Description of Artificial Sequence: Synthetic oligonucleotide
  Target: ATXN1; (+) strand; PAM type: NRG; PAM sequence: GGG
tgaagctctgcttcagaaag

SEQ ID NO: 142370 - DNA, 20 bp, Artificial Sequence
  Description of Artificial Sequence: Synthetic oligonucleotide
  Target: ATXN1; (+) strand; PAM type: NRG; PAM sequence: TAG
tgcttcagaaaggggatgtt

SEQ ID NO: 142371 - DNA, 20 bp, Artificial Sequence
  Description of Artificial Sequence: Synthetic oligonucleotide
  Target: ATXN1; (+) strand; PAM type: NRG; PAM sequence: AAG
tcagaaaggggatgtttagt

SEQ ID NO: 142372 - DNA, 20 bp, Artificial Sequence
  Description of Artificial Sequence: Synthetic oligonucleotide
  Target: ATXN1; (+) strand; PAM type: NRG; PAM sequence: AAG
aaaggggatgtttagtaaga

SEQ ID NO: 142373 - DNA, 20 bp, Artificial Sequence
  Description of Artificial Sequence: Synthetic oligonucleotide
  Target: ATXN1; (+) strand; PAM type: NRG; PAM sequence: AAG
atgctattcaacgtaaaaca

SEQ ID NO: 142374 - DNA, 20 bp, Artificial Sequence
  Description of Artificial Sequence: Synthetic oligonucleotide
  Target: ATXN1; (+) strand; PAM type: NRG; PAM sequence: TGG
attcaacgtaaaacaaagtg

SEQ ID NO: 142375 - DNA, 20 bp, Artificial Sequence
  Description of Artificial Sequence: Synthetic oligonucleotide
  Target: ATXN1; (+) strand; PAM type: NRG; PAM sequence: GGG
ttcaacgtaaaacaaagtgt

SEQ ID NO: 142376 - DNA, 20 bp, Artificial Sequence
  Description of Artificial Sequence: Synthetic oligonucleotide
  Target: ATXN1; (+) strand; PAM type: NRG; PAM sequence: GGG
tcaacgtaaaacaaagtgtg

SEQ ID NO: 142377 - DNA, 20 bp, Artificial Sequence
  Description of Artificial Sequence: Synthetic oligonucleotide
  Target: ATXN1; (+) strand; PAM type: NRG; PAM sequence: CAG
aaacaaagtgtggggatcca

SEQ ID NO: 142378 - DNA, 20 bp, Artificial Sequence
  Description of Artificial Sequence: Synthetic oligonucleotide
  Target: ATXN1; (+) strand; PAM type: NRG; PAM sequence: AGG
aacaaagtgtggggatccac

SEQ ID NO: 142379 - DNA, 20 bp, Artificial Sequence
  Description of Artificial Sequence: Synthetic oligonucleotide
  Target: ATXN1; (+) strand; PAM type: NRG; PAM sequence: GGG
acaaagtgtggggatccaca

SEQ ID NO: 142380 - DNA, 20 bp, Artificial Sequence
  Description of Artificial Sequence: Synthetic oligonucleotide
  Target: ATXN1; (+) strand; PAM type: NRG; PAM sequence: CAG
gtggggatccacagggttaa

SEQ ID NO: 142381 - DNA, 20 bp, Artificial Sequence
  Description of Artificial Sequence: Synthetic oligonucleotide
  Target: ATXN1; (+) strand; PAM type: NRG; PAM sequence: AGG
tggggatccacagggttaac

SEQ ID NO: 142382 - DNA, 20 bp, Artificial Sequence
  Description of Artificial Sequence: Synthetic oligonucleotide
  Target: ATXN1; (+) strand; PAM type: NRG; PAM sequence: TGG
gatccacagggttaacaggc

SEQ ID NO: 142383 - DNA, 20 bp, Artificial Sequence
  Description of Artificial Sequence: Synthetic oligonucleotide
  Target: ATXN1; (+) strand; PAM type: NRG; PAM sequence: CGG
cacagggttaacaggctggc

SEQ ID NO: 142384 - DNA, 20 bp, Artificial Sequence
  Description of Artificial Sequence: Synthetic oligonucleotide
  Target: ATXN1; (+) strand; PAM type: NRG; PAM sequence: CAG
ttaacaggctggccggtaac

SEQ ID NO: 142385 - DNA, 20 bp, Artificial Sequence
  Description of Artificial Sequence: Synthetic oligonucleotide
  Target: ATXN1; (+) strand; PAM type: NRG; PAM sequence: CGG
ggtaaccagtaacacaatga

SEQ ID NO: 142386 - DNA, 20 bp, Artificial Sequence
  Description of Artificial Sequence: Synthetic oligonucleotide
  Target: ATXN1; (+) strand; PAM type: NRG; PAM sequence: AAG
accagtaacacaatgacggc

SEQ ID NO: 142387 - DNA, 20 bp, Artificial Sequence
  Description of Artificial Sequence: Synthetic oligonucleotide
  Target: ATXN1; (+) strand; PAM type: NRG; PAM sequence: CAG
taacacaatgacggcaagca

SEQ ID NO: 142388 - DNA, 20 bp, Artificial Sequence
  Description of Artificial Sequence: Synthetic oligonucleotide
  Target: ATXN1; (+) strand; PAM type: NRG; PAM sequence: GAG
acacaatgacggcaagcaca

SEQ ID NO: 142389 - DNA, 20 bp, Artificial Sequence
  Description of Artificial Sequence: Synthetic oligonucleotide
  Target: ATXN1; (+) strand; PAM type: NRG; PAM sequence: AAG
caatgacggcaagcacagag

SEQ ID NO: 142390 - DNA, 20 bp, Artificial Sequence
  Description of Artificial Sequence: Synthetic oligonucleotide
  Target: ATXN1; (+) strand; PAM type: NRG; PAM sequence: AGG
aatgacggcaagcacagaga

SEQ ID NO: 142391 - DNA, 20 bp, Artificial Sequence
  Description of Artificial Sequence: Synthetic oligonucleotide
  Target: ATXN1; (+) strand; PAM type: NRG; PAM sequence: AAG
ggcaagcacagagaaggaaa

SEQ ID NO: 142392 - DNA, 20 bp, Artificial Sequence
  Description of Artificial Sequence: Synthetic oligonucleotide
  Target: ATXN1; (+) strand; PAM type: NRG; PAM sequence: CAG
agcacagagaaggaaaaagt

SEQ ID NO: 142393 - DNA, 20 bp, Artificial Sequence
  Description of Artificial Sequence: Synthetic oligonucleotide
  Target: ATXN1; (+) strand; PAM type: NRG; PAM sequence: AAG
ggaaaaagtcagatccccta

SEQ ID NO: 142394 - DNA, 20 bp, Artificial Sequence
  Description of Artificial Sequence: Synthetic oligonucleotide
  Target: ATXN1; (+) strand; PAM type: NRG; PAM sequence: AAG
agatcccctaaagaaaaaca

SEQ ID NO: 142395 - DNA, 20 bp, Artificial Sequence
  Description of Artificial Sequence: Synthetic oligonucleotide
  Target: ATXN1; (+) strand; PAM type: NRG; PAM sequence: AGG
gatcccctaaagaaaaacaa

SEQ ID NO: 142396 - DNA, 20 bp, Artificial Sequence
  Description of Artificial Sequence: Synthetic oligonucleotide
  Target: ATXN1; (+) strand; PAM type: NRG; PAM sequence: CAG
ccctaaagaaaaacaaagga

SEQ ID NO: 142397 - DNA, 20 bp, Artificial Sequence
  Description of Artificial Sequence: Synthetic oligonucleotide
  Target: ATXN1; (+) strand; PAM type: NRG; PAM sequence: AAG
aacaaaggacagtatttcaa

SEQ ID NO: 142398 - DNA, 20 bp, Artificial Sequence
  Description of Artificial Sequence: Synthetic oligonucleotide
  Target: ATXN1; (+) strand; PAM type: NRG; PAM sequence: AAG
aaaggacagtatttcaaaag

SEQ ID NO: 142399 - DNA, 20 bp, Artificial Sequence
  Description of Artificial Sequence: Synthetic oligonucleotide
  Target: ATXN1; (+) strand; PAM type: NRG; PAM sequence: TGG
agaagcctatctcacttatt

SEQ ID NO: 142400 - DNA, 20 bp, Artificial Sequence
  Description of Artificial Sequence: Synthetic oligonucleotide
  Target: ATXN1; (+) strand; PAM type: NRG; PAM sequence: CAG
acttatttggatataatatt

SEQ ID NO: 142401 - DNA, 20 bp, Artificial Sequence
  Description of Artificial Sequence: Synthetic oligonucleotide
  Target: ATXN1; (+) strand; PAM type: NRG; PAM sequence: AGG
cttatttggatataatattc

SEQ ID NO: 142402 - DNA, 20 bp, Artificial Sequence
  Description of Artificial Sequence: Synthetic oligonucleotide
  Target: ATXN1; (+) strand; PAM type: NRG; PAM sequence: CAG
tttggatataatattcaggc

SEQ ID NO: 142403 - DNA, 20 bp, Artificial Sequence
  Description of Artificial Sequence: Synthetic oligonucleotide
  Target: ATXN1; (+) strand; PAM type: NRG; PAM sequence: AGG
ttggatataatattcaggcc

SEQ ID NO: 142404 - DNA, 20 bp, Artificial Sequence
  Description of Artificial Sequence: Synthetic oligonucleotide
  Target: ATXN1; (+) strand; PAM type: NRG; PAM sequence: CAG
tataatattcaggccaggca

SEQ ID NO: 142405 - DNA, 20 bp, Artificial Sequence
  Description of Artificial Sequence: Synthetic oligonucleotide
  Target: ATXN1; (+) strand; PAM type: NRG; PAM sequence: TGG
aatattcaggccaggcacag

SEQ ID NO: 142406 - DNA, 20 bp, Artificial Sequence
  Description of Artificial Sequence: Synthetic oligonucleotide
  Target: ATXN1; (+) strand; PAM type: NRG; PAM sequence: CAG
gtggtgcatgcctgtaatcc

SEQ ID NO: 142407 - DNA, 20 bp, Artificial Sequence
  Description of Artificial Sequence: Synthetic oligonucleotide
  Target: ATXN1; (+) strand; PAM type: NRG; PAM sequence: GAG
gcctgtaatcccagcacttt

SEQ ID NO: 142408 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttga

SEQ ID NO: 142409 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttgag

SEQ ID NO: 142410 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgagaggcc

SEQ ID NO: 142411 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgagaggcca

SEQ ID NO: 142412 - DNA, 20 bp, Artificial Sequence
  Description of Artificial Sequence: Synthetic oligonucleotide
  Target: ATXN1; (+) strand; PAM type: NRG; PAM sequence: CAG
agcactttgagaggccaagg

SEQ ID NO: 142413 - DNA, 20 bp, Artificial Sequence
  Description of Artificial Sequence: Synthetic oligonucleotide
  Target: ATXN1; (+) strand; PAM type: NRG; PAM sequence: AGG
gcactttgagaggccaaggc

SEQ ID NO: 142414 - DNA, 20 bp, Artificial Sequence
  Description of Artificial Sequence: Synthetic oligonucleotide
  Target: ATXN1; (+) strand; PAM type: NRG; PAM sequence: TGG
ggccaaggcaggatgattgc

SEQ ID NO: 142415 - DNA, 20 bp, Artificial Sequence
  Description of Artificial Sequence: Synthetic oligonucleotide
  Target: ATXN1; (+) strand; PAM type: NRG; PAM sequence: GAG
ccaaggcaggatgattgctg

SEQ ID NO: 142416 - DNA, 20 bp, Artificial Sequence
  Description of Artificial Sequence: Synthetic oligonucleotide
  Target: ATXN1; (+) strand; PAM type: NRG; PAM sequence: CAG
gcaggatgattgctggagcc

SEQ ID NO: 142417 - DNA, 20 bp, Artificial Sequence
  Description of Artificial Sequence: Synthetic oligonucleotide
  Target: ATXN1; (+) strand; PAM type: NRG; PAM sequence: AGG
caggatgattgctggagccc

SEQ ID NO: 142418 - DNA, 20 bp, Artificial Sequence
  Description of Artificial Sequence: Synthetic oligonucleotide
  Target: ATXN1; (+) strand; PAM type: NRG; PAM sequence: GAG
ggatgattgctggagcccag

SEQ ID NO: 142419 - DNA, 20 bp, Artificial Sequence
  Description of Artificial Sequence: Synthetic oligonucleotide
  Target: ATXN1; (+) strand; PAM type: NRG; PAM sequence: CAG
ttgctggagcccaggagttc

SEQ ID NO: 142420 - DNA, 20 bp, Artificial Sequence
  Description of Artificial Sequence: Synthetic oligonucleotide
  Target: ATXN1; (+) strand; PAM type: NRG; PAM sequence: CAG
ggagcccaggagttccagac

SEQ ID NO: 142421 - DNA, 20 bp, Artificial Sequence
  Description of Artificial Sequence: Synthetic oligonucleotide
  Target: ATXN1; (+) strand; PAM type: NRG; PAM sequence: TGG
ccaggagttccagaccagtc

SEQ ID NO: 142422 - DNA, 20 bp, Artificial Sequence
  Description of Artificial Sequence: Synthetic oligonucleotide
  Target: ATXN1; (+) strand; PAM type: NRG; PAM sequence: TAG
ccagaccagtctggacaaca

SEQ ID NO: 142423 - DNA, 20 bp, Artificial Sequence
  Description of Artificial Sequence: Synthetic oligonucleotide
  Target: ATXN1; (+) strand; PAM type: NRG; PAM sequence: GAG
accagtctggacaacatagc

SEQ ID NO: 142424 - DNA, 20 bp, Artificial Sequence
  Description of Artificial Sequence: Synthetic oligonucleotide
  Target: ATXN1; (+) strand; PAM type: NRG; PAM sequence: TGG
acctcgtatctacaaaaaaa

SEQ ID NO: 142425 - DNA, 20 bp, Artificial Sequence
  Description of Artificial Sequence: Synthetic oligonucleotide
  Target: ATXN1; (+) strand; PAM type: NRG; PAM sequence: TAG
ctacaaaaaaatggaaaaat

SEQ ID NO: 142426 - DNA, 20 bp, Artificial Sequence
  Description of Artificial Sequence: Synthetic oligonucleotide
  Target: ATXN1; (+) strand; PAM type: NRG; PAM sequence: CAG
aaaaaaatggaaaaattagc

SEQ ID NO: 142427 - DNA, 20 bp, Artificial Sequence
  Description of Artificial Sequence: Synthetic oligonucleotide
  Target: ATXN1; (+) strand; PAM type: NRG; PAM sequence: AGG
aaaaaatggaaaaattagcc

SEQ ID NO: 142428 - DNA, 20 bp, Artificial Sequence
  Description of Artificial Sequence: Synthetic oligonucleotide
  Target: ATXN1; (+) strand; PAM type: NRG; PAM sequence: TGG
atggaaaaattagccaggca

SEQ ID NO: 142429 - DNA, 20 bp, Artificial Sequence
  Description of Artificial Sequence: Synthetic oligonucleotide
  Target: ATXN1; (+) strand; PAM type: NRG; PAM sequence: TGG
gaaaaattagccaggcatgg

SEQ ID NO: 142430 - DNA, 20 bp, Artificial Sequence
  Description of Artificial Sequence: Synthetic oligonucleotide
  Target: ATXN1; (+) strand; PAM type: NRG; PAM sequence: TAG
ggcatggtggcgcgtgcctg

SEQ ID NO: 142431 - DNA, 20 bp, Artificial Sequence
  Description of Artificial Sequence: Synthetic oligonucleotide
  Target: ATXN1; (+) strand; PAM type: NRG; PAM sequence: CGG
gtggcgcgtgcctgtagtct

SEQ ID NO: 142432 - DNA, 20 bp, Artificial Sequence
  Description of Artificial Sequence: Synthetic oligonucleotide
  Target: ATXN1; (+) strand; PAM type: NRG; PAM sequence: TGG
gtgcctgtagtctcggctac

SEQ ID NO: 142433 - DNA, 20 bp, Artificial Sequence
  Description of Artificial Sequence: Synthetic oligonucleotide
  Target: ATXN1; (+) strand; PAM type: NRG; PAM sequence: AAG
tgatgatgattcctgccctg

SEQ ID NO: 142434 - DNA, 20 bp, Artificial Sequence
  Description of Artificial Sequence: Synthetic oligonucleotide
  Target: ATXN1; (+) strand; PAM type: NRG; PAM sequence: TGG
gaagctgtgtgtacccctga

SEQ ID NO: 142435 - DNA, 20 bp, Artificial Sequence
  Description of Artificial Sequence: Synthetic oligonucleotide
  Target: ATXN1; (+) strand; PAM type: NRG; PAM sequence: CAG
ggcgtgatgacaaacactaa

SEQ ID NO: 142436 - DNA, 20 bp, Artificial Sequence
  Description of Artificial Sequence: Synthetic oligonucleotide
  Target: ATXN1; (+) strand; PAM type: NRG; PAM sequence: TAG
aacactaacagaacaacaca

SEQ ID NO: 142437 - DNA, 20 bp, Artificial Sequence
  Description of Artificial Sequence: Synthetic oligonucleotide
  Target: ATXN1; (+) strand; PAM type: NRG; PAM sequence: CAG
actaacagaacaacacatag

SEQ ID NO: 142438 - DNA, 20 bp, Artificial Sequence
  Description of Artificial Sequence: Synthetic oligonucleotide
  Target: ATXN1; (+) strand; PAM type: NRG; PAM sequence: CAG
gcagtgcattttatatgatg

SEQ ID NO: 142439 - DNA, 20 bp, Artificial Sequence
  Description of Artificial Sequence: Synthetic oligonucleotide
  Target: ATXN1; (+) strand; PAM type: NRG; PAM sequence: AGG
cagtgcattttatatgatgc

SEQ ID NO: 142440 - DNA, 20 bp, Artificial Sequence
  Description of Artificial Sequence: Synthetic oligonucleotide
  Target: ATXN1; (+) strand; PAM type: NRG; PAM sequence: CAG
gatgcaggccctaaatgtga

SEQ ID NO: 142441 - DNA, 20 bp, Artificial Sequence
  Description of Artificial Sequence: Synthetic oligonucleotide
  Target: ATXN1; (+) strand; PAM type: NRG; PAM sequence: AAG
gcaggccctaaatgtgacag

SEQ ID NO: 142442 - DNA, 20 bp, Artificial Sequence
  Description of Artificial Sequence: Synthetic oligonucleotide
  Target: ATXN1; (+) strand; PAM type: NRG; PAM sequence: AAG
aaatgtgacagaagttcata

SEQ ID NO: 142443 - DNA, 20 bp, Artificial Sequence
  Description of Artificial Sequence: Synthetic oligonucleotide
  Target: ATXN1; (+) strand; PAM type: NRG; PAM sequence: GAG
atgtgacagaagttcataaa

SEQ ID NO: 142444 - DNA, 20 bp, Artificial Sequence
  Description of Artificial Sequence: Synthetic oligonucleotide
  Target: ATXN1; (+) strand; PAM type: NRG; PAM sequence: GAG
gtgacagaagttcataaaga

SEQ ID NO: 142445 - DNA, 20 bp, Artificial Sequence
  Description of Artificial Sequence: Synthetic oligonucleotide
  Target: ATXN1; (+) strand; PAM type: NRG; PAM sequence: CAG
agaagttcataaagagagac

SEQ ID NO: 142446 - DNA, 20 bp, Artificial Sequence
  Description of Artificial Sequence: Synthetic oligonucleotide
  Target: ATXN1; (+) strand; PAM type: NRG; PAM sequence: CAG
gttcataaagagagaccagt

SEQ ID NO: 142447 - DNA, 20 bp, Artificial Sequence
  Description of Artificial Sequence: Synthetic oligonucleotide
  Target: ATXN1; (+) strand; PAM type: NRG; PAM sequence: AAG
taaagagagaccagtcagcg

SEQ ID NO: 142448 - DNA, 20 bp, Artificial Sequence
  Description of Artificial Sequence: Synthetic oligonucleotide
  Target: ATXN1; (+) strand; PAM type: NRG; PAM sequence: CAG
tcagcgaagtcctaaaaatt

SEQ ID NO: 142449 - DNA, 20 bp, Artificial Sequence
  Description of Artificial Sequence: Synthetic oligonucleotide
  Target: ATXN1; (+) strand; PAM type: NRG; PAM sequence: AAG
gaagtcctaaaaattcagtg

SEQ ID NO: 142450 - DNA, 20 bp, Artificial Sequence
  Description of Artificial Sequence: Synthetic oligonucleotide
  Target: ATXN1; (+) strand; PAM type: NRG; PAM sequence: CAG
agtgaagactttatgaatga

SEQ ID NO: 142451 - DNA, 20 bp, Artificial Sequence
  Description of Artificial Sequence: Synthetic oligonucleotide
  Target: ATXN1; (+) strand; PAM type: NRG; PAM sequence: CAG
aagactttatgaatgacagc

SEQ ID NO: 142452 - DNA, 20 bp, Artificial Sequence
  Description of Artificial Sequence: Synthetic oligonucleotide
  Target: ATXN1; (+) strand; PAM type: NRG; PAM sequence: AGG
agactttatgaatgacagcc

SEQ ID NO: 142453 - DNA, 20 bp, Artificial Sequence
  Description of Artificial Sequence: Synthetic oligonucleotide
  Target: ATXN1; (+) strand; PAM type: NRG; PAM sequence: TAG
tttatgaatgacagccagga

SEQ ID NO: 142454 - DNA, 20 bp, Artificial Sequence
  Description of Artificial Sequence: Synthetic oligonucleotide
  Target: ATXN1; (+) strand; PAM type: NRG; PAM sequence: CAG
aatgacagccaggatagtcc

SEQ ID NO: 142455 - DNA, 20 bp, Artificial Sequence
  Description of Artificial Sequence: Synthetic oligonucleotide
  Target: ATXN1; (+) strand; PAM type: NRG; PAM sequence: TGG
aggatagtcccagtctcata

SEQ ID NO: 142456 - DNA, 20 bp, Artificial Sequence
  Description of Artificial Sequence: Synthetic oligonucleotide
  Target: ATXN1; (+) strand; PAM type: NRG; PAM sequence: CAG
gtcccagtctcatatggtcc

SEQ ID NO: 142457 - DNA, 20 bp, Artificial Sequence
  Description of Artificial Sequence: Synthetic oligonucleotide
  Target: ATXN1; (+) strand; PAM type: NRG; PAM sequence: AAG
gtctcatatggtcccagcac

SEQ ID NO: 142458 - DNA, 20 bp, Artificial Sequence
  Description of Artificial Sequence: Synthetic oligonucleotide
  Target: ATXN1; (+) strand; PAM type: NRG; PAM sequence: CAG
aagctacgattgcaccactg

SEQ ID NO: 142459 - DNA, 20 bp, Artificial Sequence
  Description of Artificial Sequence: Synthetic oligonucleotide
  Target: ATXN1; (+) strand; PAM type: NRG; PAM sequence: CAG
acgattgcaccactgcagtc

SEQ ID NO: 142460 - DNA, 20 bp, Artificial Sequence
  Description of Artificial Sequence: Synthetic oligonucleotide
  Target: ATXN1; (+) strand; PAM type: NRG; PAM sequence: TGG
tgcaccactgcagtccagcc

SEQ ID NO: 142461 - DNA, 20 bp, Artificial Sequence
  Description of Artificial Sequence: Synthetic oligonucleotide
  Target: ATXN1; (+) strand; PAM type: NRG; PAM sequence: GGG
gcaccactgcagtccagcct

SEQ ID NO: 142462 - DNA, 20 bp, Artificial Sequence
  Description of Artificial Sequence: Synthetic oligonucleotide
  Target: ATXN1; (+) strand; PAM type: NRG; PAM sequence: AAG
gcagtccagcctgggcaaca

SEQ ID NO: 142463 - DNA, 20 bp, Artificial Sequence
  Description of Artificial Sequence: Synthetic oligonucleotide
  Target: ATXN1; (+) strand; PAM type: NRG; PAM sequence: GAG
agtccagcctgggcaacaaa

SEQ ID NO: 142464 - DNA, 20 bp, Artificial Sequence
  Description of Artificial Sequence: Synthetic oligonucleotide
  Target: ATXN1; (+) strand; PAM type: NRG; PAM sequence: AAG
cagcctgggcaacaaagaga

SEQ ID NO: 142465 - DNA, 20 bp, Artificial Sequence
  Description of Artificial Sequence: Synthetic oligonucleotide
  Target: ATXN1; (+) strand; PAM type: NRG; PAM sequence: AAG
aaatgaatataatattcata

SEQ ID NO: 142466 - DNA, 20 bp, Artificial Sequence
  Description of Artificial Sequence: Synthetic oligonucleotide
  Target: ATXN1; (+) strand; PAM type: NRG; PAM sequence: AAG
acatttttttttaatgttgc

SEQ ID NO: 142467 - DNA, 20 bp, Artificial Sequence
  Description of Artificial Sequence: Synthetic oligonucleotide
  Target: ATXN1; (+) strand; PAM type: NRG; PAM sequence: AGG
catttttttttaatgttgca

SEQ ID NO: 142468 - DNA, 20 bp, Artificial Sequence
  Description of Artificial Sequence: Synthetic oligonucleotide
  Target: ATXN1; (+) strand; PAM type: NRG; PAM sequence: GGG
atttttttttaatgttgcaa

SEQ ID NO: 142469 - DNA, 20 bp, Artificial Sequence
  Description of Artificial Sequence: Synthetic oligonucleotide
  Target: ATXN1; (+) strand; PAM type: NRG; PAM sequence: CGG
agggaataaattatttactg

SEQ ID NO: 142470 - DNA, 20 bp, Artificial Sequence
  Description of Artificial Sequence: Synthetic oligonucleotide
  Target: ATXN1; (+) strand; PAM type: NRG; PAM sequence: GGG
gggaataaattatttactgc

SEQ ID NO: 142471 - DNA, 20 bp, Artificial Sequence
  Description of Artificial Sequence: Synthetic oligonucleotide
  Target: ATXN1; (+) strand; PAM type: NRG; PAM sequence: CGG
ataaattatttactgcgggc

SEQ ID NO: 142472 - DNA, 20 bp, Artificial Sequence
  Description of Artificial Sequence: Synthetic oligonucleotide
  Target: ATXN1; (+) strand; PAM type: NRG; PAM sequence: GGG
taaattatttactgcgggcc

SEQ ID NO: 142473 - DNA, 20 bp, Artificial Sequence
  Description of Artificial Sequence: Synthetic oligonucleotide
  Target: ATXN1; (+) strand; PAM type: NRG; PAM sequence: CAG
tatttactgcgggccgggtg

SEQ ID NO: 142474 - DNA, 20 bp, Artificial Sequence
  Description of Artificial Sequence: Synthetic oligonucleotide
  Target: ATXN1; (+) strand; PAM type: NRG; PAM sequence: TGG
ttactgcgggccgggtgcag

SEQ ID NO: 142475 - DNA, 20 bp, Artificial Sequence
  Description of Artificial Sequence: Synthetic oligonucleotide
  Target: ATXN1; (+) strand; PAM type: NRG; PAM sequence: CAG
gtggttcacatctgtaatcc

SEQ ID NO: 142476 - DNA, 20 bp, Artificial Sequence
  Description of Artificial Sequence: Synthetic oligonucleotide
  Target: ATXN1; (+) strand; PAM type: NRG; PAM sequence: TGG
catctgtaatcccagcactt

SEQ ID NO: 142477 - DNA, 20 bp, Artificial Sequence
  Description of Artificial Sequence: Synthetic oligonucleotide
  Target: ATXN1; (+) strand; PAM type: NRG; PAM sequence: GGG
atctgtaatcccagcacttt

SEQ ID NO: 142478 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 142479 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 142480 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggct

SEQ ID NO: 142481 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggctg

SEQ ID NO: 142482 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggctgagg

SEQ ID NO: 142483 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggctgaggc

SEQ ID NO: 142484 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggctgaggcagg

SEQ ID NO: 142485 - DNA, 20 bp, Artificial Sequence
  Description of Artificial Sequence: Synthetic oligonucleotide
  Target: ATXN1; (+) strand; PAM type: NRG; PAM sequence: GAG
ctgaggcaggcggatcacct

SEQ ID NO: 142486 - DNA, 20 bp, Artificial Sequence
  Description of Artificial Sequence: Synthetic oligonucleotide
  Target: ATXN1; (+) strand; PAM type: NRG; PAM sequence: AGG
tgaggcaggcggatcacctg

SEQ ID NO: 142487 - DNA, 20 bp, Artificial Sequence
  Description of Artificial Sequence: Synthetic oligonucleotide
  Target: ATXN1; (+) strand; PAM type: NRG; PAM sequence: GAG
gcaggcggatcacctgaggt

SEQ ID NO: 142488 - DNA, 20 bp, Artificial Sequence
  Description of Artificial Sequence: Synthetic oligonucleotide
  Target: ATXN1; (+) strand; PAM type: NRG; PAM sequence: AGG
caggcggatcacctgaggtg

SEQ ID NO: 142489 - DNA, 20 bp, Artificial Sequence
  Description of Artificial Sequence: Synthetic oligonucleotide
  Target: ATXN1; (+) strand; PAM type: NRG; PAM sequence: GAG
ggcggatcacctgaggtgag

SEQ ID NO: 142490 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtgaggagatc

SEQ ID NO: 142491 - DNA, 20 bp, Artificial Sequence
  Description of Artificial Sequence: Synthetic oligonucleotide
  Target: ATXN1; (+) strand; PAM type: NRG; PAM sequence: TGG
tgaggagatcgagaccatcc

SEQ ID NO: 142492 - DNA, 20 bp, Artificial Sequence
  Description of Artificial Sequence: Synthetic oligonucleotide
  Target: ATXN1; (+) strand; PAM type: NRG; PAM sequence: TGG
cgagaccatcctggctaaca

SEQ ID NO: 142493 - DNA, 20 bp, Artificial Sequence
  Description of Artificial Sequence: Synthetic oligonucleotide
  Target: ATXN1; (+) strand; PAM type: NRG; PAM sequence: CAG
tggctaacatggtgaaaccc

SEQ ID NO: 142494 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 142495 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaaattagc

SEQ ID NO: 142496 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattagct

SEQ ID NO: 142497 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagctgggca

SEQ ID NO: 142498 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgggcatgg

SEQ ID NO: 142499 - DNA, 20 bp, Artificial Sequence
  Description of Artificial Sequence: Synthetic oligonucleotide
  Target: ATXN1; (+) strand; PAM type: NRG; PAM sequence: TAG
ggcatggtggcacgcatctg

SEQ ID NO: 142500 - DNA, 20 bp, Artificial Sequence
  Description of Artificial Sequence: Synthetic oligonucleotide
  Target: ATXN1; (+) strand; PAM type: NRG; PAM sequence: CAG
gtggcacgcatctgtagtcc

SEQ ID NO: 142501 - DNA, 20 bp, Artificial Sequence
  Description of Artificial Sequence: Synthetic oligonucleotide
  Target: ATXN1; (+) strand; PAM type: NRG; PAM sequence: CGG
catctgtagtcccagctact

SEQ ID NO: 142502 - DNA, 20 bp, Artificial Sequence
  Description of Artificial Sequence: Synthetic oligonucleotide
  Target: ATXN1; (+) strand; PAM type: NRG; PAM sequence: GGG
atctgtagtcccagctactc

SEQ ID NO: 142503 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctactcgg

SEQ ID NO: 142504 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctactcggg

SEQ ID NO: 142505 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcgggaggtt

SEQ ID NO: 142506 - DNA, 20 bp, Artificial Sequence
  Description of Artificial Sequence: Synthetic oligonucleotide
  Target: ATXN1; (+) strand; PAM type: NRG; PAM sequence: AGG
cccagctactcgggaggttg

SEQ ID NO: 142507 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggttgagg

SEQ ID NO: 142508 - DNA, 20 bp, Artificial Sequence
  Description of Artificial Sequence: Synthetic oligonucleotide
  Target: ATXN1; (+) strand; PAM type: NRG; PAM sequence: AGG
gctactcgggaggttgaggc

SEQ ID NO: 142509 - DNA, 20 bp, Artificial Sequence
  Description of Artificial Sequence: Synthetic oligonucleotide
  Target: ATXN1; (+) strand; PAM type: NRG; PAM sequence: GAG
tactcgggaggttgaggcag

SEQ ID NO: 142510 - DNA, 20 bp, Artificial Sequence
  Description of Artificial Sequence: Synthetic oligonucleotide
  Target: ATXN1; (+) strand; PAM type: NRG; PAM sequence: TGG
gcaggagaatcgcttgaacc

SEQ ID NO: 142511 - DNA, 20 bp, Artificial Sequence
  Description of Artificial Sequence: Synthetic oligonucleotide
  Target: ATXN1; (+) strand; PAM type: NRG; PAM sequence: GGG
caggagaatcgcttgaacct

SEQ ID NO: 142512 - DNA, 20 bp, Artificial Sequence
  Description of Artificial Sequence: Synthetic oligonucleotide
  Target: ATXN1; (+) strand; PAM type: NRG; PAM sequence: GAG
ggagaatcgcttgaacctgg

SEQ ID NO: 142513 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacctggg

SEQ ID NO: 142514 - DNA, 20 bp, Artificial Sequence
  Description of Artificial Sequence: Synthetic oligonucleotide
  Target: ATXN1; (+) strand; PAM type: NRG; PAM sequence: TGG
aatcgcttgaacctgggagg

SEQ ID NO: 142515 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacctgggaggtg

SEQ ID NO: 142516 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacctgggaggtgg

SEQ ID NO: 142517 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggtggaggttg

SEQ ID NO: 142518 - DNA, 20 bp, Artificial Sequence
  Description of Artificial Sequence: Synthetic oligonucleotide
  Target: ATXN1; (+) strand; PAM type: NRG; PAM sequence: GAG
ggtggaggttgcagtgaact

SEQ ID NO: 142519 - DNA, 20 bp, Artificial Sequence
  Description of Artificial Sequence: Synthetic oligonucleotide
  Target: ATXN1; (+) strand; PAM type: NRG; PAM sequence: CAG
gagactgtgccactgcactc

SEQ ID NO: 142520 - DNA, 20 bp, Artificial Sequence
  Description of Artificial Sequence: Synthetic oligonucleotide
  Target: ATXN1; (+) strand; PAM type: NRG; PAM sequence: TGG
tgtgccactgcactccagcc

SEQ ID NO: 142521 - DNA, 20 bp, Artificial Sequence
  Description of Artificial Sequence: Synthetic oligonucleotide
  Target: ATXN1; (+) strand; PAM type: NRG; PAM sequence: CAG
actgcactccagcctggtga

SEQ ID NO: 142522 - DNA, 20 bp, Artificial Sequence
  Description of Artificial Sequence: Synthetic oligonucleotide
  Target: ATXN1; (+) strand; PAM type: NRG; PAM sequence: GAG
tgcactccagcctggtgaca

SEQ ID NO: 142523 - DNA, 20 bp, Artificial Sequence
  Description of Artificial Sequence: Synthetic oligonucleotide
  Target: ATXN1; (+) strand; PAM type: NRG; PAM sequence: AAG
ctccagcctggtgacagagc

SEQ ID NO: 142524 - DNA, 20 bp, Artificial Sequence
  Description of Artificial Sequence: Synthetic oligonucleotide
  Target: ATXN1; (+) strand; PAM type: NRG; PAM sequence: CAG
aacaaaaaaattatttactg

SEQ ID NO: 142525 - DNA, 20 bp, Artificial Sequence
  Description of Artificial Sequence: Synthetic oligonucleotide
  Target: ATXN1; (+) strand; PAM type: NRG; PAM sequence: CAG
ttatttactgcagatgctga

SEQ ID NO: 142526 - DNA, 20 bp, Artificial Sequence
  Description of Artificial Sequence: Synthetic oligonucleotide
  Target: ATXN1; (+) strand; PAM type: NRG; PAM sequence: AAG
ctgacagtcctgtttgacca

SEQ ID NO: 142527 - DNA, 20 bp, Artificial Sequence
  Description of Artificial Sequence: Synthetic oligonucleotide
  Target: ATXN1; (+) strand; PAM type: NRG; PAM sequence: AGG
tgacagtcctgtttgaccaa

SEQ ID NO: 142528 - DNA, 20 bp, Artificial Sequence
  Description of Artificial Sequence: Synthetic oligonucleotide
  Target: ATXN1; (+) strand; PAM type: NRG; PAM sequence: GGG
gacagtcctgtttgaccaaa

SEQ ID NO: 142529 - DNA, 20 bp, Artificial Sequence
  Description of Artificial Sequence: Synthetic oligonucleotide
  Target: ATXN1; (+) strand; PAM type: NRG; PAM sequence: TGG
gtcctgtttgaccaaagggc

SEQ ID NO: 142530 - DNA, 20 bp, Artificial Sequence
  Description of Artificial Sequence: Synthetic oligonucleotide
  Target: ATXN1; (+) strand; PAM type: NRG; PAM sequence: TGG
ccaaagggctggctgtcaaa

SEQ ID NO: 142531 - DNA, 20 bp, Artificial Sequence
  Description of Artificial Sequence: Synthetic oligonucleotide
  Target: ATXN1; (+) strand; PAM type: NRG; PAM sequence: GGG
caaagggctggctgtcaaat

SEQ ID NO: 142532 - DNA, 20 bp, Artificial Sequence
  Description of Artificial Sequence: Synthetic oligonucleotide
  Target: ATXN1; (+) strand; PAM type: NRG; PAM sequence: TGG
ctggctgtcaaatgggcaaa

SEQ ID NO: 142533 - DNA, 20 bp, Artificial Sequence
  Description of Artificial Sequence: Synthetic oligonucleotide
  Target: ATXN1; (+) strand; PAM type: NRG; PAM sequence: GGG
tggctgtcaaatgggcaaat

SEQ ID NO: 142534 - DNA, 20 bp, Artificial Sequence
  Description of Artificial Sequence: Synthetic oligonucleotide
  Target: ATXN1; (+) strand; PAM type: NRG; PAM sequence: GGG
ggctgtcaaatgggcaaatg

SEQ ID NO: 142535 - DNA, 20 bp, Artificial Sequence
  Description of Artificial Sequence: Synthetic oligonucleotide
  Target: ATXN1; (+) strand; PAM type: NRG; PAM sequence: CAG
gtcaaatgggcaaatggggc

SEQ ID NO: 142536 - DNA, 20 bp, Artificial Sequence
  Description of Artificial Sequence: Synthetic oligonucleotide
  Target: ATXN1; (+) strand; PAM type: NRG; PAM sequence: AGG
tcaaatgggcaaatggggcc

SEQ ID NO: 142537 - DNA, 20 bp, Artificial Sequence
  Description of Artificial Sequence: Synthetic oligonucleotide
  Target: ATXN1; (+) strand; PAM type: NRG; PAM sequence: GAG
aaatgggcaaatggggccag

SEQ ID NO: 142538 - DNA, 20 bp, Artificial Sequence
  Description of Artificial Sequence: Synthetic oligonucleotide
  Target: ATXN1; (+) strand; PAM type: NRG; PAM sequence: AGG
aatgggcaaatggggccagg

SEQ ID NO: 142539 - DNA, 20 bp, Artificial Sequence
  Description of Artificial Sequence: Synthetic oligonucleotide
  Target: ATXN1; (+) strand; PAM type: NRG; PAM sequence: GGG
atgggcaaatggggccagga

SEQ ID NO: 142540 - DNA, 20 bp, Artificial Sequence
  Description of Artificial Sequence: Synthetic oligonucleotide
  Target: ATXN1; (+) strand; PAM type: NRG; PAM sequence: GAG
ggggccaggagggacccccc

SEQ ID NO: 142541 - DNA, 20 bp, Artificial Sequence
  Description of Artificial Sequence: Synthetic oligonucleotide
  Target: ATXN1; (+) strand; PAM type: NRG; PAM sequence: AGG
gggccaggagggaccccccg

SEQ ID NO: 142542 - DNA, 20 bp, Artificial Sequence
  Description of Artificial Sequence: Synthetic oligonucleotide
  Target: ATXN1; (+) strand; PAM type: NRG; PAM sequence: TGG
ggagggaccccccgaggacc

SEQ ID NO: 142543 - DNA, 20 bp, Artificial Sequence
  Description of Artificial Sequence: Synthetic oligonucleotide
  Target: ATXN1; (+) strand; PAM type: NRG; PAM sequence: TGG
ctggctcctttcctccacac

SEQ ID NO: 142544 - DNA, 20 bp, Artificial Sequence
  Description of Artificial Sequence: Synthetic oligonucleotide
  Target: ATXN1; (+) strand; PAM type: NRG; PAM sequence: GAG
tccacactggttgatacaat

SEQ ID NO: 142545 - DNA, 20 bp, Artificial Sequence
  Description of Artificial Sequence: Synthetic oligonucleotide
  Target: ATXN1; (+) strand; PAM type: NRG; PAM sequence: AAG
cccctctgcaaatgaccacc

SEQ ID NO: 142546 - DNA, 20 bp, Artificial Sequence
  Description of Artificial Sequence: Synthetic oligonucleotide
  Target: ATXN1; (+) strand; PAM type: NRG; PAM sequence: CAG
aaatgaccaccaagcctaca

SEQ ID NO: 142547 - DNA, 20 bp, Artificial Sequence
  Description of Artificial Sequence: Synthetic oligonucleotide
  Target: ATXN1; (+) strand; PAM type: NRG; PAM sequence: TGG
agcctacacagaaattctgt

SEQ ID NO: 142548 - DNA, 20 bp, Artificial Sequence
  Description of Artificial Sequence: Synthetic oligonucleotide
  Target: ATXN1; (+) strand; PAM type: NRG; PAM sequence: GGG
gcctacacagaaattctgtt

SEQ ID NO: 142549 - DNA, 20 bp, Artificial Sequence
  Description of Artificial Sequence: Synthetic oligonucleotide
  Target: ATXN1; (+) strand; PAM type: NRG; PAM sequence: AAG
acacagaaattctgttgggc

SEQ ID NO: 142550 - DNA, 20 bp, Artificial Sequence
  Description of Artificial Sequence: Synthetic oligonucleotide
  Target: ATXN1; (+) strand; PAM type: NRG; PAM sequence: AAG
attctgttgggcaagaactg

SEQ ID NO: 142551 - DNA, 20 bp, Artificial Sequence
  Description of Artificial Sequence: Synthetic oligonucleotide
  Target: ATXN1; (+) strand; PAM type: NRG; PAM sequence: TGG
ctgttgggcaagaactgaag

SEQ ID NO: 142552 - DNA, 20 bp, Artificial Sequence
  Description of Artificial Sequence: Synthetic oligonucleotide
  Target: ATXN1; (+) strand; PAM type: NRG; PAM sequence: TAG
aattatttaattcattgcac

SEQ ID NO: 142553 - DNA, 20 bp, Artificial Sequence
  Description of Artificial Sequence: Synthetic oligonucleotide
  Target: ATXN1; (+) strand; PAM type: NRG; PAM sequence: GAG
ttatttaattcattgcacta

SEQ ID NO: 142554 - DNA, 20 bp, Artificial Sequence
  Description of Artificial Sequence: Synthetic oligonucleotide
  Target: ATXN1; (+) strand; PAM type: NRG; PAM sequence: AGG
tatttaattcattgcactag

SEQ ID NO: 142555 - DNA, 20 bp, Artificial Sequence
  Description of Artificial Sequence: Synthetic oligonucleotide
  Target: ATXN1; (+) strand; PAM type: NRG; PAM sequence: GGG
atttaattcattgcactaga

SEQ ID NO: 142556 - DNA, 20 bp, Artificial Sequence
  Description of Artificial Sequence: Synthetic oligonucleotide
  Target: ATXN1; (+) strand; PAM type: NRG; PAM sequence: CAG
ggaactgaattataaatttg

SEQ ID NO: 142557 - DNA, 20 bp, Artificial Sequence
  Description of Artificial Sequence: Synthetic oligonucleotide
  Target: ATXN1; (+) strand; PAM type: NRG; PAM sequence: AGG
gaactgaattataaatttgc

SEQ ID NO: 142558 - DNA, 20 bp, Artificial Sequence
  Description of Artificial Sequence: Synthetic oligonucleotide
  Target: ATXN1; (+) strand; PAM type: NRG; PAM sequence: GAG
actgaattataaatttgcag

SEQ ID NO: 142559 - DNA, 20 bp, Artificial Sequence
  Description of Artificial Sequence: Synthetic oligonucleotide
  Target: ATXN1; (+) strand; PAM type: NRG; PAM sequence: TGG
tataaatttgcaggagacct

SEQ ID NO: 142560 - DNA, 20 bp, Artificial Sequence
  Description of Artificial Sequence: Synthetic oligonucleotide
  Target: ATXN1; (+) strand; PAM type: NRG; PAM sequence: GAG
taaatttgcaggagaccttg

SEQ ID NO: 142561 - DNA, 20 bp, Artificial Sequence
  Description of Artificial Sequence: Synthetic oligonucleotide
  Target: ATXN1; (+) strand; PAM type: NRG; PAM sequence: CAG
ttgcaggagaccttggagat

SEQ ID NO: 142562 - DNA, 20 bp, Artificial Sequence
  Description of Artificial Sequence: Synthetic oligonucleotide
  Target: ATXN1; (+) strand; PAM type: NRG; PAM sequence: TAG
aggagaccttggagatcagt

SEQ ID NO: 142563 - DNA, 20 bp, Artificial Sequence
  Description of Artificial Sequence: Synthetic oligonucleotide
  Target: ATXN1; (+) strand; PAM type: NRG; PAM sequence: AGG
ggagaccttggagatcagtt

SEQ ID NO: 142564 - DNA, 20 bp, Artificial Sequence
  Description of Artificial Sequence: Synthetic oligonucleotide
  Target: ATXN1; (+) strand; PAM type: NRG; PAM sequence: AAG
gttaggcacatacatcttta

SEQ ID NO: 142565 - DNA, 20 bp, Artificial Sequence
  Description of Artificial Sequence: Synthetic oligonucleotide
  Target: ATXN1; (+) strand; PAM type: NRG; PAM sequence: AGG
ttaggcacatacatctttaa

SEQ ID NO: 142566 - DNA, 20 bp, Artificial Sequence
  Description of Artificial Sequence: Synthetic oligonucleotide
  Target: ATXN1; (+) strand; PAM type: NRG; PAM sequence: AAG
gcacatacatctttaaaggc

SEQ ID NO: 142567 - DNA, 20 bp, Artificial Sequence
  Description of Artificial Sequence: Synthetic oligonucleotide
  Target: ATXN1; (+) strand; PAM type: NRG; PAM sequence: AAG
ctttaaaggcaagtcgttcc

SEQ ID NO: 142568 - DNA, 20 bp, Artificial Sequence
  Description of Artificial Sequence: Synthetic oligonucleotide
  Target: ATXN1; (+) strand; PAM type: NRG; PAM sequence: GAG
gcaagtcgttccaagatgat

SEQ ID NO: 142569 - DNA, 20 bp, Artificial Sequence
  Description of Artificial Sequence: Synthetic oligonucleotide
  Target: ATXN1; (+) strand; PAM type: NRG; PAM sequence: AAG
gtcgttccaagatgatgagc

SEQ ID NO: 142570 - DNA, 20 bp, Artificial Sequence
  Description of Artificial Sequence: Synthetic oligonucleotide
  Target: ATXN1; (+) strand; PAM type: NRG; PAM sequence: AAG
agatgatgagcaagttctcc

SEQ ID NO: 142571 - DNA, 20 bp, Artificial Sequence
  Description of Artificial Sequence: Synthetic oligonucleotide
  Target: ATXN1; (+) strand; PAM type: NRG; PAM sequence: AGG
gatgatgagcaagttctcca

SEQ ID NO: 142572 - DNA, 20 bp, Artificial Sequence
  Description of Artificial Sequence: Synthetic oligonucleotide
  Target: ATXN1; (+) strand; PAM type: NRG; PAM sequence: AAG
gcaagttctccaaggtgacc

SEQ ID NO: 142573 - DNA, 20 bp, Artificial Sequence
  Description of Artificial Sequence: Synthetic oligonucleotide
  Target: ATXN1; (+) strand; PAM type: NRG; PAM sequence: TAG
gttctccaaggtgaccaaga

SEQ ID NO: 142574 - DNA, 20 bp, Artificial Sequence
  Description of Artificial Sequence: Synthetic oligonucleotide
  Target: ATXN1; (+) strand; PAM type: NRG; PAM sequence: AGG
ttctccaaggtgaccaagat

SEQ ID NO: 142575 - DNA, 20 bp, Artificial Sequence
  Description of Artificial Sequence: Synthetic oligonucleotide
  Target: ATXN1; (+) strand; PAM type: NRG; PAM sequence: TGG
tccaaggtgaccaagatagg

SEQ ID NO: 142576 - DNA, 20 bp, Artificial Sequence
  Description of Artificial Sequence: Synthetic oligonucleotide
  Target: ATXN1; (+) strand; PAM type: NRG; PAM sequence: GGG
ccaaggtgaccaagataggt

SEQ ID NO: 142577 - DNA, 20 bp, Artificial Sequence
  Description of Artificial Sequence: Synthetic oligonucleotide
  Target: ATXN1; (+) strand; PAM type: NRG; PAM sequence: GGG
caaggtgaccaagataggtg

SEQ ID NO: 142578 - DNA, 20 bp, Artificial Sequence
  Description of Artificial Sequence: Synthetic oligonucleotide
  Target: ATXN1; (+) strand; PAM type: NRG; PAM sequence: CAG
ggtgaccaagataggtgggg

SEQ ID NO: 142579 - DNA, 20 bp, Artificial Sequence
  Description of Artificial Sequence: Synthetic oligonucleotide
  Target: ATXN1; (+) strand; PAM type: NRG; PAM sequence: TAG
caagataggtggggcagacc

SEQ ID NO: 142580 - DNA, 20 bp, Artificial Sequence
  Description of Artificial Sequence: Synthetic oligonucleotide
  Target: ATXN1; (+) strand; PAM type: NRG; PAM sequence: AGG
aagataggtggggcagacct

SEQ ID NO: 142581 - DNA, 20 bp, Artificial Sequence
  Description of Artificial Sequence: Synthetic oligonucleotide
  Target: ATXN1; (+) strand; PAM type: NRG; PAM sequence: GAG
gcagacctaggcttcaattt

SEQ ID NO: 142582 - DNA, 20 bp, Artificial Sequence
  Description of Artificial Sequence: Synthetic oligonucleotide
  Target: ATXN1; (+) strand; PAM type: NRG; PAM sequence: AGG
cagacctaggcttcaatttg

SEQ ID NO: 142583 - DNA, 20 bp, Artificial Sequence
  Description of Artificial Sequence: Synthetic oligonucleotide
  Target: ATXN1; (+) strand; PAM type: NRG; PAM sequence: CAG
caatttgaggactctgcttc

SEQ ID NO: 142584 - DNA, 20 bp, Artificial Sequence
  Description of Artificial Sequence: Synthetic oligonucleotide
  Target: ATXN1; (+) strand; PAM type: NRG; PAM sequence: AGG
aatttgaggactctgcttcc

SEQ ID NO: 142585 - DNA, 20 bp, Artificial Sequence
  Description of Artificial Sequence: Synthetic oligonucleotide
  Target: ATXN1; (+) strand; PAM type: NRG; PAM sequence: CGG
cttccaggtaatatcatgaa

SEQ ID NO: 142586 - DNA, 20 bp, Artificial Sequence
  Description of Artificial Sequence: Synthetic oligonucleotide
  Target: ATXN1; (+) strand; PAM type: NRG; PAM sequence: GGG
ttccaggtaatatcatgaac

SEQ ID NO: 142587 - DNA, 20 bp, Artificial Sequence
  Description of Artificial Sequence: Synthetic oligonucleotide
  Target: ATXN1; (+) strand; PAM type: NRG; PAM sequence: GGG
tccaggtaatatcatgaacg

SEQ ID NO: 142588 - DNA, 20 bp, Artificial Sequence
  Description of Artificial Sequence: Synthetic oligonucleotide
  Target: ATXN1; (+) strand; PAM type: NRG; PAM sequence: TGG
gttgataaaaaaaaaattcc

SEQ ID NO: 142589 - DNA, 20 bp, Artificial Sequence
  Description of Artificial Sequence: Synthetic oligonucleotide
  Target: ATXN1; (+) strand; PAM type: NRG; PAM sequence: AAG
gataaaaaaaaaattcctgg

SEQ ID NO: 142590 - DNA, 20 bp, Artificial Sequence
  Description of Artificial Sequence: Synthetic oligonucleotide
  Target: ATXN1; (+) strand; PAM type: NRG; PAM sequence: TGG
cctggaagtccacattatgt

SEQ ID NO: 142591 - DNA, 20 bp, Artificial Sequence
  Description of Artificial Sequence: Synthetic oligonucleotide
  Target: ATXN1; (+) strand; PAM type: NRG; PAM sequence: TGG
cattatgttggtgtatgctc

SEQ ID NO: 142592 - DNA, 20 bp, Artificial Sequence
  Description of Artificial Sequence: Synthetic oligonucleotide
  Target: ATXN1; (+) strand; PAM type: NRG; PAM sequence: TGG
tgttggtgtatgctctggaa

SEQ ID NO: 142593 - DNA, 20 bp, Artificial Sequence
  Description of Artificial Sequence: Synthetic oligonucleotide
  Target: ATXN1; (+) strand; PAM type: NRG; PAM sequence: TAG
atggttttatcatttattta

SEQ ID NO: 142594 - DNA, 20 bp, Artificial Sequence
  Description of Artificial Sequence: Synthetic oligonucleotide
  Target: ATXN1; (+) strand; PAM type: NRG; PAM sequence: TAG
tttatcatttatttatagtt

SEQ ID NO: 142595 - DNA, 20 bp, Artificial Sequence
  Description of Artificial Sequence: Synthetic oligonucleotide
  Target: ATXN1; (+) strand; PAM type: NRG; PAM sequence: GAG
tatcatttatttatagttta

SEQ ID NO: 142596 - DNA, 20 bp, Artificial Sequence
  Description of Artificial Sequence: Synthetic oligonucleotide
  Target: ATXN1; (+) strand; PAM type: NRG; PAM sequence: CAG
agtgtttgaattccaacccc

SEQ ID NO: 142597 - DNA, 20 bp, Artificial Sequence
  Description of Artificial Sequence: Synthetic oligonucleotide
  Target: ATXN1; (+) strand; PAM type: NRG; PAM sequence: AAG
tgaattccaacccccagact

SEQ ID NO: 142598 - DNA, 20 bp, Artificial Sequence
  Description of Artificial Sequence: Synthetic oligonucleotide
  Target: ATXN1; (+) strand; PAM type: NRG; PAM sequence: AAG
ccagactaagactgtcattc

SEQ ID NO: 142599 - DNA, 20 bp, Artificial Sequence
  Description of Artificial Sequence: Synthetic oligonucleotide
  Target: ATXN1; (+) strand; PAM type: NRG; PAM sequence: AGG
cagactaagactgtcattca

SEQ ID NO: 142600 - DNA, 20 bp, Artificial Sequence
  Description of Artificial Sequence: Synthetic oligonucleotide
  Target: ATXN1; (+) strand; PAM type: NRG; PAM sequence: GGG
agactaagactgtcattcaa

SEQ ID NO: 142601 - DNA, 20 bp, Artificial Sequence
  Description of Artificial Sequence: Synthetic oligonucleotide
  Target: ATXN1; (+) strand; PAM type: NRG; PAM sequence: AAG
aagggcccatgtatacttaa

SEQ ID NO: 142602 - DNA, 20 bp, Artificial Sequence
  Description of Artificial Sequence: Synthetic oligonucleotide
  Target: ATXN1; (+) strand; PAM type: NRG; PAM sequence: CAG
atgtatacttaaaagttact

SEQ ID NO: 142603 - DNA, 20 bp, Artificial Sequence
  Description of Artificial Sequence: Synthetic oligonucleotide
  Target: ATXN1; (+) strand; PAM type: NRG; PAM sequence: CAG
ctcagtaaatgtttgctgaa

SEQ ID NO: 142604 - DNA, 20 bp, Artificial Sequence
  Description of Artificial Sequence: Synthetic oligonucleotide
  Target: ATXN1; (+) strand; PAM type: NRG; PAM sequence: AGG
tcagtaaatgtttgctgaac

SEQ ID NO: 142605 - DNA, 20 bp, Artificial Sequence
  Description of Artificial Sequence: Synthetic oligonucleotide
  Target: ATXN1; (+) strand; PAM type: NRG; PAM sequence: TGG
aatgtttgctgaacaggact

SEQ ID NO: 142606 - DNA, 20 bp, Artificial Sequence
  Description of Artificial Sequence: Synthetic oligonucleotide
  Target: ATXN1; (+) strand; PAM type: NRG; PAM sequence: TAG
tttcaccttgcccatcacaa

SEQ ID NO: 142607 - DNA, 20 bp, Artificial Sequence
  Description of Artificial Sequence: Synthetic oligonucleotide
  Target: ATXN1; (+) strand; PAM type: NRG; PAM sequence: CAG
agtcatgcatcatttaatga

SEQ ID NO: 142608 - DNA, 20 bp, Artificial Sequence
  Description of Artificial Sequence: Synthetic oligonucleotide
  Target: ATXN1; (+) strand; PAM type: NRG; PAM sequence: AGG
gtcatgcatcatttaatgac

SEQ ID NO: 142609 - DNA, 20 bp, Artificial Sequence
  Description of Artificial Sequence: Synthetic oligonucleotide
  Target: ATXN1; (+) strand; PAM type: NRG; PAM sequence: GGG
tcatgcatcatttaatgaca

SEQ ID NO: 142610 - DNA, 20 bp, Artificial Sequence
  Description of Artificial Sequence: Synthetic oligonucleotide
  Target: ATXN1; (+) strand; PAM type: NRG; PAM sequence: GAG
taatgacagggatatgctct

SEQ ID NO: 142611 - DNA, 20 bp, Artificial Sequence
  Description of Artificial Sequence: Synthetic oligonucleotide
  Target: ATXN1; (+) strand; PAM type: NRG; PAM sequence: TAG
tgctctgagaaatgcattgt

SEQ ID NO: 142612 - DNA, 20 bp, Artificial Sequence
  Description of Artificial Sequence: Synthetic oligonucleotide
  Target: ATXN1; (+) strand; PAM type: NRG; PAM sequence: AGG
gctctgagaaatgcattgtt

SEQ ID NO: 142613 - DNA, 20 bp, Artificial Sequence
  Description of Artificial Sequence: Synthetic oligonucleotide
  Target: ATXN1; (+) strand; PAM type: NRG; PAM sequence: CAG
tttgtcactgtgcaacatca

SEQ ID NO: 142614 - DNA, 20 bp, Artificial Sequence
  Description of Artificial Sequence: Synthetic oligonucleotide
  Target: ATXN1; (+) strand; PAM type: NRG; PAM sequence: GAG
tgtcactgtgcaacatcaca

SEQ ID NO: 142615 - DNA, 20 bp, Artificial Sequence
  Description of Artificial Sequence: Synthetic oligonucleotide
  Target: ATXN1; (+) strand; PAM type: NRG; PAM sequence: CAG
aacatcacagagtactttca

SEQ ID NO: 142616 - DNA, 20 bp, Artificial Sequence
  Description of Artificial Sequence: Synthetic oligonucleotide
  Target: ATXN1; (+) strand; PAM type: NRG; PAM sequence: AGG
acatcacagagtactttcac

SEQ ID NO: 142617 - DNA, 20 bp, Artificial Sequence
  Description of Artificial Sequence: Synthetic oligonucleotide
  Target: ATXN1; (+) strand; PAM type: NRG; PAM sequence: TGG
acagagtactttcacaggcc

SEQ ID NO: 142618 - DNA, 20 bp, Artificial Sequence
  Description of Artificial Sequence: Synthetic oligonucleotide
  Target: ATXN1; (+) strand; PAM type: NRG; PAM sequence: TGG
agtactttcacaggcctgga

SEQ ID NO: 142619 - DNA, 20 bp, Artificial Sequence
  Description of Artificial Sequence: Synthetic oligonucleotide
  Target: ATXN1; (+) strand; PAM type: NRG; PAM sequence: CGG
tactacacgcctgcgctata

SEQ ID NO: 142620 - DNA, 20 bp, Artificial Sequence
  Description of Artificial Sequence: Synthetic oligonucleotide
  Target: ATXN1; (+) strand; PAM type: NRG; PAM sequence: TAG
cacgcctgcgctatacggta

SEQ ID NO: 142621 - DNA, 20 bp, Artificial Sequence
  Description of Artificial Sequence: Synthetic oligonucleotide
  Target: ATXN1; (+) strand; PAM type: NRG; PAM sequence: TAG
acggtatagcttattgctcc

SEQ ID NO: 142622 - DNA, 20 bp, Artificial Sequence
  Description of Artificial Sequence: Synthetic oligonucleotide
  Target: ATXN1; (+) strand; PAM type: NRG; PAM sequence: AGG
cggtatagcttattgctcct

SEQ ID NO: 142623 - DNA, 20 bp, Artificial Sequence
  Description of Artificial Sequence: Synthetic oligonucleotide
  Target: ATXN1; (+) strand; PAM type: NRG; PAM sequence: TGG
ttgctcctaggctacaaacc

SEQ ID NO: 142624 - DNA, 20 bp, Artificial Sequence
  Description of Artificial Sequence: Synthetic oligonucleotide
  Target: ATXN1; (+) strand; PAM type: NRG; PAM sequence: CGG
tcctaggctacaaacctgga

SEQ ID NO: 142625 - DNA, 20 bp, Artificial Sequence
  Description of Artificial Sequence: Synthetic oligonucleotide
  Target: ATXN1; (+) strand; PAM type: NRG; PAM sequence: TAG
acctggacggcatgctactg

SEQ ID NO: 142626 - DNA, 20 bp, Artificial Sequence
  Description of Artificial Sequence: Synthetic oligonucleotide
  Target: ATXN1; (+) strand; PAM type: NRG; PAM sequence: TAG
tgctactgtagtgaatactg

SEQ ID NO: 142627 - DNA, 20 bp, Artificial Sequence
  Description of Artificial Sequence: Synthetic oligonucleotide
  Target: ATXN1; (+) strand; PAM type: NRG; PAM sequence: AGG
gctactgtagtgaatactgt

SEQ ID NO: 142628 - DNA, 20 bp, Artificial Sequence
  Description of Artificial Sequence: Synthetic oligonucleotide
  Target: ATXN1; (+) strand; PAM type: NRG; PAM sequence: TGG
tgtaggcaactgtaacacaa

SEQ ID NO: 142629 - DNA, 20 bp, Artificial Sequence
  Description of Artificial Sequence: Synthetic oligonucleotide
  Target: ATXN1; (+) strand; PAM type: NRG; PAM sequence: TAG
aggcaactgtaacacaatgg

SEQ ID NO: 142630 - DNA, 20 bp, Artificial Sequence
  Description of Artificial Sequence: Synthetic oligonucleotide
  Target: ATXN1; (+) strand; PAM type: NRG; PAM sequence: AGG
ggcaactgtaacacaatggt

SEQ ID NO: 142631 - DNA, 20 bp, Artificial Sequence
  Description of Artificial Sequence: Synthetic oligonucleotide
  Target: ATXN1; (+) strand; PAM type: NRG; PAM sequence: TAG
cctctaaacacatctaaaca

SEQ ID NO: 142632 - DNA, 20 bp, Artificial Sequence
  Description of Artificial Sequence: Synthetic oligonucleotide
  Target: ATXN1; (+) strand; PAM type: NRG; PAM sequence: AAG
aaacacatctaaacatagaa

SEQ ID NO: 142633 - DNA, 20 bp, Artificial Sequence
  Description of Artificial Sequence: Synthetic oligonucleotide
  Target: ATXN1; (+) strand; PAM type: NRG; PAM sequence: AGG
aacacatctaaacatagaaa

SEQ ID NO: 142634 - DNA, 20 bp, Artificial Sequence
  Description of Artificial Sequence: Synthetic oligonucleotide
  Target: ATXN1; (+) strand; PAM type: NRG; PAM sequence: CAG
gaaaaggtacaaccaaaata

SEQ ID NO: 142635 - DNA, 20 bp, Artificial Sequence
  Description of Artificial Sequence: Synthetic oligonucleotide
  Target: ATXN1; (+) strand; PAM type: NRG; PAM sequence: GAG
tttttttttttttttttttt

SEQ ID NO: 142636 - DNA, 20 bp, Artificial Sequence
  Description of Artificial Sequence: Synthetic oligonucleotide
  Target: ATXN1; (+) strand; PAM type: NRG; PAM sequence: TGG
ttttttttttttttttgaga

SEQ ID NO: 142637 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttttgagatg

SEQ ID NO: 142638 - DNA, 20 bp, Artificial Sequence
  Description of Artificial Sequence: Synthetic oligonucleotide
  Target: ATXN1; (+) strand; PAM type: NRG; PAM sequence: CAG
tggagtctcgctctgtcgcc

SEQ ID NO: 142639 - DNA, 20 bp, Artificial Sequence
  Description of Artificial Sequence: Synthetic oligonucleotide
  Target: ATXN1; (+) strand; PAM type: NRG; PAM sequence: AGG
ggagtctcgctctgtcgccc

SEQ ID NO: 142640 - DNA, 20 bp, Artificial Sequence
  Description of Artificial Sequence: Synthetic oligonucleotide
  Target: ATXN1; (+) strand; PAM type: NRG; PAM sequence: TGG
tctcgctctgtcgcccaggc

SEQ ID NO: 142641 - DNA, 20 bp, Artificial Sequence
  Description of Artificial Sequence: Synthetic oligonucleotide
  Target: ATXN1; (+) strand; PAM type: NRG; PAM sequence: GAG
tcgctctgtcgcccaggctg

SEQ ID NO: 142642 - DNA, 20 bp, Artificial Sequence
  Description of Artificial Sequence: Synthetic oligonucleotide
  Target: ATXN1; (+) strand; PAM type: NRG; PAM sequence: CAG
ctgtcgcccaggctggagtg

SEQ ID NO: 142643 - DNA, 20 bp, Artificial Sequence
  Description of Artificial Sequence: Synthetic oligonucleotide
  Target: ATXN1; (+) strand; PAM type: NRG; PAM sequence: TGG
tcgcccaggctggagtgcag

SEQ ID NO: 142644 - DNA, 20 bp, Artificial Sequence
  Description of Artificial Sequence: Synthetic oligonucleotide
  Target: ATXN1; (+) strand; PAM type: NRG; PAM sequence: CGG
ggagtgcagtggtgcaatct

SEQ ID NO: 142645 - DNA, 20 bp, Artificial Sequence
  Description of Artificial Sequence: Synthetic oligonucleotide
  Target: ATXN1; (+) strand; PAM type: NRG; PAM sequence: AAG
gtgcaatctcggctcactgc

SEQ ID NO: 142646 - DNA, 20 bp, Artificial Sequence
  Description of Artificial Sequence: Synthetic oligonucleotide
  Target: ATXN1; (+) strand; PAM type: NRG; PAM sequence: CAG
tcactgcaagctctgcctcc

SEQ ID NO: 142647 - DNA, 20 bp, Artificial Sequence
  Description of Artificial Sequence: Synthetic oligonucleotide
  Target: ATXN1; (+) strand; PAM type: NRG; PAM sequence: AGG
cactgcaagctctgcctccc

SEQ ID NO: 142648 - DNA, 20 bp, Artificial Sequence
  Description of Artificial Sequence: Synthetic oligonucleotide
  Target: ATXN1; (+) strand; PAM type: NRG; PAM sequence: CAG
ttcacgccattctgctgcct

SEQ ID NO: 142649 - DNA, 20 bp, Artificial Sequence
  Description of Artificial Sequence: Synthetic oligonucleotide
  Target: ATXN1; (+) strand; PAM type: NRG; PAM sequence: AAG
ttctgctgcctcagcctccc

SEQ ID NO: 142650 - DNA, 20 bp, Artificial Sequence
  Description of Artificial Sequence: Synthetic oligonucleotide
  Target: ATXN1; (+) strand; PAM type: NRG; PAM sequence: TAG
tgctgcctcagcctcccaag

SEQ ID NO: 142651 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtagc

SEQ ID NO: 142652 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagct

SEQ ID NO: 142653 - DNA, 20 bp, Artificial Sequence
  Description of Artificial Sequence: Synthetic oligonucleotide
  Target: ATXN1; (+) strand; PAM type: NRG; PAM sequence: AAG
tcccaagtagctgggactac

SEQ ID NO: 142654 - DNA, 20 bp, Artificial Sequence
  Description of Artificial Sequence: Synthetic oligonucleotide
  Target: ATXN1; (+) strand; PAM type: NRG; PAM sequence: CGG
caagcgcccgccactacacc

SEQ ID NO: 142655 - DNA, 20 bp, Artificial Sequence
  Description of Artificial Sequence: Synthetic oligonucleotide
  Target: ATXN1; (+) strand; PAM type: NRG; PAM sequence: TAG
taattttttttttgtattct

SEQ ID NO: 142656 - DNA, 20 bp, Artificial Sequence
  Description of Artificial Sequence: Synthetic oligonucleotide
  Target: ATXN1; (+) strand; PAM type: NRG; PAM sequence: TAG
ttttttttttgtattcttag

SEQ ID NO: 142657 - DNA, 20 bp, Artificial Sequence
  Description of Artificial Sequence: Synthetic oligonucleotide
  Target: ATXN1; (+) strand; PAM type: NRG; PAM sequence: GAG
ttttttttgtattcttagta

SEQ ID NO: 142658 - DNA, 20 bp, Artificial Sequence
  Description of Artificial Sequence: Synthetic oligonucleotide
  Target: ATXN1; (+) strand; PAM type: NRG; PAM sequence: CAG
ttttgtattcttagtagaga

SEQ ID NO: 142659 - DNA, 20 bp, Artificial Sequence
  Description of Artificial Sequence: Synthetic oligonucleotide
  Target: ATXN1; (+) strand; PAM type: NRG; PAM sequence: AGG
tttgtattcttagtagagac

SEQ ID NO: 142660 - DNA, 20 bp, Artificial Sequence
  Description of Artificial Sequence: Synthetic oligonucleotide
  Target: ATXN1; (+) strand; PAM type: NRG; PAM sequence: GGG
ttgtattcttagtagagaca

SEQ ID NO: 142661 - DNA, 20 bp, Artificial Sequence
  Description of Artificial Sequence: Synthetic oligonucleotide
  Target: ATXN1; (+) strand; PAM type: NRG; PAM sequence: TAG
gagacagggtttcaccgcgt

SEQ ID NO: 142662 - DNA, 20 bp, Artificial Sequence
  Description of Artificial Sequence: Synthetic oligonucleotide
  Target: ATXN1; (+) strand; PAM type: NRG; PAM sequence: CAG
cagggtttcaccgcgttagc

SEQ ID NO: 142663 - DNA, 20 bp, Artificial Sequence
  Description of Artificial Sequence: Synthetic oligonucleotide
  Target: ATXN1; (+) strand; PAM type: NRG; PAM sequence: AGG
agggtttcaccgcgttagcc

SEQ ID NO: 142664 - DNA, 20 bp, Artificial Sequence
  Description of Artificial Sequence: Synthetic oligonucleotide
  Target: ATXN1; (+) strand; PAM type: NRG; PAM sequence: CGG
acctcgtgatccgcgcgcct

SEQ ID NO: 142665 - DNA, 20 bp, Artificial Sequence
  Description of Artificial Sequence: Synthetic oligonucleotide
  Target: ATXN1; (+) strand; PAM type: NRG; PAM sequence: AAG
ccgcgcgcctcggcctccca

SEQ ID NO: 142666 - DNA, 20 bp, Artificial Sequence
  Description of Artificial Sequence: Synthetic oligonucleotide
  Target: ATXN1; (+) strand; PAM type: NRG; PAM sequence: TGG
gcctcggcctcccaaagtgc

SEQ ID NO: 142667 - DNA, 20 bp, Artificial Sequence
  Description of Artificial Sequence: Synthetic oligonucleotide
  Target: ATXN1; (+) strand; PAM type: NRG; PAM sequence: GGG
cctcggcctcccaaagtgct

SEQ ID NO: 142668 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 142669 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 142670 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggcgt

SEQ ID NO: 142671 - DNA, 20 bp, Artificial Sequence
  Description of Artificial Sequence: Synthetic oligonucleotide
  Target: ATXN1; (+) strand; PAM type: NRG; PAM sequence: CAG
caggcgtgagccaccacacc

SEQ ID NO: 142672 - DNA, 20 bp, Artificial Sequence
  Description of Artificial Sequence: Synthetic oligonucleotide
  Target: ATXN1; (+) strand; PAM type: NRG; PAM sequence: CAG
gtgagccaccacacccagcc

SEQ ID NO: 142673 - DNA, 20 bp, Artificial Sequence
  Description of Artificial Sequence: Synthetic oligonucleotide
  Target: ATXN1; (+) strand; PAM type: NRG; PAM sequence: TGG
agcccagtattataatctta

SEQ ID NO: 142674 - DNA, 20 bp, Artificial Sequence
  Description of Artificial Sequence: Synthetic oligonucleotide
  Target: ATXN1; (+) strand; PAM type: NRG; PAM sequence: GGG
gcccagtattataatcttat

SEQ ID NO: 142675 - DNA, 20 bp, Artificial Sequence
  Description of Artificial Sequence: Synthetic oligonucleotide
  Target: ATXN1; (+) strand; PAM type: NRG; PAM sequence: TGG
ttgactgaaacttcattatg

SEQ ID NO: 142676 - DNA, 20 bp, Artificial Sequence
  Description of Artificial Sequence: Synthetic oligonucleotide
  Target: ATXN1; (+) strand; PAM type: NRG; PAM sequence: AAG
acatgactgtatttgatcac

SEQ ID NO: 142677 - DNA, 20 bp, Artificial Sequence
  Description of Artificial Sequence: Synthetic oligonucleotide
  Target: ATXN1; (+) strand; PAM type: NRG; PAM sequence: CAG
cgattaatcccttatgtttt

SEQ ID NO: 142678 - DNA, 20 bp, Artificial Sequence
  Description of Artificial Sequence: Synthetic oligonucleotide
  Target: ATXN1; (+) strand; PAM type: NRG; PAM sequence: TGG
ccttatgttttcagctaaaa

SEQ ID NO: 142679 - DNA, 20 bp, Artificial Sequence
  Description of Artificial Sequence: Synthetic oligonucleotide
  Target: ATXN1; (+) strand; PAM type: NRG; PAM sequence: GAG
ttatgttttcagctaaaatg

SEQ ID NO: 142680 - DNA, 20 bp, Artificial Sequence
  Description of Artificial Sequence: Synthetic oligonucleotide
  Target: ATXN1; (+) strand; PAM type: NRG; PAM sequence: TGG
ttcagctaaaatggagtatc

SEQ ID NO: 142681 - DNA, 20 bp, Artificial Sequence
  Description of Artificial Sequence: Synthetic oligonucleotide
  Target: ATXN1; (+) strand; PAM type: NRG; PAM sequence: TAG
agctaaaatggagtatctgg

SEQ ID NO: 142682 - DNA, 20 bp, Artificial Sequence
  Description of Artificial Sequence: Synthetic oligonucleotide
  Target: ATXN1; (+) strand; PAM type: NRG; PAM sequence: TAG
aatggagtatctggtagatg

SEQ ID NO: 142683 - DNA, 20 bp, Artificial Sequence
  Description of Artificial Sequence: Synthetic oligonucleotide
  Target: ATXN1; (+) strand; PAM type: NRG; PAM sequence: TAG
ttatttgctgtttgtgtgtt

SEQ ID NO: 142684 - DNA, 20 bp, Artificial Sequence
  Description of Artificial Sequence: Synthetic oligonucleotide
  Target: ATXN1; (+) strand; PAM type: NRG; PAM sequence: TGG
tgtttgtgtgtttagttgtt

SEQ ID NO: 142685 - DNA, 20 bp, Artificial Sequence
  Description of Artificial Sequence: Synthetic oligonucleotide
  Target: ATXN1; (+) strand; PAM type: NRG; PAM sequence: GGG
gtttgtgtgtttagttgttt

SEQ ID NO: 142686 - DNA, 20 bp, Artificial Sequence
  Description of Artificial Sequence: Synthetic oligonucleotide
  Target: ATXN1; (+) strand; PAM type: NRG; PAM sequence: CAG
aaccacaaatacattctatt

SEQ ID NO: 142687 - DNA, 20 bp, Artificial Sequence
  Description of Artificial Sequence: Synthetic oligonucleotide
  Target: ATXN1; (+) strand; PAM type: NRG; PAM sequence: AAG
ttcagatcatactattctgc

SEQ ID NO: 142688 - DNA, 20 bp, Artificial Sequence
  Description of Artificial Sequence: Synthetic oligonucleotide
  Target: ATXN1; (+) strand; PAM type: NRG; PAM sequence: CAG
tcatactattctgcaagttt

SEQ ID NO: 142689 - DNA, 20 bp, Artificial Sequence
  Description of Artificial Sequence: Synthetic oligonucleotide
  Target: ATXN1; (+) strand; PAM type: NRG; PAM sequence: AAG
gtttcagaaacaaacacata

SEQ ID NO: 142690 - DNA, 20 bp, Artificial Sequence
  Description of Artificial Sequence: Synthetic oligonucleotide
  Target: ATXN1; (+) strand; PAM type: NRG; PAM sequence: CGG
acaaacacataaagtaaatg

SEQ ID NO: 142691 - DNA, 20 bp, Artificial Sequence
  Description of Artificial Sequence: Synthetic oligonucleotide
  Target: ATXN1; (+) strand; PAM type: NRG; PAM sequence: CAG
agtaaatgcggttgctctct

SEQ ID NO: 142692 - DNA, 20 bp, Artificial Sequence
  Description of Artificial Sequence: Synthetic oligonucleotide
  Target: ATXN1; (+) strand; PAM type: NRG; PAM sequence: TAG
ctctctcagtgctctgtcac

SEQ ID NO: 142693 - DNA, 20 bp, Artificial Sequence
  Description of Artificial Sequence: Synthetic oligonucleotide
  Target: ATXN1; (+) strand; PAM type: NRG; PAM sequence: AGG
tctctcagtgctctgtcact

SEQ ID NO: 142694 - DNA, 20 bp, Artificial Sequence
  Description of Artificial Sequence: Synthetic oligonucleotide
  Target: ATXN1; (+) strand; PAM type: NRG; PAM sequence: TAG
ttttcaaatgtcctgttatt

SEQ ID NO: 142695 - DNA, 20 bp, Artificial Sequence
  Description of Artificial Sequence: Synthetic oligonucleotide
  Target: ATXN1; (+) strand; PAM type: NRG; PAM sequence: AGG
tttcaaatgtcctgttattt

SEQ ID NO: 142696 - DNA, 20 bp, Artificial Sequence
  Description of Artificial Sequence: Synthetic oligonucleotide
  Target: ATXN1; (+) strand; PAM type: NRG; PAM sequence: TAG
atgtcctgttatttaggatg

SEQ ID NO: 142697 - DNA, 20 bp, Artificial Sequence
  Description of Artificial Sequence: Synthetic oligonucleotide
  Target: ATXN1; (+) strand; PAM type: NRG; PAM sequence: GAG
gtcctgttatttaggatgta

SEQ ID NO: 142698 - DNA, 20 bp, Artificial Sequence
  Description of Artificial Sequence: Synthetic oligonucleotide
  Target: ATXN1; (+) strand; PAM type: NRG; PAM sequence: TAG
ttatttaggatgtagagaaa

SEQ ID NO: 142699 - DNA, 20 bp, Artificial Sequence
  Description of Artificial Sequence: Synthetic oligonucleotide
  Target: ATXN1; (+) strand; PAM type: NRG; PAM sequence: AAG
gagaaatagcaatacgcttg

SEQ ID NO: 142700 - DNA, 20 bp, Artificial Sequence
  Description of Artificial Sequence: Synthetic oligonucleotide
  Target: ATXN1; (+) strand; PAM type: NRG; PAM sequence: AAG
aaatagcaatacgcttgaag

SEQ ID NO: 142701 - DNA, 20 bp, Artificial Sequence
  Description of Artificial Sequence: Synthetic oligonucleotide
  Target: ATXN1; (+) strand; PAM type: NRG; PAM sequence: AAG
tagcaatacgcttgaagaag

SEQ ID NO: 142702 - DNA, 20 bp, Artificial Sequence
  Description of Artificial Sequence: Synthetic oligonucleotide
  Target: ATXN1; (+) strand; PAM type: NRG; PAM sequence: TGG
tacgcttgaagaagaagttc

SEQ ID NO: 142703 - DNA, 20 bp, Artificial Sequence
  Description of Artificial Sequence: Synthetic oligonucleotide
  Target: ATXN1; (+) strand; PAM type: NRG; PAM sequence: CAG
aagaagaagttctggtacac

SEQ ID NO: 142704 - DNA, 20 bp, Artificial Sequence
  Description of Artificial Sequence: Synthetic oligonucleotide
  Target: ATXN1; (+) strand; PAM type: NRG; PAM sequence: AAG
gaagttctggtacaccagtg

SEQ ID NO: 142705 - DNA, 20 bp, Artificial Sequence
  Description of Artificial Sequence: Synthetic oligonucleotide
  Target: ATXN1; (+) strand; PAM type: NRG; PAM sequence: AAG
gtgatgcccgatgacattta

SEQ ID NO: 142706 - DNA, 20 bp, Artificial Sequence
  Description of Artificial Sequence: Synthetic oligonucleotide
  Target: ATXN1; (+) strand; PAM type: NRG; PAM sequence: AAG
ccgatgacatttaaagctaa

SEQ ID NO: 142707 - DNA, 20 bp, Artificial Sequence
  Description of Artificial Sequence: Synthetic oligonucleotide
  Target: ATXN1; (+) strand; PAM type: NRG; PAM sequence: AAG
atttaaagctaaaagatgtc

SEQ ID NO: 142708 - DNA, 20 bp, Artificial Sequence
  Description of Artificial Sequence: Synthetic oligonucleotide
  Target: ATXN1; (+) strand; PAM type: NRG; PAM sequence: TGG
ctaaaagatgtcaagtcttt

SEQ ID NO: 142709 - DNA, 20 bp, Artificial Sequence
  Description of Artificial Sequence: Synthetic oligonucleotide
  Target: ATXN1; (+) strand; PAM type: NRG; PAM sequence: AAG
ccaaaaaccatttgtgtttc

SEQ ID NO: 142710 - DNA, 20 bp, Artificial Sequence
  Description of Artificial Sequence: Synthetic oligonucleotide
  Target: ATXN1; (+) strand; PAM type: NRG; PAM sequence: CAG
gtgtttcaagaccatccgtg

SEQ ID NO: 142711 - DNA, 20 bp, Artificial Sequence
  Description of Artificial Sequence: Synthetic oligonucleotide
  Target: ATXN1; (+) strand; PAM type: NRG; PAM sequence: AGG
tgtttcaagaccatccgtgc

SEQ ID NO: 142712 - DNA, 20 bp, Artificial Sequence
  Description of Artificial Sequence: Synthetic oligonucleotide
  Target: ATXN1; (+) strand; PAM type: NRG; PAM sequence: TGG
cactctttctctcttgttcc

SEQ ID NO: 142713 - DNA, 20 bp, Artificial Sequence
  Description of Artificial Sequence: Synthetic oligonucleotide
  Target: ATXN1; (+) strand; PAM type: NRG; PAM sequence: CAG
tctctcttgttcctggtctg

SEQ ID NO: 142714 - DNA, 20 bp, Artificial Sequence
  Description of Artificial Sequence: Synthetic oligonucleotide
  Target: ATXN1; (+) strand; PAM type: NRG; PAM sequence: CAG
ctcttgttcctggtctgcag

SEQ ID NO: 142715 - DNA, 20 bp, Artificial Sequence
  Description of Artificial Sequence: Synthetic oligonucleotide
  Target: ATXN1; (+) strand; PAM type: NRG; PAM sequence: AAG
tcctggtctgcagcagcact

SEQ ID NO: 142716 - DNA, 20 bp, Artificial Sequence
  Description of Artificial Sequence: Synthetic oligonucleotide
  Target: ATXN1; (+) strand; PAM type: NRG; PAM sequence: AAG
ctgcagcagcactaagtttg

SEQ ID NO: 142717 - DNA, 20 bp, Artificial Sequence
  Description of Artificial Sequence: Synthetic oligonucleotide
  Target: ATXN1; (+) strand; PAM type: NRG; PAM sequence: TAG
ctaagtttgaagcttcaaaa

SEQ ID NO: 142718 - DNA, 20 bp, Artificial Sequence
  Description of Artificial Sequence: Synthetic oligonucleotide
  Target: ATXN1; (+) strand; PAM type: NRG; PAM sequence: CAG
tagactctttcactatgctc

SEQ ID NO: 142719 - DNA, 20 bp, Artificial Sequence
  Description of Artificial Sequence: Synthetic oligonucleotide
  Target: ATXN1; (+) strand; PAM type: NRG; PAM sequence: CAG
cactatgctccagtatgctg

SEQ ID NO: 142720 - DNA, 20 bp, Artificial Sequence
  Description of Artificial Sequence: Synthetic oligonucleotide
  Target: ATXN1; (+) strand; PAM type: NRG; PAM sequence: AAG
gtcaaacaaaacaaaatacc

SEQ ID NO: 142721 - DNA, 20 bp, Artificial Sequence
  Description of Artificial Sequence: Synthetic oligonucleotide
  Target: ATXN1; (+) strand; PAM type: NRG; PAM sequence: CAG
aacaaaacaaaataccaagt

SEQ ID NO: 142722 - DNA, 20 bp, Artificial Sequence
  Description of Artificial Sequence: Synthetic oligonucleotide
  Target: ATXN1; (+) strand; PAM type: NRG; PAM sequence: AAG
cagaatgaaaatgccacttc

SEQ ID NO: 142723 - DNA, 20 bp, Artificial Sequence
  Description of Artificial Sequence: Synthetic oligonucleotide
  Target: ATXN1; (+) strand; PAM type: NRG; PAM sequence: CAG
aatgaaaatgccacttcaag

SEQ ID NO: 142724 - DNA, 20 bp, Artificial Sequence
  Description of Artificial Sequence: Synthetic oligonucleotide
  Target: ATXN1; (+) strand; PAM type: NRG; PAM sequence: TAG
aaaatgccacttcaagcagt

SEQ ID NO: 142725 - DNA, 20 bp, Artificial Sequence
  Description of Artificial Sequence: Synthetic oligonucleotide
  Target: ATXN1; (+) strand; PAM type: NRG; PAM sequence: TGG
atgccacttcaagcagttag

SEQ ID NO: 142726 - DNA, 20 bp, Artificial Sequence
  Description of Artificial Sequence: Synthetic oligonucleotide
  Target: ATXN1; (+) strand; PAM type: NRG; PAM sequence: CAG
tcaagcagttagtggatatt

SEQ ID NO: 142727 - DNA, 20 bp, Artificial Sequence
  Description of Artificial Sequence: Synthetic oligonucleotide
  Target: ATXN1; (+) strand; PAM type: NRG; PAM sequence: AGG
caagcagttagtggatattc

SEQ ID NO: 142728 - DNA, 20 bp, Artificial Sequence
  Description of Artificial Sequence: Synthetic oligonucleotide
  Target: ATXN1; (+) strand; PAM type: NRG; PAM sequence: GGG
aagcagttagtggatattca

SEQ ID NO: 142729 - DNA, 20 bp, Artificial Sequence
  Description of Artificial Sequence: Synthetic oligonucleotide
  Target: ATXN1; (+) strand; PAM type: NRG; PAM sequence: GGG
agcagttagtggatattcag

SEQ ID NO: 142730 - DNA, 20 bp, Artificial Sequence
  Description of Artificial Sequence: Synthetic oligonucleotide
  Target: ATXN1; (+) strand; PAM type: NRG; PAM sequence: GGG
gcagttagtggatattcagg

SEQ ID NO: 142731 - DNA, 20 bp, Artificial Sequence
  Description of Artificial Sequence: Synthetic oligonucleotide
  Target: ATXN1; (+) strand; PAM type: NRG; PAM sequence: TGG
gatattcagggggaaatccc

SEQ ID NO: 142732 - DNA, 20 bp, Artificial Sequence
  Description of Artificial Sequence: Synthetic oligonucleotide
  Target: ATXN1; (+) strand; PAM type: NRG; PAM sequence: AAG
tatatttcataacctcaaac

SEQ ID NO: 142733 - DNA, 20 bp, Artificial Sequence
  Description of Artificial Sequence: Synthetic oligonucleotide
  Target: ATXN1; (+) strand; PAM type: NRG; PAM sequence: CAG
caaacaagcatgttaattat

SEQ ID NO: 142734 - DNA, 20 bp, Artificial Sequence
  Description of Artificial Sequence: Synthetic oligonucleotide
  Target: ATXN1; (+) strand; PAM type: NRG; PAM sequence: AGG
aaacaagcatgttaattatc

SEQ ID NO: 142735 - DNA, 20 bp, Artificial Sequence
  Description of Artificial Sequence: Synthetic oligonucleotide
  Target: ATXN1; (+) strand; PAM type: NRG; PAM sequence: AAG
gcatgttaattatcaggatg

SEQ ID NO: 142736 - DNA, 20 bp, Artificial Sequence
  Description of Artificial Sequence: Synthetic oligonucleotide
  Target: ATXN1; (+) strand; PAM type: NRG; PAM sequence: AAG
atctcactgcttatctacat

SEQ ID NO: 142737 - DNA, 20 bp, Artificial Sequence
  Description of Artificial Sequence: Synthetic oligonucleotide
  Target: ATXN1; (+) strand; PAM type: NRG; PAM sequence: AGG
tctcactgcttatctacata

SEQ ID NO: 142738 - DNA, 20 bp, Artificial Sequence
  Description of Artificial Sequence: Synthetic oligonucleotide
  Target: ATXN1; (+) strand; PAM type: NRG; PAM sequence: TGG
cataaggtgccctaaaatac

SEQ ID NO: 142739 - DNA, 20 bp, Artificial Sequence
  Description of Artificial Sequence: Synthetic oligonucleotide
  Target: ATXN1; (+) strand; PAM type: NRG; PAM sequence: GAG
taaggtgccctaaaatactg

SEQ ID NO: 142740 - DNA, 20 bp, Artificial Sequence
  Description of Artificial Sequence: Synthetic oligonucleotide
  Target: ATXN1; (+) strand; PAM type: NRG; PAM sequence: AGG
aaggtgccctaaaatactgg

SEQ ID NO: 142741 - DNA, 20 bp, Artificial Sequence
  Description of Artificial Sequence: Synthetic oligonucleotide
  Target: ATXN1; (+) strand; PAM type: NRG; PAM sequence: TGG
gtgccctaaaatactggagg

SEQ ID NO: 142742 - DNA, 20 bp, Artificial Sequence
  Description of Artificial Sequence: Synthetic oligonucleotide
  Target: ATXN1; (+) strand; PAM type: NRG; PAM sequence: GGG
tgccctaaaatactggaggt

SEQ ID NO: 142743 - DNA, 20 bp, Artificial Sequence
  Description of Artificial Sequence: Synthetic oligonucleotide
  Target: ATXN1; (+) strand; PAM type: NRG; PAM sequence: GGG
gccctaaaatactggaggtg

SEQ ID NO: 142744 - DNA, 20 bp, Artificial Sequence
  Description of Artificial Sequence: Synthetic oligonucleotide
  Target: ATXN1; (+) strand; PAM type: NRG; PAM sequence: TGG
aaaatactggaggtggggtg

SEQ ID NO: 142745 - DNA, 20 bp, Artificial Sequence
  Description of Artificial Sequence: Synthetic oligonucleotide
  Target: ATXN1; (+) strand; PAM type: NRG; PAM sequence: GGG
aaatactggaggtggggtgt

SEQ ID NO: 142746 - DNA, 20 bp, Artificial Sequence
  Description of Artificial Sequence: Synthetic oligonucleotide
  Target: ATXN1; (+) strand; PAM type: NRG; PAM sequence: AAG
tactggaggtggggtgtggg

SEQ ID NO: 142747 - DNA, 20 bp, Artificial Sequence
  Description of Artificial Sequence: Synthetic oligonucleotide
  Target: ATXN1; (+) strand; PAM type: NRG; PAM sequence: AGG
actggaggtggggtgtggga

SEQ ID NO: 142748 - DNA, 20 bp, Artificial Sequence
  Description of Artificial Sequence: Synthetic oligonucleotide
  Target: ATXN1; (+) strand; PAM type: NRG; PAM sequence: AAG
ggaggtggggtgtgggaagg

SEQ ID NO: 142749 - DNA, 20 bp, Artificial Sequence
  Description of Artificial Sequence: Synthetic oligonucleotide
  Target: ATXN1; (+) strand; PAM type: NRG; PAM sequence: AAG
gtggggtgtgggaaggaaga

SEQ ID NO: 142750 - DNA, 20 bp, Artificial Sequence
  Description of Artificial Sequence: Synthetic oligonucleotide
  Target: ATXN1; (+) strand; PAM type: NRG; PAM sequence: AAG
ggtgtgggaaggaagaaaga

SEQ ID NO: 142751 - DNA, 20 bp, Artificial Sequence
  Description of Artificial Sequence: Synthetic oligonucleotide
  Target: ATXN1; (+) strand; PAM type: NRG; PAM sequence: AAG
gaaagaaagaaaaaaaaaac

SEQ ID NO: 142752 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaacaagcatgacac

SEQ ID NO: 142753 - DNA, 20 bp, Artificial Sequence
  Description of Artificial Sequence: Synthetic oligonucleotide
  Target: ATXN1; (+) strand; PAM type: NRG; PAM sequence: GGG
aaaaaaacaagcatgacact

SEQ ID NO: 142754 - DNA, 20 bp, Artificial Sequence
  Description of Artificial Sequence: Synthetic oligonucleotide
  Target: ATXN1; (+) strand; PAM type: NRG; PAM sequence: GGG
aaaaaacaagcatgacactg

SEQ ID NO: 142755 - DNA, 20 bp, Artificial Sequence
  Description of Artificial Sequence: Synthetic oligonucleotide
  Target: ATXN1; (+) strand; PAM type: NRG; PAM sequence: GGG
aaaaacaagcatgacactgg

SEQ ID NO: 142756 - DNA, 20 bp, Artificial Sequence
  Description of Artificial Sequence: Synthetic oligonucleotide
  Target: ATXN1; (+) strand; PAM type: NRG; PAM sequence: GAG
aaacaagcatgacactgggg

SEQ ID NO: 142757 - DNA, 20 bp, Artificial Sequence
  Description of Artificial Sequence: Synthetic oligonucleotide
  Target: ATXN1; (+) strand; PAM type: NRG; PAM sequence: AGG
aacaagcatgacactggggg

SEQ ID NO: 142758 - DNA, 20 bp, Artificial Sequence
  Description of Artificial Sequence: Synthetic oligonucleotide
  Target: ATXN1; (+) strand; PAM type: NRG; PAM sequence: TAG
aagcatgacactgggggagg

SEQ ID NO: 142759 - DNA, 20 bp, Artificial Sequence
  Description of Artificial Sequence: Synthetic oligonucleotide
  Target: ATXN1; (+) strand; PAM type: NRG; PAM sequence: CAG
catgacactgggggaggtag

SEQ ID NO: 142760 - DNA, 20 bp, Artificial Sequence
  Description of Artificial Sequence: Synthetic oligonucleotide
  Target: ATXN1; (+) strand; PAM type: NRG; PAM sequence: AGG
atgacactgggggaggtagc

SEQ ID NO: 142761 - DNA, 20 bp, Artificial Sequence
  Description of Artificial Sequence: Synthetic oligonucleotide
  Target: ATXN1; (+) strand; PAM type: NRG; PAM sequence: CAG
aggtagcaggtcttgaaaat

SEQ ID NO: 142762 - DNA, 20 bp, Artificial Sequence
  Description of Artificial Sequence: Synthetic oligonucleotide
  Target: ATXN1; (+) strand; PAM type: NRG; PAM sequence: CAG
ttgaaaatcagaatgtacac

SEQ ID NO: 142763 - DNA, 20 bp, Artificial Sequence
  Description of Artificial Sequence: Synthetic oligonucleotide
  Target: ATXN1; (+) strand; PAM type: NRG; PAM sequence: TGG
aaaatcagaatgtacaccag

SEQ ID NO: 142764 - DNA, 20 bp, Artificial Sequence
  Description of Artificial Sequence: Synthetic oligonucleotide
  Target: ATXN1; (+) strand; PAM type: NRG; PAM sequence: GGG
aaatcagaatgtacaccagt

SEQ ID NO: 142765 - DNA, 20 bp, Artificial Sequence
  Description of Artificial Sequence: Synthetic oligonucleotide
  Target: ATXN1; (+) strand; PAM type: NRG; PAM sequence: AAG
gaatgcacttgcaaaatttc

SEQ ID NO: 142766 - DNA, 20 bp, Artificial Sequence
  Description of Artificial Sequence: Synthetic oligonucleotide
  Target: ATXN1; (+) strand; PAM type: NRG; PAM sequence: AAG
atttcaagtttaccgattga

SEQ ID NO: 142767 - DNA, 20 bp, Artificial Sequence
  Description of Artificial Sequence: Synthetic oligonucleotide
  Target: ATXN1; (+) strand; PAM type: NRG; PAM sequence: AAG
ccgattgaaagatgtgaata

SEQ ID NO: 142768 - DNA, 20 bp, Artificial Sequence
  Description of Artificial Sequence: Synthetic oligonucleotide
  Target: ATXN1; (+) strand; PAM type: NRG; PAM sequence: CAG
gatgtgaataaagaaaaatt

SEQ ID NO: 142769 - DNA, 20 bp, Artificial Sequence
  Description of Artificial Sequence: Synthetic oligonucleotide
  Target: ATXN1; (+) strand; PAM type: NRG; PAM sequence: AAG
aagaaaaattcagtacgtct

SEQ ID NO: 142770 - DNA, 20 bp, Artificial Sequence
  Description of Artificial Sequence: Synthetic oligonucleotide
  Target: ATXN1; (+) strand; PAM type: NRG; PAM sequence: AAG
tcagtacgtctaagtgatta

SEQ ID NO: 142771 - DNA, 20 bp, Artificial Sequence
  Description of Artificial Sequence: Synthetic oligonucleotide
  Target: ATXN1; (+) strand; PAM type: NRG; PAM sequence: CAG
agtgattaaagactgatgtg

SEQ ID NO: 142772 - DNA, 20 bp, Artificial Sequence
  Description of Artificial Sequence: Synthetic oligonucleotide
  Target: ATXN1; (+) strand; PAM type: NRG; PAM sequence: AAG
aaagactgatgtgcagtatc

SEQ ID NO: 142773 - DNA, 20 bp, Artificial Sequence
  Description of Artificial Sequence: Synthetic oligonucleotide
  Target: ATXN1; (+) strand; PAM type: NRG; PAM sequence: AGG
aagactgatgtgcagtatca

SEQ ID NO: 142774 - DNA, 20 bp, Artificial Sequence
  Description of Artificial Sequence: Synthetic oligonucleotide
  Target: ATXN1; (+) strand; PAM type: NRG; PAM sequence: GGG
agactgatgtgcagtatcaa

SEQ ID NO: 142775 - DNA, 20 bp, Artificial Sequence
  Description of Artificial Sequence: Synthetic oligonucleotide
  Target: ATXN1; (+) strand; PAM type: NRG; PAM sequence: CAG
ctgatgtgcagtatcaaggg

SEQ ID NO: 142776 - DNA, 20 bp, Artificial Sequence
  Description of Artificial Sequence: Synthetic oligonucleotide
  Target: ATXN1; (+) strand; PAM type: NRG; PAM sequence: AAG
tgtgcagtatcaagggcaga

SEQ ID NO: 142777 - DNA, 20 bp, Artificial Sequence
  Description of Artificial Sequence: Synthetic oligonucleotide
  Target: ATXN1; (+) strand; PAM type: NRG; PAM sequence: AAG
agtatcaagggcagaaagtg

SEQ ID NO: 142778 - DNA, 20 bp, Artificial Sequence
  Description of Artificial Sequence: Synthetic oligonucleotide
  Target: ATXN1; (+) strand; PAM type: NRG; PAM sequence: AAG
tcaagggcagaaagtgaaga

SEQ ID NO: 142779 - DNA, 20 bp, Artificial Sequence
  Description of Artificial Sequence: Synthetic oligonucleotide
  Target: ATXN1; (+) strand; PAM type: NRG; PAM sequence: AAG
agaaagtttgcttcaaatga

SEQ ID NO: 142780 - DNA, 20 bp, Artificial Sequence
  Description of Artificial Sequence: Synthetic oligonucleotide
  Target: ATXN1; (+) strand; PAM type: NRG; PAM sequence: CAG
tttgcttcaaatgaaagact

SEQ ID NO: 142781 - DNA, 20 bp, Artificial Sequence
  Description of Artificial Sequence: Synthetic oligonucleotide
  Target: ATXN1; (+) strand; PAM type: NRG; PAM sequence: AAG
atgtgaatactttttaaata

SEQ ID NO: 142782 - DNA, 20 bp, Artificial Sequence
  Description of Artificial Sequence: Synthetic oligonucleotide
  Target: ATXN1; (+) strand; PAM type: NRG; PAM sequence: GAG
gtgaatactttttaaataaa

SEQ ID NO: 142783 - DNA, 20 bp, Artificial Sequence
  Description of Artificial Sequence: Synthetic oligonucleotide
  Target: ATXN1; (+) strand; PAM type: NRG; PAM sequence: AAG
tttttaaataaagagctatt

SEQ ID NO: 142784 - DNA, 20 bp, Artificial Sequence
  Description of Artificial Sequence: Synthetic oligonucleotide
  Target: ATXN1; (+) strand; PAM type: NRG; PAM sequence: TGG
taaataaagagctattaaga

SEQ ID NO: 142785 - DNA, 20 bp, Artificial Sequence
  Description of Artificial Sequence: Synthetic oligonucleotide
  Target: ATXN1; (+) strand; PAM type: NRG; PAM sequence: AAG
gctattaagatggaacaaaa

SEQ ID NO: 142786 - DNA, 20 bp, Artificial Sequence
  Description of Artificial Sequence: Synthetic oligonucleotide
  Target: ATXN1; (+) strand; PAM type: NRG; PAM sequence: AAG
aagatggaacaaaaaagata

SEQ ID NO: 142787 - DNA, 20 bp, Artificial Sequence
  Description of Artificial Sequence: Synthetic oligonucleotide
  Target: ATXN1; (+) strand; PAM type: NRG; PAM sequence: AAG
gaacaaaaaagataaagcat

SEQ ID NO: 142788 - DNA, 20 bp, Artificial Sequence
  Description of Artificial Sequence: Synthetic oligonucleotide
  Target: ATXN1; (+) strand; PAM type: NRG; PAM sequence: GAG
acaaaaaagataaagcataa

SEQ ID NO: 142789 - DNA, 20 bp, Artificial Sequence
  Description of Artificial Sequence: Synthetic oligonucleotide
  Target: ATXN1; (+) strand; PAM type: NRG; PAM sequence: GAG
aaaaaagataaagcataaga

SEQ ID NO: 142790 - DNA, 20 bp, Artificial Sequence
  Description of Artificial Sequence: Synthetic oligonucleotide
  Target: ATXN1; (+) strand; PAM type: NRG; PAM sequence: GAG
aaaagataaagcataagaga

SEQ ID NO: 142791 - DNA, 20 bp, Artificial Sequence
  Description of Artificial Sequence: Synthetic oligonucleotide
  Target: ATXN1; (+) strand; PAM type: NRG; PAM sequence: AAG
cattttccattttgccctat

SEQ ID NO: 142792 - DNA, 20 bp, Artificial Sequence
  Description of Artificial Sequence: Synthetic oligonucleotide
  Target: ATXN1; (+) strand; PAM type: NRG; PAM sequence: TAG
tttccattttgccctataag

SEQ ID NO: 142793 - DNA, 20 bp, Artificial Sequence
  Description of Artificial Sequence: Synthetic oligonucleotide
  Target: ATXN1; (+) strand; PAM type: NRG; PAM sequence: AGG
ttccattttgccctataagt

SEQ ID NO: 142794 - DNA, 20 bp, Artificial Sequence
  Description of Artificial Sequence: Synthetic oligonucleotide
  Target: ATXN1; (+) strand; PAM type: NRG; PAM sequence: TGG
ccctataagtaggtaatgca

SEQ ID NO: 142795 - DNA, 20 bp, Artificial Sequence
  Description of Artificial Sequence: Synthetic oligonucleotide
  Target: ATXN1; (+) strand; PAM type: NRG; PAM sequence: GGG
cctataagtaggtaatgcat

SEQ ID NO: 142796 - DNA, 20 bp, Artificial Sequence
  Description of Artificial Sequence: Synthetic oligonucleotide
  Target: ATXN1; (+) strand; PAM type: NRG; PAM sequence: AAG
gataaatactttctccaccc

SEQ ID NO: 142797 - DNA, 20 bp, Artificial Sequence
  Description of Artificial Sequence: Synthetic oligonucleotide
  Target: ATXN1; (+) strand; PAM type: NRG; PAM sequence: AAG
ctttctccacccaagctgaa

SEQ ID NO: 142798 - DNA, 20 bp, Artificial Sequence
  Description of Artificial Sequence: Synthetic oligonucleotide
  Target: ATXN1; (+) strand; PAM type: NRG; PAM sequence: CAG
tctccacccaagctgaaaag

SEQ ID NO: 142799 - DNA, 20 bp, Artificial Sequence
  Description of Artificial Sequence: Synthetic oligonucleotide
  Target: ATXN1; (+) strand; PAM type: NRG; PAM sequence: TAG
ccacccaagctgaaaagcag

SEQ ID NO: 142800 - DNA, 20 bp, Artificial Sequence
  Description of Artificial Sequence: Synthetic oligonucleotide
  Target: ATXN1; (+) strand; PAM type: NRG; PAM sequence: CAG
catgcctctttacccccact

SEQ ID NO: 142801 - DNA, 20 bp, Artificial Sequence
  Description of Artificial Sequence: Synthetic oligonucleotide
  Target: ATXN1; (+) strand; PAM type: NRG; PAM sequence: GAG
tgcctctttacccccactca

SEQ ID NO: 142802 - DNA, 20 bp, Artificial Sequence
  Description of Artificial Sequence: Synthetic oligonucleotide
  Target: ATXN1; (+) strand; PAM type: NRG; PAM sequence: CAG
ctctttacccccactcagag

SEQ ID NO: 142803 - DNA, 20 bp, Artificial Sequence
  Description of Artificial Sequence: Synthetic oligonucleotide
  Target: ATXN1; (+) strand; PAM type: NRG; PAM sequence: AAG
cccactcagagcagctgata

SEQ ID NO: 142804 - DNA, 20 bp, Artificial Sequence
  Description of Artificial Sequence: Synthetic oligonucleotide
  Target: ATXN1; (+) strand; PAM type: NRG; PAM sequence: TAG
agctgataaagcctacacat

SEQ ID NO: 142805 - DNA, 20 bp, Artificial Sequence
  Description of Artificial Sequence: Synthetic oligonucleotide
  Target: ATXN1; (+) strand; PAM type: NRG; PAM sequence: AAG
acattagaacctcgtctgac

SEQ ID NO: 142806 - DNA, 20 bp, Artificial Sequence
  Description of Artificial Sequence: Synthetic oligonucleotide
  Target: ATXN1; (+) strand; PAM type: NRG; PAM sequence: AGG
cattagaacctcgtctgaca

SEQ ID NO: 142807 - DNA, 20 bp, Artificial Sequence
  Description of Artificial Sequence: Synthetic oligonucleotide
  Target: ATXN1; (+) strand; PAM type: NRG; PAM sequence: AAG
tctgacaaggtcactctgaa

SEQ ID NO: 142808 - DNA, 20 bp, Artificial Sequence
  Description of Artificial Sequence: Synthetic oligonucleotide
  Target: ATXN1; (+) strand; PAM type: NRG; PAM sequence: GAG
aaagttcctttctgccttgt

SEQ ID NO: 142809 - DNA, 20 bp, Artificial Sequence
  Description of Artificial Sequence: Synthetic oligonucleotide
  Target: ATXN1; (+) strand; PAM type: NRG; PAM sequence: CAG
cttttaacgctcacttgtca

SEQ ID NO: 142810 - DNA, 20 bp, Artificial Sequence
  Description of Artificial Sequence: Synthetic oligonucleotide
  Target: ATXN1; (+) strand; PAM type: NRG; PAM sequence: AGG
ttttaacgctcacttgtcac

SEQ ID NO: 142811 - DNA, 20 bp, Artificial Sequence
  Description of Artificial Sequence: Synthetic oligonucleotide
  Target: ATXN1; (+) strand; PAM type: NRG; PAM sequence: AAG
cttgtcacaggctgttgtta

SEQ ID NO: 142812 - DNA, 20 bp, Artificial Sequence
  Description of Artificial Sequence: Synthetic oligonucleotide
  Target: ATXN1; (+) strand; PAM type: NRG; PAM sequence: TAG
ttaaagcatcttctgatgct

SEQ ID NO: 142813 - DNA, 20 bp, Artificial Sequence
  Description of Artificial Sequence: Synthetic oligonucleotide
  Target: ATXN1; (+) strand; PAM type: NRG; PAM sequence: TGG
cactgtttgttttttgacaa

SEQ ID NO: 142814 - DNA, 20 bp, Artificial Sequence
  Description of Artificial Sequence: Synthetic oligonucleotide
  Target: ATXN1; (+) strand; PAM type: NRG; PAM sequence: GAG
ttttttgacaatggccattt

SEQ ID NO: 142815 - DNA, 20 bp, Artificial Sequence
  Description of Artificial Sequence: Synthetic oligonucleotide
  Target: ATXN1; (+) strand; PAM type: NRG; PAM sequence: GAG
ttttgacaatggccatttga

SEQ ID NO: 142816 - DNA, 20 bp, Artificial Sequence
  Description of Artificial Sequence: Synthetic oligonucleotide
  Target: ATXN1; (+) strand; PAM type: NRG; PAM sequence: TAG
acaatggccatttgagagcc

SEQ ID NO: 142817 - DNA, 20 bp, Artificial Sequence
  Description of Artificial Sequence: Synthetic oligonucleotide
  Target: ATXN1; (+) strand; PAM type: NRG; PAM sequence: CAG
gccatttgagagcctagaaa

SEQ ID NO: 142818 - DNA, 20 bp, Artificial Sequence
  Description of Artificial Sequence: Synthetic oligonucleotide
  Target: ATXN1; (+) strand; PAM type: NRG; PAM sequence: AAG
agcctagaaacagtcttcca

SEQ ID NO: 142819 - DNA, 20 bp, Artificial Sequence
  Description of Artificial Sequence: Synthetic oligonucleotide
  Target: ATXN1; (+) strand; PAM type: NRG; PAM sequence: AGG
gcctagaaacagtcttccaa

SEQ ID NO: 142820 - DNA, 20 bp, Artificial Sequence
  Description of Artificial Sequence: Synthetic oligonucleotide
  Target: ATXN1; (+) strand; PAM type: NRG; PAM sequence: TAG
aaggtgtctgcctccttttt

SEQ ID NO: 142821 - DNA, 20 bp, Artificial Sequence
  Description of Artificial Sequence: Synthetic oligonucleotide
  Target: ATXN1; (+) strand; PAM type: NRG; PAM sequence: GAG
ctccttttttagccttttat

SEQ ID NO: 142822 - DNA, 20 bp, Artificial Sequence
  Description of Artificial Sequence: Synthetic oligonucleotide
  Target: ATXN1; (+) strand; PAM type: NRG; PAM sequence: CGG
catctatgttgaaaacccat

SEQ ID NO: 142823 - DNA, 20 bp, Artificial Sequence
  Description of Artificial Sequence: Synthetic oligonucleotide
  Target: ATXN1; (+) strand; PAM type: NRG; PAM sequence: CAG
cccatcggctgactgtcatc

SEQ ID NO: 142824 - DNA, 20 bp, Artificial Sequence
  Description of Artificial Sequence: Synthetic oligonucleotide
  Target: ATXN1; (+) strand; PAM type: NRG; PAM sequence: GAG
tgactgtcatccagttccct

SEQ ID NO: 142825 - DNA, 20 bp, Artificial Sequence
  Description of Artificial Sequence: Synthetic oligonucleotide
  Target: ATXN1; (+) strand; PAM type: NRG; PAM sequence: TGG
gtcatccagttccctgagta

SEQ ID NO: 142826 - DNA, 20 bp, Artificial Sequence
  Description of Artificial Sequence: Synthetic oligonucleotide
  Target: ATXN1; (+) strand; PAM type: NRG; PAM sequence: TGG
atccagttccctgagtatgg

SEQ ID NO: 142827 - DNA, 20 bp, Artificial Sequence
  Description of Artificial Sequence: Synthetic oligonucleotide
  Target: ATXN1; (+) strand; PAM type: NRG; PAM sequence: AAG
ctaaactccataaatctcca

SEQ ID NO: 142828 - DNA, 20 bp, Artificial Sequence
  Description of Artificial Sequence: Synthetic oligonucleotide
  Target: ATXN1; (+) strand; PAM type: NRG; PAM sequence: AGG
taaactccataaatctccaa

SEQ ID NO: 142829 - DNA, 20 bp, Artificial Sequence
  Description of Artificial Sequence: Synthetic oligonucleotide
  Target: ATXN1; (+) strand; PAM type: NRG; PAM sequence: CGG
ataaatctccaaaggtccca

SEQ ID NO: 142830 - DNA, 20 bp, Artificial Sequence
  Description of Artificial Sequence: Synthetic oligonucleotide
  Target: ATXN1; (+) strand; PAM type: NRG; PAM sequence: AAG
aggtcccacggtgatcatca

SEQ ID NO: 142831 - DNA, 20 bp, Artificial Sequence
  Description of Artificial Sequence: Synthetic oligonucleotide
  Target: ATXN1; (+) strand; PAM type: NRG; PAM sequence: TGG
ccacggtgatcatcaaagat

SEQ ID NO: 142832 - DNA, 20 bp, Artificial Sequence
  Description of Artificial Sequence: Synthetic oligonucleotide
  Target: ATXN1; (+) strand; PAM type: NRG; PAM sequence: AAG
tgatcatcaaagattggatc

SEQ ID NO: 142833 - DNA, 20 bp, Artificial Sequence
  Description of Artificial Sequence: Synthetic oligonucleotide
  Target: ATXN1; (+) strand; PAM type: NRG; PAM sequence: AAG
aaagattggatcaagtgacc

SEQ ID NO: 142834 - DNA, 20 bp, Artificial Sequence
  Description of Artificial Sequence: Synthetic oligonucleotide
  Target: ATXN1; (+) strand; PAM type: NRG; PAM sequence: AAG
ggatcaagtgaccaagttgt

SEQ ID NO: 142835 - DNA, 20 bp, Artificial Sequence
  Description of Artificial Sequence: Synthetic oligonucleotide
  Target: ATXN1; (+) strand; PAM type: NRG; PAM sequence: AAG
caagtgaccaagttgtaaga

SEQ ID NO: 142836 - DNA, 20 bp, Artificial Sequence
  Description of Artificial Sequence: Synthetic oligonucleotide
  Target: ATXN1; (+) strand; PAM type: NRG; PAM sequence: GAG
agtgaccaagttgtaagaaa

SEQ ID NO: 142837 - DNA, 20 bp, Artificial Sequence
  Description of Artificial Sequence: Synthetic oligonucleotide
  Target: ATXN1; (+) strand; PAM type: NRG; PAM sequence: AGG
gtgaccaagttgtaagaaag

SEQ ID NO: 142838 - DNA, 20 bp, Artificial Sequence
  Description of Artificial Sequence: Synthetic oligonucleotide
  Target: ATXN1; (+) strand; PAM type: NRG; PAM sequence: CAG
gaggatatgctcgtatgcct

SEQ ID NO: 142839 - DNA, 20 bp, Artificial Sequence
  Description of Artificial Sequence: Synthetic oligonucleotide
  Target: ATXN1; (+) strand; PAM type: NRG; PAM sequence: AAG
gatatgctcgtatgcctcag

SEQ ID NO: 142840 - DNA, 20 bp, Artificial Sequence
  Description of Artificial Sequence: Synthetic oligonucleotide
  Target: ATXN1; (+) strand; PAM type: NRG; PAM sequence: AAG
gtgaataactaattccttga

SEQ ID NO: 142841 - DNA, 20 bp, Artificial Sequence
  Description of Artificial Sequence: Synthetic oligonucleotide
  Target: ATXN1; (+) strand; PAM type: NRG; PAM sequence: TGG
cttctgtaactattacttta

SEQ ID NO: 142842 - DNA, 20 bp, Artificial Sequence
  Description of Artificial Sequence: Synthetic oligonucleotide
  Target: ATXN1; (+) strand; PAM type: NRG; PAM sequence: TAG
gtaactattactttatggaa

SEQ ID NO: 142843 - DNA, 20 bp, Artificial Sequence
  Description of Artificial Sequence: Synthetic oligonucleotide
  Target: ATXN1; (+) strand; PAM type: NRG; PAM sequence: CGG
ggaatagtcaaccttttttt

SEQ ID NO: 142844 - DNA, 20 bp, Artificial Sequence
  Description of Artificial Sequence: Synthetic oligonucleotide
  Target: ATXN1; (+) strand; PAM type: NRG; PAM sequence: GGG
gaatagtcaacctttttttc

SEQ ID NO: 142845 - DNA, 20 bp, Artificial Sequence
  Description of Artificial Sequence: Synthetic oligonucleotide
  Target: ATXN1; (+) strand; PAM type: NRG; PAM sequence: GAG
acctttttttcgggacgttt

SEQ ID NO: 142846 - DNA, 20 bp, Artificial Sequence
  Description of Artificial Sequence: Synthetic oligonucleotide
  Target: ATXN1; (+) strand; PAM type: NRG; PAM sequence: AGG
cctttttttcgggacgtttg

SEQ ID NO: 142847 - DNA, 20 bp, Artificial Sequence
  Description of Artificial Sequence: Synthetic oligonucleotide
  Target: ATXN1; (+) strand; PAM type: NRG; PAM sequence: GAG
tttttttcgggacgtttgag

SEQ ID NO: 142848 - DNA, 20 bp, Artificial Sequence
  Description of Artificial Sequence: Synthetic oligonucleotide
  Target: ATXN1; (+) strand; PAM type: NRG; PAM sequence: TGG
tgaggagttgtgtctatctg

SEQ ID NO: 142849 - DNA, 20 bp, Artificial Sequence
  Description of Artificial Sequence: Synthetic oligonucleotide
  Target: ATXN1; (+) strand; PAM type: NRG; PAM sequence: TGG
tctatctgtggttaaattcc

SEQ ID NO: 142850 - DNA, 20 bp, Artificial Sequence
  Description of Artificial Sequence: Synthetic oligonucleotide
  Target: ATXN1; (+) strand; PAM type: NRG; PAM sequence: GGG
ctatctgtggttaaattcct

SEQ ID NO: 142851 - DNA, 20 bp, Artificial Sequence
  Description of Artificial Sequence: Synthetic oligonucleotide
  Target: ATXN1; (+) strand; PAM type: NRG; PAM sequence: GAG
tgggaacactaaaaactttt

SEQ ID NO: 142852 - DNA, 20 bp, Artificial Sequence
  Description of Artificial Sequence: Synthetic oligonucleotide
  Target: ATXN1; (+) strand; PAM type: NRG; PAM sequence: AGG
gggaacactaaaaacttttg

SEQ ID NO: 142853 - DNA, 20 bp, Artificial Sequence
  Description of Artificial Sequence: Synthetic oligonucleotide
  Target: ATXN1; (+) strand; PAM type: NRG; PAM sequence: GAG
gaacactaaaaacttttgag

SEQ ID NO: 142854 - DNA, 20 bp, Artificial Sequence
  Description of Artificial Sequence: Synthetic oligonucleotide
  Target: ATXN1; (+) strand; PAM type: NRG; PAM sequence: AGG
aacactaaaaacttttgagg

SEQ ID NO: 142855 - DNA, 20 bp, Artificial Sequence
  Description of Artificial Sequence: Synthetic oligonucleotide
  Target: ATXN1; (+) strand; PAM type: NRG; PAM sequence: GAG
cactaaaaacttttgaggag

SEQ ID NO: 142856 - DNA, 20 bp, Artificial Sequence
  Description of Artificial Sequence: Synthetic oligonucleotide
  Target: ATXN1; (+) strand; PAM type: NRG; PAM sequence: AAG
aaaaacttttgaggaggaga

SEQ ID NO: 142857 - DNA, 20 bp, Artificial Sequence
  Description of Artificial Sequence: Synthetic oligonucleotide
  Target: ATXN1; (+) strand; PAM type: NRG; PAM sequence: GAG
ccgttaatgtttaaacatgt

SEQ ID NO: 142858 - DNA, 20 bp, Artificial Sequence
  Description of Artificial Sequence: Synthetic oligonucleotide
  Target: ATXN1; (+) strand; PAM type: NRG; PAM sequence: GAG
aatgtttaaacatgtgagtt

SEQ ID NO: 142859 - DNA, 20 bp, Artificial Sequence
  Description of Artificial Sequence: Synthetic oligonucleotide
  Target: ATXN1; (+) strand; PAM type: NRG; PAM sequence: TAG
atgccattcaattttccatc

SEQ ID NO: 142860 - DNA, 20 bp, Artificial Sequence
  Description of Artificial Sequence: Synthetic oligonucleotide
  Target: ATXN1; (+) strand; PAM type: NRG; PAM sequence: CGG
cattcaattttccatctagc

SEQ ID NO: 142861 - DNA, 20 bp, Artificial Sequence
  Description of Artificial Sequence: Synthetic oligonucleotide
  Target: ATXN1; (+) strand; PAM type: NRG; PAM sequence: GAG
ttcaattttccatctagccg

SEQ ID NO: 142862 - DNA, 20 bp, Artificial Sequence
  Description of Artificial Sequence: Synthetic oligonucleotide
  Target: ATXN1; (+) strand; PAM type: NRG; PAM sequence: AGG
tcaattttccatctagccgg

SEQ ID NO: 142863 - DNA, 20 bp, Artificial Sequence
  Description of Artificial Sequence: Synthetic oligonucleotide
  Target: ATXN1; (+) strand; PAM type: NRG; PAM sequence: TGG
gaggaacaactgcctgaaaa

SEQ ID NO: 142864 - DNA, 20 bp, Artificial Sequence
  Description of Artificial Sequence: Synthetic oligonucleotide
  Target: ATXN1; (+) strand; PAM type: NRG; PAM sequence: AAG
caactgcctgaaaatggcaa

SEQ ID NO: 142865 - DNA, 20 bp, Artificial Sequence
  Description of Artificial Sequence: Synthetic oligonucleotide
  Target: ATXN1; (+) strand; PAM type: NRG; PAM sequence: TGG
caaaagccttttttattttt

SEQ ID NO: 142866 - DNA, 20 bp, Artificial Sequence
  Description of Artificial Sequence: Synthetic oligonucleotide
  Target: ATXN1; (+) strand; PAM type: NRG; PAM sequence: CAG
ttttattttttggatgctat

SEQ ID NO: 142867 - DNA, 20 bp, Artificial Sequence
  Description of Artificial Sequence: Synthetic oligonucleotide
  Target: ATXN1; (+) strand; PAM type: NRG; PAM sequence: CAG
ttggatgctatcagtaccca

SEQ ID NO: 142868 - DNA, 20 bp, Artificial Sequence
  Description of Artificial Sequence: Synthetic oligonucleotide
  Target: ATXN1; (+) strand; PAM type: NRG; PAM sequence: TGG
ctatcagtacccacagaaaa

SEQ ID NO: 142869 - DNA, 20 bp, Artificial Sequence
  Description of Artificial Sequence: Synthetic oligonucleotide
  Target: ATXN1; (+) strand; PAM type: NRG; PAM sequence: GGG
tatcagtacccacagaaaat

SEQ ID NO: 142870 - DNA, 20 bp, Artificial Sequence
  Description of Artificial Sequence: Synthetic oligonucleotide
  Target: ATXN1; (+) strand; PAM type: NRG; PAM sequence: GGG
atcagtacccacagaaaatg

SEQ ID NO: 142871 - DNA, 20 bp, Artificial Sequence
  Description of Artificial Sequence: Synthetic oligonucleotide
  Target: ATXN1; (+) strand; PAM type: NRG; PAM sequence: AAG
cccacagaaaatggggttgt

SEQ ID NO: 142872 - DNA, 20 bp, Artificial Sequence
  Description of Artificial Sequence: Synthetic oligonucleotide
  Target: ATXN1; (+) strand; PAM type: NRG; PAM sequence: AGG
ccacagaaaatggggttgta

SEQ ID NO: 142873 - DNA, 20 bp, Artificial Sequence
  Description of Artificial Sequence: Synthetic oligonucleotide
  Target: ATXN1; (+) strand; PAM type: NRG; PAM sequence: TAG
tggggttgtaaggattttat

SEQ ID NO: 142874 - DNA, 20 bp, Artificial Sequence
  Description of Artificial Sequence: Synthetic oligonucleotide
  Target: ATXN1; (+) strand; PAM type: NRG; PAM sequence: CAG
tttattagttttatgtaact

SEQ ID NO: 142875 - DNA, 20 bp, Artificial Sequence
  Description of Artificial Sequence: Synthetic oligonucleotide
  Target: ATXN1; (+) strand; PAM type: NRG; PAM sequence: AAG
cagctcccactcaaatgtgt

SEQ ID NO: 142876 - DNA, 20 bp, Artificial Sequence
  Description of Artificial Sequence: Synthetic oligonucleotide
  Target: ATXN1; (+) strand; PAM type: NRG; PAM sequence: AGG
agctcccactcaaatgtgta

SEQ ID NO: 142877 - DNA, 20 bp, Artificial Sequence
  Description of Artificial Sequence: Synthetic oligonucleotide
  Target: ATXN1; (+) strand; PAM type: NRG; PAM sequence: TAG
tgtgtaaggcaacatactga

SEQ ID NO: 142878 - DNA, 20 bp, Artificial Sequence
  Description of Artificial Sequence: Synthetic oligonucleotide
  Target: ATXN1; (+) strand; PAM type: NRG; PAM sequence: AAG
atactgatagaaatcaacat

SEQ ID NO: 142879 - DNA, 20 bp, Artificial Sequence
  Description of Artificial Sequence: Synthetic oligonucleotide
  Target: ATXN1; (+) strand; PAM type: NRG; PAM sequence: CAG
tgatagaaatcaacataagc

SEQ ID NO: 142880 - DNA, 20 bp, Artificial Sequence
  Description of Artificial Sequence: Synthetic oligonucleotide
  Target: ATXN1; (+) strand; PAM type: NRG; PAM sequence: AGG
gatagaaatcaacataagcc

SEQ ID NO: 142881 - DNA, 20 bp, Artificial Sequence
  Description of Artificial Sequence: Synthetic oligonucleotide
  Target: ATXN1; (+) strand; PAM type: NRG; PAM sequence: AAG
agaaatcaacataagccagg

SEQ ID NO: 142882 - DNA, 20 bp, Artificial Sequence
  Description of Artificial Sequence: Synthetic oligonucleotide
  Target: ATXN1; (+) strand; PAM type: NRG; PAM sequence: AAG
aacataagccaggaagttca

SEQ ID NO: 142883 - DNA, 20 bp, Artificial Sequence
  Description of Artificial Sequence: Synthetic oligonucleotide
  Target: ATXN1; (+) strand; PAM type: NRG; PAM sequence: CGG
acaaactgtctttactttac

SEQ ID NO: 142884 - DNA, 20 bp, Artificial Sequence
  Description of Artificial Sequence: Synthetic oligonucleotide
  Target: ATXN1; (+) strand; PAM type: NRG; PAM sequence: TGG
ctgtctttactttaccggct

SEQ ID NO: 142885 - DNA, 20 bp, Artificial Sequence
  Description of Artificial Sequence: Synthetic oligonucleotide
  Target: ATXN1; (+) strand; PAM type: NRG; PAM sequence: CAG
ctttaccggcttggtaaaaa

SEQ ID NO: 142886 - DNA, 20 bp, Artificial Sequence
  Description of Artificial Sequence: Synthetic oligonucleotide
  Target: ATXN1; (+) strand; PAM type: NRG; PAM sequence: TGG
ggcttggtaaaaacagaatt

SEQ ID NO: 142887 - DNA, 20 bp, Artificial Sequence
  Description of Artificial Sequence: Synthetic oligonucleotide
  Target: ATXN1; (+) strand; PAM type: NRG; PAM sequence: GAG
cttggtaaaaacagaatttg

SEQ ID NO: 142888 - DNA, 20 bp, Artificial Sequence
  Description of Artificial Sequence: Synthetic oligonucleotide
  Target: ATXN1; (+) strand; PAM type: NRG; PAM sequence: GAG
tggtaaaaacagaatttgga

SEQ ID NO: 142889 - DNA, 20 bp, Artificial Sequence
  Description of Artificial Sequence: Synthetic oligonucleotide
  Target: ATXN1; (+) strand; PAM type: NRG; PAM sequence: GAG
gtaaaaacagaatttggaga

SEQ ID NO: 142890 - DNA, 20 bp, Artificial Sequence
  Description of Artificial Sequence: Synthetic oligonucleotide
  Target: ATXN1; (+) strand; PAM type: NRG; PAM sequence: AGG
taaaaacagaatttggagag

SEQ ID NO: 142891 - DNA, 20 bp, Artificial Sequence
  Description of Artificial Sequence: Synthetic oligonucleotide
  Target: ATXN1; (+) strand; PAM type: NRG; PAM sequence: GAG
aaaacagaatttggagagag

SEQ ID NO: 142892 - DNA, 20 bp, Artificial Sequence
  Description of Artificial Sequence: Synthetic oligonucleotide
  Target: ATXN1; (+) strand; PAM type: NRG; PAM sequence: AGG
aaacagaatttggagagagg

SEQ ID NO: 142893 - DNA, 20 bp, Artificial Sequence
  Description of Artificial Sequence: Synthetic oligonucleotide
  Target: ATXN1; (+) strand; PAM type: NRG; PAM sequence: GAG
acagaatttggagagaggag

SEQ ID NO: 142894 - DNA, 20 bp, Artificial Sequence
  Description of Artificial Sequence: Synthetic oligonucleotide
  Target: ATXN1; (+) strand; PAM type: NRG; PAM sequence: AGG
cagaatttggagagaggagg

SEQ ID NO: 142895 - DNA, 20 bp, Artificial Sequence
  Description of Artificial Sequence: Synthetic oligonucleotide
  Target: ATXN1; (+) strand; PAM type: NRG; PAM sequence: AAG
gagaggaggaggatttaaac

SEQ ID NO: 142896 - DNA, 20 bp, Artificial Sequence
  Description of Artificial Sequence: Synthetic oligonucleotide
  Target: ATXN1; (+) strand; PAM type: NRG; PAM sequence: AAG
gatttaaacaagttcactgc

SEQ ID NO: 142897 - DNA, 20 bp, Artificial Sequence
  Description of Artificial Sequence: Synthetic oligonucleotide
  Target: ATXN1; (+) strand; PAM type: NRG; PAM sequence: TGG
acaagttcactgcaagttac

SEQ ID NO: 142898 - DNA, 20 bp, Artificial Sequence
  Description of Artificial Sequence: Synthetic oligonucleotide
  Target: ATXN1; (+) strand; PAM type: NRG; PAM sequence: GAG
tgttaccaacttcatatctc

SEQ ID NO: 142899 - DNA, 20 bp, Artificial Sequence
  Description of Artificial Sequence: Synthetic oligonucleotide
  Target: ATXN1; (+) strand; PAM type: NRG; PAM sequence: AGG
gttaccaacttcatatctcg

SEQ ID NO: 142900 - DNA, 20 bp, Artificial Sequence
  Description of Artificial Sequence: Synthetic oligonucleotide
  Target: ATXN1; (+) strand; PAM type: NRG; PAM sequence: TGG
atctcgaggtattctataat

SEQ ID NO: 142901 - DNA, 20 bp, Artificial Sequence
  Description of Artificial Sequence: Synthetic oligonucleotide
  Target: ATXN1; (+) strand; PAM type: NRG; PAM sequence: AAG
tcgaggtattctataattgg

SEQ ID NO: 142902 - DNA, 20 bp, Artificial Sequence
  Description of Artificial Sequence: Synthetic oligonucleotide
  Target: ATXN1; (+) strand; PAM type: NRG; PAM sequence: GAG
gaggtattctataattggaa

SEQ ID NO: 142903 - DNA, 20 bp, Artificial Sequence
  Description of Artificial Sequence: Synthetic oligonucleotide
  Target: ATXN1; (+) strand; PAM type: NRG; PAM sequence: AGG
aggtattctataattggaag

SEQ ID NO: 142904 - DNA, 20 bp, Artificial Sequence
  Description of Artificial Sequence: Synthetic oligonucleotide
  Target: ATXN1; (+) strand; PAM type: NRG; PAM sequence: AAG
tcattccaatgtcttctgca

SEQ ID NO: 142905 - DNA, 20 bp, Artificial Sequence
  Description of Artificial Sequence: Synthetic oligonucleotide
  Target: ATXN1; (+) strand; PAM type: NRG; PAM sequence: AGG
cattccaatgtcttctgcaa

SEQ ID NO: 142906 - DNA, 20 bp, Artificial Sequence
  Description of Artificial Sequence: Synthetic oligonucleotide
  Target: ATXN1; (+) strand; PAM type: NRG; PAM sequence: CAG
tgcaaaggaacctgctgacc

SEQ ID NO: 142907 - DNA, 20 bp, Artificial Sequence
  Description of Artificial Sequence: Synthetic oligonucleotide
  Target: ATXN1; (+) strand; PAM type: NRG; PAM sequence: AGG
gcaaaggaacctgctgaccc

SEQ ID NO: 142908 - DNA, 20 bp, Artificial Sequence
  Description of Artificial Sequence: Synthetic oligonucleotide
  Target: ATXN1; (+) strand; PAM type: NRG; PAM sequence: GGG
caaaggaacctgctgaccca

SEQ ID NO: 142909 - DNA, 20 bp, Artificial Sequence
  Description of Artificial Sequence: Synthetic oligonucleotide
  Target: ATXN1; (+) strand; PAM type: NRG; PAM sequence: GAG
aaggaacctgctgacccagg

SEQ ID NO: 142910 - DNA, 20 bp, Artificial Sequence
  Description of Artificial Sequence: Synthetic oligonucleotide
  Target: ATXN1; (+) strand; PAM type: NRG; PAM sequence: AGG
aggaacctgctgacccaggg

SEQ ID NO: 142911 - DNA, 20 bp, Artificial Sequence
  Description of Artificial Sequence: Synthetic oligonucleotide
  Target: ATXN1; (+) strand; PAM type: NRG; PAM sequence: AAG
ggttgacatacctcttttta

SEQ ID NO: 142912 - DNA, 20 bp, Artificial Sequence
  Description of Artificial Sequence: Synthetic oligonucleotide
  Target: ATXN1; (+) strand; PAM type: NRG; PAM sequence: CAG
tacctctttttaaagtcata

SEQ ID NO: 142913 - DNA, 20 bp, Artificial Sequence
  Description of Artificial Sequence: Synthetic oligonucleotide
  Target: ATXN1; (+) strand; PAM type: NRG; PAM sequence: AAG
tctttttaaagtcatacaga

SEQ ID NO: 142914 - DNA, 20 bp, Artificial Sequence
  Description of Artificial Sequence: Synthetic oligonucleotide
  Target: ATXN1; (+) strand; PAM type: NRG; PAM sequence: TGG
aagttaatatgtactttgac

SEQ ID NO: 142915 - DNA, 20 bp, Artificial Sequence
  Description of Artificial Sequence: Synthetic oligonucleotide
  Target: ATXN1; (+) strand; PAM type: NRG; PAM sequence: TGG
tatgtactttgactggattc

SEQ ID NO: 142916 - DNA, 20 bp, Artificial Sequence
  Description of Artificial Sequence: Synthetic oligonucleotide
  Target: ATXN1; (+) strand; PAM type: NRG; PAM sequence: GGG
atgtactttgactggattct

SEQ ID NO: 142917 - DNA, 20 bp, Artificial Sequence
  Description of Artificial Sequence: Synthetic oligonucleotide
  Target: ATXN1; (+) strand; PAM type: NRG; PAM sequence: TGG
tcatgctcattgacgcttaa

SEQ ID NO: 142918 - DNA, 20 bp, Artificial Sequence
  Description of Artificial Sequence: Synthetic oligonucleotide
  Target: ATXN1; (+) strand; PAM type: NRG; PAM sequence: CGG
tcatttaatgaaatgtaatg

SEQ ID NO: 142919 - DNA, 20 bp, Artificial Sequence
  Description of Artificial Sequence: Synthetic oligonucleotide
  Target: ATXN1; (+) strand; PAM type: NRG; PAM sequence: TAG
aatgaaatgtaatgcggttt

SEQ ID NO: 142920 - DNA, 20 bp, Artificial Sequence
  Description of Artificial Sequence: Synthetic oligonucleotide
  Target: ATXN1; (+) strand; PAM type: NRG; PAM sequence: CAG
ttttagtttgaaaaatttac

SEQ ID NO: 142921 - DNA, 20 bp, Artificial Sequence
  Description of Artificial Sequence: Synthetic oligonucleotide
  Target: ATXN1; (+) strand; PAM type: NRG; PAM sequence: TAG
tagtttgaaaaatttaccag

SEQ ID NO: 142922 - DNA, 20 bp, Artificial Sequence
  Description of Artificial Sequence: Synthetic oligonucleotide
  Target: ATXN1; (+) strand; PAM type: NRG; PAM sequence: TAG
agtagcatgatacttcctca

SEQ ID NO: 142923 - DNA, 20 bp, Artificial Sequence
  Description of Artificial Sequence: Synthetic oligonucleotide
  Target: ATXN1; (+) strand; PAM type: NRG; PAM sequence: AAG
ttctgttttgtttttgccat

SEQ ID NO: 142924 - DNA, 20 bp, Artificial Sequence
  Description of Artificial Sequence: Synthetic oligonucleotide
  Target: ATXN1; (+) strand; PAM type: NRG; PAM sequence: TGG
taagaaaataaattcatttc

SEQ ID NO: 142925 - DNA, 20 bp, Artificial Sequence
  Description of Artificial Sequence: Synthetic oligonucleotide
  Target: ATXN1; (+) strand; PAM type: NRG; PAM sequence: CAG
tattattttcaactatcttg

SEQ ID NO: 142926 - DNA, 20 bp, Artificial Sequence
  Description of Artificial Sequence: Synthetic oligonucleotide
  Target: ATXN1; (+) strand; PAM type: NRG; PAM sequence: TGG
atcttgcagcaaaatcgatc

SEQ ID NO: 142927 - DNA, 20 bp, Artificial Sequence
  Description of Artificial Sequence: Synthetic oligonucleotide
  Target: ATXN1; (+) strand; PAM type: NRG; PAM sequence: GGG
tcttgcagcaaaatcgatct

SEQ ID NO: 142928 - DNA, 20 bp, Artificial Sequence
  Description of Artificial Sequence: Synthetic oligonucleotide
  Target: ATXN1; (+) strand; PAM type: NRG; PAM sequence: GAG
ttgcagcaaaatcgatctgg

SEQ ID NO: 142929 - DNA, 20 bp, Artificial Sequence
  Description of Artificial Sequence: Synthetic oligonucleotide
  Target: ATXN1; (+) strand; PAM type: NRG; PAM sequence: GAG
gcagcaaaatcgatctggga

SEQ ID NO: 142930 - DNA, 20 bp, Artificial Sequence
  Description of Artificial Sequence: Synthetic oligonucleotide
  Target: ATXN1; (+) strand; PAM type: NRG; PAM sequence: AGG
cagcaaaatcgatctgggag

SEQ ID NO: 142931 - DNA, 20 bp, Artificial Sequence
  Description of Artificial Sequence: Synthetic oligonucleotide
  Target: ATXN1; (+) strand; PAM type: NRG; PAM sequence: CAG
caaaatcgatctgggagagg

SEQ ID NO: 142932 - DNA, 20 bp, Artificial Sequence
  Description of Artificial Sequence: Synthetic oligonucleotide
  Target: ATXN1; (+) strand; PAM type: NRG; PAM sequence: TGG
tcgatctgggagaggcagaa

SEQ ID NO: 142933 - DNA, 20 bp, Artificial Sequence
  Description of Artificial Sequence: Synthetic oligonucleotide
  Target: ATXN1; (+) strand; PAM type: NRG; PAM sequence: CAG
gttactttaacaaccttcac

SEQ ID NO: 142934 - DNA, 20 bp, Artificial Sequence
  Description of Artificial Sequence: Synthetic oligonucleotide
  Target: ATXN1; (+) strand; PAM type: NRG; PAM sequence: AAG
acaaccttcaccagctgcca

SEQ ID NO: 142935 - DNA, 20 bp, Artificial Sequence
  Description of Artificial Sequence: Synthetic oligonucleotide
  Target: ATXN1; (+) strand; PAM type: NRG; PAM sequence: TAG
ccttcaccagctgccaaagc

SEQ ID NO: 142936 - DNA, 20 bp, Artificial Sequence
  Description of Artificial Sequence: Synthetic oligonucleotide
  Target: ATXN1; (+) strand; PAM type: NRG; PAM sequence: AGG
cttcaccagctgccaaagct

SEQ ID NO: 142937 - DNA, 20 bp, Artificial Sequence
  Description of Artificial Sequence: Synthetic oligonucleotide
  Target: ATXN1; (+) strand; PAM type: NRG; PAM sequence: CAG
agctgccaaagctaggtgtc

SEQ ID NO: 142938 - DNA, 20 bp, Artificial Sequence
  Description of Artificial Sequence: Synthetic oligonucleotide
  Target: ATXN1; (+) strand; PAM type: NRG; PAM sequence: AAG
ccaaagctaggtgtccagaa

SEQ ID NO: 142939 - DNA, 20 bp, Artificial Sequence
  Description of Artificial Sequence: Synthetic oligonucleotide
  Target: ATXN1; (+) strand; PAM type: NRG; PAM sequence: AAG
agctaggtgtccagaaaagt

SEQ ID NO: 142940 - DNA, 20 bp, Artificial Sequence
  Description of Artificial Sequence: Synthetic oligonucleotide
  Target: ATXN1; (+) strand; PAM type: NRG; PAM sequence: AGG
gctaggtgtccagaaaagta

SEQ ID NO: 142941 - DNA, 20 bp, Artificial Sequence
  Description of Artificial Sequence: Synthetic oligonucleotide
  Target: ATXN1; (+) strand; PAM type: NRG; PAM sequence: CAG
taaggtttatactattcata

SEQ ID NO: 142942 - DNA, 20 bp, Artificial Sequence
  Description of Artificial Sequence: Synthetic oligonucleotide
  Target: ATXN1; (+) strand; PAM type: NRG; PAM sequence: AAG
ttcatacagaaaaaaaaaat

SEQ ID NO: 142943 - DNA, 20 bp, Artificial Sequence
  Description of Artificial Sequence: Synthetic oligonucleotide
  Target: ATXN1; (+) strand; PAM type: NRG; PAM sequence: AGG
tcatacagaaaaaaaaaata

SEQ ID NO: 142944 - DNA, 20 bp, Artificial Sequence
  Description of Artificial Sequence: Synthetic oligonucleotide
  Target: ATXN1; (+) strand; PAM type: NRG; PAM sequence: AAG
aaaaaaataaggactcatct

SEQ ID NO: 142945 - DNA, 20 bp, Artificial Sequence
  Description of Artificial Sequence: Synthetic oligonucleotide
  Target: ATXN1; (+) strand; PAM type: NRG; PAM sequence: TAG
tccattcttacttatatctg

SEQ ID NO: 142946 - DNA, 20 bp, Artificial Sequence
  Description of Artificial Sequence: Synthetic oligonucleotide
  Target: ATXN1; (+) strand; PAM type: NRG; PAM sequence: AAG
tacttatatctgtagatgtg

SEQ ID NO: 142947 - DNA, 20 bp, Artificial Sequence
  Description of Artificial Sequence: Synthetic oligonucleotide
  Target: ATXN1; (+) strand; PAM type: NRG; PAM sequence: AGG
acttatatctgtagatgtga

SEQ ID NO: 142948 - DNA, 20 bp, Artificial Sequence
  Description of Artificial Sequence: Synthetic oligonucleotide
  Target: ATXN1; (+) strand; PAM type: NRG; PAM sequence: GAG
ttatatctgtagatgtgaag

SEQ ID NO: 142949 - DNA, 20 bp, Artificial Sequence
  Description of Artificial Sequence: Synthetic oligonucleotide
  Target: ATXN1; (+) strand; PAM type: NRG; PAM sequence: TGG
atctgtagatgtgaaggagt

SEQ ID NO: 142950 - DNA, 20 bp, Artificial Sequence
  Description of Artificial Sequence: Synthetic oligonucleotide
  Target: ATXN1; (+) strand; PAM type: NRG; PAM sequence: AAG
tgtagatgtgaaggagttgg

SEQ ID NO: 142951 - DNA, 20 bp, Artificial Sequence
  Description of Artificial Sequence: Synthetic oligonucleotide
  Target: ATXN1; (+) strand; PAM type: NRG; PAM sequence: CAG
ttcatttgcacatactacaa

SEQ ID NO: 142952 - DNA, 20 bp, Artificial Sequence
  Description of Artificial Sequence: Synthetic oligonucleotide
  Target: ATXN1; (+) strand; PAM type: NRG; PAM sequence: GAG
gcacatactacaacagctat

SEQ ID NO: 142953 - DNA, 20 bp, Artificial Sequence
  Description of Artificial Sequence: Synthetic oligonucleotide
  Target: ATXN1; (+) strand; PAM type: NRG; PAM sequence: AGG
cacatactacaacagctatg

SEQ ID NO: 142954 - DNA, 20 bp, Artificial Sequence
  Description of Artificial Sequence: Synthetic oligonucleotide
  Target: ATXN1; (+) strand; PAM type: NRG; PAM sequence: AAG
tatgaggcaactcttatcaa

SEQ ID NO: 142955 - DNA, 20 bp, Artificial Sequence
  Description of Artificial Sequence: Synthetic oligonucleotide
  Target: ATXN1; (+) strand; PAM type: NRG; PAM sequence: AAG
aattctacacacttcttttt

SEQ ID NO: 142956 - DNA, 20 bp, Artificial Sequence
  Description of Artificial Sequence: Synthetic oligonucleotide
  Target: ATXN1; (+) strand; PAM type: NRG; PAM sequence: CAG
ttcaatatgcttccctcttt

SEQ ID NO: 142957 - DNA, 20 bp, Artificial Sequence
  Description of Artificial Sequence: Synthetic oligonucleotide
  Target: ATXN1; (+) strand; PAM type: NRG; PAM sequence: TGG
taataatcaacaaaacaaac

SEQ ID NO: 142958 - DNA, 20 bp, Artificial Sequence
  Description of Artificial Sequence: Synthetic oligonucleotide
  Target: ATXN1; (+) strand; PAM type: NRG; PAM sequence: TGG
atcaacaaaacaaactggct

SEQ ID NO: 142959 - DNA, 20 bp, Artificial Sequence
  Description of Artificial Sequence: Synthetic oligonucleotide
  Target: ATXN1; (+) strand; PAM type: NRG; PAM sequence: GGG
tcaacaaaacaaactggctt

SEQ ID NO: 142960 - DNA, 20 bp, Artificial Sequence
  Description of Artificial Sequence: Synthetic oligonucleotide
  Target: ATXN1; (+) strand; PAM type: NRG; PAM sequence: AAG
cccttcttgtttaccatttg

SEQ ID NO: 142961 - DNA, 20 bp, Artificial Sequence
  Description of Artificial Sequence: Synthetic oligonucleotide
  Target: ATXN1; (+) strand; PAM type: NRG; PAM sequence: AAG
ttaccatttgaagttatcat

SEQ ID NO: 142962 - DNA, 20 bp, Artificial Sequence
  Description of Artificial Sequence: Synthetic oligonucleotide
  Target: ATXN1; (+) strand; PAM type: NRG; PAM sequence: AAG
atttgaagttatcataagca

SEQ ID NO: 142963 - DNA, 20 bp, Artificial Sequence
  Description of Artificial Sequence: Synthetic oligonucleotide
  Target: ATXN1; (+) strand; PAM type: NRG; PAM sequence: AAG
aagttatcataagcaaagat

SEQ ID NO: 142964 - DNA, 20 bp, Artificial Sequence
  Description of Artificial Sequence: Synthetic oligonucleotide
  Target: ATXN1; (+) strand; PAM type: NRG; PAM sequence: AGG
agttatcataagcaaagata

SEQ ID NO: 142965 - DNA, 20 bp, Artificial Sequence
  Description of Artificial Sequence: Synthetic oligonucleotide
  Target: ATXN1; (+) strand; PAM type: NRG; PAM sequence: AAG
ataagcaaagataaggccaa

SEQ ID NO: 142966 - DNA, 20 bp, Artificial Sequence
  Description of Artificial Sequence: Synthetic oligonucleotide
  Target: ATXN1; (+) strand; PAM type: NRG; PAM sequence: AAG
gataaggccaaaagcccaaa

SEQ ID NO: 142967 - DNA, 20 bp, Artificial Sequence
  Description of Artificial Sequence: Synthetic oligonucleotide
  Target: ATXN1; (+) strand; PAM type: NRG; PAM sequence: CAG
aaggccaaaagcccaaaaag

SEQ ID NO: 142968 - DNA, 20 bp, Artificial Sequence
  Description of Artificial Sequence: Synthetic oligonucleotide
  Target: ATXN1; (+) strand; PAM type: NRG; PAM sequence: AAG
gccaaaagcccaaaaagcag

SEQ ID NO: 142969 - DNA, 20 bp, Artificial Sequence
  Description of Artificial Sequence: Synthetic oligonucleotide
  Target: ATXN1; (+) strand; PAM type: NRG; PAM sequence: GAG
caaaagcccaaaaagcagaa

SEQ ID NO: 142970 - DNA, 20 bp, Artificial Sequence
  Description of Artificial Sequence: Synthetic oligonucleotide
  Target: ATXN1; (+) strand; PAM type: NRG; PAM sequence: AAG
agcccaaaaagcagaagaga

SEQ ID NO: 142971 - DNA, 20 bp, Artificial Sequence
  Description of Artificial Sequence: Synthetic oligonucleotide
  Target: ATXN1; (+) strand; PAM type: NRG; PAM sequence: CAG
aaaaagcagaagagaaagca

SEQ ID NO: 142972 - DNA, 20 bp, Artificial Sequence
  Description of Artificial Sequence: Synthetic oligonucleotide
  Target: ATXN1; (+) strand; PAM type: NRG; PAM sequence: AGG
aaaagcagaagagaaagcac

SEQ ID NO: 142973 - DNA, 20 bp, Artificial Sequence
  Description of Artificial Sequence: Synthetic oligonucleotide
  Target: ATXN1; (+) strand; PAM type: NRG; PAM sequence: GGG
aaagcagaagagaaagcaca

SEQ ID NO: 142974 - DNA, 20 bp, Artificial Sequence
  Description of Artificial Sequence: Synthetic oligonucleotide
  Target: ATXN1; (+) strand; PAM type: NRG; PAM sequence: GGG
aagcagaagagaaagcacag

SEQ ID NO: 142975 - DNA, 20 bp, Artificial Sequence
  Description of Artificial Sequence: Synthetic oligonucleotide
  Target: ATXN1; (+) strand; PAM type: NRG; PAM sequence: TAG
gaagagaaagcacaggggcc

SEQ ID NO: 142976 - DNA, 20 bp, Artificial Sequence
  Description of Artificial Sequence: Synthetic oligonucleotide
  Target: ATXN1; (+) strand; PAM type: NRG; PAM sequence: AGG
aagagaaagcacaggggcct

SEQ ID NO: 142977 - DNA, 20 bp, Artificial Sequence
  Description of Artificial Sequence: Synthetic oligonucleotide
  Target: ATXN1; (+) strand; PAM type: NRG; PAM sequence: GGG
agagaaagcacaggggccta

SEQ ID NO: 142978 - DNA, 20 bp, Artificial Sequence
  Description of Artificial Sequence: Synthetic oligonucleotide
  Target: ATXN1; (+) strand; PAM type: NRG; PAM sequence: CAG
acaggggcctagggcattca

SEQ ID NO: 142979 - DNA, 20 bp, Artificial Sequence
  Description of Artificial Sequence: Synthetic oligonucleotide
  Target: ATXN1; (+) strand; PAM type: NRG; PAM sequence: AAG
agatatgcctgcatatgtga

SEQ ID NO: 142980 - DNA, 20 bp, Artificial Sequence
  Description of Artificial Sequence: Synthetic oligonucleotide
  Target: ATXN1; (+) strand; PAM type: NRG; PAM sequence: TGG
atgcctgcatatgtgaaagt

SEQ ID NO: 142981 - DNA, 20 bp, Artificial Sequence
  Description of Artificial Sequence: Synthetic oligonucleotide
  Target: ATXN1; (+) strand; PAM type: NRG; PAM sequence: AAG
aaagttggctatattttaaa

SEQ ID NO: 142982 - DNA, 20 bp, Artificial Sequence
  Description of Artificial Sequence: Synthetic oligonucleotide
  Target: ATXN1; (+) strand; PAM type: NRG; PAM sequence: AGG
aagttggctatattttaaaa

SEQ ID NO: 142983 - DNA, 20 bp, Artificial Sequence
  Description of Artificial Sequence: Synthetic oligonucleotide
  Target: ATXN1; (+) strand; PAM type: NRG; PAM sequence: CAG
ttttaaaaaggatctcactc

SEQ ID NO: 142984 - DNA, 20 bp, Artificial Sequence
  Description of Artificial Sequence: Synthetic oligonucleotide
  Target: ATXN1; (+) strand; PAM type: NRG; PAM sequence: GAG
ttaaaaaggatctcactcca

SEQ ID NO: 142985 - DNA, 20 bp, Artificial Sequence
  Description of Artificial Sequence: Synthetic oligonucleotide
  Target: ATXN1; (+) strand; PAM type: NRG; PAM sequence: AGG
taaaaaggatctcactccag

SEQ ID NO: 142986 - DNA, 20 bp, Artificial Sequence
  Description of Artificial Sequence: Synthetic oligonucleotide
  Target: ATXN1; (+) strand; PAM type: NRG; PAM sequence: GGG
aaaaaggatctcactccaga

SEQ ID NO: 142987 - DNA, 20 bp, Artificial Sequence
  Description of Artificial Sequence: Synthetic oligonucleotide
  Target: ATXN1; (+) strand; PAM type: NRG; PAM sequence: TAG
cagagggttttccaatttga

SEQ ID NO: 142988 - DNA, 20 bp, Artificial Sequence
  Description of Artificial Sequence: Synthetic oligonucleotide
  Target: ATXN1; (+) strand; PAM type: NRG; PAM sequence: TGG
ttccaatttgatagacattt

SEQ ID NO: 142989 - DNA, 20 bp, Artificial Sequence
  Description of Artificial Sequence: Synthetic oligonucleotide
  Target: ATXN1; (+) strand; PAM type: NRG; PAM sequence: CAG
tttggtgaaaattttctgaa

SEQ ID NO: 142990 - DNA, 20 bp, Artificial Sequence
  Description of Artificial Sequence: Synthetic oligonucleotide
  Target: ATXN1; (+) strand; PAM type: NRG; PAM sequence: AAG
aaaattttctgaacagttat

SEQ ID NO: 142991 - DNA, 20 bp, Artificial Sequence
  Description of Artificial Sequence: Synthetic oligonucleotide
  Target: ATXN1; (+) strand; PAM type: NRG; PAM sequence: CAG
ttctgaacagttataagcaa

SEQ ID NO: 142992 - DNA, 20 bp, Artificial Sequence
  Description of Artificial Sequence: Synthetic oligonucleotide
  Target: ATXN1; (+) strand; PAM type: NRG; PAM sequence: CAG
tgaacagttataagcaacag

SEQ ID NO: 142993 - DNA, 20 bp, Artificial Sequence
  Description of Artificial Sequence: Synthetic oligonucleotide
  Target: ATXN1; (+) strand; PAM type: NRG; PAM sequence: CAG
acagttataagcaacagcag

SEQ ID NO: 142994 - DNA, 20 bp, Artificial Sequence
  Description of Artificial Sequence: Synthetic oligonucleotide
  Target: ATXN1; (+) strand; PAM type: NRG; PAM sequence: CAG
gttataagcaacagcagcag

SEQ ID NO: 142995 - DNA, 20 bp, Artificial Sequence
  Description of Artificial Sequence: Synthetic oligonucleotide
  Target: ATXN1; (+) strand; PAM type: NRG; PAM sequence: AAG
aagcaacagcagcagcagca

SEQ ID NO: 142996 - DNA, 20 bp, Artificial Sequence
  Description of Artificial Sequence: Synthetic oligonucleotide
  Target: ATXN1; (+) strand; PAM type: NRG; PAM sequence: TGG
acagcagcagcagcaaagta

SEQ ID NO: 142997 - DNA, 20 bp, Artificial Sequence
  Description of Artificial Sequence: Synthetic oligonucleotide
  Target: ATXN1; (+) strand; PAM type: NRG; PAM sequence: GGG
cagcagcagcagcaaagtat

SEQ ID NO: 142998 - DNA, 20 bp, Artificial Sequence
  Description of Artificial Sequence: Synthetic oligonucleotide
  Target: ATXN1; (+) strand; PAM type: NRG; PAM sequence: CAG
ggatatcaacaacctataaa

SEQ ID NO: 142999 - DNA, 20 bp, Artificial Sequence
  Description of Artificial Sequence: Synthetic oligonucleotide
  Target: ATXN1; (+) strand; PAM type: NRG; PAM sequence: TGG
acaacctataaacagtgacc

SEQ ID NO: 143000 - DNA, 20 bp, Artificial Sequence
  Description of Artificial Sequence: Synthetic oligonucleotide
  Target: ATXN1; (+) strand; PAM type: NRG; PAM sequence: GGG
caacctataaacagtgacct

SEQ ID NO: 143001 - DNA, 20 bp, Artificial Sequence
  Description of Artificial Sequence: Synthetic oligonucleotide
  Target: ATXN1; (+) strand; PAM type: NRG; PAM sequence: GAG
acctataaacagtgacctgg

SEQ ID NO: 143002 - DNA, 20 bp, Artificial Sequence
  Description of Artificial Sequence: Synthetic oligonucleotide
  Target: ATXN1; (+) strand; PAM type: NRG; PAM sequence: TAG
gagtcatgaaatatactttt

SEQ ID NO: 143003 - DNA, 20 bp, Artificial Sequence
  Description of Artificial Sequence: Synthetic oligonucleotide
  Target: ATXN1; (+) strand; PAM type: NRG; PAM sequence: TAG
actttttagtcttaatgttg

SEQ ID NO: 143004 - DNA, 20 bp, Artificial Sequence
  Description of Artificial Sequence: Synthetic oligonucleotide
  Target: ATXN1; (+) strand; PAM type: NRG; PAM sequence: TGG
gtcttaatgttgtagctaat

SEQ ID NO: 143005 - DNA, 20 bp, Artificial Sequence
  Description of Artificial Sequence: Synthetic oligonucleotide
  Target: ATXN1; (+) strand; PAM type: NRG; PAM sequence: AAG
ctaattggacttttaaatgt

SEQ ID NO: 143006 - DNA, 20 bp, Artificial Sequence
  Description of Artificial Sequence: Synthetic oligonucleotide
  Target: ATXN1; (+) strand; PAM type: NRG; PAM sequence: CGG
ggacttttaaatgtaagtca

SEQ ID NO: 143007 - DNA, 20 bp, Artificial Sequence
  Description of Artificial Sequence: Synthetic oligonucleotide
  Target: ATXN1; (+) strand; PAM type: NRG; PAM sequence: TAG
cacggccttttaaataaaat

SEQ ID NO: 143008 - DNA, 20 bp, Artificial Sequence
  Description of Artificial Sequence: Synthetic oligonucleotide
  Target: ATXN1; (+) strand; PAM type: NRG; PAM sequence: AAG
agttcctaatctatcaaata

SEQ ID NO: 143009 - DNA, 20 bp, Artificial Sequence
  Description of Artificial Sequence: Synthetic oligonucleotide
  Target: ATXN1; (+) strand; PAM type: NRG; PAM sequence: AGG
gttcctaatctatcaaataa

SEQ ID NO: 143010 - DNA, 20 bp, Artificial Sequence
  Description of Artificial Sequence: Synthetic oligonucleotide
  Target: ATXN1; (+) strand; PAM type: NRG; PAM sequence: TAG
aactatcttatatgatttac

SEQ ID NO: 143011 - DNA, 20 bp, Artificial Sequence
  Description of Artificial Sequence: Synthetic oligonucleotide
  Target: ATXN1; (+) strand; PAM type: NRG; PAM sequence: AAG
tatgatttactagacccact

SEQ ID NO: 143012 - DNA, 20 bp, Artificial Sequence
  Description of Artificial Sequence: Synthetic oligonucleotide
  Target: ATXN1; (+) strand; PAM type: NRG; PAM sequence: TAG
ttattcaaaaatgcaacaat

SEQ ID NO: 143013 - DNA, 20 bp, Artificial Sequence
  Description of Artificial Sequence: Synthetic oligonucleotide
  Target: ATXN1; (+) strand; PAM type: NRG; PAM sequence: CAG
aaaaatgcaacaattagaca

SEQ ID NO: 143014 - DNA, 20 bp, Artificial Sequence
  Description of Artificial Sequence: Synthetic oligonucleotide
  Target: ATXN1; (+) strand; PAM type: NRG; PAM sequence: AAG
ttagacacagattgcataat

SEQ ID NO: 143015 - DNA, 20 bp, Artificial Sequence
  Description of Artificial Sequence: Synthetic oligonucleotide
  Target: ATXN1; (+) strand; PAM type: NRG; PAM sequence: GAG
agacacagattgcataataa

SEQ ID NO: 143016 - DNA, 20 bp, Artificial Sequence
  Description of Artificial Sequence: Synthetic oligonucleotide
  Target: ATXN1; (+) strand; PAM type: NRG; PAM sequence: CAG
attgcataataagagacaaa

SEQ ID NO: 143017 - DNA, 20 bp, Artificial Sequence
  Description of Artificial Sequence: Synthetic oligonucleotide
  Target: ATXN1; (+) strand; PAM type: NRG; PAM sequence: AGG
ttgcataataagagacaaac

SEQ ID NO: 143018 - DNA, 20 bp, Artificial Sequence
  Description of Artificial Sequence: Synthetic oligonucleotide
  Target: ATXN1; (+) strand; PAM type: NRG; PAM sequence: CAG
ataagagacaaacaggttct

SEQ ID NO: 143019 - DNA, 20 bp, Artificial Sequence
  Description of Artificial Sequence: Synthetic oligonucleotide
  Target: ATXN1; (+) strand; PAM type: NRG; PAM sequence: TAG
agagacaaacaggttctcag

SEQ ID NO: 143020 - DNA, 20 bp, Artificial Sequence
  Description of Artificial Sequence: Synthetic oligonucleotide
  Target: ATXN1; (+) strand; PAM type: NRG; PAM sequence: CAG
ttctcagtagaatatcaact

SEQ ID NO: 143021 - DNA, 20 bp, Artificial Sequence
  Description of Artificial Sequence: Synthetic oligonucleotide
  Target: ATXN1; (+) strand; PAM type: NRG; PAM sequence: AGG
tctcagtagaatatcaactc

SEQ ID NO: 143022 - DNA, 20 bp, Artificial Sequence
  Description of Artificial Sequence: Synthetic oligonucleotide
  Target: ATXN1; (+) strand; PAM type: NRG; PAM sequence: GGG
ctcagtagaatatcaactca

SEQ ID NO: 143023 - DNA, 20 bp, Artificial Sequence
  Description of Artificial Sequence: Synthetic oligonucleotide
  Target: ATXN1; (+) strand; PAM type: NRG; PAM sequence: AAG
gaatatcaactcagggaaaa

SEQ ID NO: 143024 - DNA, 20 bp, Artificial Sequence
  Description of Artificial Sequence: Synthetic oligonucleotide
  Target: ATXN1; (+) strand; PAM type: NRG; PAM sequence: GAG
atatcaactcagggaaaaaa

SEQ ID NO: 143025 - DNA, 20 bp, Artificial Sequence
  Description of Artificial Sequence: Synthetic oligonucleotide
  Target: ATXN1; (+) strand; PAM type: NRG; PAM sequence: AGG
tatcaactcagggaaaaaag

SEQ ID NO: 143026 - DNA, 20 bp, Artificial Sequence
  Description of Artificial Sequence: Synthetic oligonucleotide
  Target: ATXN1; (+) strand; PAM type: NRG; PAM sequence: TGG
aaaagaggtttattttgttt

SEQ ID NO: 143027 - DNA, 20 bp, Artificial Sequence
  Description of Artificial Sequence: Synthetic oligonucleotide
  Target: ATXN1; (+) strand; PAM type: NRG; PAM sequence: GAG
tttttttttttttttttttt

SEQ ID NO: 143028 - DNA, 20 bp, Artificial Sequence
  Description of Artificial Sequence: Synthetic oligonucleotide
  Target: ATXN1; (+) strand; PAM type: NRG; PAM sequence: CAG
ttttttttttttttttgaga

SEQ ID NO: 143029 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttttgagaca

SEQ ID NO: 143030 - DNA, 20 bp, Artificial Sequence
  Description of Artificial Sequence: Synthetic oligonucleotide
  Target: ATXN1; (+) strand; PAM type: NRG; PAM sequence: CAG
cagagttttgctctttcacc

SEQ ID NO: 143031 - DNA, 20 bp, Artificial Sequence
  Description of Artificial Sequence: Synthetic oligonucleotide
  Target: ATXN1; (+) strand; PAM type: NRG; PAM sequence: AGG
agagttttgctctttcaccc

SEQ ID NO: 143032 - DNA, 20 bp, Artificial Sequence
  Description of Artificial Sequence: Synthetic oligonucleotide
  Target: ATXN1; (+) strand; PAM type: NRG; PAM sequence: TGG
ttttgctctttcacccaggc

SEQ ID NO: 143033 - DNA, 20 bp, Artificial Sequence
  Description of Artificial Sequence: Synthetic oligonucleotide
  Target: ATXN1; (+) strand; PAM type: NRG; PAM sequence: GAG
ttgctctttcacccaggctg

SEQ ID NO: 143034 - DNA, 20 bp, Artificial Sequence
  Description of Artificial Sequence: Synthetic oligonucleotide
  Target: ATXN1; (+) strand; PAM type: NRG; PAM sequence: CAG
ctttcacccaggctggagtg

SEQ ID NO: 143035 - DNA, 20 bp, Artificial Sequence
  Description of Artificial Sequence: Synthetic oligonucleotide
  Target: ATXN1; (+) strand; PAM type: NRG; PAM sequence: TGG
tcacccaggctggagtgcag

SEQ ID NO: 143036 - DNA, 20 bp, Artificial Sequence
  Description of Artificial Sequence: Synthetic oligonucleotide
  Target: ATXN1; (+) strand; PAM type: NRG; PAM sequence: GAG
acccaggctggagtgcagtg

SEQ ID NO: 143037 - DNA, 20 bp, Artificial Sequence
  Description of Artificial Sequence: Synthetic oligonucleotide
  Target: ATXN1; (+) strand; PAM type: NRG; PAM sequence: CAG
ggagtgcagtggagtgatct

SEQ ID NO: 143038 - DNA, 20 bp, Artificial Sequence
  Description of Artificial Sequence: Synthetic oligonucleotide
  Target: ATXN1; (+) strand; PAM type: NRG; PAM sequence: TGG
tcactgcaacctctgccttc

SEQ ID NO: 143039 - DNA, 20 bp, Artificial Sequence
  Description of Artificial Sequence: Synthetic oligonucleotide
  Target: ATXN1; (+) strand; PAM type: NRG; PAM sequence: AAG
aacctctgccttctggtttc

SEQ ID NO: 143040 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaattctcctgcct

SEQ ID NO: 143041 - DNA, 20 bp, Artificial Sequence
  Description of Artificial Sequence: Synthetic oligonucleotide
  Target: ATXN1; (+) strand; PAM type: NRG; PAM sequence: AGG
tcaagcaattctcctgcctc

SEQ ID NO: 143042 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcctcaggctccc

SEQ ID NO: 143043 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcaggctcccaag

SEQ ID NO: 143044 - DNA, 20 bp, Artificial Sequence
  Description of Artificial Sequence: Synthetic oligonucleotide
  Target: ATXN1; (+) strand; PAM type: NRG; PAM sequence: TAG
gcctcaggctcccaagtagc

SEQ ID NO: 143045 - DNA, 20 bp, Artificial Sequence
  Description of Artificial Sequence: Synthetic oligonucleotide
  Target: ATXN1; (+) strand; PAM type: NRG; PAM sequence: AGG
cctcaggctcccaagtagct

SEQ ID NO: 143046 - DNA, 20 bp, Artificial Sequence
  Description of Artificial Sequence: Synthetic oligonucleotide
  Target: ATXN1; (+) strand; PAM type: NRG; PAM sequence: TAG
ctcccaagtagctaggatca

SEQ ID NO: 143047 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctaggatcat

SEQ ID NO: 143048 - DNA, 20 bp, Artificial Sequence
  Description of Artificial Sequence: Synthetic oligonucleotide
  Target: ATXN1; (+) strand; PAM type: NRG; PAM sequence: CAG
taggtgcccaccaccacacc

SEQ ID NO: 143049 - DNA, 20 bp, Artificial Sequence
  Description of Artificial Sequence: Synthetic oligonucleotide
  Target: ATXN1; (+) strand; PAM type: NRG; PAM sequence: TAG
ccagctaatttttgtatttt

SEQ ID NO: 143050 - DNA, 20 bp, Artificial Sequence
  Description of Artificial Sequence: Synthetic oligonucleotide
  Target: ATXN1; (+) strand; PAM type: NRG; PAM sequence: TGG
gctaatttttgtatttttag

SEQ ID NO: 143051 - DNA, 20 bp, Artificial Sequence
  Description of Artificial Sequence: Synthetic oligonucleotide
  Target: ATXN1; (+) strand; PAM type: NRG; PAM sequence: GAG
taatttttgtatttttagtg

SEQ ID NO: 143052 - DNA, 20 bp, Artificial Sequence
  Description of Artificial Sequence: Synthetic oligonucleotide
  Target: ATXN1; (+) strand; PAM type: NRG; PAM sequence: CGG
ttttgtatttttagtggaga

SEQ ID NO: 143053 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtggagac

SEQ ID NO: 143054 - DNA, 20 bp, Artificial Sequence
  Description of Artificial Sequence: Synthetic oligonucleotide
  Target: ATXN1; (+) strand; PAM type: NRG; PAM sequence: TGG
gagacgggatttcaccatgt

SEQ ID NO: 143055 - DNA, 20 bp, Artificial Sequence
  Description of Artificial Sequence: Synthetic oligonucleotide
  Target: ATXN1; (+) strand; PAM type: NRG; PAM sequence: CAG
cgggatttcaccatgttggc

SEQ ID NO: 143056 - DNA, 20 bp, Artificial Sequence
  Description of Artificial Sequence: Synthetic oligonucleotide
  Target: ATXN1; (+) strand; PAM type: NRG; PAM sequence: AGG
gggatttcaccatgttggcc

SEQ ID NO: 143057 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttggccaggc

SEQ ID NO: 143058 - DNA, 20 bp, Artificial Sequence
  Description of Artificial Sequence: Synthetic oligonucleotide
  Target: ATXN1; (+) strand; PAM type: NRG; PAM sequence: AAG
tcacccgctttgacctccca

SEQ ID NO: 143059 - DNA, 20 bp, Artificial Sequence
  Description of Artificial Sequence: Synthetic oligonucleotide
  Target: ATXN1; (+) strand; PAM type: NRG; PAM sequence: TGG
gctttgacctcccaaagtgc

SEQ ID NO: 143060 - DNA, 20 bp, Artificial Sequence
  Description of Artificial Sequence: Synthetic oligonucleotide
  Target: ATXN1; (+) strand; PAM type: NRG; PAM sequence: GGG
ctttgacctcccaaagtgct

SEQ ID NO: 143061 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 143062 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacagatgt

SEQ ID NO: 143063 - DNA, 20 bp, Artificial Sequence
  Description of Artificial Sequence: Synthetic oligonucleotide
  Target: ATXN1; (+) strand; PAM type: NRG; PAM sequence: TGG
cagatgtgagccaccgcacc

SEQ ID NO: 143064 - DNA, 20 bp, Artificial Sequence
  Description of Artificial Sequence: Synthetic oligonucleotide
  Target: ATXN1; (+) strand; PAM type: NRG; PAM sequence: CAG
gtgagccaccgcacctggcc

SEQ ID NO: 143065 - DNA, 20 bp, Artificial Sequence
  Description of Artificial Sequence: Synthetic oligonucleotide
  Target: ATXN1; (+) strand; PAM type: NRG; PAM sequence: AGG
tgagccaccgcacctggccc

SEQ ID NO: 143066 - DNA, 20 bp, Artificial Sequence
  Description of Artificial Sequence: Synthetic oligonucleotide
  Target: ATXN1; (+) strand; PAM type: NRG; PAM sequence: AAG
caccgcacctggcccaggaa

SEQ ID NO: 143067 - DNA, 20 bp, Artificial Sequence
  Description of Artificial Sequence: Synthetic oligonucleotide
  Target: ATXN1; (+) strand; PAM type: NRG; PAM sequence: AGG
accgcacctggcccaggaaa

SEQ ID NO: 143068 - DNA, 20 bp, Artificial Sequence
  Description of Artificial Sequence: Synthetic oligonucleotide
  Target: ATXN1; (+) strand; PAM type: NRG; PAM sequence: GGG
ccgcacctggcccaggaaaa

SEQ ID NO: 143069 - DNA, 20 bp, Artificial Sequence
  Description of Artificial Sequence: Synthetic oligonucleotide
  Target: ATXN1; (+) strand; PAM type: NRG; PAM sequence: TAG
agggtattgtaatcaataaa

SEQ ID NO: 143070 - DNA, 20 bp, Artificial Sequence
  Description of Artificial Sequence: Synthetic oligonucleotide
  Target: ATXN1; (+) strand; PAM type: NRG; PAM sequence: TGG
ttgtaatcaataaatagtgc

SEQ ID NO: 143071 - DNA, 20 bp, Artificial Sequence
  Description of Artificial Sequence: Synthetic oligonucleotide
  Target: ATXN1; (+) strand; PAM type: NRG; PAM sequence: GGG
tgtaatcaataaatagtgct

SEQ ID NO: 143072 - DNA, 20 bp, Artificial Sequence
  Description of Artificial Sequence: Synthetic oligonucleotide
  Target: ATXN1; (+) strand; PAM type: NRG; PAM sequence: TGG
ataaatagtgctgggaaacc

SEQ ID NO: 143073 - DNA, 20 bp, Artificial Sequence
  Description of Artificial Sequence: Synthetic oligonucleotide
  Target: ATXN1; (+) strand; PAM type: NRG; PAM sequence: AAG
aacctggctcttcgtttcga

SEQ ID NO: 143074 - DNA, 20 bp, Artificial Sequence
  Description of Artificial Sequence: Synthetic oligonucleotide
  Target: ATXN1; (+) strand; PAM type: NRG; PAM sequence: GAG
cctggctcttcgtttcgaaa

SEQ ID NO: 143075 - DNA, 20 bp, Artificial Sequence
  Description of Artificial Sequence: Synthetic oligonucleotide
  Target: ATXN1; (+) strand; PAM type: NRG; PAM sequence: TGG
gattgctatcttacaccata

SEQ ID NO: 143076 - DNA, 20 bp, Artificial Sequence
  Description of Artificial Sequence: Synthetic oligonucleotide
  Target: ATXN1; (+) strand; PAM type: NRG; PAM sequence: TAG
accatatggaaaataaattc

SEQ ID NO: 143077 - DNA, 20 bp, Artificial Sequence
  Description of Artificial Sequence: Synthetic oligonucleotide
  Target: ATXN1; (+) strand; PAM type: NRG; PAM sequence: TAG
tttatacaaatatacatata

SEQ ID NO: 143078 - DNA, 20 bp, Artificial Sequence
  Description of Artificial Sequence: Synthetic oligonucleotide
  Target: ATXN1; (+) strand; PAM type: NRG; PAM sequence: TAG
atatattattttacaaaata

SEQ ID NO: 143079 - DNA, 20 bp, Artificial Sequence
  Description of Artificial Sequence: Synthetic oligonucleotide
  Target: ATXN1; (+) strand; PAM type: NRG; PAM sequence: AAG
atatagaaaaataattttat

SEQ ID NO: 143080 - DNA, 20 bp, Artificial Sequence
  Description of Artificial Sequence: Synthetic oligonucleotide
  Target: ATXN1; (+) strand; PAM type: NRG; PAM sequence: AAG
aaataattttataagcatga

SEQ ID NO: 143081 - DNA, 20 bp, Artificial Sequence
  Description of Artificial Sequence: Synthetic oligonucleotide
  Target: ATXN1; (+) strand; PAM type: NRG; PAM sequence: AGG
aataattttataagcatgaa

SEQ ID NO: 143082 - DNA, 20 bp, Artificial Sequence
  Description of Artificial Sequence: Synthetic oligonucleotide
  Target: ATXN1; (+) strand; PAM type: NRG; PAM sequence: TAG
tataagcatgaaaggccttg

SEQ ID NO: 143083 - DNA, 20 bp, Artificial Sequence
  Description of Artificial Sequence: Synthetic oligonucleotide
  Target: ATXN1; (+) strand; PAM type: NRG; PAM sequence: AGG
ataagcatgaaaggccttgt

SEQ ID NO: 143084 - DNA, 20 bp, Artificial Sequence
  Description of Artificial Sequence: Synthetic oligonucleotide
  Target: ATXN1; (+) strand; PAM type: NRG; PAM sequence: AAG
aggccttgtaggccattgta

SEQ ID NO: 143085 - DNA, 20 bp, Artificial Sequence
  Description of Artificial Sequence: Synthetic oligonucleotide
  Target: ATXN1; (+) strand; PAM type: NRG; PAM sequence: AAG
ttgtaaagataccgactttt

SEQ ID NO: 143086 - DNA, 20 bp, Artificial Sequence
  Description of Artificial Sequence: Synthetic oligonucleotide
  Target: ATXN1; (+) strand; PAM type: NRG; PAM sequence: TGG
ataccgacttttaagtaaaa

SEQ ID NO: 143087 - DNA, 20 bp, Artificial Sequence
  Description of Artificial Sequence: Synthetic oligonucleotide
  Target: ATXN1; (+) strand; PAM type: NRG; PAM sequence: GGG
taccgacttttaagtaaaat

SEQ ID NO: 143088 - DNA, 20 bp, Artificial Sequence
  Description of Artificial Sequence: Synthetic oligonucleotide
  Target: ATXN1; (+) strand; PAM type: NRG; PAM sequence: AAG
cgacttttaagtaaaatggg

SEQ ID NO: 143089 - DNA, 20 bp, Artificial Sequence
  Description of Artificial Sequence: Synthetic oligonucleotide
  Target: ATXN1; (+) strand; PAM type: NRG; PAM sequence: CAG
tttaagtaaaatgggaagac

SEQ ID NO: 143090 - DNA, 20 bp, Artificial Sequence
  Description of Artificial Sequence: Synthetic oligonucleotide
  Target: ATXN1; (+) strand; PAM type: NRG; PAM sequence: GAG
taagtaaaatgggaagacca

SEQ ID NO: 143091 - DNA, 20 bp, Artificial Sequence
  Description of Artificial Sequence: Synthetic oligonucleotide
  Target: ATXN1; (+) strand; PAM type: NRG; PAM sequence: CAG
accagagataatttttaatg

SEQ ID NO: 143092 - DNA, 20 bp, Artificial Sequence
  Description of Artificial Sequence: Synthetic oligonucleotide
  Target: ATXN1; (+) strand; PAM type: NRG; PAM sequence: TAG
agagataatttttaatgcag

SEQ ID NO: 143093 - DNA, 20 bp, Artificial Sequence
  Description of Artificial Sequence: Synthetic oligonucleotide
  Target: ATXN1; (+) strand; PAM type: NRG; PAM sequence: AAG
catgatctgccttacatttt

SEQ ID NO: 143094 - DNA, 20 bp, Artificial Sequence
  Description of Artificial Sequence: Synthetic oligonucleotide
  Target: ATXN1; (+) strand; PAM type: NRG; PAM sequence: AGG
atgatctgccttacatttta

SEQ ID NO: 143095 - DNA, 20 bp, Artificial Sequence
  Description of Artificial Sequence: Synthetic oligonucleotide
  Target: ATXN1; (+) strand; PAM type: NRG; PAM sequence: GGG
tgatctgccttacattttaa

SEQ ID NO: 143096 - DNA, 20 bp, Artificial Sequence
  Description of Artificial Sequence: Synthetic oligonucleotide
  Target: ATXN1; (+) strand; PAM type: NRG; PAM sequence: TGG
ttacattttaagggctcatt

SEQ ID NO: 143097 - DNA, 20 bp, Artificial Sequence
  Description of Artificial Sequence: Synthetic oligonucleotide
  Target: ATXN1; (+) strand; PAM type: NRG; PAM sequence: CAG
ggctcatttggtctgattgt

SEQ ID NO: 143098 - DNA, 20 bp, Artificial Sequence
  Description of Artificial Sequence: Synthetic oligonucleotide
  Target: ATXN1; (+) strand; PAM type: NRG; PAM sequence: AGG
gctcatttggtctgattgtc

SEQ ID NO: 143099 - DNA, 20 bp, Artificial Sequence
  Description of Artificial Sequence: Synthetic oligonucleotide
  Target: ATXN1; (+) strand; PAM type: NRG; PAM sequence: TAG
tttggtctgattgtcaggaa

SEQ ID NO: 143100 - DNA, 20 bp, Artificial Sequence
  Description of Artificial Sequence: Synthetic oligonucleotide
  Target: ATXN1; (+) strand; PAM type: NRG; PAM sequence: AAG
gattgtcaggaatagaccat

SEQ ID NO: 143101 - DNA, 20 bp, Artificial Sequence
  Description of Artificial Sequence: Synthetic oligonucleotide
  Target: ATXN1; (+) strand; PAM type: NRG; PAM sequence: AGG
attgtcaggaatagaccata

SEQ ID NO: 143102 - DNA, 20 bp, Artificial Sequence
  Description of Artificial Sequence: Synthetic oligonucleotide
  Target: ATXN1; (+) strand; PAM type: NRG; PAM sequence: GGG
ttgtcaggaatagaccataa

SEQ ID NO: 143103 - DNA, 20 bp, Artificial Sequence
  Description of Artificial Sequence: Synthetic oligonucleotide
  Target: ATXN1; (+) strand; PAM type: NRG; PAM sequence: GGG
tgtcaggaatagaccataag

SEQ ID NO: 143104 - DNA, 20 bp, Artificial Sequence
  Description of Artificial Sequence: Synthetic oligonucleotide
  Target: ATXN1; (+) strand; PAM type: NRG; PAM sequence: AAG
ccataaggggatataaatta

SEQ ID NO: 143105 - DNA, 20 bp, Artificial Sequence
  Description of Artificial Sequence: Synthetic oligonucleotide
  Target: ATXN1; (+) strand; PAM type: NRG; PAM sequence: AAG
ggggatataaattaaagcac

SEQ ID NO: 143106 - DNA, 20 bp, Artificial Sequence
  Description of Artificial Sequence: Synthetic oligonucleotide
  Target: ATXN1; (+) strand; PAM type: NRG; PAM sequence: AAG
aaagcacaagttactgttat

SEQ ID NO: 143107 - DNA, 20 bp, Artificial Sequence
  Description of Artificial Sequence: Synthetic oligonucleotide
  Target: ATXN1; (+) strand; PAM type: NRG; PAM sequence: CAG
gcacaagttactgttataag

SEQ ID NO: 143108 - DNA, 20 bp, Artificial Sequence
  Description of Artificial Sequence: Synthetic oligonucleotide
  Target: ATXN1; (+) strand; PAM type: NRG; PAM sequence: CAG
ttactgttataagcagcctg

SEQ ID NO: 143109 - DNA, 20 bp, Artificial Sequence
  Description of Artificial Sequence: Synthetic oligonucleotide
  Target: ATXN1; (+) strand; PAM type: NRG; PAM sequence: AGG
tactgttataagcagcctgc

SEQ ID NO: 143110 - DNA, 20 bp, Artificial Sequence
  Description of Artificial Sequence: Synthetic oligonucleotide
  Target: ATXN1; (+) strand; PAM type: NRG; PAM sequence: TGG
gttataagcagcctgcagga

SEQ ID NO: 143111 - DNA, 20 bp, Artificial Sequence
  Description of Artificial Sequence: Synthetic oligonucleotide
  Target: ATXN1; (+) strand; PAM type: NRG; PAM sequence: CAG
gcagcctgcaggatggcttc

SEQ ID NO: 143112 - DNA, 20 bp, Artificial Sequence
  Description of Artificial Sequence: Synthetic oligonucleotide
  Target: ATXN1; (+) strand; PAM type: NRG; PAM sequence: TGG
cttccagtgatcccacctct

SEQ ID NO: 143113 - DNA, 20 bp, Artificial Sequence
  Description of Artificial Sequence: Synthetic oligonucleotide
  Target: ATXN1; (+) strand; PAM type: NRG; PAM sequence: AAG
ttggaattcatgcccttgta

SEQ ID NO: 143114 - DNA, 20 bp, Artificial Sequence
  Description of Artificial Sequence: Synthetic oligonucleotide
  Target: ATXN1; (+) strand; PAM type: NRG; PAM sequence: GAG
tgcccttgtaaagccttctt

SEQ ID NO: 143115 - DNA, 20 bp, Artificial Sequence
  Description of Artificial Sequence: Synthetic oligonucleotide
  Target: ATXN1; (+) strand; PAM type: NRG; PAM sequence: TGG
ttgtaaagccttcttgagtg

SEQ ID NO: 143116 - DNA, 20 bp, Artificial Sequence
  Description of Artificial Sequence: Synthetic oligonucleotide
  Target: ATXN1; (+) strand; PAM type: NRG; PAM sequence: TGG
aagccttcttgagtgtggac

SEQ ID NO: 143117 - DNA, 20 bp, Artificial Sequence
  Description of Artificial Sequence: Synthetic oligonucleotide
  Target: ATXN1; (+) strand; PAM type: NRG; PAM sequence: TAG
tcttgagtgtggactggatt

SEQ ID NO: 143118 - DNA, 20 bp, Artificial Sequence
  Description of Artificial Sequence: Synthetic oligonucleotide
  Target: ATXN1; (+) strand; PAM type: NRG; PAM sequence: TAG
tggatttagtgactcaattc

SEQ ID NO: 143119 - DNA, 20 bp, Artificial Sequence
  Description of Artificial Sequence: Synthetic oligonucleotide
  Target: ATXN1; (+) strand; PAM type: NRG; PAM sequence: CAG
agtgactcaattctagcaaa

SEQ ID NO: 143120 - DNA, 20 bp, Artificial Sequence
  Description of Artificial Sequence: Synthetic oligonucleotide
  Target: ATXN1; (+) strand; PAM type: NRG; PAM sequence: TGG
caattctagcaaacagactg

SEQ ID NO: 143121 - DNA, 20 bp, Artificial Sequence
  Description of Artificial Sequence: Synthetic oligonucleotide
  Target: ATXN1; (+) strand; PAM type: NRG; PAM sequence: AAG
ctagcaaacagactgtggca

SEQ ID NO: 143122 - DNA, 20 bp, Artificial Sequence
  Description of Artificial Sequence: Synthetic oligonucleotide
  Target: ATXN1; (+) strand; PAM type: NRG; PAM sequence: AGG
tagcaaacagactgtggcaa

SEQ ID NO: 143123 - DNA, 20 bp, Artificial Sequence
  Description of Artificial Sequence: Synthetic oligonucleotide
  Target: ATXN1; (+) strand; PAM type: NRG; PAM sequence: TGG
acagactgtggcaaaggtaa

SEQ ID NO: 143124 - DNA, 20 bp, Artificial Sequence
  Description of Artificial Sequence: Synthetic oligonucleotide
  Target: ATXN1; (+) strand; PAM type: NRG; PAM sequence: GGG
cagactgtggcaaaggtaat

SEQ ID NO: 143125 - DNA, 20 bp, Artificial Sequence
  Description of Artificial Sequence: Synthetic oligonucleotide
  Target: ATXN1; (+) strand; PAM type: NRG; PAM sequence: GAG
gactgtggcaaaggtaatgg

SEQ ID NO: 143126 - DNA, 20 bp, Artificial Sequence
  Description of Artificial Sequence: Synthetic oligonucleotide
  Target: ATXN1; (+) strand; PAM type: NRG; PAM sequence: AAG
ggtaatgggagatcatttcc

SEQ ID NO: 143127 - DNA, 20 bp, Artificial Sequence
  Description of Artificial Sequence: Synthetic oligonucleotide
  Target: ATXN1; (+) strand; PAM type: NRG; PAM sequence: TGG
tgggagatcatttccaagac

SEQ ID NO: 143128 - DNA, 20 bp, Artificial Sequence
  Description of Artificial Sequence: Synthetic oligonucleotide
  Target: ATXN1; (+) strand; PAM type: NRG; PAM sequence: GGG
gggagatcatttccaagact

SEQ ID NO: 143129 - DNA, 20 bp, Artificial Sequence
  Description of Artificial Sequence: Synthetic oligonucleotide
  Target: ATXN1; (+) strand; PAM type: NRG; PAM sequence: AAG
ttccaagactgggttacatg

SEQ ID NO: 143130 - DNA, 20 bp, Artificial Sequence
  Description of Artificial Sequence: Synthetic oligonucleotide
  Target: ATXN1; (+) strand; PAM type: NRG; PAM sequence: TGG
aagactgggttacatgaaga

SEQ ID NO: 143131 - DNA, 20 bp, Artificial Sequence
  Description of Artificial Sequence: Synthetic oligonucleotide
  Target: ATXN1; (+) strand; PAM type: NRG; PAM sequence: TGG
actgggttacatgaagatgg

SEQ ID NO: 143132 - DNA, 20 bp, Artificial Sequence
  Description of Artificial Sequence: Synthetic oligonucleotide
  Target: ATXN1; (+) strand; PAM type: NRG; PAM sequence: TGG
gaagatggtggcttccatct

SEQ ID NO: 143133 - DNA, 20 bp, Artificial Sequence
  Description of Artificial Sequence: Synthetic oligonucleotide
  Target: ATXN1; (+) strand; PAM type: NRG; PAM sequence: GGG
aagatggtggcttccatctt

SEQ ID NO: 143134 - DNA, 20 bp, Artificial Sequence
  Description of Artificial Sequence: Synthetic oligonucleotide
  Target: ATXN1; (+) strand; PAM type: NRG; PAM sequence: TGG
tgggatcttgcatcctcttc

SEQ ID NO: 143135 - DNA, 20 bp, Artificial Sequence
  Description of Artificial Sequence: Synthetic oligonucleotide
  Target: ATXN1; (+) strand; PAM type: NRG; PAM sequence: GGG
gggatcttgcatcctcttct

SEQ ID NO: 143136 - DNA, 20 bp, Artificial Sequence
  Description of Artificial Sequence: Synthetic oligonucleotide
  Target: ATXN1; (+) strand; PAM type: NRG; PAM sequence: TGG
cctcttctgggttactcacc

SEQ ID NO: 143137 - DNA, 20 bp, Artificial Sequence
  Description of Artificial Sequence: Synthetic oligonucleotide
  Target: ATXN1; (+) strand; PAM type: NRG; PAM sequence: GGG
ctcttctgggttactcacct

SEQ ID NO: 143138 - DNA, 20 bp, Artificial Sequence
  Description of Artificial Sequence: Synthetic oligonucleotide
  Target: ATXN1; (+) strand; PAM type: NRG; PAM sequence: GGG
tcttctgggttactcacctg

SEQ ID NO: 143139 - DNA, 20 bp, Artificial Sequence
  Description of Artificial Sequence: Synthetic oligonucleotide
  Target: ATXN1; (+) strand; PAM type: NRG; PAM sequence: GGG
cttctgggttactcacctgg

SEQ ID NO: 143140 - DNA, 20 bp, Artificial Sequence
  Description of Artificial Sequence: Synthetic oligonucleotide
  Target: ATXN1; (+) strand; PAM type: NRG; PAM sequence: GAG
tctgggttactcacctgggg

SEQ ID NO: 143141 - DNA, 20 bp, Artificial Sequence
  Description of Artificial Sequence: Synthetic oligonucleotide
  Target: ATXN1; (+) strand; PAM type: NRG; PAM sequence: AGG
ctgggttactcacctggggg

SEQ ID NO: 143142 - DNA, 20 bp, Artificial Sequence
  Description of Artificial Sequence: Synthetic oligonucleotide
  Target: ATXN1; (+) strand; PAM type: NRG; PAM sequence: CAG
acctgggggaggctgactgc

SEQ ID NO: 143143 - DNA, 20 bp, Artificial Sequence
  Description of Artificial Sequence: Synthetic oligonucleotide
  Target: ATXN1; (+) strand; PAM type: NRG; PAM sequence: AGG
cctgggggaggctgactgcc

SEQ ID NO: 143144 - DNA, 20 bp, Artificial Sequence
  Description of Artificial Sequence: Synthetic oligonucleotide
  Target: ATXN1; (+) strand; PAM type: NRG; PAM sequence: CAG
ctgactgccaggctgtgatg

SEQ ID NO: 143145 - DNA, 20 bp, Artificial Sequence
  Description of Artificial Sequence: Synthetic oligonucleotide
  Target: ATXN1; (+) strand; PAM type: NRG; PAM sequence: TGG
caggctgtgatgcagtcctg

SEQ ID NO: 143146 - DNA, 20 bp, Artificial Sequence
  Description of Artificial Sequence: Synthetic oligonucleotide
  Target: ATXN1; (+) strand; PAM type: NRG; PAM sequence: AAG
gctgtgatgcagtcctgtgg

SEQ ID NO: 143147 - DNA, 20 bp, Artificial Sequence
  Description of Artificial Sequence: Synthetic oligonucleotide
  Target: ATXN1; (+) strand; PAM type: NRG; PAM sequence: AGG
ctgtgatgcagtcctgtgga

SEQ ID NO: 143148 - DNA, 20 bp, Artificial Sequence
  Description of Artificial Sequence: Synthetic oligonucleotide
  Target: ATXN1; (+) strand; PAM type: NRG; PAM sequence: GGG
tgtgatgcagtcctgtggaa

SEQ ID NO: 143149 - DNA, 20 bp, Artificial Sequence
  Description of Artificial Sequence: Synthetic oligonucleotide
  Target: ATXN1; (+) strand; PAM type: NRG; PAM sequence: TGG
gtcctgtggaagggcccaca

SEQ ID NO: 143150 - DNA, 20 bp, Artificial Sequence
  Description of Artificial Sequence: Synthetic oligonucleotide
  Target: ATXN1; (+) strand; PAM type: NRG; PAM sequence: GAG
ggcccacatggcatatcact

SEQ ID NO: 143151 - DNA, 20 bp, Artificial Sequence
  Description of Artificial Sequence: Synthetic oligonucleotide
  Target: ATXN1; (+) strand; PAM type: NRG; PAM sequence: AGG
gcccacatggcatatcactg

SEQ ID NO: 143152 - DNA, 20 bp, Artificial Sequence
  Description of Artificial Sequence: Synthetic oligonucleotide
  Target: ATXN1; (+) strand; PAM type: NRG; PAM sequence: TAG
ggcatatcactgaggcctgc

SEQ ID NO: 143153 - DNA, 20 bp, Artificial Sequence
  Description of Artificial Sequence: Synthetic oligonucleotide
  Target: ATXN1; (+) strand; PAM type: NRG; PAM sequence: GAG
aggcctgctagcatctatgt

SEQ ID NO: 143154 - DNA, 20 bp, Artificial Sequence
  Description of Artificial Sequence: Synthetic oligonucleotide
  Target: ATXN1; (+) strand; PAM type: NRG; PAM sequence: TGG
cctgctagcatctatgtgag

SEQ ID NO: 143155 - DNA, 20 bp, Artificial Sequence
  Description of Artificial Sequence: Synthetic oligonucleotide
  Target: ATXN1; (+) strand; PAM type: NRG; PAM sequence: TGG
agcatctatgtgagtggatt

SEQ ID NO: 143156 - DNA, 20 bp, Artificial Sequence
  Description of Artificial Sequence: Synthetic oligonucleotide
  Target: ATXN1; (+) strand; PAM type: NRG; PAM sequence: AAG
atctatgtgagtggatttgg

SEQ ID NO: 143157 - DNA, 20 bp, Artificial Sequence
  Description of Artificial Sequence: Synthetic oligonucleotide
  Target: ATXN1; (+) strand; PAM type: NRG; PAM sequence: CAG
tatgtgagtggatttggaag

SEQ ID NO: 143158 - DNA, 20 bp, Artificial Sequence
  Description of Artificial Sequence: Synthetic oligonucleotide
  Target: ATXN1; (+) strand; PAM type: NRG; PAM sequence: CAG
accgcccccaccctatcctt

SEQ ID NO: 143159 - DNA, 20 bp, Artificial Sequence
  Description of Artificial Sequence: Synthetic oligonucleotide
  Target: ATXN1; (+) strand; PAM type: NRG; PAM sequence: CAG
ctatccttcagatgaaacgt

SEQ ID NO: 143160 - DNA, 20 bp, Artificial Sequence
  Description of Artificial Sequence: Synthetic oligonucleotide
  Target: ATXN1; (+) strand; PAM type: NRG; PAM sequence: CAG
cttcagatgaaacgtcagcc

SEQ ID NO: 143161 - DNA, 20 bp, Artificial Sequence
  Description of Artificial Sequence: Synthetic oligonucleotide
  Target: ATXN1; (+) strand; PAM type: NRG; PAM sequence: AGG
ttcagatgaaacgtcagccc

SEQ ID NO: 143162 - DNA, 20 bp, Artificial Sequence
  Description of Artificial Sequence: Synthetic oligonucleotide
  Target: ATXN1; (+) strand; PAM type: NRG; PAM sequence: AAG
acttgactacaacctcatga

SEQ ID NO: 143163 - DNA, 20 bp, Artificial Sequence
  Description of Artificial Sequence: Synthetic oligonucleotide
  Target: ATXN1; (+) strand; PAM type: NRG; PAM sequence: TGG
ctacaacctcatgaaagact

SEQ ID NO: 143164 - DNA, 20 bp, Artificial Sequence
  Description of Artificial Sequence: Synthetic oligonucleotide
  Target: ATXN1; (+) strand; PAM type: NRG; PAM sequence: GAG
acaacctcatgaaagacttg

SEQ ID NO: 143165 - DNA, 20 bp, Artificial Sequence
  Description of Artificial Sequence: Synthetic oligonucleotide
  Target: ATXN1; (+) strand; PAM type: NRG; PAM sequence: TAG
cctcatgaaagacttggagc

SEQ ID NO: 143166 - DNA, 20 bp, Artificial Sequence
  Description of Artificial Sequence: Synthetic oligonucleotide
  Target: ATXN1; (+) strand; PAM type: NRG; PAM sequence: GAG
tcatgaaagacttggagcta

SEQ ID NO: 143167 - DNA, 20 bp, Artificial Sequence
  Description of Artificial Sequence: Synthetic oligonucleotide
  Target: ATXN1; (+) strand; PAM type: NRG; PAM sequence: CAG
gacttggagctagagacacc

SEQ ID NO: 143168 - DNA, 20 bp, Artificial Sequence
  Description of Artificial Sequence: Synthetic oligonucleotide
  Target: ATXN1; (+) strand; PAM type: NRG; PAM sequence: CAG
agacacccagctatgatatg

SEQ ID NO: 143169 - DNA, 20 bp, Artificial Sequence
  Description of Artificial Sequence: Synthetic oligonucleotide
  Target: ATXN1; (+) strand; PAM type: NRG; PAM sequence: TAG
gatatgcagtgattcacact

SEQ ID NO: 143170 - DNA, 20 bp, Artificial Sequence
  Description of Artificial Sequence: Synthetic oligonucleotide
  Target: ATXN1; (+) strand; PAM type: NRG; PAM sequence: GAG
gattcacacttagaaaaact

SEQ ID NO: 143171 - DNA, 20 bp, Artificial Sequence
  Description of Artificial Sequence: Synthetic oligonucleotide
  Target: ATXN1; (+) strand; PAM type: NRG; PAM sequence: GAG
ttcacacttagaaaaactga

SEQ ID NO: 143172 - DNA, 20 bp, Artificial Sequence
  Description of Artificial Sequence: Synthetic oligonucleotide
  Target: ATXN1; (+) strand; PAM type: NRG; PAM sequence: AAG
taataaacacttgttgtttt

SEQ ID NO: 143173 - DNA, 20 bp, Artificial Sequence
  Description of Artificial Sequence: Synthetic oligonucleotide
  Target: ATXN1; (+) strand; PAM type: NRG; PAM sequence: AAG
acttgttgttttaagccact

SEQ ID NO: 143174 - DNA, 20 bp, Artificial Sequence
  Description of Artificial Sequence: Synthetic oligonucleotide
  Target: ATXN1; (+) strand; PAM type: NRG; PAM sequence: TGG
tgttttaagccactaagatt

SEQ ID NO: 143175 - DNA, 20 bp, Artificial Sequence
  Description of Artificial Sequence: Synthetic oligonucleotide
  Target: ATXN1; (+) strand; PAM type: NRG; PAM sequence: GAG
ttttaagccactaagatttg

SEQ ID NO: 143176 - DNA, 20 bp, Artificial Sequence
  Description of Artificial Sequence: Synthetic oligonucleotide
  Target: ATXN1; (+) strand; PAM type: NRG; PAM sequence: CAG
atttggagtaattacttaca

SEQ ID NO: 143177 - DNA, 20 bp, Artificial Sequence
  Description of Artificial Sequence: Synthetic oligonucleotide
  Target: ATXN1; (+) strand; PAM type: NRG; PAM sequence: CAG
tggagtaattacttacacag

SEQ ID NO: 143178 - DNA, 20 bp, Artificial Sequence
  Description of Artificial Sequence: Synthetic oligonucleotide
  Target: ATXN1; (+) strand; PAM type: NRG; PAM sequence: TAG
agtaattacttacacagcag

SEQ ID NO: 143179 - DNA, 20 bp, Artificial Sequence
  Description of Artificial Sequence: Synthetic oligonucleotide
  Target: ATXN1; (+) strand; PAM type: NRG; PAM sequence: CAG
acagcagtagataactacta

SEQ ID NO: 143180 - DNA, 20 bp, Artificial Sequence
  Description of Artificial Sequence: Synthetic oligonucleotide
  Target: ATXN1; (+) strand; PAM type: NRG; PAM sequence: TGG
caatgtatgaaacactcttc

SEQ ID NO: 143181 - DNA, 20 bp, Artificial Sequence
  Description of Artificial Sequence: Synthetic oligonucleotide
  Target: ATXN1; (+) strand; PAM type: NRG; PAM sequence: GGG
aatgtatgaaacactcttct

SEQ ID NO: 143182 - DNA, 20 bp, Artificial Sequence
  Description of Artificial Sequence: Synthetic oligonucleotide
  Target: ATXN1; (+) strand; PAM type: NRG; PAM sequence: CAG
gaactttacatgacttttta

SEQ ID NO: 143183 - DNA, 20 bp, Artificial Sequence
  Description of Artificial Sequence: Synthetic oligonucleotide
  Target: ATXN1; (+) strand; PAM type: NRG; PAM sequence: TGG
ctttacatgactttttacag

SEQ ID NO: 143184 - DNA, 20 bp, Artificial Sequence
  Description of Artificial Sequence: Synthetic oligonucleotide
  Target: ATXN1; (+) strand; PAM type: NRG; PAM sequence: GGG
tttacatgactttttacagt

SEQ ID NO: 143185 - DNA, 20 bp, Artificial Sequence
  Description of Artificial Sequence: Synthetic oligonucleotide
  Target: ATXN1; (+) strand; PAM type: NRG; PAM sequence: GAG
tacatgactttttacagtgg

SEQ ID NO: 143186 - DNA, 20 bp, Artificial Sequence
  Description of Artificial Sequence: Synthetic oligonucleotide
  Target: ATXN1; (+) strand; PAM type: NRG; PAM sequence: GAG
tttttacagtgggagaaact

SEQ ID NO: 143187 - DNA, 20 bp, Artificial Sequence
  Description of Artificial Sequence: Synthetic oligonucleotide
  Target: ATXN1; (+) strand; PAM type: NRG; PAM sequence: AAG
gtgggagaaactgagcccca

SEQ ID NO: 143188 - DNA, 20 bp, Artificial Sequence
  Description of Artificial Sequence: Synthetic oligonucleotide
  Target: ATXN1; (+) strand; PAM type: NRG; PAM sequence: AAG
ggagaaactgagccccaaag

SEQ ID NO: 143189 - DNA, 20 bp, Artificial Sequence
  Description of Artificial Sequence: Synthetic oligonucleotide
  Target: ATXN1; (+) strand; PAM type: NRG; PAM sequence: CAG
aagttaaatcacctgttcaa

SEQ ID NO: 143190 - DNA, 20 bp, Artificial Sequence
  Description of Artificial Sequence: Synthetic oligonucleotide
  Target: ATXN1; (+) strand; PAM type: NRG; PAM sequence: TGG
tgttcaacagcacacataca

SEQ ID NO: 143191 - DNA, 20 bp, Artificial Sequence
  Description of Artificial Sequence: Synthetic oligonucleotide
  Target: ATXN1; (+) strand; PAM type: NRG; PAM sequence: TAG
tcaacagcacacatacatgg

SEQ ID NO: 143192 - DNA, 20 bp, Artificial Sequence
  Description of Artificial Sequence: Synthetic oligonucleotide
  Target: ATXN1; (+) strand; PAM type: NRG; PAM sequence: GAG
aacagcacacatacatggta

SEQ ID NO: 143193 - DNA, 20 bp, Artificial Sequence
  Description of Artificial Sequence: Synthetic oligonucleotide
  Target: ATXN1; (+) strand; PAM type: NRG; PAM sequence: AGG
acagcacacatacatggtag

SEQ ID NO: 143194 - DNA, 20 bp, Artificial Sequence
  Description of Artificial Sequence: Synthetic oligonucleotide
  Target: ATXN1; (+) strand; PAM type: NRG; PAM sequence: TGG
gcacacatacatggtagagg

SEQ ID NO: 143195 - DNA, 20 bp, Artificial Sequence
  Description of Artificial Sequence: Synthetic oligonucleotide
  Target: ATXN1; (+) strand; PAM type: NRG; PAM sequence: GGG
cacacatacatggtagaggt

SEQ ID NO: 143196 - DNA, 20 bp, Artificial Sequence
  Description of Artificial Sequence: Synthetic oligonucleotide
  Target: ATXN1; (+) strand; PAM type: NRG; PAM sequence: CAG
gtagaggtgggactcaaact

SEQ ID NO: 143197 - DNA, 20 bp, Artificial Sequence
  Description of Artificial Sequence: Synthetic oligonucleotide
  Target: ATXN1; (+) strand; PAM type: NRG; PAM sequence: AGG
tagaggtgggactcaaactc

SEQ ID NO: 143198 - DNA, 20 bp, Artificial Sequence
  Description of Artificial Sequence: Synthetic oligonucleotide
  Target: ATXN1; (+) strand; PAM type: NRG; PAM sequence: CAG
aaactcaggccatctgactc

SEQ ID NO: 143199 - DNA, 20 bp, Artificial Sequence
  Description of Artificial Sequence: Synthetic oligonucleotide
  Target: ATXN1; (+) strand; PAM type: NRG; PAM sequence: CAG
ggccatctgactccagaaac

SEQ ID NO: 143200 - DNA, 20 bp, Artificial Sequence
  Description of Artificial Sequence: Synthetic oligonucleotide
  Target: ATXN1; (+) strand; PAM type: NRG; PAM sequence: AGG
gccatctgactccagaaacc

SEQ ID NO: 143201 - DNA, 20 bp, Artificial Sequence
  Description of Artificial Sequence: Synthetic oligonucleotide
  Target: ATXN1; (+) strand; PAM type: NRG; PAM sequence: AAG
ctgcatcacactaccccttt

SEQ ID NO: 143202 - DNA, 20 bp, Artificial Sequence
  Description of Artificial Sequence: Synthetic oligonucleotide
  Target: ATXN1; (+) strand; PAM type: NRG; PAM sequence: TAG
aagaaccatttttcctactt

SEQ ID NO: 143203 - DNA, 20 bp, Artificial Sequence
  Description of Artificial Sequence: Synthetic oligonucleotide
  Target: ATXN1; (+) strand; PAM type: NRG; PAM sequence: AGG
agaaccatttttcctacttt

SEQ ID NO: 143204 - DNA, 20 bp, Artificial Sequence
  Description of Artificial Sequence: Synthetic oligonucleotide
  Target: ATXN1; (+) strand; PAM type: NRG; PAM sequence: TAG
tgaaatttgactttccactg

SEQ ID NO: 143205 - DNA, 20 bp, Artificial Sequence
  Description of Artificial Sequence: Synthetic oligonucleotide
  Target: ATXN1; (+) strand; PAM type: NRG; PAM sequence: AAG
taaaatcacacaatttgcac

SEQ ID NO: 143206 - DNA, 20 bp, Artificial Sequence
  Description of Artificial Sequence: Synthetic oligonucleotide
  Target: ATXN1; (+) strand; PAM type: NRG; PAM sequence: AAG
cacaatttgcacaagcaatg

SEQ ID NO: 143207 - DNA, 20 bp, Artificial Sequence
  Description of Artificial Sequence: Synthetic oligonucleotide
  Target: ATXN1; (+) strand; PAM type: NRG; PAM sequence: TAG
tcttttttttttttttgaaa

SEQ ID NO: 143208 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttttgaaata

SEQ ID NO: 143209 - DNA, 20 bp, Artificial Sequence
  Description of Artificial Sequence: Synthetic oligonucleotide
  Target: ATXN1; (+) strand; PAM type: NRG; PAM sequence: CAG
agagttttgctcttgttgcc

SEQ ID NO: 143210 - DNA, 20 bp, Artificial Sequence
  Description of Artificial Sequence: Synthetic oligonucleotide
  Target: ATXN1; (+) strand; PAM type: NRG; PAM sequence: AGG
gagttttgctcttgttgccc

SEQ ID NO: 143211 - DNA, 20 bp, Artificial Sequence
  Description of Artificial Sequence: Synthetic oligonucleotide
  Target: ATXN1; (+) strand; PAM type: NRG; PAM sequence: TGG
tttgctcttgttgcccaggc

SEQ ID NO: 143212 - DNA, 20 bp, Artificial Sequence
  Description of Artificial Sequence: Synthetic oligonucleotide
  Target: ATXN1; (+) strand; PAM type: NRG; PAM sequence: GAG
tgctcttgttgcccaggctg

SEQ ID NO: 143213 - DNA, 20 bp, Artificial Sequence
  Description of Artificial Sequence: Synthetic oligonucleotide
  Target: ATXN1; (+) strand; PAM type: NRG; PAM sequence: TGG
ttgcccaggctggagtacaa

SEQ ID NO: 143214 - DNA, 20 bp, Artificial Sequence
  Description of Artificial Sequence: Synthetic oligonucleotide
  Target: ATXN1; (+) strand; PAM type: NRG; PAM sequence: TGG
caggctggagtacaatggtg

SEQ ID NO: 143215 - DNA, 20 bp, Artificial Sequence
  Description of Artificial Sequence: Synthetic oligonucleotide
  Target: ATXN1; (+) strand; PAM type: NRG; PAM sequence: CAG
ggagtacaatggtgtggtct

SEQ ID NO: 143216 - DNA, 20 bp, Artificial Sequence
  Description of Artificial Sequence: Synthetic oligonucleotide
  Target: ATXN1; (+) strand; PAM type: NRG; PAM sequence: CAG
tcactgcaacctctgcctct

SEQ ID NO: 143217 - DNA, 20 bp, Artificial Sequence
  Description of Artificial Sequence: Synthetic oligonucleotide
  Target: ATXN1; (+) strand; PAM type: NRG; PAM sequence: AGG
cactgcaacctctgcctctc

SEQ ID NO: 143218 - DNA, 20 bp, Artificial Sequence
  Description of Artificial Sequence: Synthetic oligonucleotide
  Target: ATXN1; (+) strand; PAM type: NRG; PAM sequence: AAG
aacctctgcctctcaggttc

SEQ ID NO: 143219 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaattctcctgcct

SEQ ID NO: 143220 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcctcagcctccc

SEQ ID NO: 143221 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccaag

SEQ ID NO: 143222 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtagc

SEQ ID NO: 143223 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagct

SEQ ID NO: 143224 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggatta

SEQ ID NO: 143225 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggattac

SEQ ID NO: 143226 - DNA, 20 bp, Artificial Sequence
  Description of Artificial Sequence: Synthetic oligonucleotide
  Target: ATXN1; (+) strand; PAM type: NRG; PAM sequence: CAG
caggcacacgccaccacgcc

SEQ ID NO: 143227 - DNA, 20 bp, Artificial Sequence
  Description of Artificial Sequence: Synthetic oligonucleotide
  Target: ATXN1; (+) strand; PAM type: NRG; PAM sequence: TAG
cagctaattttttgtatttt

SEQ ID NO: 143228 - DNA, 20 bp, Artificial Sequence
  Description of Artificial Sequence: Synthetic oligonucleotide
  Target: ATXN1; (+) strand; PAM type: NRG; PAM sequence: TAG
ctaattttttgtatttttag

SEQ ID NO: 143229 - DNA, 20 bp, Artificial Sequence
  Description of Artificial Sequence: Synthetic oligonucleotide
  Target: ATXN1; (+) strand; PAM type: NRG; PAM sequence: GAG
aattttttgtatttttagta

SEQ ID NO: 143230 - DNA, 20 bp, Artificial Sequence
  Description of Artificial Sequence: Synthetic oligonucleotide
  Target: ATXN1; (+) strand; PAM type: NRG; PAM sequence: CAG
ttttgtatttttagtagaga

SEQ ID NO: 143231 - DNA, 20 bp, Artificial Sequence
  Description of Artificial Sequence: Synthetic oligonucleotide
  Target: ATXN1; (+) strand; PAM type: NRG; PAM sequence: AGG
tttgtatttttagtagagac

SEQ ID NO: 143232 - DNA, 20 bp, Artificial Sequence
  Description of Artificial Sequence: Synthetic oligonucleotide
  Target: ATXN1; (+) strand; PAM type: NRG; PAM sequence: TGG
gagacaggatttcaccatgt

SEQ ID NO: 143233 - DNA, 20 bp, Artificial Sequence
  Description of Artificial Sequence: Synthetic oligonucleotide
  Target: ATXN1; (+) strand; PAM type: NRG; PAM sequence: CAG
caggatttcaccatgttggc

SEQ ID NO: 143234 - DNA, 20 bp, Artificial Sequence
  Description of Artificial Sequence: Synthetic oligonucleotide
  Target: ATXN1; (+) strand; PAM type: NRG; PAM sequence: AGG
aggatttcaccatgttggcc

SEQ ID NO: 143235 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttggccaggc

SEQ ID NO: 143236 - DNA, 20 bp, Artificial Sequence
  Description of Artificial Sequence: Synthetic oligonucleotide
  Target: ATXN1; (+) strand; PAM type: NRG; PAM sequence: CAG
tggtcttgaactcttgacct

SEQ ID NO: 143237 - DNA, 20 bp, Artificial Sequence
  Description of Artificial Sequence: Synthetic oligonucleotide
  Target: ATXN1; (+) strand; PAM type: NRG; PAM sequence: AGG
ggtcttgaactcttgacctc

SEQ ID NO: 143238 - DNA, 20 bp, Artificial Sequence
  Description of Artificial Sequence: Synthetic oligonucleotide
  Target: ATXN1; (+) strand; PAM type: NRG; PAM sequence: TGG
cttgacctcaggtgatctgc

SEQ ID NO: 143239 - DNA, 20 bp, Artificial Sequence
  Description of Artificial Sequence: Synthetic oligonucleotide
  Target: ATXN1; (+) strand; PAM type: NRG; PAM sequence: CGG
ctcaggtgatctgctggtct

SEQ ID NO: 143240 - DNA, 20 bp, Artificial Sequence
  Description of Artificial Sequence: Synthetic oligonucleotide
  Target: ATXN1; (+) strand; PAM type: NRG; PAM sequence: AAG
ctgctggtctcggcctccca

SEQ ID NO: 143241 - DNA, 20 bp, Artificial Sequence
  Description of Artificial Sequence: Synthetic oligonucleotide
  Target: ATXN1; (+) strand; PAM type: NRG; PAM sequence: TGG
gtctcggcctcccaaagtgc

SEQ ID NO: 143242 - DNA, 20 bp, Artificial Sequence
  Description of Artificial Sequence: Synthetic oligonucleotide
  Target: ATXN1; (+) strand; PAM type: NRG; PAM sequence: GGG
tctcggcctcccaaagtgct

SEQ ID NO: 143243 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 143244 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 143245 - DNA, 20 bp, Artificial Sequence
  Description of Artificial Sequence: Synthetic oligonucleotide
  Target: ATXN1; (+) strand; PAM type: NRG; PAM sequence: TGG
aagtgctgggattacaggcg

SEQ ID NO: 143246 - DNA, 20 bp, Artificial Sequence
  Description of Artificial Sequence: Synthetic oligonucleotide
  Target: ATXN1; (+) strand; PAM type: NRG; PAM sequence: GGG
agtgctgggattacaggcgt

SEQ ID NO: 143247 - DNA, 20 bp, Artificial Sequence
  Description of Artificial Sequence: Synthetic oligonucleotide
  Target: ATXN1; (+) strand; PAM type: NRG; PAM sequence: CGG
caggcgtgggccactgcacc

SEQ ID NO: 143248 - DNA, 20 bp, Artificial Sequence
  Description of Artificial Sequence: Synthetic oligonucleotide
  Target: ATXN1; (+) strand; PAM type: NRG; PAM sequence: CAG
cactgcacccggccattcat

SEQ ID NO: 143249 - DNA, 20 bp, Artificial Sequence
  Description of Artificial Sequence: Synthetic oligonucleotide
  Target: ATXN1; (+) strand; PAM type: NRG; PAM sequence: AGG
actgcacccggccattcatc

SEQ ID NO: 143250 - DNA, 20 bp, Artificial Sequence
  Description of Artificial Sequence: Synthetic oligonucleotide
  Target: ATXN1; (+) strand; PAM type: NRG; PAM sequence: TAG
aggcttcttaacctgccaca

SEQ ID NO: 143251 - DNA, 20 bp, Artificial Sequence
  Description of Artificial Sequence: Synthetic oligonucleotide
  Target: ATXN1; (+) strand; PAM type: NRG; PAM sequence: AAG
tgataccttaactatatcat

SEQ ID NO: 143252 - DNA, 20 bp, Artificial Sequence
  Description of Artificial Sequence: Synthetic oligonucleotide
  Target: ATXN1; (+) strand; PAM type: NRG; PAM sequence: CAG
actatatcataagctatatt

SEQ ID NO: 143253 - DNA, 20 bp, Artificial Sequence
  Description of Artificial Sequence: Synthetic oligonucleotide
  Target: ATXN1; (+) strand; PAM type: NRG; PAM sequence: AAG
taagctatattcagttgtca

SEQ ID NO: 143254 - DNA, 20 bp, Artificial Sequence
  Description of Artificial Sequence: Synthetic oligonucleotide
  Target: ATXN1; (+) strand; PAM type: NRG; PAM sequence: CAG
tattcagttgtcaaagaaaa

SEQ ID NO: 143255 - DNA, 20 bp, Artificial Sequence
  Description of Artificial Sequence: Synthetic oligonucleotide
  Target: ATXN1; (+) strand; PAM type: NRG; PAM sequence: AAG
cagttgtcaaagaaaacaga

SEQ ID NO: 143256 - DNA, 20 bp, Artificial Sequence
  Description of Artificial Sequence: Synthetic oligonucleotide
  Target: ATXN1; (+) strand; PAM type: NRG; PAM sequence: AGG
agttgtcaaagaaaacagaa

SEQ ID NO: 143257 - DNA, 20 bp, Artificial Sequence
  Description of Artificial Sequence: Synthetic oligonucleotide
  Target: ATXN1; (+) strand; PAM type: NRG; PAM sequence: TAG
tgtcaaagaaaacagaaagg

SEQ ID NO: 143258 - DNA, 20 bp, Artificial Sequence
  Description of Artificial Sequence: Synthetic oligonucleotide
  Target: ATXN1; (+) strand; PAM type: NRG; PAM sequence: AAG
aggtagcctcttgctgtttg

SEQ ID NO: 143259 - DNA, 20 bp, Artificial Sequence
  Description of Artificial Sequence: Synthetic oligonucleotide
  Target: ATXN1; (+) strand; PAM type: NRG; PAM sequence: GAG
gtagcctcttgctgtttgaa

SEQ ID NO: 143260 - DNA, 20 bp, Artificial Sequence
  Description of Artificial Sequence: Synthetic oligonucleotide
  Target: ATXN1; (+) strand; PAM type: NRG; PAM sequence: CAG
tgctgtttgaagagcaacct

SEQ ID NO: 143261 - DNA, 20 bp, Artificial Sequence
  Description of Artificial Sequence: Synthetic oligonucleotide
  Target: ATXN1; (+) strand; PAM type: NRG; PAM sequence: TGG
tttgaagagcaacctcagta

SEQ ID NO: 143262 - DNA, 20 bp, Artificial Sequence
  Description of Artificial Sequence: Synthetic oligonucleotide
  Target: ATXN1; (+) strand; PAM type: NRG; PAM sequence: CAG
tcagtatggttcttccattt

SEQ ID NO: 143263 - DNA, 20 bp, Artificial Sequence
  Description of Artificial Sequence: Synthetic oligonucleotide
  Target: ATXN1; (+) strand; PAM type: NRG; PAM sequence: TGG
atggttcttccatttcagtc

SEQ ID NO: 143264 - DNA, 20 bp, Artificial Sequence
  Description of Artificial Sequence: Synthetic oligonucleotide
  Target: ATXN1; (+) strand; PAM type: NRG; PAM sequence: TAG
aatttgcgtcatttaactat

SEQ ID NO: 143265 - DNA, 20 bp, Artificial Sequence
  Description of Artificial Sequence: Synthetic oligonucleotide
  Target: ATXN1; (+) strand; PAM type: NRG; PAM sequence: GAG
tttgcgtcatttaactatta

SEQ ID NO: 143266 - DNA, 20 bp, Artificial Sequence
  Description of Artificial Sequence: Synthetic oligonucleotide
  Target: ATXN1; (+) strand; PAM type: NRG; PAM sequence: CAG
tttaactattagagaatttc

SEQ ID NO: 143267 - DNA, 20 bp, Artificial Sequence
  Description of Artificial Sequence: Synthetic oligonucleotide
  Target: ATXN1; (+) strand; PAM type: NRG; PAM sequence: TAG
tttgccaacgctgtaataaa

SEQ ID NO: 143268 - DNA, 20 bp, Artificial Sequence
  Description of Artificial Sequence: Synthetic oligonucleotide
  Target: ATXN1; (+) strand; PAM type: NRG; PAM sequence: AAG
aatgtctttttgcaattgta

SEQ ID NO: 143269 - DNA, 20 bp, Artificial Sequence
  Description of Artificial Sequence: Synthetic oligonucleotide
  Target: ATXN1; (+) strand; PAM type: NRG; PAM sequence: AGG
atgtctttttgcaattgtaa

SEQ ID NO: 143270 - DNA, 20 bp, Artificial Sequence
  Description of Artificial Sequence: Synthetic oligonucleotide
  Target: ATXN1; (+) strand; PAM type: NRG; PAM sequence: GGG
tgtctttttgcaattgtaaa

SEQ ID NO: 143271 - DNA, 20 bp, Artificial Sequence
  Description of Artificial Sequence: Synthetic oligonucleotide
  Target: ATXN1; (+) strand; PAM type: NRG; PAM sequence: CAG
gggttttccctgaaactact

SEQ ID NO: 143272 - DNA, 20 bp, Artificial Sequence
  Description of Artificial Sequence: Synthetic oligonucleotide
  Target: ATXN1; (+) strand; PAM type: NRG; PAM sequence: TGG
ttttccctgaaactactcag

SEQ ID NO: 143273 - DNA, 20 bp, Artificial Sequence
  Description of Artificial Sequence: Synthetic oligonucleotide
  Target: ATXN1; (+) strand; PAM type: NRG; PAM sequence: AAG
ccctgaaactactcagtggt

SEQ ID NO: 143274 - DNA, 20 bp, Artificial Sequence
  Description of Artificial Sequence: Synthetic oligonucleotide
  Target: ATXN1; (+) strand; PAM type: NRG; PAM sequence: AGG
cctgaaactactcagtggta

SEQ ID NO: 143275 - DNA, 20 bp, Artificial Sequence
  Description of Artificial Sequence: Synthetic oligonucleotide
  Target: ATXN1; (+) strand; PAM type: NRG; PAM sequence: AAG
aactactcagtggtaaggaa

SEQ ID NO: 143276 - DNA, 20 bp, Artificial Sequence
  Description of Artificial Sequence: Synthetic oligonucleotide
  Target: ATXN1; (+) strand; PAM type: NRG; PAM sequence: AAG
tcagtggtaaggaaaagaac

SEQ ID NO: 143277 - DNA, 20 bp, Artificial Sequence
  Description of Artificial Sequence: Synthetic oligonucleotide
  Target: ATXN1; (+) strand; PAM type: NRG; PAM sequence: AAG
aaaagaacaagatactgaat

SEQ ID NO: 143278 - DNA, 20 bp, Artificial Sequence
  Description of Artificial Sequence: Synthetic oligonucleotide
  Target: ATXN1; (+) strand; PAM type: NRG; PAM sequence: TAG
gaacaagatactgaataaga

SEQ ID NO: 143279 - DNA, 20 bp, Artificial Sequence
  Description of Artificial Sequence: Synthetic oligonucleotide
  Target: ATXN1; (+) strand; PAM type: NRG; PAM sequence: CAG
gatactgaataagatagcca

SEQ ID NO: 143280 - DNA, 20 bp, Artificial Sequence
  Description of Artificial Sequence: Synthetic oligonucleotide
  Target: ATXN1; (+) strand; PAM type: NRG; PAM sequence: TGG
tagccacagtattttctgtt

SEQ ID NO: 143281 - DNA, 20 bp, Artificial Sequence
  Description of Artificial Sequence: Synthetic oligonucleotide
  Target: ATXN1; (+) strand; PAM type: NRG; PAM sequence: TGG
ttttttttttttttttgaaa

SEQ ID NO: 143282 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttttgaaatg

SEQ ID NO: 143283 - DNA, 20 bp, Artificial Sequence
  Description of Artificial Sequence: Synthetic oligonucleotide
  Target: ATXN1; (+) strand; PAM type: NRG; PAM sequence: CAG
ggagttttgctcttgttgcc

SEQ ID NO: 143284 - DNA, 20 bp, Artificial Sequence
  Description of Artificial Sequence: Synthetic oligonucleotide
  Target: ATXN1; (+) strand; PAM type: NRG; PAM sequence: AGG
gagttttgctcttgttgccc

SEQ ID NO: 143285 - DNA, 20 bp, Artificial Sequence
  Description of Artificial Sequence: Synthetic oligonucleotide
  Target: ATXN1; (+) strand; PAM type: NRG; PAM sequence: TAG
tgctcttgttgcccaggctg

SEQ ID NO: 143286 - DNA, 20 bp, Artificial Sequence
  Description of Artificial Sequence: Synthetic oligonucleotide
  Target: ATXN1; (+) strand; PAM type: NRG; PAM sequence: TGG
ttgcccaggctgtagtgcaa

SEQ ID NO: 143287 - DNA, 20 bp, Artificial Sequence
  Description of Artificial Sequence: Synthetic oligonucleotide
  Target: ATXN1; (+) strand; PAM type: NRG; PAM sequence: CGG
gtagtgcaatggtgcaatgt

SEQ ID NO: 143288 - DNA, 20 bp, Artificial Sequence
  Description of Artificial Sequence: Synthetic oligonucleotide
  Target: ATXN1; (+) strand; PAM type: NRG; PAM sequence: CGG
tcgctgcaacctctgcctcc

SEQ ID NO: 143289 - DNA, 20 bp, Artificial Sequence
  Description of Artificial Sequence: Synthetic oligonucleotide
  Target: ATXN1; (+) strand; PAM type: NRG; PAM sequence: GGG
cgctgcaacctctgcctccc

SEQ ID NO: 143290 - DNA, 20 bp, Artificial Sequence
  Description of Artificial Sequence: Synthetic oligonucleotide
  Target: ATXN1; (+) strand; PAM type: NRG; PAM sequence: AAG
aacctctgcctcccgggttc

SEQ ID NO: 143291 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgattctcctgcct

SEQ ID NO: 143292 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcctcagcctccc

SEQ ID NO: 143293 - DNA, 20 bp, Artificial Sequence
  Description of Artificial Sequence: Synthetic oligonucleotide
  Target: ATXN1; (+) strand; PAM type: NRG; PAM sequence: CAG
tcctgcctcagcctcccaag

SEQ ID NO: 143294 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagcagc

SEQ ID NO: 143295 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagcagct

SEQ ID NO: 143296 - DNA, 20 bp, Artificial Sequence
  Description of Artificial Sequence: Synthetic oligonucleotide
  Target: ATXN1; (+) strand; PAM type: NRG; PAM sequence: CAG
ctcccaagcagctgggatta

SEQ ID NO: 143297 - DNA, 20 bp, Artificial Sequence
  Description of Artificial Sequence: Synthetic oligonucleotide
  Target: ATXN1; (+) strand; PAM type: NRG; PAM sequence: AGG
tcccaagcagctgggattac

SEQ ID NO: 143298 - DNA, 20 bp, Artificial Sequence
  Description of Artificial Sequence: Synthetic oligonucleotide
  Target: ATXN1; (+) strand; PAM type: NRG; PAM sequence: TGG
caggcgtccaccaccatgcc

SEQ ID NO: 143299 - DNA, 20 bp, Artificial Sequence
  Description of Artificial Sequence: Synthetic oligonucleotide
  Target: ATXN1; (+) strand; PAM type: NRG; PAM sequence: TAG
atgcctggctaattaatctt

SEQ ID NO: 143300 - DNA, 20 bp, Artificial Sequence
  Description of Artificial Sequence: Synthetic oligonucleotide
  Target: ATXN1; (+) strand; PAM type: NRG; PAM sequence: TAG
cctggctaattaatctttag

SEQ ID NO: 143301 - DNA, 20 bp, Artificial Sequence
  Description of Artificial Sequence: Synthetic oligonucleotide
  Target: ATXN1; (+) strand; PAM type: NRG; PAM sequence: GAG
tggctaattaatctttagta

SEQ ID NO: 143302 - DNA, 20 bp, Artificial Sequence
  Description of Artificial Sequence: Synthetic oligonucleotide
  Target: ATXN1; (+) strand; PAM type: NRG; PAM sequence: CGG
taattaatctttagtagaga

SEQ ID NO: 143303 - DNA, 20 bp, Artificial Sequence
  Description of Artificial Sequence: Synthetic oligonucleotide
  Target: ATXN1; (+) strand; PAM type: NRG; PAM sequence: GGG
aattaatctttagtagagac

SEQ ID NO: 143304 - DNA, 20 bp, Artificial Sequence
  Description of Artificial Sequence: Synthetic oligonucleotide
  Target: ATXN1; (+) strand; PAM type: NRG; PAM sequence: GGG
attaatctttagtagagacg

SEQ ID NO: 143305 - DNA, 20 bp, Artificial Sequence
  Description of Artificial Sequence: Synthetic oligonucleotide
  Target: ATXN1; (+) strand; PAM type: NRG; PAM sequence: TGG
gagacggggtttcaccatgt

SEQ ID NO: 143306 - DNA, 20 bp, Artificial Sequence
  Description of Artificial Sequence: Synthetic oligonucleotide
  Target: ATXN1; (+) strand; PAM type: NRG; PAM sequence: CAG
cggggtttcaccatgttggt

SEQ ID NO: 143307 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccatgttggtc

SEQ ID NO: 143308 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttggtcaggc

SEQ ID NO: 143309 - DNA, 20 bp, Artificial Sequence
  Description of Artificial Sequence: Synthetic oligonucleotide
  Target: ATXN1; (+) strand; PAM type: NRG; PAM sequence: CAG
tggtctctaactcctgacct

SEQ ID NO: 143310 - DNA, 20 bp, Artificial Sequence
  Description of Artificial Sequence: Synthetic oligonucleotide
  Target: ATXN1; (+) strand; PAM type: NRG; PAM sequence: AGG
ggtctctaactcctgacctc

SEQ ID NO: 143311 - DNA, 20 bp, Artificial Sequence
  Description of Artificial Sequence: Synthetic oligonucleotide
  Target: ATXN1; (+) strand; PAM type: NRG; PAM sequence: CGG
ctcaggtgatccacccacct

SEQ ID NO: 143312 - DNA, 20 bp, Artificial Sequence
  Description of Artificial Sequence: Synthetic oligonucleotide
  Target: ATXN1; (+) strand; PAM type: NRG; PAM sequence: AAG
ccacccacctcggcctcccg

SEQ ID NO: 143313 - DNA, 20 bp, Artificial Sequence
  Description of Artificial Sequence: Synthetic oligonucleotide
  Target: ATXN1; (+) strand; PAM type: NRG; PAM sequence: TAG
acctcggcctcccgaagtgc

SEQ ID NO: 143314 - DNA, 20 bp, Artificial Sequence
  Description of Artificial Sequence: Synthetic oligonucleotide
  Target: ATXN1; (+) strand; PAM type: NRG; PAM sequence: AGG
cctcggcctcccgaagtgct

SEQ ID NO: 143315 - DNA, 20 bp, Artificial Sequence
  Description of Artificial Sequence: Synthetic oligonucleotide
  Target: ATXN1; (+) strand; PAM type: NRG; PAM sequence: CAG
ctcccgaagtgctaggatta

SEQ ID NO: 143316 - DNA, 20 bp, Artificial Sequence
  Description of Artificial Sequence: Synthetic oligonucleotide
  Target: ATXN1; (+) strand; PAM type: NRG; PAM sequence: AGG
tcccgaagtgctaggattac

SEQ ID NO: 143317 - DNA, 20 bp, Artificial Sequence
  Description of Artificial Sequence: Synthetic oligonucleotide
  Target: ATXN1; (+) strand; PAM type: NRG; PAM sequence: CAG
cgaagtgctaggattacagg

SEQ ID NO: 143318 - DNA, 20 bp, Artificial Sequence
  Description of Artificial Sequence: Synthetic oligonucleotide
  Target: ATXN1; (+) strand; PAM type: NRG; PAM sequence: AGG
gaagtgctaggattacaggc

SEQ ID NO: 143319 - DNA, 20 bp, Artificial Sequence
  Description of Artificial Sequence: Synthetic oligonucleotide
  Target: ATXN1; (+) strand; PAM type: NRG; PAM sequence: GAG
agtgctaggattacaggcag

SEQ ID NO: 143320 - DNA, 20 bp, Artificial Sequence
  Description of Artificial Sequence: Synthetic oligonucleotide
  Target: ATXN1; (+) strand; PAM type: NRG; PAM sequence: CGG
caggcaggagccaccgtgcc

SEQ ID NO: 143321 - DNA, 20 bp, Artificial Sequence
  Description of Artificial Sequence: Synthetic oligonucleotide
  Target: ATXN1; (+) strand; PAM type: NRG; PAM sequence: TGG
caggagccaccgtgcccggc

SEQ ID NO: 143322 - DNA, 20 bp, Artificial Sequence
  Description of Artificial Sequence: Synthetic oligonucleotide
  Target: ATXN1; (+) strand; PAM type: NRG; PAM sequence: TAG
ggctggatttttttttaata

SEQ ID NO: 143323 - DNA, 20 bp, Artificial Sequence
  Description of Artificial Sequence: Synthetic oligonucleotide
  Target: ATXN1; (+) strand; PAM type: NRG; PAM sequence: AGG
gctggatttttttttaatat

SEQ ID NO: 143324 - DNA, 20 bp, Artificial Sequence
  Description of Artificial Sequence: Synthetic oligonucleotide
  Target: ATXN1; (+) strand; PAM type: NRG; PAM sequence: CAG
tataggaaaaaatcaatttt

SEQ ID NO: 143325 - DNA, 20 bp, Artificial Sequence
  Description of Artificial Sequence: Synthetic oligonucleotide
  Target: ATXN1; (+) strand; PAM type: NRG; PAM sequence: TGG
ggaaaaaatcaattttcagt

SEQ ID NO: 143326 - DNA, 20 bp, Artificial Sequence
  Description of Artificial Sequence: Synthetic oligonucleotide
  Target: ATXN1; (+) strand; PAM type: NRG; PAM sequence: TAG
aatcaattttcagttggcaa

SEQ ID NO: 143327 - DNA, 20 bp, Artificial Sequence
  Description of Artificial Sequence: Synthetic oligonucleotide
  Target: ATXN1; (+) strand; PAM type: NRG; PAM sequence: AAG
aattttcagttggcaataga

SEQ ID NO: 143328 - DNA, 20 bp, Artificial Sequence
  Description of Artificial Sequence: Synthetic oligonucleotide
  Target: ATXN1; (+) strand; PAM type: NRG; PAM sequence: AAG
gttggcaatagaaagtcact

SEQ ID NO: 143329 - DNA, 20 bp, Artificial Sequence
  Description of Artificial Sequence: Synthetic oligonucleotide
  Target: ATXN1; (+) strand; PAM type: NRG; PAM sequence: AGG
ttggcaatagaaagtcacta

SEQ ID NO: 143330 - DNA, 20 bp, Artificial Sequence
  Description of Artificial Sequence: Synthetic oligonucleotide
  Target: ATXN1; (+) strand; PAM type: NRG; PAM sequence: AAG
ctaaggattcaaactgtacg

SEQ ID NO: 143331 - DNA, 20 bp, Artificial Sequence
  Description of Artificial Sequence: Synthetic oligonucleotide
  Target: ATXN1; (+) strand; PAM type: NRG; PAM sequence: CAG
tcaaactgtacgaagtgttt

SEQ ID NO: 143332 - DNA, 20 bp, Artificial Sequence
  Description of Artificial Sequence: Synthetic oligonucleotide
  Target: ATXN1; (+) strand; PAM type: NRG; PAM sequence: TAG
aactgtacgaagtgtttcag

SEQ ID NO: 143333 - DNA, 20 bp, Artificial Sequence
  Description of Artificial Sequence: Synthetic oligonucleotide
  Target: ATXN1; (+) strand; PAM type: NRG; PAM sequence: AGG
actgtacgaagtgtttcagt

SEQ ID NO: 143334 - DNA, 20 bp, Artificial Sequence
  Description of Artificial Sequence: Synthetic oligonucleotide
  Target: ATXN1; (+) strand; PAM type: NRG; PAM sequence: CGG
cgaagtgtttcagtaggaac

SEQ ID NO: 143335 - DNA, 20 bp, Artificial Sequence
  Description of Artificial Sequence: Synthetic oligonucleotide
  Target: ATXN1; (+) strand; PAM type: NRG; PAM sequence: AAG
gtgtttcagtaggaaccggc

SEQ ID NO: 143336 - DNA, 20 bp, Artificial Sequence
  Description of Artificial Sequence: Synthetic oligonucleotide
  Target: ATXN1; (+) strand; PAM type: NRG; PAM sequence: AAG
agaccaaaaaattttttaaa

SEQ ID NO: 143337 - DNA, 20 bp, Artificial Sequence
  Description of Artificial Sequence: Synthetic oligonucleotide
  Target: ATXN1; (+) strand; PAM type: NRG; PAM sequence: CAG
cttttgaattatataaaata

SEQ ID NO: 143338 - DNA, 20 bp, Artificial Sequence
  Description of Artificial Sequence: Synthetic oligonucleotide
  Target: ATXN1; (+) strand; PAM type: NRG; PAM sequence: AAG
tataattattataacaaatt

SEQ ID NO: 143339 - DNA, 20 bp, Artificial Sequence
  Description of Artificial Sequence: Synthetic oligonucleotide
  Target: ATXN1; (+) strand; PAM type: NRG; PAM sequence: TGG
agatgtttctattctttctg

SEQ ID NO: 143340 - DNA, 20 bp, Artificial Sequence
  Description of Artificial Sequence: Synthetic oligonucleotide
  Target: ATXN1; (+) strand; PAM type: NRG; PAM sequence: TAG
tttctattctttctgtggca

SEQ ID NO: 143341 - DNA, 20 bp, Artificial Sequence
  Description of Artificial Sequence: Synthetic oligonucleotide
  Target: ATXN1; (+) strand; PAM type: NRG; PAM sequence: CAG
tggcatagacatgtgaaata

SEQ ID NO: 143342 - DNA, 20 bp, Artificial Sequence
  Description of Artificial Sequence: Synthetic oligonucleotide
  Target: ATXN1; (+) strand; PAM type: NRG; PAM sequence: AAG
catagacatgtgaaatacag

SEQ ID NO: 143343 - DNA, 20 bp, Artificial Sequence
  Description of Artificial Sequence: Synthetic oligonucleotide
  Target: ATXN1; (+) strand; PAM type: NRG; PAM sequence: AGG
atagacatgtgaaatacaga

SEQ ID NO: 143344 - DNA, 20 bp, Artificial Sequence
  Description of Artificial Sequence: Synthetic oligonucleotide
  Target: ATXN1; (+) strand; PAM type: NRG; PAM sequence: GAG
agacatgtgaaatacagaag

SEQ ID NO: 143345 - DNA, 20 bp, Artificial Sequence
  Description of Artificial Sequence: Synthetic oligonucleotide
  Target: ATXN1; (+) strand; PAM type: NRG; PAM sequence: AAG
atgtgaaatacagaaggaga

SEQ ID NO: 143346 - DNA, 20 bp, Artificial Sequence
  Description of Artificial Sequence: Synthetic oligonucleotide
  Target: ATXN1; (+) strand; PAM type: NRG; PAM sequence: TAG
ctcctgcctcaatacaaatt

SEQ ID NO: 143347 - DNA, 20 bp, Artificial Sequence
  Description of Artificial Sequence: Synthetic oligonucleotide
  Target: ATXN1; (+) strand; PAM type: NRG; PAM sequence: TGG
gcctcaatacaaatttagaa

SEQ ID NO: 143348 - DNA, 20 bp, Artificial Sequence
  Description of Artificial Sequence: Synthetic oligonucleotide
  Target: ATXN1; (+) strand; PAM type: NRG; PAM sequence: CGG
aatttagaatggcactgtgc

SEQ ID NO: 143349 - DNA, 20 bp, Artificial Sequence
  Description of Artificial Sequence: Synthetic oligonucleotide
  Target: ATXN1; (+) strand; PAM type: NRG; PAM sequence: GGG
atttagaatggcactgtgcc

SEQ ID NO: 143350 - DNA, 20 bp, Artificial Sequence
  Description of Artificial Sequence: Synthetic oligonucleotide
  Target: ATXN1; (+) strand; PAM type: NRG; PAM sequence: AAG
tagaatggcactgtgccggg

SEQ ID NO: 143351 - DNA, 20 bp, Artificial Sequence
  Description of Artificial Sequence: Synthetic oligonucleotide
  Target: ATXN1; (+) strand; PAM type: NRG; PAM sequence: TGG
gcactgtgccgggaagaaac

SEQ ID NO: 143352 - DNA, 20 bp, Artificial Sequence
  Description of Artificial Sequence: Synthetic oligonucleotide
  Target: ATXN1; (+) strand; PAM type: NRG; PAM sequence: TGG
tgccgggaagaaactggtgc

SEQ ID NO: 143353 - DNA, 20 bp, Artificial Sequence
  Description of Artificial Sequence: Synthetic oligonucleotide
  Target: ATXN1; (+) strand; PAM type: NRG; PAM sequence: GGG
gccgggaagaaactggtgct

SEQ ID NO: 143354 - DNA, 20 bp, Artificial Sequence
  Description of Artificial Sequence: Synthetic oligonucleotide
  Target: ATXN1; (+) strand; PAM type: NRG; PAM sequence: TGG
gggaagaaactggtgctggg

SEQ ID NO: 143355 - DNA, 20 bp, Artificial Sequence
  Description of Artificial Sequence: Synthetic oligonucleotide
  Target: ATXN1; (+) strand; PAM type: NRG; PAM sequence: AAG
aaactggtgctgggtggtgc

SEQ ID NO: 143356 - DNA, 20 bp, Artificial Sequence
  Description of Artificial Sequence: Synthetic oligonucleotide
  Target: ATXN1; (+) strand; PAM type: NRG; PAM sequence: CAG
gtgctgggtggtgcaagtat

SEQ ID NO: 143357 - DNA, 20 bp, Artificial Sequence
  Description of Artificial Sequence: Synthetic oligonucleotide
  Target: ATXN1; (+) strand; PAM type: NRG; PAM sequence: TAG
caagtatcagtctcatgtct

SEQ ID NO: 143358 - DNA, 20 bp, Artificial Sequence
  Description of Artificial Sequence: Synthetic oligonucleotide
  Target: ATXN1; (+) strand; PAM type: NRG; PAM sequence: AGG
aagtatcagtctcatgtctt

SEQ ID NO: 143359 - DNA, 20 bp, Artificial Sequence
  Description of Artificial Sequence: Synthetic oligonucleotide
  Target: ATXN1; (+) strand; PAM type: NRG; PAM sequence: AAG
tatcagtctcatgtcttagg

SEQ ID NO: 143360 - DNA, 20 bp, Artificial Sequence
  Description of Artificial Sequence: Synthetic oligonucleotide
  Target: ATXN1; (+) strand; PAM type: NRG; PAM sequence: CAG
ggaagatgatgctcatcacg

SEQ ID NO: 143361 - DNA, 20 bp, Artificial Sequence
  Description of Artificial Sequence: Synthetic oligonucleotide
  Target: ATXN1; (+) strand; PAM type: NRG; PAM sequence: CAG
agatgatgctcatcacgcag

SEQ ID NO: 143362 - DNA, 20 bp, Artificial Sequence
  Description of Artificial Sequence: Synthetic oligonucleotide
  Target: ATXN1; (+) strand; PAM type: NRG; PAM sequence: CAG
gatgctcatcacgcagcagc

SEQ ID NO: 143363 - DNA, 20 bp, Artificial Sequence
  Description of Artificial Sequence: Synthetic oligonucleotide
  Target: ATXN1; (+) strand; PAM type: NRG; PAM sequence: AGG
atgctcatcacgcagcagcc

SEQ ID NO: 143364 - DNA, 20 bp, Artificial Sequence
  Description of Artificial Sequence: Synthetic oligonucleotide
  Target: ATXN1; (+) strand; PAM type: NRG; PAM sequence: GAG
gctcatcacgcagcagccag

SEQ ID NO: 143365 - DNA, 20 bp, Artificial Sequence
  Description of Artificial Sequence: Synthetic oligonucleotide
  Target: ATXN1; (+) strand; PAM type: NRG; PAM sequence: TAG
tatttatttatttatttatt

SEQ ID NO: 143366 - DNA, 20 bp, Artificial Sequence
  Description of Artificial Sequence: Synthetic oligonucleotide
  Target: ATXN1; (+) strand; PAM type: NRG; PAM sequence: GAG
tttatttatttatttattta

SEQ ID NO: 143367 - DNA, 20 bp, Artificial Sequence
  Description of Artificial Sequence: Synthetic oligonucleotide
  Target: ATXN1; (+) strand; PAM type: NRG; PAM sequence: CAG
tttatttatttatttagaga

SEQ ID NO: 143368 - DNA, 20 bp, Artificial Sequence
  Description of Artificial Sequence: Synthetic oligonucleotide
  Target: ATXN1; (+) strand; PAM type: NRG; PAM sequence: AGG
ttatttatttatttagagac

SEQ ID NO: 143369 - DNA, 20 bp, Artificial Sequence
  Description of Artificial Sequence: Synthetic oligonucleotide
  Target: ATXN1; (+) strand; PAM type: NRG; PAM sequence: GGG
tatttatttatttagagaca

SEQ ID NO: 143370 - DNA, 20 bp, Artificial Sequence
  Description of Artificial Sequence: Synthetic oligonucleotide
  Target: ATXN1; (+) strand; PAM type: NRG; PAM sequence: TAG
cagggtcttgctctgtcact

SEQ ID NO: 143371 - DNA, 20 bp, Artificial Sequence
  Description of Artificial Sequence: Synthetic oligonucleotide
  Target: ATXN1; (+) strand; PAM type: NRG; PAM sequence: AGG
agggtcttgctctgtcactt

SEQ ID NO: 143372 - DNA, 20 bp, Artificial Sequence
  Description of Artificial Sequence: Synthetic oligonucleotide
  Target: ATXN1; (+) strand; PAM type: NRG; PAM sequence: TGG
tcttgctctgtcacttaggc

SEQ ID NO: 143373 - DNA, 20 bp, Artificial Sequence
  Description of Artificial Sequence: Synthetic oligonucleotide
  Target: ATXN1; (+) strand; PAM type: NRG; PAM sequence: GAG
ttgctctgtcacttaggctg

SEQ ID NO: 143374 - DNA, 20 bp, Artificial Sequence
  Description of Artificial Sequence: Synthetic oligonucleotide
  Target: ATXN1; (+) strand; PAM type: NRG; PAM sequence: TAG
ctgtcacttaggctggagtg

SEQ ID NO: 143375 - DNA, 20 bp, Artificial Sequence
  Description of Artificial Sequence: Synthetic oligonucleotide
  Target: ATXN1; (+) strand; PAM type: NRG; PAM sequence: TGG
tcacttaggctggagtgtag

SEQ ID NO: 143376 - DNA, 20 bp, Artificial Sequence
  Description of Artificial Sequence: Synthetic oligonucleotide
  Target: ATXN1; (+) strand; PAM type: NRG; PAM sequence: TAG
ggagtgtagtggtgtgatca

SEQ ID NO: 143377 - DNA, 20 bp, Artificial Sequence
  Description of Artificial Sequence: Synthetic oligonucleotide
  Target: ATXN1; (+) strand; PAM type: NRG; PAM sequence: CGG
agtggtgtgatcatagctca

SEQ ID NO: 143378 - DNA, 20 bp, Artificial Sequence
  Description of Artificial Sequence: Synthetic oligonucleotide
  Target: ATXN1; (+) strand; PAM type: NRG; PAM sequence: AAG
aacctcgaactcctcaactc

SEQ ID NO: 143379 - DNA, 20 bp, Artificial Sequence
  Description of Artificial Sequence: Synthetic oligonucleotide
  Target: ATXN1; (+) strand; PAM type: NRG; PAM sequence: CAG
ctcgaactcctcaactcaag

SEQ ID NO: 143380 - DNA, 20 bp, Artificial Sequence
  Description of Artificial Sequence: Synthetic oligonucleotide
  Target: ATXN1; (+) strand; PAM type: NRG; PAM sequence: CAG
ctcaactcaagcagtcctcc

SEQ ID NO: 143381 - DNA, 20 bp, Artificial Sequence
  Description of Artificial Sequence: Synthetic oligonucleotide
  Target: ATXN1; (+) strand; PAM type: NRG; PAM sequence: CAG
ctcaagcagtcctcccagct

SEQ ID NO: 143382 - DNA, 20 bp, Artificial Sequence
  Description of Artificial Sequence: Synthetic oligonucleotide
  Target: ATXN1; (+) strand; PAM type: NRG; PAM sequence: AAG
tcctcccagctcagcctccc

SEQ ID NO: 143383 - DNA, 20 bp, Artificial Sequence
  Description of Artificial Sequence: Synthetic oligonucleotide
  Target: ATXN1; (+) strand; PAM type: NRG; PAM sequence: TAG
tcccagctcagcctcccaag

SEQ ID NO: 143384 - DNA, 20 bp, Artificial Sequence
  Description of Artificial Sequence: Synthetic oligonucleotide
  Target: ATXN1; (+) strand; PAM type: NRG; PAM sequence: TGG
agctcagcctcccaagtagc

SEQ ID NO: 143385 - DNA, 20 bp, Artificial Sequence
  Description of Artificial Sequence: Synthetic oligonucleotide
  Target: ATXN1; (+) strand; PAM type: NRG; PAM sequence: GGG
gctcagcctcccaagtagct

SEQ ID NO: 143386 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggatta

SEQ ID NO: 143387 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggattac

SEQ ID NO: 143388 - DNA, 20 bp, Artificial Sequence
  Description of Artificial Sequence: Synthetic oligonucleotide
  Target: ATXN1; (+) strand; PAM type: NRG; PAM sequence: CGG
caggtgtgacccatcatgtc

SEQ ID NO: 143389 - DNA, 20 bp, Artificial Sequence
  Description of Artificial Sequence: Synthetic oligonucleotide
  Target: ATXN1; (+) strand; PAM type: NRG; PAM sequence: CAG
tgtgacccatcatgtccggc

SEQ ID NO: 143390 - DNA, 20 bp, Artificial Sequence
  Description of Artificial Sequence: Synthetic oligonucleotide
  Target: ATXN1; (+) strand; PAM type: NRG; PAM sequence: AGG
gtgacccatcatgtccggcc

SEQ ID NO: 143391 - DNA, 20 bp, Artificial Sequence
  Description of Artificial Sequence: Synthetic oligonucleotide
  Target: ATXN1; (+) strand; PAM type: NRG; PAM sequence: TGG
atgtttttgatccatactga

SEQ ID NO: 143392 - DNA, 20 bp, Artificial Sequence
  Description of Artificial Sequence: Synthetic oligonucleotide
  Target: ATXN1; (+) strand; PAM type: NRG; PAM sequence: TGG
tgatggaatattctttattt

SEQ ID NO: 143393 - DNA, 20 bp, Artificial Sequence
  Description of Artificial Sequence: Synthetic oligonucleotide
  Target: ATXN1; (+) strand; PAM type: NRG; PAM sequence: TAG
ctttattttggtctgactct

SEQ ID NO: 143394 - DNA, 20 bp, Artificial Sequence
  Description of Artificial Sequence: Synthetic oligonucleotide
  Target: ATXN1; (+) strand; PAM type: NRG; PAM sequence: AGG
tttattttggtctgactctt

SEQ ID NO: 143395 - DNA, 20 bp, Artificial Sequence
  Description of Artificial Sequence: Synthetic oligonucleotide
  Target: ATXN1; (+) strand; PAM type: NRG; PAM sequence: TGG
aggattgtacccacaaccaa

SEQ ID NO: 143396 - DNA, 20 bp, Artificial Sequence
  Description of Artificial Sequence: Synthetic oligonucleotide
  Target: ATXN1; (+) strand; PAM type: NRG; PAM sequence: AAG
cccacaaccaatggaaacta

SEQ ID NO: 143397 - DNA, 20 bp, Artificial Sequence
  Description of Artificial Sequence: Synthetic oligonucleotide
  Target: ATXN1; (+) strand; PAM type: NRG; PAM sequence: TGG
accaatggaaactaaagcac

SEQ ID NO: 143398 - DNA, 20 bp, Artificial Sequence
  Description of Artificial Sequence: Synthetic oligonucleotide
  Target: ATXN1; (+) strand; PAM type: NRG; PAM sequence: AAG
atggaaactaaagcactgga

SEQ ID NO: 143399 - DNA, 20 bp, Artificial Sequence
  Description of Artificial Sequence: Synthetic oligonucleotide
  Target: ATXN1; (+) strand; PAM type: NRG; PAM sequence: AAG
aaactaaagcactggaaaga

SEQ ID NO: 143400 - DNA, 20 bp, Artificial Sequence
  Description of Artificial Sequence: Synthetic oligonucleotide
  Target: ATXN1; (+) strand; PAM type: NRG; PAM sequence: AAG
tggaaagaaagaatcataaa

SEQ ID NO: 143401 - DNA, 20 bp, Artificial Sequence
  Description of Artificial Sequence: Synthetic oligonucleotide
  Target: ATXN1; (+) strand; PAM type: NRG; PAM sequence: AAG
ctaaatctttctgttaccca

SEQ ID NO: 143402 - DNA, 20 bp, Artificial Sequence
  Description of Artificial Sequence: Synthetic oligonucleotide
  Target: ATXN1; (+) strand; PAM type: NRG; PAM sequence: AAG
aaagtgactgtgttttatta

SEQ ID NO: 143403 - DNA, 20 bp, Artificial Sequence
  Description of Artificial Sequence: Synthetic oligonucleotide
  Target: ATXN1; (+) strand; PAM type: NRG; PAM sequence: AGG
aagtgactgtgttttattaa

SEQ ID NO: 143404 - DNA, 20 bp, Artificial Sequence
  Description of Artificial Sequence: Synthetic oligonucleotide
  Target: ATXN1; (+) strand; PAM type: NRG; PAM sequence: AAG
aggcatgtgatgcatcaccg

SEQ ID NO: 143405 - DNA, 20 bp, Artificial Sequence
  Description of Artificial Sequence: Synthetic oligonucleotide
  Target: ATXN1; (+) strand; PAM type: NRG; PAM sequence: AGG
ggcatgtgatgcatcaccga

SEQ ID NO: 143406 - DNA, 20 bp, Artificial Sequence
  Description of Artificial Sequence: Synthetic oligonucleotide
  Target: ATXN1; (+) strand; PAM type: NRG; PAM sequence: CAG
tgccatttaaaaataccaaa

SEQ ID NO: 143407 - DNA, 20 bp, Artificial Sequence
  Description of Artificial Sequence: Synthetic oligonucleotide
  Target: ATXN1; (+) strand; PAM type: NRG; PAM sequence: TAG
catttaaaaataccaaacag

SEQ ID NO: 143408 - DNA, 20 bp, Artificial Sequence
  Description of Artificial Sequence: Synthetic oligonucleotide
  Target: ATXN1; (+) strand; PAM type: NRG; PAM sequence: CAG
aaaataccaaacagtagtaa

SEQ ID NO: 143409 - DNA, 20 bp, Artificial Sequence
  Description of Artificial Sequence: Synthetic oligonucleotide
  Target: ATXN1; (+) strand; PAM type: NRG; PAM sequence: CAG
aaacagtagtaacagctcaa

SEQ ID NO: 143410 - DNA, 20 bp, Artificial Sequence
  Description of Artificial Sequence: Synthetic oligonucleotide
  Target: ATXN1; (+) strand; PAM type: NRG; PAM sequence: TAG
agtagtaacagctcaacagc

SEQ ID NO: 143411 - DNA, 20 bp, Artificial Sequence
  Description of Artificial Sequence: Synthetic oligonucleotide
  Target: ATXN1; (+) strand; PAM type: NRG; PAM sequence: AGG
gtagtaacagctcaacagct

SEQ ID NO: 143412 - DNA, 20 bp, Artificial Sequence
  Description of Artificial Sequence: Synthetic oligonucleotide
  Target: ATXN1; (+) strand; PAM type: NRG; PAM sequence: TGG
ctaccacttaacctgcaatt

SEQ ID NO: 143413 - DNA, 20 bp, Artificial Sequence
  Description of Artificial Sequence: Synthetic oligonucleotide
  Target: ATXN1; (+) strand; PAM type: NRG; PAM sequence: TGG
ctgcaatttggacaattttg

SEQ ID NO: 143414 - DNA, 20 bp, Artificial Sequence
  Description of Artificial Sequence: Synthetic oligonucleotide
  Target: ATXN1; (+) strand; PAM type: NRG; PAM sequence: GGG
tgcaatttggacaattttgt

SEQ ID NO: 143415 - DNA, 20 bp, Artificial Sequence
  Description of Artificial Sequence: Synthetic oligonucleotide
  Target: ATXN1; (+) strand; PAM type: NRG; PAM sequence: GGG
gcaatttggacaattttgtg

SEQ ID NO: 143416 - DNA, 20 bp, Artificial Sequence
  Description of Artificial Sequence: Synthetic oligonucleotide
  Target: ATXN1; (+) strand; PAM type: NRG; PAM sequence: TGG
ttactttgtcttatgacaca

SEQ ID NO: 143417 - DNA, 20 bp, Artificial Sequence
  Description of Artificial Sequence: Synthetic oligonucleotide
  Target: ATXN1; (+) strand; PAM type: NRG; PAM sequence: GAG
actttgtcttatgacacatg

SEQ ID NO: 143418 - DNA, 20 bp, Artificial Sequence
  Description of Artificial Sequence: Synthetic oligonucleotide
  Target: ATXN1; (+) strand; PAM type: NRG; PAM sequence: CAG
ttgtcttatgacacatggag

SEQ ID NO: 143419 - DNA, 20 bp, Artificial Sequence
  Description of Artificial Sequence: Synthetic oligonucleotide
  Target: ATXN1; (+) strand; PAM type: NRG; PAM sequence: CAG
acacacaaaaatgtctaaaa

SEQ ID NO: 143420 - DNA, 20 bp, Artificial Sequence
  Description of Artificial Sequence: Synthetic oligonucleotide
  Target: ATXN1; (+) strand; PAM type: NRG; PAM sequence: GAG
acacaaaaatgtctaaaaca

SEQ ID NO: 143421 - DNA, 20 bp, Artificial Sequence
  Description of Artificial Sequence: Synthetic oligonucleotide
  Target: ATXN1; (+) strand; PAM type: NRG; PAM sequence: TGG
tttaaaaaaacatatgcatt

SEQ ID NO: 143422 - DNA, 20 bp, Artificial Sequence
  Description of Artificial Sequence: Synthetic oligonucleotide
  Target: ATXN1; (+) strand; PAM type: NRG; PAM sequence: CAG
aaaacatatgcatttggaaa

SEQ ID NO: 143423 - DNA, 20 bp, Artificial Sequence
  Description of Artificial Sequence: Synthetic oligonucleotide
  Target: ATXN1; (+) strand; PAM type: NRG; PAM sequence: AAG
acatatgcatttggaaacag

SEQ ID NO: 143424 - DNA, 20 bp, Artificial Sequence
  Description of Artificial Sequence: Synthetic oligonucleotide
  Target: ATXN1; (+) strand; PAM type: NRG; PAM sequence: TAG
tatgcatttggaaacagaag

SEQ ID NO: 143425 - DNA, 20 bp, Artificial Sequence
  Description of Artificial Sequence: Synthetic oligonucleotide
  Target: ATXN1; (+) strand; PAM type: NRG; PAM sequence: CAG
tttggaaacagaagtagaaa

SEQ ID NO: 143426 - DNA, 20 bp, Artificial Sequence
  Description of Artificial Sequence: Synthetic oligonucleotide
  Target: ATXN1; (+) strand; PAM type: NRG; PAM sequence: AAG
cagaagtagaaacagcttca

SEQ ID NO: 143427 - DNA, 20 bp, Artificial Sequence
  Description of Artificial Sequence: Synthetic oligonucleotide
  Target: ATXN1; (+) strand; PAM type: NRG; PAM sequence: GAG
gaagtagaaacagcttcaaa

SEQ ID NO: 143428 - DNA, 20 bp, Artificial Sequence
  Description of Artificial Sequence: Synthetic oligonucleotide
  Target: ATXN1; (+) strand; PAM type: NRG; PAM sequence: AAG
gaaacagcttcaaagagtat

SEQ ID NO: 143429 - DNA, 20 bp, Artificial Sequence
  Description of Artificial Sequence: Synthetic oligonucleotide
  Target: ATXN1; (+) strand; PAM type: NRG; PAM sequence: TGG
ttcaaagagtataagcaaaa

SEQ ID NO: 143430 - DNA, 20 bp, Artificial Sequence
  Description of Artificial Sequence: Synthetic oligonucleotide
  Target: ATXN1; (+) strand; PAM type: NRG; PAM sequence: AAG
atggcataatacaatgaatg

SEQ ID NO: 143431 - DNA, 20 bp, Artificial Sequence
  Description of Artificial Sequence: Synthetic oligonucleotide
  Target: ATXN1; (+) strand; PAM type: NRG; PAM sequence: GAG
ggcataatacaatgaatgaa

SEQ ID NO: 143432 - DNA, 20 bp, Artificial Sequence
  Description of Artificial Sequence: Synthetic oligonucleotide
  Target: ATXN1; (+) strand; PAM type: NRG; PAM sequence: AAG
aatgaagagtatgttttttt

SEQ ID NO: 143433 - DNA, 20 bp, Artificial Sequence
  Description of Artificial Sequence: Synthetic oligonucleotide
  Target: ATXN1; (+) strand; PAM type: NRG; PAM sequence: AAG
aagagtatgtttttttaaga

SEQ ID NO: 143434 - DNA, 20 bp, Artificial Sequence
  Description of Artificial Sequence: Synthetic oligonucleotide
  Target: ATXN1; (+) strand; PAM type: NRG; PAM sequence: CAG
gtttttttaagaaagtcaat

SEQ ID NO: 143435 - DNA, 20 bp, Artificial Sequence
  Description of Artificial Sequence: Synthetic oligonucleotide
  Target: ATXN1; (+) strand; PAM type: NRG; PAM sequence: AAG
agaaagtcaatcagattcgc

SEQ ID NO: 143436 - DNA, 20 bp, Artificial Sequence
  Description of Artificial Sequence: Synthetic oligonucleotide
  Target: ATXN1; (+) strand; PAM type: NRG; PAM sequence: TAG
agattcgcaagtgaatttta

SEQ ID NO: 143437 - DNA, 20 bp, Artificial Sequence
  Description of Artificial Sequence: Synthetic oligonucleotide
  Target: ATXN1; (+) strand; PAM type: NRG; PAM sequence: AGG
gattcgcaagtgaattttat

SEQ ID NO: 143438 - DNA, 20 bp, Artificial Sequence
  Description of Artificial Sequence: Synthetic oligonucleotide
  Target: ATXN1; (+) strand; PAM type: NRG; PAM sequence: AAG
tataggcctctctctaaata

SEQ ID NO: 143439 - DNA, 20 bp, Artificial Sequence
  Description of Artificial Sequence: Synthetic oligonucleotide
  Target: ATXN1; (+) strand; PAM type: NRG; PAM sequence: TGG
gcctctctctaaataaagta

SEQ ID NO: 143440 - DNA, 20 bp, Artificial Sequence
  Description of Artificial Sequence: Synthetic oligonucleotide
  Target: ATXN1; (+) strand; PAM type: NRG; PAM sequence: AAG
ctaaataaagtatggatttg

SEQ ID NO: 143441 - DNA, 20 bp, Artificial Sequence
  Description of Artificial Sequence: Synthetic oligonucleotide
  Target: ATXN1; (+) strand; PAM type: NRG; PAM sequence: AGG
taaataaagtatggatttga

SEQ ID NO: 143442 - DNA, 20 bp, Artificial Sequence
  Description of Artificial Sequence: Synthetic oligonucleotide
  Target: ATXN1; (+) strand; PAM type: NRG; PAM sequence: CGG
gcttttaatttttttgttaa

SEQ ID NO: 143443 - DNA, 20 bp, Artificial Sequence
  Description of Artificial Sequence: Synthetic oligonucleotide
  Target: ATXN1; (+) strand; PAM type: NRG; PAM sequence: AAG
ttaatttttttgttaacgga

SEQ ID NO: 143444 - DNA, 20 bp, Artificial Sequence
  Description of Artificial Sequence: Synthetic oligonucleotide
  Target: ATXN1; (+) strand; PAM type: NRG; PAM sequence: GAG
aatttttttgttaacggaaa

SEQ ID NO: 143445 - DNA, 20 bp, Artificial Sequence
  Description of Artificial Sequence: Synthetic oligonucleotide
  Target: ATXN1; (+) strand; PAM type: NRG; PAM sequence: AGG
atttttttgttaacggaaag

SEQ ID NO: 143446 - DNA, 20 bp, Artificial Sequence
  Description of Artificial Sequence: Synthetic oligonucleotide
  Target: ATXN1; (+) strand; PAM type: NRG; PAM sequence: GGG
tttttttgttaacggaaaga

SEQ ID NO: 143447 - DNA, 20 bp, Artificial Sequence
  Description of Artificial Sequence: Synthetic oligonucleotide
  Target: ATXN1; (+) strand; PAM type: NRG; PAM sequence: CAG
ttttgttaacggaaagaggg

SEQ ID NO: 143448 - DNA, 20 bp, Artificial Sequence
  Description of Artificial Sequence: Synthetic oligonucleotide
  Target: ATXN1; (+) strand; PAM type: NRG; PAM sequence: CAG
gggcagcccatatcatatac

SEQ ID NO: 143449 - DNA, 20 bp, Artificial Sequence
  Description of Artificial Sequence: Synthetic oligonucleotide
  Target: ATXN1; (+) strand; PAM type: NRG; PAM sequence: CGG
agcccatatcatataccagc

SEQ ID NO: 143450 - DNA, 20 bp, Artificial Sequence
  Description of Artificial Sequence: Synthetic oligonucleotide
  Target: ATXN1; (+) strand; PAM type: NRG; PAM sequence: TAG
ataccagccggtacgttcca

SEQ ID NO: 143451 - DNA, 20 bp, Artificial Sequence
  Description of Artificial Sequence: Synthetic oligonucleotide
  Target: ATXN1; (+) strand; PAM type: NRG; PAM sequence: AGG
taccagccggtacgttccat

SEQ ID NO: 143452 - DNA, 20 bp, Artificial Sequence
  Description of Artificial Sequence: Synthetic oligonucleotide
  Target: ATXN1; (+) strand; PAM type: NRG; PAM sequence: TGG
taggatgttatattccattg

SEQ ID NO: 143453 - DNA, 20 bp, Artificial Sequence
  Description of Artificial Sequence: Synthetic oligonucleotide
  Target: ATXN1; (+) strand; PAM type: NRG; PAM sequence: AAG
ttatgttgtgccaaaattaa

SEQ ID NO: 143454 - DNA, 20 bp, Artificial Sequence
  Description of Artificial Sequence: Synthetic oligonucleotide
  Target: ATXN1; (+) strand; PAM type: NRG; PAM sequence: AGG
tatgttgtgccaaaattaaa

SEQ ID NO: 143455 - DNA, 20 bp, Artificial Sequence
  Description of Artificial Sequence: Synthetic oligonucleotide
  Target: ATXN1; (+) strand; PAM type: NRG; PAM sequence: GAG
tgttgtgccaaaattaaaag

SEQ ID NO: 143456 - DNA, 20 bp, Artificial Sequence
  Description of Artificial Sequence: Synthetic oligonucleotide
  Target: ATXN1; (+) strand; PAM type: NRG; PAM sequence: AGG
gttgtgccaaaattaaaagg

SEQ ID NO: 143457 - DNA, 20 bp, Artificial Sequence
  Description of Artificial Sequence: Synthetic oligonucleotide
  Target: ATXN1; (+) strand; PAM type: NRG; PAM sequence: AAG
aattaaaaggaggataaaaa

SEQ ID NO: 143458 - DNA, 20 bp, Artificial Sequence
  Description of Artificial Sequence: Synthetic oligonucleotide
  Target: ATXN1; (+) strand; PAM type: NRG; PAM sequence: AGG
attaaaaggaggataaaaaa

SEQ ID NO: 143459 - DNA, 20 bp, Artificial Sequence
  Description of Artificial Sequence: Synthetic oligonucleotide
  Target: ATXN1; (+) strand; PAM type: NRG; PAM sequence: TGG
aaaggaggataaaaaaaggt

SEQ ID NO: 143460 - DNA, 20 bp, Artificial Sequence
  Description of Artificial Sequence: Synthetic oligonucleotide
  Target: ATXN1; (+) strand; PAM type: NRG; PAM sequence: GGG
aaggaggataaaaaaaggtt

SEQ ID NO: 143461 - DNA, 20 bp, Artificial Sequence
  Description of Artificial Sequence: Synthetic oligonucleotide
  Target: ATXN1; (+) strand; PAM type: NRG; PAM sequence: AAG
gttgggataatttgttttta

SEQ ID NO: 143462 - DNA, 20 bp, Artificial Sequence
  Description of Artificial Sequence: Synthetic oligonucleotide
  Target: ATXN1; (+) strand; PAM type: NRG; PAM sequence: AGG
ttgggataatttgtttttaa

SEQ ID NO: 143463 - DNA, 20 bp, Artificial Sequence
  Description of Artificial Sequence: Synthetic oligonucleotide
  Target: ATXN1; (+) strand; PAM type: NRG; PAM sequence: TGG
gataatttgtttttaaaggt

SEQ ID NO: 143464 - DNA, 20 bp, Artificial Sequence
  Description of Artificial Sequence: Synthetic oligonucleotide
  Target: ATXN1; (+) strand; PAM type: NRG; PAM sequence: GGG
ataatttgtttttaaaggtt

SEQ ID NO: 143465 - DNA, 20 bp, Artificial Sequence
  Description of Artificial Sequence: Synthetic oligonucleotide
  Target: ATXN1; (+) strand; PAM type: NRG; PAM sequence: TGG
tttaaaggttgggataaatt

SEQ ID NO: 143466 - DNA, 20 bp, Artificial Sequence
  Description of Artificial Sequence: Synthetic oligonucleotide
  Target: ATXN1; (+) strand; PAM type: NRG; PAM sequence: GGG
ttaaaggttgggataaattt

SEQ ID NO: 143467 - DNA, 20 bp, Artificial Sequence
  Description of Artificial Sequence: Synthetic oligonucleotide
  Target: ATXN1; (+) strand; PAM type: NRG; PAM sequence: AAG
aggttgggataaatttggga

SEQ ID NO: 143468 - DNA, 20 bp, Artificial Sequence
  Description of Artificial Sequence: Synthetic oligonucleotide
  Target: ATXN1; (+) strand; PAM type: NRG; PAM sequence: TGG
gataaatttgggaaagactt

SEQ ID NO: 143469 - DNA, 20 bp, Artificial Sequence
  Description of Artificial Sequence: Synthetic oligonucleotide
  Target: ATXN1; (+) strand; PAM type: NRG; PAM sequence: GAG
taaatttgggaaagactttg

SEQ ID NO: 143470 - DNA, 20 bp, Artificial Sequence
  Description of Artificial Sequence: Synthetic oligonucleotide
  Target: ATXN1; (+) strand; PAM type: NRG; PAM sequence: AGG
aaatttgggaaagactttgg

SEQ ID NO: 143471 - DNA, 20 bp, Artificial Sequence
  Description of Artificial Sequence: Synthetic oligonucleotide
  Target: ATXN1; (+) strand; PAM type: NRG; PAM sequence: GGG
aatttgggaaagactttgga

SEQ ID NO: 143472 - DNA, 20 bp, Artificial Sequence
  Description of Artificial Sequence: Synthetic oligonucleotide
  Target: ATXN1; (+) strand; PAM type: NRG; PAM sequence: GAG
catgtgtattgtaaatctat

SEQ ID NO: 143473 - DNA, 20 bp, Artificial Sequence
  Description of Artificial Sequence: Synthetic oligonucleotide
  Target: ATXN1; (+) strand; PAM type: NRG; PAM sequence: AGG
atgtgtattgtaaatctatg

SEQ ID NO: 143474 - DNA, 20 bp, Artificial Sequence
  Description of Artificial Sequence: Synthetic oligonucleotide
  Target: ATXN1; (+) strand; PAM type: NRG; PAM sequence: GGG
tgtgtattgtaaatctatga

SEQ ID NO: 143475 - DNA, 20 bp, Artificial Sequence
  Description of Artificial Sequence: Synthetic oligonucleotide
  Target: ATXN1; (+) strand; PAM type: NRG; PAM sequence: GGG
gtgtattgtaaatctatgag

SEQ ID NO: 143476 - DNA, 20 bp, Artificial Sequence
  Description of Artificial Sequence: Synthetic oligonucleotide
  Target: ATXN1; (+) strand; PAM type: NRG; PAM sequence: GAG
gtattgtaaatctatgaggg

SEQ ID NO: 143477 - DNA, 20 bp, Artificial Sequence
  Description of Artificial Sequence: Synthetic oligonucleotide
  Target: ATXN1; (+) strand; PAM type: NRG; PAM sequence: AAG
tgtaaatctatgaggggaga

SEQ ID NO: 143478 - DNA, 20 bp, Artificial Sequence
  Description of Artificial Sequence: Synthetic oligonucleotide
  Target: ATXN1; (+) strand; PAM type: NRG; PAM sequence: TAG
gaggggagaaagcactcatc

SEQ ID NO: 143479 - DNA, 20 bp, Artificial Sequence
  Description of Artificial Sequence: Synthetic oligonucleotide
  Target: ATXN1; (+) strand; PAM type: NRG; PAM sequence: AGG
aggggagaaagcactcatct

SEQ ID NO: 143480 - DNA, 20 bp, Artificial Sequence
  Description of Artificial Sequence: Synthetic oligonucleotide
  Target: ATXN1; (+) strand; PAM type: NRG; PAM sequence: CAG
gcccaaaatatattttacca

SEQ ID NO: 143481 - DNA, 20 bp, Artificial Sequence
  Description of Artificial Sequence: Synthetic oligonucleotide
  Target: ATXN1; (+) strand; PAM type: NRG; PAM sequence: CAG
ttaccacagaacactttttc

SEQ ID NO: 143482 - DNA, 20 bp, Artificial Sequence
  Description of Artificial Sequence: Synthetic oligonucleotide
  Target: ATXN1; (+) strand; PAM type: NRG; PAM sequence: AAG
ccacagaacactttttccag

SEQ ID NO: 143483 - DNA, 20 bp, Artificial Sequence
  Description of Artificial Sequence: Synthetic oligonucleotide
  Target: ATXN1; (+) strand; PAM type: NRG; PAM sequence: AAG
agaacactttttccagaaga

SEQ ID NO: 143484 - DNA, 20 bp, Artificial Sequence
  Description of Artificial Sequence: Synthetic oligonucleotide
  Target: ATXN1; (+) strand; PAM type: NRG; PAM sequence: AGG
gaacactttttccagaagaa

SEQ ID NO: 143485 - DNA, 20 bp, Artificial Sequence
  Description of Artificial Sequence: Synthetic oligonucleotide
  Target: ATXN1; (+) strand; PAM type: NRG; PAM sequence: CAG
ttccagaagaaaggtgaaac

SEQ ID NO: 143486 - DNA, 20 bp, Artificial Sequence
  Description of Artificial Sequence: Synthetic oligonucleotide
  Target: ATXN1; (+) strand; PAM type: NRG; PAM sequence: TGG
cagaagaaaggtgaaaccag

SEQ ID NO: 143487 - DNA, 20 bp, Artificial Sequence
  Description of Artificial Sequence: Synthetic oligonucleotide
  Target: ATXN1; (+) strand; PAM type: NRG; PAM sequence: CAG
aaaggtgaaaccagtggaca

SEQ ID NO: 143488 - DNA, 20 bp, Artificial Sequence
  Description of Artificial Sequence: Synthetic oligonucleotide
  Target: ATXN1; (+) strand; PAM type: NRG; PAM sequence: AGG
aaggtgaaaccagtggacac

SEQ ID NO: 143489 - DNA, 20 bp, Artificial Sequence
  Description of Artificial Sequence: Synthetic oligonucleotide
  Target: ATXN1; (+) strand; PAM type: NRG; PAM sequence: GGG
aggtgaaaccagtggacaca

SEQ ID NO: 143490 - DNA, 20 bp, Artificial Sequence
  Description of Artificial Sequence: Synthetic oligonucleotide
  Target: ATXN1; (+) strand; PAM type: NRG; PAM sequence: TAG
aaaccagtggacacagggtg

SEQ ID NO: 143491 - DNA, 20 bp, Artificial Sequence
  Description of Artificial Sequence: Synthetic oligonucleotide
  Target: ATXN1; (+) strand; PAM type: NRG; PAM sequence: CAG
cacagggtgtagacactgac

SEQ ID NO: 143492 - DNA, 20 bp, Artificial Sequence
  Description of Artificial Sequence: Synthetic oligonucleotide
  Target: ATXN1; (+) strand; PAM type: NRG; PAM sequence: TAG
ggtgtagacactgaccagac

SEQ ID NO: 143493 - DNA, 20 bp, Artificial Sequence
  Description of Artificial Sequence: Synthetic oligonucleotide
  Target: ATXN1; (+) strand; PAM type: NRG; PAM sequence: AGG
gtgtagacactgaccagact

SEQ ID NO: 143494 - DNA, 20 bp, Artificial Sequence
  Description of Artificial Sequence: Synthetic oligonucleotide
  Target: ATXN1; (+) strand; PAM type: NRG; PAM sequence: CAG
agacactgaccagactaggc

SEQ ID NO: 143495 - DNA, 20 bp, Artificial Sequence
  Description of Artificial Sequence: Synthetic oligonucleotide
  Target: ATXN1; (+) strand; PAM type: NRG; PAM sequence: TGG
cactgaccagactaggccag

SEQ ID NO: 143496 - DNA, 20 bp, Artificial Sequence
  Description of Artificial Sequence: Synthetic oligonucleotide
  Target: ATXN1; (+) strand; PAM type: NRG; PAM sequence: TGG
gccagtggtcctcacacttt

SEQ ID NO: 143497 - DNA, 20 bp, Artificial Sequence
  Description of Artificial Sequence: Synthetic oligonucleotide
  Target: ATXN1; (+) strand; PAM type: NRG; PAM sequence: AAG
cttttggtcctcacacttaa

SEQ ID NO: 143498 - DNA, 20 bp, Artificial Sequence
  Description of Artificial Sequence: Synthetic oligonucleotide
  Target: ATXN1; (+) strand; PAM type: NRG; PAM sequence: TGG
cctcacacttaaaagctcct

SEQ ID NO: 143499 - DNA, 20 bp, Artificial Sequence
  Description of Artificial Sequence: Synthetic oligonucleotide
  Target: ATXN1; (+) strand; PAM type: NRG; PAM sequence: GGG
ctcacacttaaaagctcctt

SEQ ID NO: 143500 - DNA, 20 bp, Artificial Sequence
  Description of Artificial Sequence: Synthetic oligonucleotide
  Target: ATXN1; (+) strand; PAM type: NRG; PAM sequence: AAG
ttgggtcctcaataaatttt

SEQ ID NO: 143501 - DNA, 20 bp, Artificial Sequence
  Description of Artificial Sequence: Synthetic oligonucleotide
  Target: ATXN1; (+) strand; PAM type: NRG; PAM sequence: GAG
gggtcctcaataaattttaa

SEQ ID NO: 143502 - DNA, 20 bp, Artificial Sequence
  Description of Artificial Sequence: Synthetic oligonucleotide
  Target: ATXN1; (+) strand; PAM type: NRG; PAM sequence: AAG
caataaattttaagagtata

SEQ ID NO: 143503 - DNA, 20 bp, Artificial Sequence
  Description of Artificial Sequence: Synthetic oligonucleotide
  Target: ATXN1; (+) strand; PAM type: NRG; PAM sequence: GAG
ctatactcctaaaatttatt

SEQ ID NO: 143504 - DNA, 20 bp, Artificial Sequence
  Description of Artificial Sequence: Synthetic oligonucleotide
  Target: ATXN1; (+) strand; PAM type: NRG; PAM sequence: AGG
tatactcctaaaatttattg

SEQ ID NO: 143505 - DNA, 20 bp, Artificial Sequence
  Description of Artificial Sequence: Synthetic oligonucleotide
  Target: ATXN1; (+) strand; PAM type: NRG; PAM sequence: AAG
taaaatttattgaggacccc

SEQ ID NO: 143506 - DNA, 20 bp, Artificial Sequence
  Description of Artificial Sequence: Synthetic oligonucleotide
  Target: ATXN1; (+) strand; PAM type: NRG; PAM sequence: AGG
aaaatttattgaggacccca

SEQ ID NO: 143507 - DNA, 20 bp, Artificial Sequence
  Description of Artificial Sequence: Synthetic oligonucleotide
  Target: ATXN1; (+) strand; PAM type: NRG; PAM sequence: TAG
gaccccaaggaacttttcat

SEQ ID NO: 143508 - DNA, 20 bp, Artificial Sequence
  Description of Artificial Sequence: Synthetic oligonucleotide
  Target: ATXN1; (+) strand; PAM type: NRG; PAM sequence: AGG
accccaaggaacttttcatt

SEQ ID NO: 143509 - DNA, 20 bp, Artificial Sequence
  Description of Artificial Sequence: Synthetic oligonucleotide
  Target: ATXN1; (+) strand; PAM type: NRG; PAM sequence: TAG
ccaaggaacttttcattagg

SEQ ID NO: 143510 - DNA, 20 bp, Artificial Sequence
  Description of Artificial Sequence: Synthetic oligonucleotide
  Target: ATXN1; (+) strand; PAM type: NRG; PAM sequence: TAG
taacaactattataccatat

SEQ ID NO: 143511 - DNA, 20 bp, Artificial Sequence
  Description of Artificial Sequence: Synthetic oligonucleotide
  Target: ATXN1; (+) strand; PAM type: NRG; PAM sequence: AAG
caactattataccatattag

SEQ ID NO: 143512 - DNA, 20 bp, Artificial Sequence
  Description of Artificial Sequence: Synthetic oligonucleotide
  Target: ATXN1; (+) strand; PAM type: NRG; PAM sequence: GAG
accatattagaagcaaaatt

SEQ ID NO: 143513 - DNA, 20 bp, Artificial Sequence
  Description of Artificial Sequence: Synthetic oligonucleotide
  Target: ATXN1; (+) strand; PAM type: NRG; PAM sequence: TAG
gaaaaatgtaaaatattcat

SEQ ID NO: 143514 - DNA, 20 bp, Artificial Sequence
  Description of Artificial Sequence: Synthetic oligonucleotide
  Target: ATXN1; (+) strand; PAM type: NRG; PAM sequence: TAG
atattcattagttcatttaa

SEQ ID NO: 143515 - DNA, 20 bp, Artificial Sequence
  Description of Artificial Sequence: Synthetic oligonucleotide
  Target: ATXN1; (+) strand; PAM type: NRG; PAM sequence: CAG
gaaaaaataattatattttt

SEQ ID NO: 143516 - DNA, 20 bp, Artificial Sequence
  Description of Artificial Sequence: Synthetic oligonucleotide
  Target: ATXN1; (+) strand; PAM type: NRG; PAM sequence: AAG
ttatatttttcagaacaaaa

SEQ ID NO: 143517 - DNA, 20 bp, Artificial Sequence
  Description of Artificial Sequence: Synthetic oligonucleotide
  Target: ATXN1; (+) strand; PAM type: NRG; PAM sequence: TAG
atttttcagaacaaaaaagt

SEQ ID NO: 143518 - DNA, 20 bp, Artificial Sequence
  Description of Artificial Sequence: Synthetic oligonucleotide
  Target: ATXN1; (+) strand; PAM type: NRG; PAM sequence: AAG
agaacaaaaaagttagtgac

SEQ ID NO: 143519 - DNA, 20 bp, Artificial Sequence
  Description of Artificial Sequence: Synthetic oligonucleotide
  Target: ATXN1; (+) strand; PAM type: NRG; PAM sequence: GAG
aacaaaaaagttagtgacaa

SEQ ID NO: 143520 - DNA, 20 bp, Artificial Sequence
  Description of Artificial Sequence: Synthetic oligonucleotide
  Target: ATXN1; (+) strand; PAM type: NRG; PAM sequence: GAG
aaaaagttagtgacaagagt

SEQ ID NO: 143521 - DNA, 20 bp, Artificial Sequence
  Description of Artificial Sequence: Synthetic oligonucleotide
  Target: ATXN1; (+) strand; PAM type: NRG; PAM sequence: TAG
tgacaagagtgagatccatt

SEQ ID NO: 143522 - DNA, 20 bp, Artificial Sequence
  Description of Artificial Sequence: Synthetic oligonucleotide
  Target: ATXN1; (+) strand; PAM type: NRG; PAM sequence: CAG
gagatccatttagatttttg

SEQ ID NO: 143523 - DNA, 20 bp, Artificial Sequence
  Description of Artificial Sequence: Synthetic oligonucleotide
  Target: ATXN1; (+) strand; PAM type: NRG; PAM sequence: TGG
ttgcagctctctttaatgcc

SEQ ID NO: 143524 - DNA, 20 bp, Artificial Sequence
  Description of Artificial Sequence: Synthetic oligonucleotide
  Target: ATXN1; (+) strand; PAM type: NRG; PAM sequence: TGG
ctctttaatgcctggcttaa

SEQ ID NO: 143525 - DNA, 20 bp, Artificial Sequence
  Description of Artificial Sequence: Synthetic oligonucleotide
  Target: ATXN1; (+) strand; PAM type: NRG; PAM sequence: TGG
atgcctggcttaatggaaaa

SEQ ID NO: 143526 - DNA, 20 bp, Artificial Sequence
  Description of Artificial Sequence: Synthetic oligonucleotide
  Target: ATXN1; (+) strand; PAM type: NRG; PAM sequence: CAG
ctcttctgtgcctctgaatt

SEQ ID NO: 143527 - DNA, 20 bp, Artificial Sequence
  Description of Artificial Sequence: Synthetic oligonucleotide
  Target: ATXN1; (+) strand; PAM type: NRG; PAM sequence: TGG
gttttctgtgatatgttgtt

SEQ ID NO: 143528 - DNA, 20 bp, Artificial Sequence
  Description of Artificial Sequence: Synthetic oligonucleotide
  Target: ATXN1; (+) strand; PAM type: NRG; PAM sequence: AAG
tgtgatatgttgtttggttg

SEQ ID NO: 143529 - DNA, 20 bp, Artificial Sequence
  Description of Artificial Sequence: Synthetic oligonucleotide
  Target: ATXN1; (+) strand; PAM type: NRG; PAM sequence: TGG
tgttgtttggttgaagtatg

SEQ ID NO: 143530 - DNA, 20 bp, Artificial Sequence
  Description of Artificial Sequence: Synthetic oligonucleotide
  Target: ATXN1; (+) strand; PAM type: NRG; PAM sequence: GAG
ttgtttggttgaagtatgtg

SEQ ID NO: 143531 - DNA, 20 bp, Artificial Sequence
  Description of Artificial Sequence: Synthetic oligonucleotide
  Target: ATXN1; (+) strand; PAM type: NRG; PAM sequence: AAG
tttggttgaagtatgtggag

SEQ ID NO: 143532 - DNA, 20 bp, Artificial Sequence
  Description of Artificial Sequence: Synthetic oligonucleotide
  Target: ATXN1; (+) strand; PAM type: NRG; PAM sequence: TGG
tgaagtatgtggagaagatg

SEQ ID NO: 143533 - DNA, 20 bp, Artificial Sequence
  Description of Artificial Sequence: Synthetic oligonucleotide
  Target: ATXN1; (+) strand; PAM type: NRG; PAM sequence: TAG
tgtggagaagatgtggccaa

SEQ ID NO: 143534 - DNA, 20 bp, Artificial Sequence
  Description of Artificial Sequence: Synthetic oligonucleotide
  Target: ATXN1; (+) strand; PAM type: NRG; PAM sequence: CAG
gaagatgtggccaatagttt

SEQ ID NO: 143535 - DNA, 20 bp, Artificial Sequence
  Description of Artificial Sequence: Synthetic oligonucleotide
  Target: ATXN1; (+) strand; PAM type: NRG; PAM sequence: TGG
gccaatagtttcagcaattg

SEQ ID NO: 143536 - DNA, 20 bp, Artificial Sequence
  Description of Artificial Sequence: Synthetic oligonucleotide
  Target: ATXN1; (+) strand; PAM type: NRG; PAM sequence: AAG
atatcataccaaaactcaat

SEQ ID NO: 143537 - DNA, 20 bp, Artificial Sequence
  Description of Artificial Sequence: Synthetic oligonucleotide
  Target: ATXN1; (+) strand; PAM type: NRG; PAM sequence: TGG
tcataccaaaactcaataag

SEQ ID NO: 143538 - DNA, 20 bp, Artificial Sequence
  Description of Artificial Sequence: Synthetic oligonucleotide
  Target: ATXN1; (+) strand; PAM type: NRG; PAM sequence: TAG
taccaaaactcaataagtgg

SEQ ID NO: 143539 - DNA, 20 bp, Artificial Sequence
  Description of Artificial Sequence: Synthetic oligonucleotide
  Target: ATXN1; (+) strand; PAM type: NRG; PAM sequence: AAG
caataagtggtagtttctta

SEQ ID NO: 143540 - DNA, 20 bp, Artificial Sequence
  Description of Artificial Sequence: Synthetic oligonucleotide
  Target: ATXN1; (+) strand; PAM type: NRG; PAM sequence: AGG
aataagtggtagtttcttaa

SEQ ID NO: 143541 - DNA, 20 bp, Artificial Sequence
  Description of Artificial Sequence: Synthetic oligonucleotide
  Target: ATXN1; (+) strand; PAM type: NRG; PAM sequence: GGG
ataagtggtagtttcttaaa

SEQ ID NO: 143542 - DNA, 20 bp, Artificial Sequence
  Description of Artificial Sequence: Synthetic oligonucleotide
  Target: ATXN1; (+) strand; PAM type: NRG; PAM sequence: GGG
taagtggtagtttcttaaag

SEQ ID NO: 143543 - DNA, 20 bp, Artificial Sequence
  Description of Artificial Sequence: Synthetic oligonucleotide
  Target: ATXN1; (+) strand; PAM type: NRG; PAM sequence: GAG
agtggtagtttcttaaaggg

SEQ ID NO: 143544 - DNA, 20 bp, Artificial Sequence
  Description of Artificial Sequence: Synthetic oligonucleotide
  Target: ATXN1; (+) strand; PAM type: NRG; PAM sequence: CAG
ggtagtttcttaaaggggag

SEQ ID NO: 143545 - DNA, 20 bp, Artificial Sequence
  Description of Artificial Sequence: Synthetic oligonucleotide
  Target: ATXN1; (+) strand; PAM type: NRG; PAM sequence: TGG
cttaaaggggagcagcacca

SEQ ID NO: 143546 - DNA, 20 bp, Artificial Sequence
  Description of Artificial Sequence: Synthetic oligonucleotide
  Target: ATXN1; (+) strand; PAM type: NRG; PAM sequence: AAG
gagcagcaccatggaatctg

SEQ ID NO: 143547 - DNA, 20 bp, Artificial Sequence
  Description of Artificial Sequence: Synthetic oligonucleotide
  Target: ATXN1; (+) strand; PAM type: NRG; PAM sequence: TAG
gcaccatggaatctgaagca

SEQ ID NO: 143548 - DNA, 20 bp, Artificial Sequence
  Description of Artificial Sequence: Synthetic oligonucleotide
  Target: ATXN1; (+) strand; PAM type: NRG; PAM sequence: AAG
gaagcatagaaataaactct

SEQ ID NO: 143549 - DNA, 20 bp, Artificial Sequence
  Description of Artificial Sequence: Synthetic oligonucleotide
  Target: ATXN1; (+) strand; PAM type: NRG; PAM sequence: TAG
tcttttatattaaaattcat

SEQ ID NO: 143550 - DNA, 20 bp, Artificial Sequence
  Description of Artificial Sequence: Synthetic oligonucleotide
  Target: ATXN1; (+) strand; PAM type: NRG; PAM sequence: TGG
cattagtctatcttgaactt

SEQ ID NO: 143551 - DNA, 20 bp, Artificial Sequence
  Description of Artificial Sequence: Synthetic oligonucleotide
  Target: ATXN1; (+) strand; PAM type: NRG; PAM sequence: TGG
agtctatcttgaactttgga

SEQ ID NO: 143552 - DNA, 20 bp, Artificial Sequence
  Description of Artificial Sequence: Synthetic oligonucleotide
  Target: ATXN1; (+) strand; PAM type: NRG; PAM sequence: TAG
ttgaactttggatggatctt

SEQ ID NO: 143553 - DNA, 20 bp, Artificial Sequence
  Description of Artificial Sequence: Synthetic oligonucleotide
  Target: ATXN1; (+) strand; PAM type: NRG; PAM sequence: TGG
gattttgtaacatcataccc

SEQ ID NO: 143554 - DNA, 20 bp, Artificial Sequence
  Description of Artificial Sequence: Synthetic oligonucleotide
  Target: ATXN1; (+) strand; PAM type: NRG; PAM sequence: TGG
aacatcataccctggtcatt

SEQ ID NO: 143555 - DNA, 20 bp, Artificial Sequence
  Description of Artificial Sequence: Synthetic oligonucleotide
  Target: ATXN1; (+) strand; PAM type: NRG; PAM sequence: TAG
ggtcatttggaaaattatat

SEQ ID NO: 143556 - DNA, 20 bp, Artificial Sequence
  Description of Artificial Sequence: Synthetic oligonucleotide
  Target: ATXN1; (+) strand; PAM type: NRG; PAM sequence: CAG
tttggaaaattatattagtt

SEQ ID NO: 143557 - DNA, 20 bp, Artificial Sequence
  Description of Artificial Sequence: Synthetic oligonucleotide
  Target: ATXN1; (+) strand; PAM type: NRG; PAM sequence: AAG
gaattatgcaaatcttccaa

SEQ ID NO: 143558 - DNA, 20 bp, Artificial Sequence
  Description of Artificial Sequence: Synthetic oligonucleotide
  Target: ATXN1; (+) strand; PAM type: NRG; PAM sequence: TAG
caatatcatcacacatcata

SEQ ID NO: 143559 - DNA, 20 bp, Artificial Sequence
  Description of Artificial Sequence: Synthetic oligonucleotide
  Target: ATXN1; (+) strand; PAM type: NRG; PAM sequence: TGG
gaaaaactccgctgtacaca

SEQ ID NO: 143560 - DNA, 20 bp, Artificial Sequence
  Description of Artificial Sequence: Synthetic oligonucleotide
  Target: ATXN1; (+) strand; PAM type: NRG; PAM sequence: AAG
aaactccgctgtacacatgg

SEQ ID NO: 143561 - DNA, 20 bp, Artificial Sequence
  Description of Artificial Sequence: Synthetic oligonucleotide
  Target: ATXN1; (+) strand; PAM type: NRG; PAM sequence: GAG
actccgctgtacacatggaa

SEQ ID NO: 143562 - DNA, 20 bp, Artificial Sequence
  Description of Artificial Sequence: Synthetic oligonucleotide
  Target: ATXN1; (+) strand; PAM type: NRG; PAM sequence: TGG
gctgtacacatggaagagaa

SEQ ID NO: 143563 - DNA, 20 bp, Artificial Sequence
  Description of Artificial Sequence: Synthetic oligonucleotide
  Target: ATXN1; (+) strand; PAM type: NRG; PAM sequence: GGG
ctgtacacatggaagagaat

SEQ ID NO: 143564 - DNA, 20 bp, Artificial Sequence
  Description of Artificial Sequence: Synthetic oligonucleotide
  Target: ATXN1; (+) strand; PAM type: NRG; PAM sequence: TGG
cacatggaagagaatgggaa

SEQ ID NO: 143565 - DNA, 20 bp, Artificial Sequence
  Description of Artificial Sequence: Synthetic oligonucleotide
  Target: ATXN1; (+) strand; PAM type: NRG; PAM sequence: TAG
ggaagagaatgggaatggaa

SEQ ID NO: 143566 - DNA, 20 bp, Artificial Sequence
  Description of Artificial Sequence: Synthetic oligonucleotide
  Target: ATXN1; (+) strand; PAM type: NRG; PAM sequence: AGG
gaagagaatgggaatggaat

SEQ ID NO: 143567 - DNA, 20 bp, Artificial Sequence
  Description of Artificial Sequence: Synthetic oligonucleotide
  Target: ATXN1; (+) strand; PAM type: NRG; PAM sequence: TAG
ggaataggtaaataatgtct

SEQ ID NO: 143568 - DNA, 20 bp, Artificial Sequence
  Description of Artificial Sequence: Synthetic oligonucleotide
  Target: ATXN1; (+) strand; PAM type: NRG; PAM sequence: CAG
taaaaataatcttgatctta

SEQ ID NO: 143569 - DNA, 20 bp, Artificial Sequence
  Description of Artificial Sequence: Synthetic oligonucleotide
  Target: ATXN1; (+) strand; PAM type: NRG; PAM sequence: CAG
tgatcttacagatgtccctc

SEQ ID NO: 143570 - DNA, 20 bp, Artificial Sequence
  Description of Artificial Sequence: Synthetic oligonucleotide
  Target: ATXN1; (+) strand; PAM type: NRG; PAM sequence: AAG
ttacagatgtccctccagaa

SEQ ID NO: 143571 - DNA, 20 bp, Artificial Sequence
  Description of Artificial Sequence: Synthetic oligonucleotide
  Target: ATXN1; (+) strand; PAM type: NRG; PAM sequence: AGG
tacagatgtccctccagaaa

SEQ ID NO: 143572 - DNA, 20 bp, Artificial Sequence
  Description of Artificial Sequence: Synthetic oligonucleotide
  Target: ATXN1; (+) strand; PAM type: NRG; PAM sequence: TGG
tgtccctccagaaaaggtct

SEQ ID NO: 143573 - DNA, 20 bp, Artificial Sequence
  Description of Artificial Sequence: Synthetic oligonucleotide
  Target: ATXN1; (+) strand; PAM type: NRG; PAM sequence: GGG
gtccctccagaaaaggtctt

SEQ ID NO: 143574 - DNA, 20 bp, Artificial Sequence
  Description of Artificial Sequence: Synthetic oligonucleotide
  Target: ATXN1; (+) strand; PAM type: NRG; PAM sequence: TGG
cctccagaaaaggtcttggg

SEQ ID NO: 143575 - DNA, 20 bp, Artificial Sequence
  Description of Artificial Sequence: Synthetic oligonucleotide
  Target: ATXN1; (+) strand; PAM type: NRG; PAM sequence: GGG
ctccagaaaaggtcttgggt

SEQ ID NO: 143576 - DNA, 20 bp, Artificial Sequence
  Description of Artificial Sequence: Synthetic oligonucleotide
  Target: ATXN1; (+) strand; PAM type: NRG; PAM sequence: GGG
tccagaaaaggtcttgggtg

SEQ ID NO: 143577 - DNA, 20 bp, Artificial Sequence
  Description of Artificial Sequence: Synthetic oligonucleotide
  Target: ATXN1; (+) strand; PAM type: NRG; PAM sequence: GGG
ccagaaaaggtcttgggtgg

SEQ ID NO: 143578 - DNA, 20 bp, Artificial Sequence
  Description of Artificial Sequence: Synthetic oligonucleotide
  Target: ATXN1; (+) strand; PAM type: NRG; PAM sequence: TGG
gaaaaggtcttgggtggggg

SEQ ID NO: 143579 - DNA, 20 bp, Artificial Sequence
  Description of Artificial Sequence: Synthetic oligonucleotide
  Target: ATXN1; (+) strand; PAM type: NRG; PAM sequence: GGG
aaaaggtcttgggtgggggt

SEQ ID NO: 143580 - DNA, 20 bp, Artificial Sequence
  Description of Artificial Sequence: Synthetic oligonucleotide
  Target: ATXN1; (+) strand; PAM type: NRG; PAM sequence: GGG
aaaggtcttgggtgggggtg

SEQ ID NO: 143581 - DNA, 20 bp, Artificial Sequence
  Description of Artificial Sequence: Synthetic oligonucleotide
  Target: ATXN1; (+) strand; PAM type: NRG; PAM sequence: GGG
aaggtcttgggtgggggtgg

SEQ ID NO: 143582 - DNA, 20 bp, Artificial Sequence
  Description of Artificial Sequence: Synthetic oligonucleotide
  Target: ATXN1; (+) strand; PAM type: NRG; PAM sequence: GGG
aggtcttgggtgggggtggg

SEQ ID NO: 143583 - DNA, 20 bp, Artificial Sequence
  Description of Artificial Sequence: Synthetic oligonucleotide
  Target: ATXN1; (+) strand; PAM type: NRG; PAM sequence: GGG
ggtcttgggtgggggtgggg

SEQ ID NO: 143584 - DNA, 20 bp, Artificial Sequence
  Description of Artificial Sequence: Synthetic oligonucleotide
  Target: ATXN1; (+) strand; PAM type: NRG; PAM sequence: AAG
tgggggtgggggggttccca

SEQ ID NO: 143585 - DNA, 20 bp, Artificial Sequence
  Description of Artificial Sequence: Synthetic oligonucleotide
  Target: ATXN1; (+) strand; PAM type: NRG; PAM sequence: GAG
ggtgggggggttcccaaagt

SEQ ID NO: 143586 - DNA, 20 bp, Artificial Sequence
  Description of Artificial Sequence: Synthetic oligonucleotide
  Target: ATXN1; (+) strand; PAM type: NRG; PAM sequence: CAG
ccaaagtgagaactgctgac

SEQ ID NO: 143587 - DNA, 20 bp, Artificial Sequence
  Description of Artificial Sequence: Synthetic oligonucleotide
  Target: ATXN1; (+) strand; PAM type: NRG; PAM sequence: AGG
caaagtgagaactgctgacc

SEQ ID NO: 143588 - DNA, 20 bp, Artificial Sequence
  Description of Artificial Sequence: Synthetic oligonucleotide
  Target: ATXN1; (+) strand; PAM type: NRG; PAM sequence: CAG
agtgagaactgctgaccagg

SEQ ID NO: 143589 - DNA, 20 bp, Artificial Sequence
  Description of Artificial Sequence: Synthetic oligonucleotide
  Target: ATXN1; (+) strand; PAM type: NRG; PAM sequence: CAG
ggcagacattctaaacccca

SEQ ID NO: 143590 - DNA, 20 bp, Artificial Sequence
  Description of Artificial Sequence: Synthetic oligonucleotide
  Target: ATXN1; (+) strand; PAM type: NRG; PAM sequence: TGG
taaaccccacagatccctac

SEQ ID NO: 143591 - DNA, 20 bp, Artificial Sequence
  Description of Artificial Sequence: Synthetic oligonucleotide
  Target: ATXN1; (+) strand; PAM type: NRG; PAM sequence: AAG
accccacagatccctactgg

SEQ ID NO: 143592 - DNA, 20 bp, Artificial Sequence
  Description of Artificial Sequence: Synthetic oligonucleotide
  Target: ATXN1; (+) strand; PAM type: NRG; PAM sequence: AAG
cagatccctactggaagtaa

SEQ ID NO: 143593 - DNA, 20 bp, Artificial Sequence
  Description of Artificial Sequence: Synthetic oligonucleotide
  Target: ATXN1; (+) strand; PAM type: NRG; PAM sequence: CAG
ccctactggaagtaaaagca

SEQ ID NO: 143594 - DNA, 20 bp, Artificial Sequence
  Description of Artificial Sequence: Synthetic oligonucleotide
  Target: ATXN1; (+) strand; PAM type: NRG; PAM sequence: TAG
gaagtaaaagcacagaactc

SEQ ID NO: 143595 - DNA, 20 bp, Artificial Sequence
  Description of Artificial Sequence: Synthetic oligonucleotide
  Target: ATXN1; (+) strand; PAM type: NRG; PAM sequence: AGG
aagtaaaagcacagaactct

SEQ ID NO: 143596 - DNA, 20 bp, Artificial Sequence
  Description of Artificial Sequence: Synthetic oligonucleotide
  Target: ATXN1; (+) strand; PAM type: NRG; PAM sequence: TGG
cagaactctaggtttccttc

SEQ ID NO: 143597 - DNA, 20 bp, Artificial Sequence
  Description of Artificial Sequence: Synthetic oligonucleotide
  Target: ATXN1; (+) strand; PAM type: NRG; PAM sequence: TGG
attcccaccatttgtcctct

SEQ ID NO: 143598 - DNA, 20 bp, Artificial Sequence
  Description of Artificial Sequence: Synthetic oligonucleotide
  Target: ATXN1; (+) strand; PAM type: NRG; PAM sequence: GGG
ttcccaccatttgtcctctt

SEQ ID NO: 143599 - DNA, 20 bp, Artificial Sequence
  Description of Artificial Sequence: Synthetic oligonucleotide
  Target: ATXN1; (+) strand; PAM type: NRG; PAM sequence: GGG
tcccaccatttgtcctcttg

SEQ ID NO: 143600 - DNA, 20 bp, Artificial Sequence
  Description of Artificial Sequence: Synthetic oligonucleotide
  Target: ATXN1; (+) strand; PAM type: NRG; PAM sequence: GAG
ttgtcctcttggggatcact

SEQ ID NO: 143601 - DNA, 20 bp, Artificial Sequence
  Description of Artificial Sequence: Synthetic oligonucleotide
  Target: ATXN1; (+) strand; PAM type: NRG; PAM sequence: AAG
tcactgagtacaacctaaca

SEQ ID NO: 143602 - DNA, 20 bp, Artificial Sequence
  Description of Artificial Sequence: Synthetic oligonucleotide
  Target: ATXN1; (+) strand; PAM type: NRG; PAM sequence: TGG
acaaagaccattaacccatg

SEQ ID NO: 143603 - DNA, 20 bp, Artificial Sequence
  Description of Artificial Sequence: Synthetic oligonucleotide
  Target: ATXN1; (+) strand; PAM type: NRG; PAM sequence: AAG
gaccattaacccatgtggtc

SEQ ID NO: 143604 - DNA, 20 bp, Artificial Sequence
  Description of Artificial Sequence: Synthetic oligonucleotide
  Target: ATXN1; (+) strand; PAM type: NRG; PAM sequence: GAG
acccatgtggtcaagaacat

SEQ ID NO: 143605 - DNA, 20 bp, Artificial Sequence
  Description of Artificial Sequence: Synthetic oligonucleotide
  Target: ATXN1; (+) strand; PAM type: NRG; PAM sequence: GAG
aagaacatgagataaaccat

SEQ ID NO: 143606 - DNA, 20 bp, Artificial Sequence
  Description of Artificial Sequence: Synthetic oligonucleotide
  Target: ATXN1; (+) strand; PAM type: NRG; PAM sequence: AGG
agaacatgagataaaccatg

SEQ ID NO: 143607 - DNA, 20 bp, Artificial Sequence
  Description of Artificial Sequence: Synthetic oligonucleotide
  Target: ATXN1; (+) strand; PAM type: NRG; PAM sequence: GGG
gaacatgagataaaccatga

SEQ ID NO: 143608 - DNA, 20 bp, Artificial Sequence
  Description of Artificial Sequence: Synthetic oligonucleotide
  Target: ATXN1; (+) strand; PAM type: NRG; PAM sequence: CAG
gagataaaccatgagggcac

SEQ ID NO: 143609 - DNA, 20 bp, Artificial Sequence
  Description of Artificial Sequence: Synthetic oligonucleotide
  Target: ATXN1; (+) strand; PAM type: NRG; PAM sequence: GAG
gataaaccatgagggcacca

SEQ ID NO: 143610 - DNA, 20 bp, Artificial Sequence
  Description of Artificial Sequence: Synthetic oligonucleotide
  Target: ATXN1; (+) strand; PAM type: NRG; PAM sequence: AGG
ataaaccatgagggcaccag

SEQ ID NO: 143611 - DNA, 20 bp, Artificial Sequence
  Description of Artificial Sequence: Synthetic oligonucleotide
  Target: ATXN1; (+) strand; PAM type: NRG; PAM sequence: GGG
taaaccatgagggcaccaga

SEQ ID NO: 143612 - DNA, 20 bp, Artificial Sequence
  Description of Artificial Sequence: Synthetic oligonucleotide
  Target: ATXN1; (+) strand; PAM type: NRG; PAM sequence: AAG
accatgagggcaccagaggg

SEQ ID NO: 143613 - DNA, 20 bp, Artificial Sequence
  Description of Artificial Sequence: Synthetic oligonucleotide
  Target: ATXN1; (+) strand; PAM type: NRG; PAM sequence: GAG
catgagggcaccagagggaa

SEQ ID NO: 143614 - DNA, 20 bp, Artificial Sequence
  Description of Artificial Sequence: Synthetic oligonucleotide
  Target: ATXN1; (+) strand; PAM type: NRG; PAM sequence: TGG
ccagagggaagagttatctg

SEQ ID NO: 143615 - DNA, 20 bp, Artificial Sequence
  Description of Artificial Sequence: Synthetic oligonucleotide
  Target: ATXN1; (+) strand; PAM type: NRG; PAM sequence: GGG
cagagggaagagttatctgt

SEQ ID NO: 143616 - DNA, 20 bp, Artificial Sequence
  Description of Artificial Sequence: Synthetic oligonucleotide
  Target: ATXN1; (+) strand; PAM type: NRG; PAM sequence: CGG
agggaagagttatctgtggg

SEQ ID NO: 143617 - DNA, 20 bp, Artificial Sequence
  Description of Artificial Sequence: Synthetic oligonucleotide
  Target: ATXN1; (+) strand; PAM type: NRG; PAM sequence: TGG
ggcggaaaactgtatttact

SEQ ID NO: 143618 - DNA, 20 bp, Artificial Sequence
  Description of Artificial Sequence: Synthetic oligonucleotide
  Target: ATXN1; (+) strand; PAM type: NRG; PAM sequence: TAG
tgtatttacttggattctac

SEQ ID NO: 143619 - DNA, 20 bp, Artificial Sequence
  Description of Artificial Sequence: Synthetic oligonucleotide
  Target: ATXN1; (+) strand; PAM type: NRG; PAM sequence: AGG
gtatttacttggattctact

SEQ ID NO: 143620 - DNA, 20 bp, Artificial Sequence
  Description of Artificial Sequence: Synthetic oligonucleotide
  Target: ATXN1; (+) strand; PAM type: NRG; PAM sequence: AAG
ttacttggattctactaggc

SEQ ID NO: 143621 - DNA, 20 bp, Artificial Sequence
  Description of Artificial Sequence: Synthetic oligonucleotide
  Target: ATXN1; (+) strand; PAM type: NRG; PAM sequence: GAG
tctactaggcaagaaactgt

SEQ ID NO: 143622 - DNA, 20 bp, Artificial Sequence
  Description of Artificial Sequence: Synthetic oligonucleotide
  Target: ATXN1; (+) strand; PAM type: NRG; PAM sequence: AAG
actaggcaagaaactgtgag

SEQ ID NO: 143623 - DNA, 20 bp, Artificial Sequence
  Description of Artificial Sequence: Synthetic oligonucleotide
  Target: ATXN1; (+) strand; PAM type: NRG; PAM sequence: TGG
ttaattttgttttattttta

SEQ ID NO: 143624 - DNA, 20 bp, Artificial Sequence
  Description of Artificial Sequence: Synthetic oligonucleotide
  Target: ATXN1; (+) strand; PAM type: NRG; PAM sequence: GGG
taattttgttttatttttat

SEQ ID NO: 143625 - DNA, 20 bp, Artificial Sequence
  Description of Artificial Sequence: Synthetic oligonucleotide
  Target: ATXN1; (+) strand; PAM type: NRG; PAM sequence: TGG
tgatcgttgtgcatatttat

SEQ ID NO: 143626 - DNA, 20 bp, Artificial Sequence
  Description of Artificial Sequence: Synthetic oligonucleotide
  Target: ATXN1; (+) strand; PAM type: NRG; PAM sequence: GGG
gatcgttgtgcatatttatt

SEQ ID NO: 143627 - DNA, 20 bp, Artificial Sequence
  Description of Artificial Sequence: Synthetic oligonucleotide
  Target: ATXN1; (+) strand; PAM type: NRG; PAM sequence: AAG
tacatgtgattttttgatac

SEQ ID NO: 143628 - DNA, 20 bp, Artificial Sequence
  Description of Artificial Sequence: Synthetic oligonucleotide
  Target: ATXN1; (+) strand; PAM type: NRG; PAM sequence: TGG
tacaagcacacaatgtgtaa

SEQ ID NO: 143629 - DNA, 20 bp, Artificial Sequence
  Description of Artificial Sequence: Synthetic oligonucleotide
  Target: ATXN1; (+) strand; PAM type: NRG; PAM sequence: AAG
caatgtgtaatggtcaaatc

SEQ ID NO: 143630 - DNA, 20 bp, Artificial Sequence
  Description of Artificial Sequence: Synthetic oligonucleotide
  Target: ATXN1; (+) strand; PAM type: NRG; PAM sequence: AGG
aatgtgtaatggtcaaatca

SEQ ID NO: 143631 - DNA, 20 bp, Artificial Sequence
  Description of Artificial Sequence: Synthetic oligonucleotide
  Target: ATXN1; (+) strand; PAM type: NRG; PAM sequence: TGG
aatggtcaaatcaaggtatt

SEQ ID NO: 143632 - DNA, 20 bp, Artificial Sequence
  Description of Artificial Sequence: Synthetic oligonucleotide
  Target: ATXN1; (+) strand; PAM type: NRG; PAM sequence: GGG
atggtcaaatcaaggtattt

SEQ ID NO: 143633 - DNA, 20 bp, Artificial Sequence
  Description of Artificial Sequence: Synthetic oligonucleotide
  Target: ATXN1; (+) strand; PAM type: NRG; PAM sequence: TAG
atcacttcatttctttttgt

SEQ ID NO: 143634 - DNA, 20 bp, Artificial Sequence
  Description of Artificial Sequence: Synthetic oligonucleotide
  Target: ATXN1; (+) strand; PAM type: NRG; PAM sequence: AGG
tcacttcatttctttttgtt

SEQ ID NO: 143635 - DNA, 20 bp, Artificial Sequence
  Description of Artificial Sequence: Synthetic oligonucleotide
  Target: ATXN1; (+) strand; PAM type: NRG; PAM sequence: GGG
cacttcatttctttttgtta

SEQ ID NO: 143636 - DNA, 20 bp, Artificial Sequence
  Description of Artificial Sequence: Synthetic oligonucleotide
  Target: ATXN1; (+) strand; PAM type: NRG; PAM sequence: TAG
acattccaaattcattcctc

SEQ ID NO: 143637 - DNA, 20 bp, Artificial Sequence
  Description of Artificial Sequence: Synthetic oligonucleotide
  Target: ATXN1; (+) strand; PAM type: NRG; PAM sequence: AAG
gttattttgaaatatacaat

SEQ ID NO: 143638 - DNA, 20 bp, Artificial Sequence
  Description of Artificial Sequence: Synthetic oligonucleotide
  Target: ATXN1; (+) strand; PAM type: NRG; PAM sequence: TAG
cctattgtgctactgaacac

SEQ ID NO: 143639 - DNA, 20 bp, Artificial Sequence
  Description of Artificial Sequence: Synthetic oligonucleotide
  Target: ATXN1; (+) strand; PAM type: NRG; PAM sequence: TAG
actatctaactatattttta

SEQ ID NO: 143640 - DNA, 20 bp, Artificial Sequence
  Description of Artificial Sequence: Synthetic oligonucleotide
  Target: ATXN1; (+) strand; PAM type: NRG; PAM sequence: TAG
ctccatgacgtcatgtttct

SEQ ID NO: 143641 - DNA, 20 bp, Artificial Sequence
  Description of Artificial Sequence: Synthetic oligonucleotide
  Target: ATXN1; (+) strand; PAM type: NRG; PAM sequence: GAG
gtttcttagctccctcatat

SEQ ID NO: 143642 - DNA, 20 bp, Artificial Sequence
  Description of Artificial Sequence: Synthetic oligonucleotide
  Target: ATXN1; (+) strand; PAM type: NRG; PAM sequence: GAG
cttagctccctcatatgagt

SEQ ID NO: 143643 - DNA, 20 bp, Artificial Sequence
  Description of Artificial Sequence: Synthetic oligonucleotide
  Target: ATXN1; (+) strand; PAM type: NRG; PAM sequence: TGG
gatatttgtctttctgtgcc

SEQ ID NO: 143644 - DNA, 20 bp, Artificial Sequence
  Description of Artificial Sequence: Synthetic oligonucleotide
  Target: ATXN1; (+) strand; PAM type: NRG; PAM sequence: CAG
ttacttaacataacgtcttc

SEQ ID NO: 143645 - DNA, 20 bp, Artificial Sequence
  Description of Artificial Sequence: Synthetic oligonucleotide
  Target: ATXN1; (+) strand; PAM type: NRG; PAM sequence: CAG
aacataacgtcttccagttc

SEQ ID NO: 143646 - DNA, 20 bp, Artificial Sequence
  Description of Artificial Sequence: Synthetic oligonucleotide
  Target: ATXN1; (+) strand; PAM type: NRG; PAM sequence: CAG
agccatgttgttacaaatga

SEQ ID NO: 143647 - DNA, 20 bp, Artificial Sequence
  Description of Artificial Sequence: Synthetic oligonucleotide
  Target: ATXN1; (+) strand; PAM type: NRG; PAM sequence: TGG
cagaatttcattcttttgta

SEQ ID NO: 143648 - DNA, 20 bp, Artificial Sequence
  Description of Artificial Sequence: Synthetic oligonucleotide
  Target: ATXN1; (+) strand; PAM type: NRG; PAM sequence: TGG
tttatccattccttcattga

SEQ ID NO: 143649 - DNA, 20 bp, Artificial Sequence
  Description of Artificial Sequence: Synthetic oligonucleotide
  Target: ATXN1; (+) strand; PAM type: NRG; PAM sequence: GAG
tatccattccttcattgatg

SEQ ID NO: 143650 - DNA, 20 bp, Artificial Sequence
  Description of Artificial Sequence: Synthetic oligonucleotide
  Target: ATXN1; (+) strand; PAM type: NRG; PAM sequence: TAG
ttccttcattgatggagact

SEQ ID NO: 143651 - DNA, 20 bp, Artificial Sequence
  Description of Artificial Sequence: Synthetic oligonucleotide
  Target: ATXN1; (+) strand; PAM type: NRG; PAM sequence: TGG
cttagattgattccatatct

SEQ ID NO: 143652 - DNA, 20 bp, Artificial Sequence
  Description of Artificial Sequence: Synthetic oligonucleotide
  Target: ATXN1; (+) strand; PAM type: NRG; PAM sequence: TAG
catatcttggctataatgaa

SEQ ID NO: 143653 - DNA, 20 bp, Artificial Sequence
  Description of Artificial Sequence: Synthetic oligonucleotide
  Target: ATXN1; (+) strand; PAM type: NRG; PAM sequence: TGG
atgaatagctgcaacaaaca

SEQ ID NO: 143654 - DNA, 20 bp, Artificial Sequence
  Description of Artificial Sequence: Synthetic oligonucleotide
  Target: ATXN1; (+) strand; PAM type: NRG; PAM sequence: GGG
tgaatagctgcaacaaacat

SEQ ID NO: 143655 - DNA, 20 bp, Artificial Sequence
  Description of Artificial Sequence: Synthetic oligonucleotide
  Target: ATXN1; (+) strand; PAM type: NRG; PAM sequence: GAG
aatagctgcaacaaacatgg

SEQ ID NO: 143656 - DNA, 20 bp, Artificial Sequence
  Description of Artificial Sequence: Synthetic oligonucleotide
  Target: ATXN1; (+) strand; PAM type: NRG; PAM sequence: CAG
ctgcaacaaacatgggagtg

SEQ ID NO: 143657 - DNA, 20 bp, Artificial Sequence
  Description of Artificial Sequence: Synthetic oligonucleotide
  Target: ATXN1; (+) strand; PAM type: NRG; PAM sequence: AGG
tgcaacaaacatgggagtgc

SEQ ID NO: 143658 - DNA, 20 bp, Artificial Sequence
  Description of Artificial Sequence: Synthetic oligonucleotide
  Target: ATXN1; (+) strand; PAM type: NRG; PAM sequence: TGG
tatactgatttcctttcttc

SEQ ID NO: 143659 - DNA, 20 bp, Artificial Sequence
  Description of Artificial Sequence: Synthetic oligonucleotide
  Target: ATXN1; (+) strand; PAM type: NRG; PAM sequence: TGG
tttctttctttctttttttt

SEQ ID NO: 143660 - DNA, 20 bp, Artificial Sequence
  Description of Artificial Sequence: Synthetic oligonucleotide
  Target: ATXN1; (+) strand; PAM type: NRG; PAM sequence: GAG
tctttctttctttttttttg

SEQ ID NO: 143661 - DNA, 20 bp, Artificial Sequence
  Description of Artificial Sequence: Synthetic oligonucleotide
  Target: ATXN1; (+) strand; PAM type: NRG; PAM sequence: TAG
ctttctttttttttggagtc

SEQ ID NO: 143662 - DNA, 20 bp, Artificial Sequence
  Description of Artificial Sequence: Synthetic oligonucleotide
  Target: ATXN1; (+) strand; PAM type: NRG; PAM sequence: CAG
ttggagtctagctgtgtcac

SEQ ID NO: 143663 - DNA, 20 bp, Artificial Sequence
  Description of Artificial Sequence: Synthetic oligonucleotide
  Target: ATXN1; (+) strand; PAM type: NRG; PAM sequence: AGG
tggagtctagctgtgtcacc

SEQ ID NO: 143664 - DNA, 20 bp, Artificial Sequence
  Description of Artificial Sequence: Synthetic oligonucleotide
  Target: ATXN1; (+) strand; PAM type: NRG; PAM sequence: TGG
gtctagctgtgtcaccaggc

SEQ ID NO: 143665 - DNA, 20 bp, Artificial Sequence
  Description of Artificial Sequence: Synthetic oligonucleotide
  Target: ATXN1; (+) strand; PAM type: NRG; PAM sequence: GAG
ctagctgtgtcaccaggctg

SEQ ID NO: 143666 - DNA, 20 bp, Artificial Sequence
  Description of Artificial Sequence: Synthetic oligonucleotide
  Target: ATXN1; (+) strand; PAM type: NRG; PAM sequence: TAG
tgtgtcaccaggctggagtg

SEQ ID NO: 143667 - DNA, 20 bp, Artificial Sequence
  Description of Artificial Sequence: Synthetic oligonucleotide
  Target: ATXN1; (+) strand; PAM type: NRG; PAM sequence: CAG
ggagtgtagtactgtgatct

SEQ ID NO: 143668 - DNA, 20 bp, Artificial Sequence
  Description of Artificial Sequence: Synthetic oligonucleotide
  Target: ATXN1; (+) strand; PAM type: NRG; PAM sequence: TGG
cactgcaacctctgactccc

SEQ ID NO: 143669 - DNA, 20 bp, Artificial Sequence
  Description of Artificial Sequence: Synthetic oligonucleotide
  Target: ATXN1; (+) strand; PAM type: NRG; PAM sequence: CAG
aacctctgactccctggttc

SEQ ID NO: 143670 - DNA, 20 bp, Artificial Sequence
  Description of Artificial Sequence: Synthetic oligonucleotide
  Target: ATXN1; (+) strand; PAM type: NRG; PAM sequence: CAG
ttccagtgattctcctgcct

SEQ ID NO: 143671 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctccc

SEQ ID NO: 143672 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccgag

SEQ ID NO: 143673 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccgagtagc

SEQ ID NO: 143674 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccgagtagct

SEQ ID NO: 143675 - DNA, 20 bp, Artificial Sequence
  Description of Artificial Sequence: Synthetic oligonucleotide
  Target: ATXN1; (+) strand; PAM type: NRG; PAM sequence: TGG
tcccgagtagctgggattac

SEQ ID NO: 143676 - DNA, 20 bp, Artificial Sequence
  Description of Artificial Sequence: Synthetic oligonucleotide
  Target: ATXN1; (+) strand; PAM type: NRG; PAM sequence: CAG
ctggcacatgccaccacact

SEQ ID NO: 143677 - DNA, 20 bp, Artificial Sequence
  Description of Artificial Sequence: Synthetic oligonucleotide
  Target: ATXN1; (+) strand; PAM type: NRG; PAM sequence: TAG
tcagttactttttgcattta

SEQ ID NO: 143678 - DNA, 20 bp, Artificial Sequence
  Description of Artificial Sequence: Synthetic oligonucleotide
  Target: ATXN1; (+) strand; PAM type: NRG; PAM sequence: TAG
gttactttttgcatttatag

SEQ ID NO: 143679 - DNA, 20 bp, Artificial Sequence
  Description of Artificial Sequence: Synthetic oligonucleotide
  Target: ATXN1; (+) strand; PAM type: NRG; PAM sequence: GAG
tactttttgcatttatagta

SEQ ID NO: 143680 - DNA, 20 bp, Artificial Sequence
  Description of Artificial Sequence: Synthetic oligonucleotide
  Target: ATXN1; (+) strand; PAM type: NRG; PAM sequence: CGG
ttttgcatttatagtagaga

SEQ ID NO: 143681 - DNA, 20 bp, Artificial Sequence
  Description of Artificial Sequence: Synthetic oligonucleotide
  Target: ATXN1; (+) strand; PAM type: NRG; PAM sequence: GAG
ttgcatttatagtagagacg

SEQ ID NO: 143682 - DNA, 20 bp, Artificial Sequence
  Description of Artificial Sequence: Synthetic oligonucleotide
  Target: ATXN1; (+) strand; PAM type: NRG; PAM sequence: TGG
gagacggagtttcaccatgt

SEQ ID NO: 143683 - DNA, 20 bp, Artificial Sequence
  Description of Artificial Sequence: Synthetic oligonucleotide
  Target: ATXN1; (+) strand; PAM type: NRG; PAM sequence: CAG
cggagtttcaccatgttggc

SEQ ID NO: 143684 - DNA, 20 bp, Artificial Sequence
  Description of Artificial Sequence: Synthetic oligonucleotide
  Target: ATXN1; (+) strand; PAM type: NRG; PAM sequence: AGG
ggagtttcaccatgttggcc

SEQ ID NO: 143685 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttggccagga

SEQ ID NO: 143686 - DNA, 20 bp, Artificial Sequence
  Description of Artificial Sequence: Synthetic oligonucleotide
  Target: ATXN1; (+) strand; PAM type: NRG; PAM sequence: CGG
actttgtgatccgttcgcct

SEQ ID NO: 143687 - DNA, 20 bp, Artificial Sequence
  Description of Artificial Sequence: Synthetic oligonucleotide
  Target: ATXN1; (+) strand; PAM type: NRG; PAM sequence: AAG
ccgttcgcctcggtctccca

SEQ ID NO: 143688 - DNA, 20 bp, Artificial Sequence
  Description of Artificial Sequence: Synthetic oligonucleotide
  Target: ATXN1; (+) strand; PAM type: NRG; PAM sequence: TGG
gcctcggtctcccaaagtgc

SEQ ID NO: 143689 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctggcatta

SEQ ID NO: 143690 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctggcattac

SEQ ID NO: 143691 - DNA, 20 bp, Artificial Sequence
  Description of Artificial Sequence: Synthetic oligonucleotide
  Target: ATXN1; (+) strand; PAM type: NRG; PAM sequence: GAG
agtgctggcattacaggtgt

SEQ ID NO: 143692 - DNA, 20 bp, Artificial Sequence
  Description of Artificial Sequence: Synthetic oligonucleotide
  Target: ATXN1; (+) strand; PAM type: NRG; PAM sequence: CAG
caggtgtgagccactgcacc

SEQ ID NO: 143693 - DNA, 20 bp, Artificial Sequence
  Description of Artificial Sequence: Synthetic oligonucleotide
  Target: ATXN1; (+) strand; PAM type: NRG; PAM sequence: TAG
cccagccatgactttttttt

SEQ ID NO: 143694 - DNA, 20 bp, Artificial Sequence
  Description of Artificial Sequence: Synthetic oligonucleotide
  Target: ATXN1; (+) strand; PAM type: NRG; PAM sequence: TAG
gcaaacactttcttccaatc

SEQ ID NO: 143695 - DNA, 20 bp, Artificial Sequence
  Description of Artificial Sequence: Synthetic oligonucleotide
  Target: ATXN1; (+) strand; PAM type: NRG; PAM sequence: AGG
caaacactttcttccaatct

SEQ ID NO: 143696 - DNA, 20 bp, Artificial Sequence
  Description of Artificial Sequence: Synthetic oligonucleotide
  Target: ATXN1; (+) strand; PAM type: NRG; PAM sequence: AAG
tttcttccaatctaggcttt

SEQ ID NO: 143697 - DNA, 20 bp, Artificial Sequence
  Description of Artificial Sequence: Synthetic oligonucleotide
  Target: ATXN1; (+) strand; PAM type: NRG; PAM sequence: TAG
caatctaggctttaagaatc

SEQ ID NO: 143698 - DNA, 20 bp, Artificial Sequence
  Description of Artificial Sequence: Synthetic oligonucleotide
  Target: ATXN1; (+) strand; PAM type: NRG; PAM sequence: AAG
gttaaaatttcttttaacta

SEQ ID NO: 143699 - DNA, 20 bp, Artificial Sequence
  Description of Artificial Sequence: Synthetic oligonucleotide
  Target: ATXN1; (+) strand; PAM type: NRG; PAM sequence: AGG
ttaaaatttcttttaactaa

SEQ ID NO: 143700 - DNA, 20 bp, Artificial Sequence
  Description of Artificial Sequence: Synthetic oligonucleotide
  Target: ATXN1; (+) strand; PAM type: NRG; PAM sequence: AAG
actaaaggaataaactttta

SEQ ID NO: 143701 - DNA, 20 bp, Artificial Sequence
  Description of Artificial Sequence: Synthetic oligonucleotide
  Target: ATXN1; (+) strand; PAM type: NRG; PAM sequence: TGG
gaataaacttttaaagtaca

SEQ ID NO: 143702 - DNA, 20 bp, Artificial Sequence
  Description of Artificial Sequence: Synthetic oligonucleotide
  Target: ATXN1; (+) strand; PAM type: NRG; PAM sequence: AAG
aaacttttaaagtacatgga

SEQ ID NO: 143703 - DNA, 20 bp, Artificial Sequence
  Description of Artificial Sequence: Synthetic oligonucleotide
  Target: ATXN1; (+) strand; PAM type: NRG; PAM sequence: GAG
acttttaaagtacatggaaa

SEQ ID NO: 143704 - DNA, 20 bp, Artificial Sequence
  Description of Artificial Sequence: Synthetic oligonucleotide
  Target: ATXN1; (+) strand; PAM type: NRG; PAM sequence: CAG
aaagtacatggaaagagatt

SEQ ID NO: 143705 - DNA, 20 bp, Artificial Sequence
  Description of Artificial Sequence: Synthetic oligonucleotide
  Target: ATXN1; (+) strand; PAM type: NRG; PAM sequence: AAG
tacatggaaagagattcaga

SEQ ID NO: 143706 - DNA, 20 bp, Artificial Sequence
  Description of Artificial Sequence: Synthetic oligonucleotide
  Target: ATXN1; (+) strand; PAM type: NRG; PAM sequence: AAG
tttcatgaaatcaattcatg

SEQ ID NO: 143707 - DNA, 20 bp, Artificial Sequence
  Description of Artificial Sequence: Synthetic oligonucleotide
  Target: ATXN1; (+) strand; PAM type: NRG; PAM sequence: TAG
aaatcaattcatgaagtaac

SEQ ID NO: 143708 - DNA, 20 bp, Artificial Sequence
  Description of Artificial Sequence: Synthetic oligonucleotide
  Target: ATXN1; (+) strand; PAM type: NRG; PAM sequence: AGG
aatcaattcatgaagtaact

SEQ ID NO: 143709 - DNA, 20 bp, Artificial Sequence
  Description of Artificial Sequence: Synthetic oligonucleotide
  Target: ATXN1; (+) strand; PAM type: NRG; PAM sequence: TAG
attataaatcattatctatt

SEQ ID NO: 143710 - DNA, 20 bp, Artificial Sequence
  Description of Artificial Sequence: Synthetic oligonucleotide
  Target: ATXN1; (+) strand; PAM type: NRG; PAM sequence: AAG
taaatcattatctatttaga

SEQ ID NO: 143711 - DNA, 20 bp, Artificial Sequence
  Description of Artificial Sequence: Synthetic oligonucleotide
  Target: ATXN1; (+) strand; PAM type: NRG; PAM sequence: AAG
atttagaaagaaaatacgca

SEQ ID NO: 143712 - DNA, 20 bp, Artificial Sequence
  Description of Artificial Sequence: Synthetic oligonucleotide
  Target: ATXN1; (+) strand; PAM type: NRG; PAM sequence: TGG
aaagaactactaaacaacac

SEQ ID NO: 143713 - DNA, 20 bp, Artificial Sequence
  Description of Artificial Sequence: Synthetic oligonucleotide
  Target: ATXN1; (+) strand; PAM type: NRG; PAM sequence: TGG
taaacaacactggttatctt

SEQ ID NO: 143714 - DNA, 20 bp, Artificial Sequence
  Description of Artificial Sequence: Synthetic oligonucleotide
  Target: ATXN1; (+) strand; PAM type: NRG; PAM sequence: GGG
aaacaacactggttatcttt

SEQ ID NO: 143715 - DNA, 20 bp, Artificial Sequence
  Description of Artificial Sequence: Synthetic oligonucleotide
  Target: ATXN1; (+) strand; PAM type: NRG; PAM sequence: TGG
tggttatctttgggtgttaa

SEQ ID NO: 143716 - DNA, 20 bp, Artificial Sequence
  Description of Artificial Sequence: Synthetic oligonucleotide
  Target: ATXN1; (+) strand; PAM type: NRG; PAM sequence: TAG
atggacacatgcaatgataa

SEQ ID NO: 143717 - DNA, 20 bp, Artificial Sequence
  Description of Artificial Sequence: Synthetic oligonucleotide
  Target: ATXN1; (+) strand; PAM type: NRG; PAM sequence: AAG
atagctaacattcacatgtt

SEQ ID NO: 143718 - DNA, 20 bp, Artificial Sequence
  Description of Artificial Sequence: Synthetic oligonucleotide
  Target: ATXN1; (+) strand; PAM type: NRG; PAM sequence: GAG
cattcacatgttaagccctt

SEQ ID NO: 143719 - DNA, 20 bp, Artificial Sequence
  Description of Artificial Sequence: Synthetic oligonucleotide
  Target: ATXN1; (+) strand; PAM type: NRG; PAM sequence: AAG
tgagtttcattatctcctct

SEQ ID NO: 143720 - DNA, 20 bp, Artificial Sequence
  Description of Artificial Sequence: Synthetic oligonucleotide
  Target: ATXN1; (+) strand; PAM type: NRG; PAM sequence: TAG
tcattatctcctctaagccc

SEQ ID NO: 143721 - DNA, 20 bp, Artificial Sequence
  Description of Artificial Sequence: Synthetic oligonucleotide
  Target: ATXN1; (+) strand; PAM type: NRG; PAM sequence: TAG
tctaagccctagaaccatcc

SEQ ID NO: 143722 - DNA, 20 bp, Artificial Sequence
  Description of Artificial Sequence: Synthetic oligonucleotide
  Target: ATXN1; (+) strand; PAM type: NRG; PAM sequence: AGG
ctaagccctagaaccatcct

SEQ ID NO: 143723 - DNA, 20 bp, Artificial Sequence
  Description of Artificial Sequence: Synthetic oligonucleotide
  Target: ATXN1; (+) strand; PAM type: NRG; PAM sequence: CAG
agccctagaaccatcctagg

SEQ ID NO: 143724 - DNA, 20 bp, Artificial Sequence
  Description of Artificial Sequence: Synthetic oligonucleotide
  Target: ATXN1; (+) strand; PAM type: NRG; PAM sequence: TGG
cctagaaccatcctaggcag

SEQ ID NO: 143725 - DNA, 20 bp, Artificial Sequence
  Description of Artificial Sequence: Synthetic oligonucleotide
  Target: ATXN1; (+) strand; PAM type: NRG; PAM sequence: AAG
tacccgccttctaataaata

SEQ ID NO: 143726 - DNA, 20 bp, Artificial Sequence
  Description of Artificial Sequence: Synthetic oligonucleotide
  Target: ATXN1; (+) strand; PAM type: NRG; PAM sequence: TGG
ccttctaataaataaagaaa

SEQ ID NO: 143727 - DNA, 20 bp, Artificial Sequence
  Description of Artificial Sequence: Synthetic oligonucleotide
  Target: ATXN1; (+) strand; PAM type: NRG; PAM sequence: GAG
ttctaataaataaagaaatg

SEQ ID NO: 143728 - DNA, 20 bp, Artificial Sequence
  Description of Artificial Sequence: Synthetic oligonucleotide
  Target: ATXN1; (+) strand; PAM type: NRG; PAM sequence: AGG
tctaataaataaagaaatgg

SEQ ID NO: 143729 - DNA, 20 bp, Artificial Sequence
  Description of Artificial Sequence: Synthetic oligonucleotide
  Target: ATXN1; (+) strand; PAM type: NRG; PAM sequence: AAG
taaataaagaaatggaggtg

SEQ ID NO: 143730 - DNA, 20 bp, Artificial Sequence
  Description of Artificial Sequence: Synthetic oligonucleotide
  Target: ATXN1; (+) strand; PAM type: NRG; PAM sequence: AGG
aaataaagaaatggaggtga

SEQ ID NO: 143731 - DNA, 20 bp, Artificial Sequence
  Description of Artificial Sequence: Synthetic oligonucleotide
  Target: ATXN1; (+) strand; PAM type: NRG; PAM sequence: GAG
ataaagaaatggaggtgaag

SEQ ID NO: 143732 - DNA, 20 bp, Artificial Sequence
  Description of Artificial Sequence: Synthetic oligonucleotide
  Target: ATXN1; (+) strand; PAM type: NRG; PAM sequence: AAG
gagctacataatgtacccac

SEQ ID NO: 143733 - DNA, 20 bp, Artificial Sequence
  Description of Artificial Sequence: Synthetic oligonucleotide
  Target: ATXN1; (+) strand; PAM type: NRG; PAM sequence: CAG
cataatgtacccacaagtga

SEQ ID NO: 143734 - DNA, 20 bp, Artificial Sequence
  Description of Artificial Sequence: Synthetic oligonucleotide
  Target: ATXN1; (+) strand; PAM type: NRG; PAM sequence: GAG
gtacccacaagtgacagatt

SEQ ID NO: 143735 - DNA, 20 bp, Artificial Sequence
  Description of Artificial Sequence: Synthetic oligonucleotide
  Target: ATXN1; (+) strand; PAM type: NRG; PAM sequence: AGG
tacccacaagtgacagattg

SEQ ID NO: 143736 - DNA, 20 bp, Artificial Sequence
  Description of Artificial Sequence: Synthetic oligonucleotide
  Target: ATXN1; (+) strand; PAM type: NRG; PAM sequence: GAG
actccaacctccatccacct

SEQ ID NO: 143737 - DNA, 20 bp, Artificial Sequence
  Description of Artificial Sequence: Synthetic oligonucleotide
  Target: ATXN1; (+) strand; PAM type: NRG; PAM sequence: GAG
tccaacctccatccacctga

SEQ ID NO: 143738 - DNA, 20 bp, Artificial Sequence
  Description of Artificial Sequence: Synthetic oligonucleotide
  Target: ATXN1; (+) strand; PAM type: NRG; PAM sequence: AAG
cctccatccacctgagagca

SEQ ID NO: 143739 - DNA, 20 bp, Artificial Sequence
  Description of Artificial Sequence: Synthetic oligonucleotide
  Target: ATXN1; (+) strand; PAM type: NRG; PAM sequence: CAG
gcaaagattctctatctcct

SEQ ID NO: 143740 - DNA, 20 bp, Artificial Sequence
  Description of Artificial Sequence: Synthetic oligonucleotide
  Target: ATXN1; (+) strand; PAM type: NRG; PAM sequence: TAG
gctgcctcctttccaattaa

SEQ ID NO: 143741 - DNA, 20 bp, Artificial Sequence
  Description of Artificial Sequence: Synthetic oligonucleotide
  Target: ATXN1; (+) strand; PAM type: NRG; PAM sequence: CGG
attaatagttgactgaactt

SEQ ID NO: 143742 - DNA, 20 bp, Artificial Sequence
  Description of Artificial Sequence: Synthetic oligonucleotide
  Target: ATXN1; (+) strand; PAM type: NRG; PAM sequence: TAG
aatagttgactgaacttcgg

SEQ ID NO: 143743 - DNA, 20 bp, Artificial Sequence
  Description of Artificial Sequence: Synthetic oligonucleotide
  Target: ATXN1; (+) strand; PAM type: NRG; PAM sequence: TGG
acttcggtagattcttcctc

SEQ ID NO: 143744 - DNA, 20 bp, Artificial Sequence
  Description of Artificial Sequence: Synthetic oligonucleotide
  Target: ATXN1; (+) strand; PAM type: NRG; PAM sequence: CAG
tcggtagattcttcctctgg

SEQ ID NO: 143745 - DNA, 20 bp, Artificial Sequence
  Description of Artificial Sequence: Synthetic oligonucleotide
  Target: ATXN1; (+) strand; PAM type: NRG; PAM sequence: AGG
cggtagattcttcctctggc

SEQ ID NO: 143746 - DNA, 20 bp, Artificial Sequence
  Description of Artificial Sequence: Synthetic oligonucleotide
  Target: ATXN1; (+) strand; PAM type: NRG; PAM sequence: AAG
ctcttcactttcttgtttca

SEQ ID NO: 143747 - DNA, 20 bp, Artificial Sequence
  Description of Artificial Sequence: Synthetic oligonucleotide
  Target: ATXN1; (+) strand; PAM type: NRG; PAM sequence: GAG
tcactttcttgtttcaaagt

SEQ ID NO: 143748 - DNA, 20 bp, Artificial Sequence
  Description of Artificial Sequence: Synthetic oligonucleotide
  Target: ATXN1; (+) strand; PAM type: NRG; PAM sequence: AGG
cactttcttgtttcaaagtg

SEQ ID NO: 143749 - DNA, 20 bp, Artificial Sequence
  Description of Artificial Sequence: Synthetic oligonucleotide
  Target: ATXN1; (+) strand; PAM type: NRG; PAM sequence: GAG
ctttcttgtttcaaagtgag

SEQ ID NO: 143750 - DNA, 20 bp, Artificial Sequence
  Description of Artificial Sequence: Synthetic oligonucleotide
  Target: ATXN1; (+) strand; PAM type: NRG; PAM sequence: TGG
cttgtttcaaagtgaggagt

SEQ ID NO: 143751 - DNA, 20 bp, Artificial Sequence
  Description of Artificial Sequence: Synthetic oligonucleotide
  Target: ATXN1; (+) strand; PAM type: NRG; PAM sequence: TGG
gaggagttggcttgatgaat

SEQ ID NO: 143752 - DNA, 20 bp, Artificial Sequence
  Description of Artificial Sequence: Synthetic oligonucleotide
  Target: ATXN1; (+) strand; PAM type: NRG; PAM sequence: CAG
gttggcttgatgaattggct

SEQ ID NO: 143753 - DNA, 20 bp, Artificial Sequence
  Description of Artificial Sequence: Synthetic oligonucleotide
  Target: ATXN1; (+) strand; PAM type: NRG; PAM sequence: GAG
tggcttgatgaattggctca

SEQ ID NO: 143754 - DNA, 20 bp, Artificial Sequence
  Description of Artificial Sequence: Synthetic oligonucleotide
  Target: ATXN1; (+) strand; PAM type: NRG; PAM sequence: CGG
atcctaaaatatgtacgtgt

SEQ ID NO: 143755 - DNA, 20 bp, Artificial Sequence
  Description of Artificial Sequence: Synthetic oligonucleotide
  Target: ATXN1; (+) strand; PAM type: NRG; PAM sequence: AAG
taaaatatgtacgtgtcggt

SEQ ID NO: 143756 - DNA, 20 bp, Artificial Sequence
  Description of Artificial Sequence: Synthetic oligonucleotide
  Target: ATXN1; (+) strand; PAM type: NRG; PAM sequence: AAG
aagattcttttgcctcccca

SEQ ID NO: 143757 - DNA, 20 bp, Artificial Sequence
  Description of Artificial Sequence: Synthetic oligonucleotide
  Target: ATXN1; (+) strand; PAM type: NRG; PAM sequence: CAG
attcttttgcctccccaaag

SEQ ID NO: 143758 - DNA, 20 bp, Artificial Sequence
  Description of Artificial Sequence: Synthetic oligonucleotide
  Target: ATXN1; (+) strand; PAM type: NRG; PAM sequence: CGG
tttgcctccccaaagcagac

SEQ ID NO: 143759 - DNA, 20 bp, Artificial Sequence
  Description of Artificial Sequence: Synthetic oligonucleotide
  Target: ATXN1; (+) strand; PAM type: NRG; PAM sequence: TGG
aaagcagaccggttatcaca

SEQ ID NO: 143760 - DNA, 20 bp, Artificial Sequence
  Description of Artificial Sequence: Synthetic oligonucleotide
  Target: ATXN1; (+) strand; PAM type: NRG; PAM sequence: AAG
gaccggttatcacatggaaa

SEQ ID NO: 143761 - DNA, 20 bp, Artificial Sequence
  Description of Artificial Sequence: Synthetic oligonucleotide
  Target: ATXN1; (+) strand; PAM type: NRG; PAM sequence: AGG
accggttatcacatggaaaa

SEQ ID NO: 143762 - DNA, 20 bp, Artificial Sequence
  Description of Artificial Sequence: Synthetic oligonucleotide
  Target: ATXN1; (+) strand; PAM type: NRG; PAM sequence: GAG
cggttatcacatggaaaaag

SEQ ID NO: 143763 - DNA, 20 bp, Artificial Sequence
  Description of Artificial Sequence: Synthetic oligonucleotide
  Target: ATXN1; (+) strand; PAM type: NRG; PAM sequence: AAG
gaaaaaggagtctcactcac

SEQ ID NO: 143764 - DNA, 20 bp, Artificial Sequence
  Description of Artificial Sequence: Synthetic oligonucleotide
  Target: ATXN1; (+) strand; PAM type: NRG; PAM sequence: TGG
ctcactcacaagccacacgc

SEQ ID NO: 143765 - DNA, 20 bp, Artificial Sequence
  Description of Artificial Sequence: Synthetic oligonucleotide
  Target: ATXN1; (+) strand; PAM type: NRG; PAM sequence: GAG
agccacacgctggattctgt

SEQ ID NO: 143766 - DNA, 20 bp, Artificial Sequence
  Description of Artificial Sequence: Synthetic oligonucleotide
  Target: ATXN1; (+) strand; PAM type: NRG; PAM sequence: AGG
gccacacgctggattctgtg

SEQ ID NO: 143767 - DNA, 20 bp, Artificial Sequence
  Description of Artificial Sequence: Synthetic oligonucleotide
  Target: ATXN1; (+) strand; PAM type: NRG; PAM sequence: TAG
aggttaaaacttttgattct

SEQ ID NO: 143768 - DNA, 20 bp, Artificial Sequence
  Description of Artificial Sequence: Synthetic oligonucleotide
  Target: ATXN1; (+) strand; PAM type: NRG; PAM sequence: AAG
ttaaaacttttgattcttag

SEQ ID NO: 143769 - DNA, 20 bp, Artificial Sequence
  Description of Artificial Sequence: Synthetic oligonucleotide
  Target: ATXN1; (+) strand; PAM type: NRG; PAM sequence: AGG
taaaacttttgattcttaga

SEQ ID NO: 143770 - DNA, 20 bp, Artificial Sequence
  Description of Artificial Sequence: Synthetic oligonucleotide
  Target: ATXN1; (+) strand; PAM type: NRG; PAM sequence: GAG
tttgattcttagaaggacat

SEQ ID NO: 143771 - DNA, 20 bp, Artificial Sequence
  Description of Artificial Sequence: Synthetic oligonucleotide
  Target: ATXN1; (+) strand; PAM type: NRG; PAM sequence: AGG
ttgattcttagaaggacatg

SEQ ID NO: 143772 - DNA, 20 bp, Artificial Sequence
  Description of Artificial Sequence: Synthetic oligonucleotide
  Target: ATXN1; (+) strand; PAM type: NRG; PAM sequence: TAG
ttcttagaaggacatgagga

SEQ ID NO: 143773 - DNA, 20 bp, Artificial Sequence
  Description of Artificial Sequence: Synthetic oligonucleotide
  Target: ATXN1; (+) strand; PAM type: NRG; PAM sequence: GAG
cttagaaggacatgaggata

SEQ ID NO: 143774 - DNA, 20 bp, Artificial Sequence
  Description of Artificial Sequence: Synthetic oligonucleotide
  Target: ATXN1; (+) strand; PAM type: NRG; PAM sequence: TGG
atgttctgtaaacaaaatga

SEQ ID NO: 143775 - DNA, 20 bp, Artificial Sequence
  Description of Artificial Sequence: Synthetic oligonucleotide
  Target: ATXN1; (+) strand; PAM type: NRG; PAM sequence: AAG
atggtctgtaaacaaaattc

SEQ ID NO: 143776 - DNA, 20 bp, Artificial Sequence
  Description of Artificial Sequence: Synthetic oligonucleotide
  Target: ATXN1; (+) strand; PAM type: NRG; PAM sequence: AGG
tggtctgtaaacaaaattca

SEQ ID NO: 143777 - DNA, 20 bp, Artificial Sequence
  Description of Artificial Sequence: Synthetic oligonucleotide
  Target: ATXN1; (+) strand; PAM type: NRG; PAM sequence: CAG
aacaaaattcaaggtatcct

SEQ ID NO: 143778 - DNA, 20 bp, Artificial Sequence
  Description of Artificial Sequence: Synthetic oligonucleotide
  Target: ATXN1; (+) strand; PAM type: NRG; PAM sequence: CAG
aattcaaggtatcctcagcc

SEQ ID NO: 143779 - DNA, 20 bp, Artificial Sequence
  Description of Artificial Sequence: Synthetic oligonucleotide
  Target: ATXN1; (+) strand; PAM type: NRG; PAM sequence: AAG
tcccctgtttattcctctga

SEQ ID NO: 143780 - DNA, 20 bp, Artificial Sequence
  Description of Artificial Sequence: Synthetic oligonucleotide
  Target: ATXN1; (+) strand; PAM type: NRG; PAM sequence: AAG
tgaaagcacatttatgaaac

SEQ ID NO: 143781 - DNA, 20 bp, Artificial Sequence
  Description of Artificial Sequence: Synthetic oligonucleotide
  Target: ATXN1; (+) strand; PAM type: NRG; PAM sequence: CAG
aacaagctctgcaaaaatgc

SEQ ID NO: 143782 - DNA, 20 bp, Artificial Sequence
  Description of Artificial Sequence: Synthetic oligonucleotide
  Target: ATXN1; (+) strand; PAM type: NRG; PAM sequence: AAG
caaaaatgccagtcatctct

SEQ ID NO: 143783 - DNA, 20 bp, Artificial Sequence
  Description of Artificial Sequence: Synthetic oligonucleotide
  Target: ATXN1; (+) strand; PAM type: NRG; PAM sequence: AGG
aaaaatgccagtcatctcta

SEQ ID NO: 143784 - DNA, 20 bp, Artificial Sequence
  Description of Artificial Sequence: Synthetic oligonucleotide
  Target: ATXN1; (+) strand; PAM type: NRG; PAM sequence: CAG
cagtcatctctaaggcacca

SEQ ID NO: 143785 - DNA, 20 bp, Artificial Sequence
  Description of Artificial Sequence: Synthetic oligonucleotide
  Target: ATXN1; (+) strand; PAM type: NRG; PAM sequence: AAG
catctctaaggcaccacagt

SEQ ID NO: 143786 - DNA, 20 bp, Artificial Sequence
  Description of Artificial Sequence: Synthetic oligonucleotide
  Target: ATXN1; (+) strand; PAM type: NRG; PAM sequence: AGG
atctctaaggcaccacagta

SEQ ID NO: 143787 - DNA, 20 bp, Artificial Sequence
  Description of Artificial Sequence: Synthetic oligonucleotide
  Target: ATXN1; (+) strand; PAM type: NRG; PAM sequence: AAG
ctaaggcaccacagtaaggc

SEQ ID NO: 143788 - DNA, 20 bp, Artificial Sequence
  Description of Artificial Sequence: Synthetic oligonucleotide
  Target: ATXN1; (+) strand; PAM type: NRG; PAM sequence: AGG
taaggcaccacagtaaggca

SEQ ID NO: 143789 - DNA, 20 bp, Artificial Sequence
  Description of Artificial Sequence: Synthetic oligonucleotide
  Target: ATXN1; (+) strand; PAM type: NRG; PAM sequence: GAG
aggcaccacagtaaggcaag

SEQ ID NO: 143790 - DNA, 20 bp, Artificial Sequence
  Description of Artificial Sequence: Synthetic oligonucleotide
  Target: ATXN1; (+) strand; PAM type: NRG; PAM sequence: TAG
cagtaaggcaaggagctatg

SEQ ID NO: 143791 - DNA, 20 bp, Artificial Sequence
  Description of Artificial Sequence: Synthetic oligonucleotide
  Target: ATXN1; (+) strand; PAM type: NRG; PAM sequence: AAG
tatgtagtgttatccttttg

SEQ ID NO: 143792 - DNA, 20 bp, Artificial Sequence
  Description of Artificial Sequence: Synthetic oligonucleotide
  Target: ATXN1; (+) strand; PAM type: NRG; PAM sequence: TGG
ttctaaacgcttaactccct

SEQ ID NO: 143793 - DNA, 20 bp, Artificial Sequence
  Description of Artificial Sequence: Synthetic oligonucleotide
  Target: ATXN1; (+) strand; PAM type: NRG; PAM sequence: GGG
tctaaacgcttaactccctt

SEQ ID NO: 143794 - DNA, 20 bp, Artificial Sequence
  Description of Artificial Sequence: Synthetic oligonucleotide
  Target: ATXN1; (+) strand; PAM type: NRG; PAM sequence: CAG
aacgcttaactcccttgggt

SEQ ID NO: 143795 - DNA, 20 bp, Artificial Sequence
  Description of Artificial Sequence: Synthetic oligonucleotide
  Target: ATXN1; (+) strand; PAM type: NRG; PAM sequence: CAG
gcttattatttctctcacct

SEQ ID NO: 143796 - DNA, 20 bp, Artificial Sequence
  Description of Artificial Sequence: Synthetic oligonucleotide
  Target: ATXN1; (+) strand; PAM type: NRG; PAM sequence: TGG
attatttctctcacctcaga

SEQ ID NO: 143797 - DNA, 20 bp, Artificial Sequence
  Description of Artificial Sequence: Synthetic oligonucleotide
  Target: ATXN1; (+) strand; PAM type: NRG; PAM sequence: TAG
aaaacatactgaacactttc

SEQ ID NO: 143798 - DNA, 20 bp, Artificial Sequence
  Description of Artificial Sequence: Synthetic oligonucleotide
  Target: ATXN1; (+) strand; PAM type: NRG; PAM sequence: TAG
aacactttctagattattct

SEQ ID NO: 143799 - DNA, 20 bp, Artificial Sequence
  Description of Artificial Sequence: Synthetic oligonucleotide
  Target: ATXN1; (+) strand; PAM type: NRG; PAM sequence: CGG
cttagtcatttttcaatgcc

SEQ ID NO: 143800 - DNA, 20 bp, Artificial Sequence
  Description of Artificial Sequence: Synthetic oligonucleotide
  Target: ATXN1; (+) strand; PAM type: NRG; PAM sequence: AAG
catttttcaatgcccggctc

SEQ ID NO: 143801 - DNA, 20 bp, Artificial Sequence
  Description of Artificial Sequence: Synthetic oligonucleotide
  Target: ATXN1; (+) strand; PAM type: NRG; PAM sequence: CAG
ttgtctttctataaccactg

SEQ ID NO: 143802 - DNA, 20 bp, Artificial Sequence
  Description of Artificial Sequence: Synthetic oligonucleotide
  Target: ATXN1; (+) strand; PAM type: NRG; PAM sequence: AAG
tgcagctcactctttcccca

SEQ ID NO: 143803 - DNA, 20 bp, Artificial Sequence
  Description of Artificial Sequence: Synthetic oligonucleotide
  Target: ATXN1; (+) strand; PAM type: NRG; PAM sequence: CGG
actctttccccaaagtgcct

SEQ ID NO: 143804 - DNA, 20 bp, Artificial Sequence
  Description of Artificial Sequence: Synthetic oligonucleotide
  Target: ATXN1; (+) strand; PAM type: NRG; PAM sequence: GGG
ctctttccccaaagtgcctc

SEQ ID NO: 143805 - DNA, 20 bp, Artificial Sequence
  Description of Artificial Sequence: Synthetic oligonucleotide
  Target: ATXN1; (+) strand; PAM type: NRG; PAM sequence: CAG
ttccccaaagtgcctcgggc

SEQ ID NO: 143806 - DNA, 20 bp, Artificial Sequence
  Description of Artificial Sequence: Synthetic oligonucleotide
  Target: ATXN1; (+) strand; PAM type: NRG; PAM sequence: AGG
tccccaaagtgcctcgggcc

SEQ ID NO: 143807 - DNA, 20 bp, Artificial Sequence
  Description of Artificial Sequence: Synthetic oligonucleotide
  Target: ATXN1; (+) strand; PAM type: NRG; PAM sequence: AAG
ctcgggccaggactcccatc

SEQ ID NO: 143808 - DNA, 20 bp, Artificial Sequence
  Description of Artificial Sequence: Synthetic oligonucleotide
  Target: ATXN1; (+) strand; PAM type: NRG; PAM sequence: AGG
tcgggccaggactcccatca

SEQ ID NO: 143809 - DNA, 20 bp, Artificial Sequence
  Description of Artificial Sequence: Synthetic oligonucleotide
  Target: ATXN1; (+) strand; PAM type: NRG; PAM sequence: TGG
ggccaggactcccatcaagg

SEQ ID NO: 143810 - DNA, 20 bp, Artificial Sequence
  Description of Artificial Sequence: Synthetic oligonucleotide
  Target: ATXN1; (+) strand; PAM type: NRG; PAM sequence: GGG
gccaggactcccatcaaggt

SEQ ID NO: 143811 - DNA, 20 bp, Artificial Sequence
  Description of Artificial Sequence: Synthetic oligonucleotide
  Target: ATXN1; (+) strand; PAM type: NRG; PAM sequence: GAG
taatgttgcctcatttgtgt

SEQ ID NO: 143812 - DNA, 20 bp, Artificial Sequence
  Description of Artificial Sequence: Synthetic oligonucleotide
  Target: ATXN1; (+) strand; PAM type: NRG; PAM sequence: CGG
tgcctcatttgtgtgagtct

SEQ ID NO: 143813 - DNA, 20 bp, Artificial Sequence
  Description of Artificial Sequence: Synthetic oligonucleotide
  Target: ATXN1; (+) strand; PAM type: NRG; PAM sequence: TAG
tcggctttcgtaactattaa

SEQ ID NO: 143814 - DNA, 20 bp, Artificial Sequence
  Description of Artificial Sequence: Synthetic oligonucleotide
  Target: ATXN1; (+) strand; PAM type: NRG; PAM sequence: CAG
tcgtaactattaatagatga

SEQ ID NO: 143815 - DNA, 20 bp, Artificial Sequence
  Description of Artificial Sequence: Synthetic oligonucleotide
  Target: ATXN1; (+) strand; PAM type: NRG; PAM sequence: TAG
cagatgttcttaaaaccttc

SEQ ID NO: 143816 - DNA, 20 bp, Artificial Sequence
  Description of Artificial Sequence: Synthetic oligonucleotide
  Target: ATXN1; (+) strand; PAM type: NRG; PAM sequence: GAG
gatgttcttaaaaccttcta

SEQ ID NO: 143817 - DNA, 20 bp, Artificial Sequence
  Description of Artificial Sequence: Synthetic oligonucleotide
  Target: ATXN1; (+) strand; PAM type: NRG; PAM sequence: AAG
accttctagagaaatctctc

SEQ ID NO: 143818 - DNA, 20 bp, Artificial Sequence
  Description of Artificial Sequence: Synthetic oligonucleotide
  Target: ATXN1; (+) strand; PAM type: NRG; PAM sequence: AGG
ccttctagagaaatctctca

SEQ ID NO: 143819 - DNA, 20 bp, Artificial Sequence
  Description of Artificial Sequence: Synthetic oligonucleotide
  Target: ATXN1; (+) strand; PAM type: NRG; PAM sequence: CAG
tctagagaaatctctcaagg

SEQ ID NO: 143820 - DNA, 20 bp, Artificial Sequence
  Description of Artificial Sequence: Synthetic oligonucleotide
  Target: ATXN1; (+) strand; PAM type: NRG; PAM sequence: TAG
atctctcaaggcagtgcaca

SEQ ID NO: 143821 - DNA, 20 bp, Artificial Sequence
  Description of Artificial Sequence: Synthetic oligonucleotide
  Target: ATXN1; (+) strand; PAM type: NRG; PAM sequence: CAG
caaggcagtgcacatagtgc

SEQ ID NO: 143822 - DNA, 20 bp, Artificial Sequence
  Description of Artificial Sequence: Synthetic oligonucleotide
  Target: ATXN1; (+) strand; PAM type: NRG; PAM sequence: GAG
gctctcatttttctctaatt

SEQ ID NO: 143823 - DNA, 20 bp, Artificial Sequence
  Description of Artificial Sequence: Synthetic oligonucleotide
  Target: ATXN1; (+) strand; PAM type: NRG; PAM sequence: GAG
tcatttttctctaattgagt

SEQ ID NO: 143824 - DNA, 20 bp, Artificial Sequence
  Description of Artificial Sequence: Synthetic oligonucleotide
  Target: ATXN1; (+) strand; PAM type: NRG; PAM sequence: AGG
catttttctctaattgagtg

SEQ ID NO: 143825 - DNA, 20 bp, Artificial Sequence
  Description of Artificial Sequence: Synthetic oligonucleotide
  Target: ATXN1; (+) strand; PAM type: NRG; PAM sequence: AAG
ctctaattgagtgaggacta

SEQ ID NO: 143826 - DNA, 20 bp, Artificial Sequence
  Description of Artificial Sequence: Synthetic oligonucleotide
  Target: ATXN1; (+) strand; PAM type: NRG; PAM sequence: TGG
gagtgaggactaaagaacac

SEQ ID NO: 143827 - DNA, 20 bp, Artificial Sequence
  Description of Artificial Sequence: Synthetic oligonucleotide
  Target: ATXN1; (+) strand; PAM type: NRG; PAM sequence: AAG
tttttttgtttttattacta

SEQ ID NO: 143828 - DNA, 20 bp, Artificial Sequence
  Description of Artificial Sequence: Synthetic oligonucleotide
  Target: ATXN1; (+) strand; PAM type: NRG; PAM sequence: TAG
tgtttttattactaaagttt

SEQ ID NO: 143829 - DNA, 20 bp, Artificial Sequence
  Description of Artificial Sequence: Synthetic oligonucleotide
  Target: ATXN1; (+) strand; PAM type: NRG; PAM sequence: AGG
gtttttattactaaagtttt

SEQ ID NO: 143830 - DNA, 20 bp, Artificial Sequence
  Description of Artificial Sequence: Synthetic oligonucleotide
  Target: ATXN1; (+) strand; PAM type: NRG; PAM sequence: GGG
tttttattactaaagtttta

SEQ ID NO: 143831 - DNA, 20 bp, Artificial Sequence
  Description of Artificial Sequence: Synthetic oligonucleotide
  Target: ATXN1; (+) strand; PAM type: NRG; PAM sequence: CAG
gggtacatgtgcacaatgtg

SEQ ID NO: 143832 - DNA, 20 bp, Artificial Sequence
  Description of Artificial Sequence: Synthetic oligonucleotide
  Target: ATXN1; (+) strand; PAM type: NRG; PAM sequence: AGG
ggtacatgtgcacaatgtgc

SEQ ID NO: 143833 - DNA, 20 bp, Artificial Sequence
  Description of Artificial Sequence: Synthetic oligonucleotide
  Target: ATXN1; (+) strand; PAM type: NRG; PAM sequence: TGG
tatgtacacatgtgccatgt

SEQ ID NO: 143834 - DNA, 20 bp, Artificial Sequence
  Description of Artificial Sequence: Synthetic oligonucleotide
  Target: ATXN1; (+) strand; PAM type: NRG; PAM sequence: TAG
gcaaccattaactcgtcatt

SEQ ID NO: 143835 - DNA, 20 bp, Artificial Sequence
  Description of Artificial Sequence: Synthetic oligonucleotide
  Target: ATXN1; (+) strand; PAM type: NRG; PAM sequence: TAG
attaactcgtcatttagcat

SEQ ID NO: 143836 - DNA, 20 bp, Artificial Sequence
  Description of Artificial Sequence: Synthetic oligonucleotide
  Target: ATXN1; (+) strand; PAM type: NRG; PAM sequence: AGG
ttaactcgtcatttagcatt

SEQ ID NO: 143837 - DNA, 20 bp, Artificial Sequence
  Description of Artificial Sequence: Synthetic oligonucleotide
  Target: ATXN1; (+) strand; PAM type: NRG; PAM sequence: CAG
cccctcccccaaccccacaa

SEQ ID NO: 143838 - DNA, 20 bp, Artificial Sequence
  Description of Artificial Sequence: Synthetic oligonucleotide
  Target: ATXN1; (+) strand; PAM type: NRG; PAM sequence: AGG
ccctcccccaaccccacaac

SEQ ID NO: 143839 - DNA, 20 bp, Artificial Sequence
  Description of Artificial Sequence: Synthetic oligonucleotide
  Target: ATXN1; (+) strand; PAM type: NRG; PAM sequence: CAG
cccaaccccacaacaggccc

SEQ ID NO: 143840 - DNA, 20 bp, Artificial Sequence
  Description of Artificial Sequence: Synthetic oligonucleotide
  Target: ATXN1; (+) strand; PAM type: NRG; PAM sequence: TGG
tgttccccttcctgtgtcca

SEQ ID NO: 143841 - DNA, 20 bp, Artificial Sequence
  Description of Artificial Sequence: Synthetic oligonucleotide
  Target: ATXN1; (+) strand; PAM type: NRG; PAM sequence: CAG
cttcctgtgtccatggaaca

SEQ ID NO: 143842 - DNA, 20 bp, Artificial Sequence
  Description of Artificial Sequence: Synthetic oligonucleotide
  Target: ATXN1; (+) strand; PAM type: NRG; PAM sequence: AGG
ttcctgtgtccatggaacac

SEQ ID NO: 143843 - DNA, 20 bp, Artificial Sequence
  Description of Artificial Sequence: Synthetic oligonucleotide
  Target: ATXN1; (+) strand; PAM type: NRG; PAM sequence: TGG
tttttaaacatcttgccttt

SEQ ID NO: 143844 - DNA, 20 bp, Artificial Sequence
  Description of Artificial Sequence: Synthetic oligonucleotide
  Target: ATXN1; (+) strand; PAM type: NRG; PAM sequence: GAG
acatcttgccttttggtctt

SEQ ID NO: 143845 - DNA, 20 bp, Artificial Sequence
  Description of Artificial Sequence: Synthetic oligonucleotide
  Target: ATXN1; (+) strand; PAM type: NRG; PAM sequence: GAG
atcttgccttttggtcttga

SEQ ID NO: 143846 - DNA, 20 bp, Artificial Sequence
  Description of Artificial Sequence: Synthetic oligonucleotide
  Target: ATXN1; (+) strand; PAM type: NRG; PAM sequence: AAG
gccttttggtcttgagagtc

SEQ ID NO: 143847 - DNA, 20 bp, Artificial Sequence
  Description of Artificial Sequence: Synthetic oligonucleotide
  Target: ATXN1; (+) strand; PAM type: NRG; PAM sequence: TAG
ggtcttgagagtcaagatat

SEQ ID NO: 143848 - DNA, 20 bp, Artificial Sequence
  Description of Artificial Sequence: Synthetic oligonucleotide
  Target: ATXN1; (+) strand; PAM type: NRG; PAM sequence: CAG
tattagccatgtaattgaac

SEQ ID NO: 143849 - DNA, 20 bp, Artificial Sequence
  Description of Artificial Sequence: Synthetic oligonucleotide
  Target: ATXN1; (+) strand; PAM type: NRG; PAM sequence: AAG
tagccatgtaattgaaccag

SEQ ID NO: 143850 - DNA, 20 bp, Artificial Sequence
  Description of Artificial Sequence: Synthetic oligonucleotide
  Target: ATXN1; (+) strand; PAM type: NRG; PAM sequence: TAG
tgtaattgaaccagaagctt

SEQ ID NO: 143851 - DNA, 20 bp, Artificial Sequence
  Description of Artificial Sequence: Synthetic oligonucleotide
  Target: ATXN1; (+) strand; PAM type: NRG; PAM sequence: AAG
agaagctttagatattatta

SEQ ID NO: 143852 - DNA, 20 bp, Artificial Sequence
  Description of Artificial Sequence: Synthetic oligonucleotide
  Target: ATXN1; (+) strand; PAM type: NRG; PAM sequence: GAG
aagctttagatattattaaa

SEQ ID NO: 143853 - DNA, 20 bp, Artificial Sequence
  Description of Artificial Sequence: Synthetic oligonucleotide
  Target: ATXN1; (+) strand; PAM type: NRG; PAM sequence: CAG
ttagatattattaaagagaa

SEQ ID NO: 143854 - DNA, 20 bp, Artificial Sequence
  Description of Artificial Sequence: Synthetic oligonucleotide
  Target: ATXN1; (+) strand; PAM type: NRG; PAM sequence: AGG
tagatattattaaagagaac

SEQ ID NO: 143855 - DNA, 20 bp, Artificial Sequence
  Description of Artificial Sequence: Synthetic oligonucleotide
  Target: ATXN1; (+) strand; PAM type: NRG; PAM sequence: GAG
gatattattaaagagaacag

SEQ ID NO: 143856 - DNA, 20 bp, Artificial Sequence
  Description of Artificial Sequence: Synthetic oligonucleotide
  Target: ATXN1; (+) strand; PAM type: NRG; PAM sequence: TAG
ttaaagagaacaggagtcta

SEQ ID NO: 143857 - DNA, 20 bp, Artificial Sequence
  Description of Artificial Sequence: Synthetic oligonucleotide
  Target: ATXN1; (+) strand; PAM type: NRG; PAM sequence: GAG
aaagagaacaggagtctata

SEQ ID NO: 143858 - DNA, 20 bp, Artificial Sequence
  Description of Artificial Sequence: Synthetic oligonucleotide
  Target: ATXN1; (+) strand; PAM type: NRG; PAM sequence: CAG
gaacaggagtctatagagtt

SEQ ID NO: 143859 - DNA, 20 bp, Artificial Sequence
  Description of Artificial Sequence: Synthetic oligonucleotide
  Target: ATXN1; (+) strand; PAM type: NRG; PAM sequence: AAG
ggagtctatagagttcagcc

SEQ ID NO: 143860 - DNA, 20 bp, Artificial Sequence
  Description of Artificial Sequence: Synthetic oligonucleotide
  Target: ATXN1; (+) strand; PAM type: NRG; PAM sequence: AGG
gagtctatagagttcagcca

SEQ ID NO: 143861 - DNA, 20 bp, Artificial Sequence
  Description of Artificial Sequence: Synthetic oligonucleotide
  Target: ATXN1; (+) strand; PAM type: NRG; PAM sequence: GGG
agtctatagagttcagccaa

SEQ ID NO: 143862 - DNA, 20 bp, Artificial Sequence
  Description of Artificial Sequence: Synthetic oligonucleotide
  Target: ATXN1; (+) strand; PAM type: NRG; PAM sequence: GAG
ttcagccaagggtgcccact

SEQ ID NO: 143863 - DNA, 20 bp, Artificial Sequence
  Description of Artificial Sequence: Synthetic oligonucleotide
  Target: ATXN1; (+) strand; PAM type: NRG; PAM sequence: AAG
agccaagggtgcccactgag

SEQ ID NO: 143864 - DNA, 20 bp, Artificial Sequence
  Description of Artificial Sequence: Synthetic oligonucleotide
  Target: ATXN1; (+) strand; PAM type: NRG; PAM sequence: TAG
cccactgagaagctccatgc

SEQ ID NO: 143865 - DNA, 20 bp, Artificial Sequence
  Description of Artificial Sequence: Synthetic oligonucleotide
  Target: ATXN1; (+) strand; PAM type: NRG; PAM sequence: CAG
tagtttatttgtgactttct

SEQ ID NO: 143866 - DNA, 20 bp, Artificial Sequence
  Description of Artificial Sequence: Synthetic oligonucleotide
  Target: ATXN1; (+) strand; PAM type: NRG; PAM sequence: AGG
agtttatttgtgactttctc

SEQ ID NO: 143867 - DNA, 20 bp, Artificial Sequence
  Description of Artificial Sequence: Synthetic oligonucleotide
  Target: ATXN1; (+) strand; PAM type: NRG; PAM sequence: GGG
gtttatttgtgactttctca

SEQ ID NO: 143868 - DNA, 20 bp, Artificial Sequence
  Description of Artificial Sequence: Synthetic oligonucleotide
  Target: ATXN1; (+) strand; PAM type: NRG; PAM sequence: AAG
tatttgtgactttctcaggg

SEQ ID NO: 143869 - DNA, 20 bp, Artificial Sequence
  Description of Artificial Sequence: Synthetic oligonucleotide
  Target: ATXN1; (+) strand; PAM type: NRG; PAM sequence: GAG
tttgtgactttctcagggaa

SEQ ID NO: 143870 - DNA, 20 bp, Artificial Sequence
  Description of Artificial Sequence: Synthetic oligonucleotide
  Target: ATXN1; (+) strand; PAM type: NRG; PAM sequence: TAG
actttctcagggaagagaat

SEQ ID NO: 143871 - DNA, 20 bp, Artificial Sequence
  Description of Artificial Sequence: Synthetic oligonucleotide
  Target: ATXN1; (+) strand; PAM type: NRG; PAM sequence: AGG
ctttctcagggaagagaatt

SEQ ID NO: 143872 - DNA, 20 bp, Artificial Sequence
  Description of Artificial Sequence: Synthetic oligonucleotide
  Target: ATXN1; (+) strand; PAM type: NRG; PAM sequence: TAG
tgtcctactgcaaactgaaa

SEQ ID NO: 143873 - DNA, 20 bp, Artificial Sequence
  Description of Artificial Sequence: Synthetic oligonucleotide
  Target: ATXN1; (+) strand; PAM type: NRG; PAM sequence: AAG
ctgcaaactgaaatagaata

SEQ ID NO: 143874 - DNA, 20 bp, Artificial Sequence
  Description of Artificial Sequence: Synthetic oligonucleotide
  Target: ATXN1; (+) strand; PAM type: NRG; PAM sequence: TAG
caaactgaaatagaataaag

SEQ ID NO: 143875 - DNA, 20 bp, Artificial Sequence
  Description of Artificial Sequence: Synthetic oligonucleotide
  Target: ATXN1; (+) strand; PAM type: NRG; PAM sequence: AGG
aaactgaaatagaataaagt

SEQ ID NO: 143876 - DNA, 20 bp, Artificial Sequence
  Description of Artificial Sequence: Synthetic oligonucleotide
  Target: ATXN1; (+) strand; PAM type: NRG; PAM sequence: TAG
tgaaatagaataaagtagga

SEQ ID NO: 143877 - DNA, 20 bp, Artificial Sequence
  Description of Artificial Sequence: Synthetic oligonucleotide
  Target: ATXN1; (+) strand; PAM type: NRG; PAM sequence: TGG
taggatagtatactaactct

SEQ ID NO: 143878 - DNA, 20 bp, Artificial Sequence
  Description of Artificial Sequence: Synthetic oligonucleotide
  Target: ATXN1; (+) strand; PAM type: NRG; PAM sequence: CAG
aactcttggcaaaaaattct

SEQ ID NO: 143879 - DNA, 20 bp, Artificial Sequence
  Description of Artificial Sequence: Synthetic oligonucleotide
  Target: ATXN1; (+) strand; PAM type: NRG; PAM sequence: CAG
cttaatgacatccatacctc

SEQ ID NO: 143880 - DNA, 20 bp, Artificial Sequence
  Description of Artificial Sequence: Synthetic oligonucleotide
  Target: ATXN1; (+) strand; PAM type: NRG; PAM sequence: AAG
tccagttccatgccctgttc

SEQ ID NO: 143881 - DNA, 20 bp, Artificial Sequence
  Description of Artificial Sequence: Synthetic oligonucleotide
  Target: ATXN1; (+) strand; PAM type: NRG; PAM sequence: CAG
atttcgtatacctctgtttt

SEQ ID NO: 143882 - DNA, 20 bp, Artificial Sequence
  Description of Artificial Sequence: Synthetic oligonucleotide
  Target: ATXN1; (+) strand; PAM type: NRG; PAM sequence: TAG
tcgtatacctctgttttcag

SEQ ID NO: 143883 - DNA, 20 bp, Artificial Sequence
  Description of Artificial Sequence: Synthetic oligonucleotide
  Target: ATXN1; (+) strand; PAM type: NRG; PAM sequence: AGG
cgtatacctctgttttcagt

SEQ ID NO: 143884 - DNA, 20 bp, Artificial Sequence
  Description of Artificial Sequence: Synthetic oligonucleotide
  Target: ATXN1; (+) strand; PAM type: NRG; PAM sequence: TGG
tcagtaggaatgccacaaac

SEQ ID NO: 143885 - DNA, 20 bp, Artificial Sequence
  Description of Artificial Sequence: Synthetic oligonucleotide
  Target: ATXN1; (+) strand; PAM type: NRG; PAM sequence: TGG
aggaatgccacaaactggta

SEQ ID NO: 143886 - DNA, 20 bp, Artificial Sequence
  Description of Artificial Sequence: Synthetic oligonucleotide
  Target: ATXN1; (+) strand; PAM type: NRG; PAM sequence: GAG
gaatgccacaaactggtatg

SEQ ID NO: 143887 - DNA, 20 bp, Artificial Sequence
  Description of Artificial Sequence: Synthetic oligonucleotide
  Target: ATXN1; (+) strand; PAM type: NRG; PAM sequence: GAG
tatttactttattttatttt

SEQ ID NO: 143888 - DNA, 20 bp, Artificial Sequence
  Description of Artificial Sequence: Synthetic oligonucleotide
  Target: ATXN1; (+) strand; PAM type: NRG; PAM sequence: TAG
tactttattttattttgaga

SEQ ID NO: 143889 - DNA, 20 bp, Artificial Sequence
  Description of Artificial Sequence: Synthetic oligonucleotide
  Target: ATXN1; (+) strand; PAM type: NRG; PAM sequence: AGG
actttattttattttgagat

SEQ ID NO: 143890 - DNA, 20 bp, Artificial Sequence
  Description of Artificial Sequence: Synthetic oligonucleotide
  Target: ATXN1; (+) strand; PAM type: NRG; PAM sequence: GGG
ctttattttattttgagata

SEQ ID NO: 143891 - DNA, 20 bp, Artificial Sequence
  Description of Artificial Sequence: Synthetic oligonucleotide
  Target: ATXN1; (+) strand; PAM type: NRG; PAM sequence: GGG
tttattttattttgagatag

SEQ ID NO: 143892 - DNA, 20 bp, Artificial Sequence
  Description of Artificial Sequence: Synthetic oligonucleotide
  Target: ATXN1; (+) strand; PAM type: NRG; PAM sequence: CAG
agataggggtctatgttgcc

SEQ ID NO: 143893 - DNA, 20 bp, Artificial Sequence
  Description of Artificial Sequence: Synthetic oligonucleotide
  Target: ATXN1; (+) strand; PAM type: NRG; PAM sequence: TGG
ggggtctatgttgcccagtc

SEQ ID NO: 143894 - DNA, 20 bp, Artificial Sequence
  Description of Artificial Sequence: Synthetic oligonucleotide
  Target: ATXN1; (+) strand; PAM type: NRG; PAM sequence: TGG
ccagtctggtcttgaactcc

SEQ ID NO: 143895 - DNA, 20 bp, Artificial Sequence
  Description of Artificial Sequence: Synthetic oligonucleotide
  Target: ATXN1; (+) strand; PAM type: NRG; PAM sequence: AAG
ggtcttgaactcctggcctc

SEQ ID NO: 143896 - DNA, 20 bp, Artificial Sequence
  Description of Artificial Sequence: Synthetic oligonucleotide
  Target: ATXN1; (+) strand; PAM type: NRG; PAM sequence: TGG
ctcaagcaatcctcccacct

SEQ ID NO: 143897 - DNA, 20 bp, Artificial Sequence
  Description of Artificial Sequence: Synthetic oligonucleotide
  Target: ATXN1; (+) strand; PAM type: NRG; PAM sequence: TGG
atcctcccaccttggcctcc

SEQ ID NO: 143898 - DNA, 20 bp, Artificial Sequence
  Description of Artificial Sequence: Synthetic oligonucleotide
  Target: ATXN1; (+) strand; PAM type: NRG; PAM sequence: GGG
tcctcccaccttggcctcct

SEQ ID NO: 143899 - DNA, 20 bp, Artificial Sequence
  Description of Artificial Sequence: Synthetic oligonucleotide
  Target: ATXN1; (+) strand; PAM type: NRG; PAM sequence: AAG
cccaccttggcctcctgggt

SEQ ID NO: 143900 - DNA, 20 bp, Artificial Sequence
  Description of Artificial Sequence: Synthetic oligonucleotide
  Target: ATXN1; (+) strand; PAM type: NRG; PAM sequence: AGG
ccaccttggcctcctgggta

SEQ ID NO: 143901 - DNA, 20 bp, Artificial Sequence
  Description of Artificial Sequence: Synthetic oligonucleotide
  Target: ATXN1; (+) strand; PAM type: NRG; PAM sequence: TGG
ttgtaatgaatattattatt

SEQ ID NO: 143902 - DNA, 20 bp, Artificial Sequence
  Description of Artificial Sequence: Synthetic oligonucleotide
  Target: ATXN1; (+) strand; PAM type: NRG; PAM sequence: CAG
gaatattattatttggatga

SEQ ID NO: 143903 - DNA, 20 bp, Artificial Sequence
  Description of Artificial Sequence: Synthetic oligonucleotide
  Target: ATXN1; (+) strand; PAM type: NRG; PAM sequence: CAG
attatttggatgacagactg

SEQ ID NO: 143904 - DNA, 20 bp, Artificial Sequence
  Description of Artificial Sequence: Synthetic oligonucleotide
  Target: ATXN1; (+) strand; PAM type: NRG; PAM sequence: AGG
ttatttggatgacagactgc

SEQ ID NO: 143905 - DNA, 20 bp, Artificial Sequence
  Description of Artificial Sequence: Synthetic oligonucleotide
  Target: ATXN1; (+) strand; PAM type: NRG; PAM sequence: AAG
tttggatgacagactgcagg

SEQ ID NO: 143906 - DNA, 20 bp, Artificial Sequence
  Description of Artificial Sequence: Synthetic oligonucleotide
  Target: ATXN1; (+) strand; PAM type: NRG; PAM sequence: CAG
atgacagactgcaggaagcc

SEQ ID NO: 143907 - DNA, 20 bp, Artificial Sequence
  Description of Artificial Sequence: Synthetic oligonucleotide
  Target: ATXN1; (+) strand; PAM type: NRG; PAM sequence: TGG
cagaatccaccccattttct

SEQ ID NO: 143908 - DNA, 20 bp, Artificial Sequence
  Description of Artificial Sequence: Synthetic oligonucleotide
  Target: ATXN1; (+) strand; PAM type: NRG; PAM sequence: GAG
tggcatcataattactcttt

SEQ ID NO: 143909 - DNA, 20 bp, Artificial Sequence
  Description of Artificial Sequence: Synthetic oligonucleotide
  Target: ATXN1; (+) strand; PAM type: NRG; PAM sequence: GAG
ctgtacactttgtataaaat

SEQ ID NO: 143910 - DNA, 20 bp, Artificial Sequence
  Description of Artificial Sequence: Synthetic oligonucleotide
  Target: ATXN1; (+) strand; PAM type: NRG; PAM sequence: GAG
gtacactttgtataaaatga

SEQ ID NO: 143911 - DNA, 20 bp, Artificial Sequence
  Description of Artificial Sequence: Synthetic oligonucleotide
  Target: ATXN1; (+) strand; PAM type: NRG; PAM sequence: AAG
aaaatgagagcatgtaaatc

SEQ ID NO: 143912 - DNA, 20 bp, Artificial Sequence
  Description of Artificial Sequence: Synthetic oligonucleotide
  Target: ATXN1; (+) strand; PAM type: NRG; PAM sequence: TAG
taataacaacaatcctccca

SEQ ID NO: 143913 - DNA, 20 bp, Artificial Sequence
  Description of Artificial Sequence: Synthetic oligonucleotide
  Target: ATXN1; (+) strand; PAM type: NRG; PAM sequence: GAG
ccatagtatgtcaaactcac

SEQ ID NO: 143914 - DNA, 20 bp, Artificial Sequence
  Description of Artificial Sequence: Synthetic oligonucleotide
  Target: ATXN1; (+) strand; PAM type: NRG; PAM sequence: AGG
catagtatgtcaaactcacg

SEQ ID NO: 143915 - DNA, 20 bp, Artificial Sequence
  Description of Artificial Sequence: Synthetic oligonucleotide
  Target: ATXN1; (+) strand; PAM type: NRG; PAM sequence: CAG
ctccaaaccctcctttctct

SEQ ID NO: 143916 - DNA, 20 bp, Artificial Sequence
  Description of Artificial Sequence: Synthetic oligonucleotide
  Target: ATXN1; (+) strand; PAM type: NRG; PAM sequence: AAG
tcctttctctcagacaaacc

SEQ ID NO: 143917 - DNA, 20 bp, Artificial Sequence
  Description of Artificial Sequence: Synthetic oligonucleotide
  Target: ATXN1; (+) strand; PAM type: NRG; PAM sequence: AAG
tcagacaaaccaagtaattg

SEQ ID NO: 143918 - DNA, 20 bp, Artificial Sequence
  Description of Artificial Sequence: Synthetic oligonucleotide
  Target: ATXN1; (+) strand; PAM type: NRG; PAM sequence: AAG
aattgaagacatgtattttc

SEQ ID NO: 143919 - DNA, 20 bp, Artificial Sequence
  Description of Artificial Sequence: Synthetic oligonucleotide
  Target: ATXN1; (+) strand; PAM type: NRG; PAM sequence: AGG
attgaagacatgtattttca

SEQ ID NO: 143920 - DNA, 20 bp, Artificial Sequence
  Description of Artificial Sequence: Synthetic oligonucleotide
  Target: ATXN1; (+) strand; PAM type: NRG; PAM sequence: TGG
acatgtattttcaaggaaca

SEQ ID NO: 143921 - DNA, 20 bp, Artificial Sequence
  Description of Artificial Sequence: Synthetic oligonucleotide
  Target: ATXN1; (+) strand; PAM type: NRG; PAM sequence: AAG
tattttcaaggaacatggct

SEQ ID NO: 143922 - DNA, 20 bp, Artificial Sequence
  Description of Artificial Sequence: Synthetic oligonucleotide
  Target: ATXN1; (+) strand; PAM type: NRG; PAM sequence: GAG
ttttcaaggaacatggctaa

SEQ ID NO: 143923 - DNA, 20 bp, Artificial Sequence
  Description of Artificial Sequence: Synthetic oligonucleotide
  Target: ATXN1; (+) strand; PAM type: NRG; PAM sequence: CAG
tcaaggaacatggctaagag

SEQ ID NO: 143924 - DNA, 20 bp, Artificial Sequence
  Description of Artificial Sequence: Synthetic oligonucleotide
  Target: ATXN1; (+) strand; PAM type: NRG; PAM sequence: CAG
taccacatcaaacttctgtg

SEQ ID NO: 143925 - DNA, 20 bp, Artificial Sequence
  Description of Artificial Sequence: Synthetic oligonucleotide
  Target: ATXN1; (+) strand; PAM type: NRG; PAM sequence: AAG
cacatcaaacttctgtgcag

SEQ ID NO: 143926 - DNA, 20 bp, Artificial Sequence
  Description of Artificial Sequence: Synthetic oligonucleotide
  Target: ATXN1; (+) strand; PAM type: NRG; PAM sequence: AAG
caaacttctgtgcagaagtt

SEQ ID NO: 143927 - DNA, 20 bp, Artificial Sequence
  Description of Artificial Sequence: Synthetic oligonucleotide
  Target: ATXN1; (+) strand; PAM type: NRG; PAM sequence: AAG
cttctgtgcagaagttaaga

SEQ ID NO: 143928 - DNA, 20 bp, Artificial Sequence
  Description of Artificial Sequence: Synthetic oligonucleotide
  Target: ATXN1; (+) strand; PAM type: NRG; PAM sequence: AGG
ttctgtgcagaagttaagaa

SEQ ID NO: 143929 - DNA, 20 bp, Artificial Sequence
  Description of Artificial Sequence: Synthetic oligonucleotide
  Target: ATXN1; (+) strand; PAM type: NRG; PAM sequence: GAG
ctgtgcagaagttaagaaag

SEQ ID NO: 143930 - DNA, 20 bp, Artificial Sequence
  Description of Artificial Sequence: Synthetic oligonucleotide
  Target: ATXN1; (+) strand; PAM type: NRG; PAM sequence: TAG
cttattcctaatgactgtga

SEQ ID NO: 143931 - DNA, 20 bp, Artificial Sequence
  Description of Artificial Sequence: Synthetic oligonucleotide
  Target: ATXN1; (+) strand; PAM type: NRG; PAM sequence: TGG
gatagactttctgccttgaa

SEQ ID NO: 143932 - DNA, 20 bp, Artificial Sequence
  Description of Artificial Sequence: Synthetic oligonucleotide
  Target: ATXN1; (+) strand; PAM type: NRG; PAM sequence: AAG
aatggtgcatttccatttgt

SEQ ID NO: 143933 - DNA, 20 bp, Artificial Sequence
  Description of Artificial Sequence: Synthetic oligonucleotide
  Target: ATXN1; (+) strand; PAM type: NRG; PAM sequence: TAG
ccatttgtaagctccattta

SEQ ID NO: 143934 - DNA, 20 bp, Artificial Sequence
  Description of Artificial Sequence: Synthetic oligonucleotide
  Target: ATXN1; (+) strand; PAM type: NRG; PAM sequence: AAG
ctccatttatagaatcacac

SEQ ID NO: 143935 - DNA, 20 bp, Artificial Sequence
  Description of Artificial Sequence: Synthetic oligonucleotide
  Target: ATXN1; (+) strand; PAM type: NRG; PAM sequence: TGG
ttttttgtatacatcactct

SEQ ID NO: 143936 - DNA, 20 bp, Artificial Sequence
  Description of Artificial Sequence: Synthetic oligonucleotide
  Target: ATXN1; (+) strand; PAM type: NRG; PAM sequence: TGG
tttgtatacatcactcttgg

SEQ ID NO: 143937 - DNA, 20 bp, Artificial Sequence
  Description of Artificial Sequence: Synthetic oligonucleotide
  Target: ATXN1; (+) strand; PAM type: NRG; PAM sequence: AAG
ggaaattttcaacaaccaca

SEQ ID NO: 143938 - DNA, 20 bp, Artificial Sequence
  Description of Artificial Sequence: Synthetic oligonucleotide
  Target: ATXN1; (+) strand; PAM type: NRG; PAM sequence: AGG
gaaattttcaacaaccacaa

SEQ ID NO: 143939 - DNA, 20 bp, Artificial Sequence
  Description of Artificial Sequence: Synthetic oligonucleotide
  Target: ATXN1; (+) strand; PAM type: NRG; PAM sequence: TGG
attttcaacaaccacaaagg

SEQ ID NO: 143940 - DNA, 20 bp, Artificial Sequence
  Description of Artificial Sequence: Synthetic oligonucleotide
  Target: ATXN1; (+) strand; PAM type: NRG; PAM sequence: GGG
ttttcaacaaccacaaaggt

SEQ ID NO: 143941 - DNA, 20 bp, Artificial Sequence
  Description of Artificial Sequence: Synthetic oligonucleotide
  Target: ATXN1; (+) strand; PAM type: NRG; PAM sequence: GGG
tttcaacaaccacaaaggtg

SEQ ID NO: 143942 - DNA, 20 bp, Artificial Sequence
  Description of Artificial Sequence: Synthetic oligonucleotide
  Target: ATXN1; (+) strand; PAM type: NRG; PAM sequence: GGG
ttcaacaaccacaaaggtgg

SEQ ID NO: 143943 - DNA, 20 bp, Artificial Sequence
  Description of Artificial Sequence: Synthetic oligonucleotide
  Target: ATXN1; (+) strand; PAM type: NRG; PAM sequence: AAG
acaaccacaaaggtggggga

SEQ ID NO: 143944 - DNA, 20 bp, Artificial Sequence
  Description of Artificial Sequence: Synthetic oligonucleotide
  Target: ATXN1; (+) strand; PAM type: NRG; PAM sequence: AGG
caaccacaaaggtgggggaa

SEQ ID NO: 143945 - DNA, 20 bp, Artificial Sequence
  Description of Artificial Sequence: Synthetic oligonucleotide
  Target: ATXN1; (+) strand; PAM type: NRG; PAM sequence: GGG
aaccacaaaggtgggggaaa

SEQ ID NO: 143946 - DNA, 20 bp, Artificial Sequence
  Description of Artificial Sequence: Synthetic oligonucleotide
  Target: ATXN1; (+) strand; PAM type: NRG; PAM sequence: TGG
caaaggtgggggaaagggcg

SEQ ID NO: 143947 - DNA, 20 bp, Artificial Sequence
  Description of Artificial Sequence: Synthetic oligonucleotide
  Target: ATXN1; (+) strand; PAM type: NRG; PAM sequence: TAG
cgtggcgtacactgactcct

SEQ ID NO: 143948 - DNA, 20 bp, Artificial Sequence
  Description of Artificial Sequence: Synthetic oligonucleotide
  Target: ATXN1; (+) strand; PAM type: NRG; PAM sequence: TAG
gtttcctgatgttgccattt

SEQ ID NO: 143949 - DNA, 20 bp, Artificial Sequence
  Description of Artificial Sequence: Synthetic oligonucleotide
  Target: ATXN1; (+) strand; PAM type: NRG; PAM sequence: AAG
ttgccattttagtgtatttt

SEQ ID NO: 143950 - DNA, 20 bp, Artificial Sequence
  Description of Artificial Sequence: Synthetic oligonucleotide
  Target: ATXN1; (+) strand; PAM type: NRG; PAM sequence: TGG
gtattttaagtatttactta

SEQ ID NO: 143951 - DNA, 20 bp, Artificial Sequence
  Description of Artificial Sequence: Synthetic oligonucleotide
  Target: ATXN1; (+) strand; PAM type: NRG; PAM sequence: TAG
tttacttatggcaacaatta

SEQ ID NO: 143952 - DNA, 20 bp, Artificial Sequence
  Description of Artificial Sequence: Synthetic oligonucleotide
  Target: ATXN1; (+) strand; PAM type: NRG; PAM sequence: AAG
ggcaacaattatagttcaca

SEQ ID NO: 143953 - DNA, 20 bp, Artificial Sequence
  Description of Artificial Sequence: Synthetic oligonucleotide
  Target: ATXN1; (+) strand; PAM type: NRG; PAM sequence: CGG
cactgttctctttttccatc

SEQ ID NO: 143954 - DNA, 20 bp, Artificial Sequence
  Description of Artificial Sequence: Synthetic oligonucleotide
  Target: ATXN1; (+) strand; PAM type: NRG; PAM sequence: CAG
tgttctctttttccatccgg

SEQ ID NO: 143955 - DNA, 20 bp, Artificial Sequence
  Description of Artificial Sequence: Synthetic oligonucleotide
  Target: ATXN1; (+) strand; PAM type: NRG; PAM sequence: TGG
ttccatccggcagaccccct

SEQ ID NO: 143956 - DNA, 20 bp, Artificial Sequence
  Description of Artificial Sequence: Synthetic oligonucleotide
  Target: ATXN1; (+) strand; PAM type: NRG; PAM sequence: AAG
cttggtgtgctctactacaa

SEQ ID NO: 143957 - DNA, 20 bp, Artificial Sequence
  Description of Artificial Sequence: Synthetic oligonucleotide
  Target: ATXN1; (+) strand; PAM type: NRG; PAM sequence: AGG
ttggtgtgctctactacaaa

SEQ ID NO: 143958 - DNA, 20 bp, Artificial Sequence
  Description of Artificial Sequence: Synthetic oligonucleotide
  Target: ATXN1; (+) strand; PAM type: NRG; PAM sequence: CAG
gtgtgctctactacaaaagg

SEQ ID NO: 143959 - DNA, 20 bp, Artificial Sequence
  Description of Artificial Sequence: Synthetic oligonucleotide
  Target: ATXN1; (+) strand; PAM type: NRG; PAM sequence: CAG
tctgaatcactgctattaat

SEQ ID NO: 143960 - DNA, 20 bp, Artificial Sequence
  Description of Artificial Sequence: Synthetic oligonucleotide
  Target: ATXN1; (+) strand; PAM type: NRG; PAM sequence: AAG
atcactgctattaatcagta

SEQ ID NO: 143961 - DNA, 20 bp, Artificial Sequence
  Description of Artificial Sequence: Synthetic oligonucleotide
  Target: ATXN1; (+) strand; PAM type: NRG; PAM sequence: TGG
aaagaattgatgtccctatt

SEQ ID NO: 143962 - DNA, 20 bp, Artificial Sequence
  Description of Artificial Sequence: Synthetic oligonucleotide
  Target: ATXN1; (+) strand; PAM type: NRG; PAM sequence: TAG
tgatgtccctatttggtgaa

SEQ ID NO: 143963 - DNA, 20 bp, Artificial Sequence
  Description of Artificial Sequence: Synthetic oligonucleotide
  Target: ATXN1; (+) strand; PAM type: NRG; PAM sequence: AAG
tttttttttttttttacttt

SEQ ID NO: 143964 - DNA, 20 bp, Artificial Sequence
  Description of Artificial Sequence: Synthetic oligonucleotide
  Target: ATXN1; (+) strand; PAM type: NRG; PAM sequence: TGG
tttttttttactttaagttc

SEQ ID NO: 143965 - DNA, 20 bp, Artificial Sequence
  Description of Artificial Sequence: Synthetic oligonucleotide
  Target: ATXN1; (+) strand; PAM type: NRG; PAM sequence: GGG
ttttttttactttaagttct

SEQ ID NO: 143966 - DNA, 20 bp, Artificial Sequence
  Description of Artificial Sequence: Synthetic oligonucleotide
  Target: ATXN1; (+) strand; PAM type: NRG; PAM sequence: CAG
taagttctgggacaaatgtg

SEQ ID NO: 143967 - DNA, 20 bp, Artificial Sequence
  Description of Artificial Sequence: Synthetic oligonucleotide
  Target: ATXN1; (+) strand; PAM type: NRG; PAM sequence: CAG
ggacaaatgtgcagaacgtg

SEQ ID NO: 143968 - DNA, 20 bp, Artificial Sequence
  Description of Artificial Sequence: Synthetic oligonucleotide
  Target: ATXN1; (+) strand; PAM type: NRG; PAM sequence: AGG
gacaaatgtgcagaacgtgc

SEQ ID NO: 143969 - DNA, 20 bp, Artificial Sequence
  Description of Artificial Sequence: Synthetic oligonucleotide
  Target: ATXN1; (+) strand; PAM type: NRG; PAM sequence: AAG
aacgtgcaggtttgttacat

SEQ ID NO: 143970 - DNA, 20 bp, Artificial Sequence
  Description of Artificial Sequence: Synthetic oligonucleotide
  Target: ATXN1; (+) strand; PAM type: NRG; PAM sequence: CGG
acataagtatacatgtatca

SEQ ID NO: 143971 - DNA, 20 bp, Artificial Sequence
  Description of Artificial Sequence: Synthetic oligonucleotide
  Target: ATXN1; (+) strand; PAM type: NRG; PAM sequence: TGG
taagtatacatgtatcacgg

SEQ ID NO: 143972 - DNA, 20 bp, Artificial Sequence
  Description of Artificial Sequence: Synthetic oligonucleotide
  Target: ATXN1; (+) strand; PAM type: NRG; PAM sequence: TAG
gtacccttcaacccgtcatc

SEQ ID NO: 143973 - DNA, 20 bp, Artificial Sequence
  Description of Artificial Sequence: Synthetic oligonucleotide
  Target: ATXN1; (+) strand; PAM type: NRG; PAM sequence: AGG
tacccttcaacccgtcatct

SEQ ID NO: 143974 - DNA, 20 bp, Artificial Sequence
  Description of Artificial Sequence: Synthetic oligonucleotide
  Target: ATXN1; (+) strand; PAM type: NRG; PAM sequence: AAG
caacccgtcatctaggtttt

SEQ ID NO: 143975 - DNA, 20 bp, Artificial Sequence
  Description of Artificial Sequence: Synthetic oligonucleotide
  Target: ATXN1; (+) strand; PAM type: NRG; PAM sequence: TAG
gttttaagccccaaatgcat

SEQ ID NO: 143976 - DNA, 20 bp, Artificial Sequence
  Description of Artificial Sequence: Synthetic oligonucleotide
  Target: ATXN1; (+) strand; PAM type: NRG; PAM sequence: AGG
ttttaagccccaaatgcatt

SEQ ID NO: 143977 - DNA, 20 bp, Artificial Sequence
  Description of Artificial Sequence: Synthetic oligonucleotide
  Target: ATXN1; (+) strand; PAM type: NRG; PAM sequence: TGG
gcattaggtatttgtccaaa

SEQ ID NO: 143978 - DNA, 20 bp, Artificial Sequence
  Description of Artificial Sequence: Synthetic oligonucleotide
  Target: ATXN1; (+) strand; PAM type: NRG; PAM sequence: CAG
gtatttgtccaaatggaact

SEQ ID NO: 143979 - DNA, 20 bp, Artificial Sequence
  Description of Artificial Sequence: Synthetic oligonucleotide
  Target: ATXN1; (+) strand; PAM type: NRG; PAM sequence: CAG
tttgtccaaatggaactcag

SEQ ID NO: 143980 - DNA, 20 bp, Artificial Sequence
  Description of Artificial Sequence: Synthetic oligonucleotide
  Target: ATXN1; (+) strand; PAM type: NRG; PAM sequence: CAG
tccaaatggaactcagcagt

SEQ ID NO: 143981 - DNA, 20 bp, Artificial Sequence
  Description of Artificial Sequence: Synthetic oligonucleotide
  Target: ATXN1; (+) strand; PAM type: NRG; PAM sequence: CAG
gcaaaatatattaaatttgt

SEQ ID NO: 143982 - DNA, 20 bp, Artificial Sequence
  Description of Artificial Sequence: Synthetic oligonucleotide
  Target: ATXN1; (+) strand; PAM type: NRG; PAM sequence: TAG
tatattaaatttgtcagttc

SEQ ID NO: 143983 - DNA, 20 bp, Artificial Sequence
  Description of Artificial Sequence: Synthetic oligonucleotide
  Target: ATXN1; (+) strand; PAM type: NRG; PAM sequence: TGG
gcctacctccacattcacat

SEQ ID NO: 143984 - DNA, 20 bp, Artificial Sequence
  Description of Artificial Sequence: Synthetic oligonucleotide
  Target: ATXN1; (+) strand; PAM type: NRG; PAM sequence: GAG
tactccctgtcctcactcct

SEQ ID NO: 143985 - DNA, 20 bp, Artificial Sequence
  Description of Artificial Sequence: Synthetic oligonucleotide
  Target: ATXN1; (+) strand; PAM type: NRG; PAM sequence: CAG
ctcctgagcacctgtcacct

SEQ ID NO: 143986 - DNA, 20 bp, Artificial Sequence
  Description of Artificial Sequence: Synthetic oligonucleotide
  Target: ATXN1; (+) strand; PAM type: NRG; PAM sequence: AAG
cacctcagaccacaccactg

SEQ ID NO: 143987 - DNA, 20 bp, Artificial Sequence
  Description of Artificial Sequence: Synthetic oligonucleotide
  Target: ATXN1; (+) strand; PAM type: NRG; PAM sequence: AAG
ccaccccatgacccccaacc

SEQ ID NO: 143988 - DNA, 20 bp, Artificial Sequence
  Description of Artificial Sequence: Synthetic oligonucleotide
  Target: ATXN1; (+) strand; PAM type: NRG; PAM sequence: AAG
cccatgacccccaaccaaga

SEQ ID NO: 143989 - DNA, 20 bp, Artificial Sequence
  Description of Artificial Sequence: Synthetic oligonucleotide
  Target: ATXN1; (+) strand; PAM type: NRG; PAM sequence: AGG
ccatgacccccaaccaagaa

SEQ ID NO: 143990 - DNA, 20 bp, Artificial Sequence
  Description of Artificial Sequence: Synthetic oligonucleotide
  Target: ATXN1; (+) strand; PAM type: NRG; PAM sequence: GGG
catgacccccaaccaagaaa

SEQ ID NO: 143991 - DNA, 20 bp, Artificial Sequence
  Description of Artificial Sequence: Synthetic oligonucleotide
  Target: ATXN1; (+) strand; PAM type: NRG; PAM sequence: AAG
acccccaaccaagaaagggt

SEQ ID NO: 143992 - DNA, 20 bp, Artificial Sequence
  Description of Artificial Sequence: Synthetic oligonucleotide
  Target: ATXN1; (+) strand; PAM type: NRG; PAM sequence: CAG
caagaaagggtaagccaaca

SEQ ID NO: 143993 - DNA, 20 bp, Artificial Sequence
  Description of Artificial Sequence: Synthetic oligonucleotide
  Target: ATXN1; (+) strand; PAM type: NRG; PAM sequence: GAG
agaaagggtaagccaacaca

SEQ ID NO: 143994 - DNA, 20 bp, Artificial Sequence
  Description of Artificial Sequence: Synthetic oligonucleotide
  Target: ATXN1; (+) strand; PAM type: NRG; PAM sequence: AAG
aagggtaagccaacacagag

SEQ ID NO: 143995 - DNA, 20 bp, Artificial Sequence
  Description of Artificial Sequence: Synthetic oligonucleotide
  Target: ATXN1; (+) strand; PAM type: NRG; PAM sequence: CAG
gtaagccaacacagagaagc

SEQ ID NO: 143996 - DNA, 20 bp, Artificial Sequence
  Description of Artificial Sequence: Synthetic oligonucleotide
  Target: ATXN1; (+) strand; PAM type: NRG; PAM sequence: AGG
taagccaacacagagaagcc

SEQ ID NO: 143997 - DNA, 20 bp, Artificial Sequence
  Description of Artificial Sequence: Synthetic oligonucleotide
  Target: ATXN1; (+) strand; PAM type: NRG; PAM sequence: GGG
aagccaacacagagaagcca

SEQ ID NO: 143998 - DNA, 20 bp, Artificial Sequence
  Description of Artificial Sequence: Synthetic oligonucleotide
  Target: ATXN1; (+) strand; PAM type: NRG; PAM sequence: TGG
ccaacacagagaagccaggg

SEQ ID NO: 143999 - DNA, 20 bp, Artificial Sequence
  Description of Artificial Sequence: Synthetic oligonucleotide
  Target: ATXN1; (+) strand; PAM type: NRG; PAM sequence: GGG
caacacagagaagccagggt

SEQ ID NO: 144000 - DNA, 20 bp, Artificial Sequence
  Description of Artificial Sequence: Synthetic oligonucleotide
  Target: ATXN1; (+) strand; PAM type: NRG; PAM sequence: CAG
gagaagccagggtgggcgct

SEQ ID NO: 144001 - DNA, 20 bp, Artificial Sequence
  Description of Artificial Sequence: Synthetic oligonucleotide
  Target: ATXN1; (+) strand; PAM type: NRG; PAM sequence: GAG
gaagccagggtgggcgctca

SEQ ID NO: 144002 - DNA, 20 bp, Artificial Sequence
  Description of Artificial Sequence: Synthetic oligonucleotide
  Target: ATXN1; (+) strand; PAM type: NRG; PAM sequence: GAG
agccagggtgggcgctcaga

SEQ ID NO: 144003 - DNA, 20 bp, Artificial Sequence
  Description of Artificial Sequence: Synthetic oligonucleotide
  Target: ATXN1; (+) strand; PAM type: NRG; PAM sequence: TGG
tgggcgctcagagagactcc

SEQ ID NO: 144004 - DNA, 20 bp, Artificial Sequence
  Description of Artificial Sequence: Synthetic oligonucleotide
  Target: ATXN1; (+) strand; PAM type: NRG; PAM sequence: GGG
gggcgctcagagagactcct

SEQ ID NO: 144005 - DNA, 20 bp, Artificial Sequence
  Description of Artificial Sequence: Synthetic oligonucleotide
  Target: ATXN1; (+) strand; PAM type: NRG; PAM sequence: TGG
ctcagagagactcctgggtc

SEQ ID NO: 144006 - DNA, 20 bp, Artificial Sequence
  Description of Artificial Sequence: Synthetic oligonucleotide
  Target: ATXN1; (+) strand; PAM type: NRG; PAM sequence: TGG
cctgggtctggtcacttctg

SEQ ID NO: 144007 - DNA, 20 bp, Artificial Sequence
  Description of Artificial Sequence: Synthetic oligonucleotide
  Target: ATXN1; (+) strand; PAM type: NRG; PAM sequence: GGG
ctgggtctggtcacttctgt

SEQ ID NO: 144008 - DNA, 20 bp, Artificial Sequence
  Description of Artificial Sequence: Synthetic oligonucleotide
  Target: ATXN1; (+) strand; PAM type: NRG; PAM sequence: AAG
gtcacttctgtgggtccact

SEQ ID NO: 144009 - DNA, 20 bp, Artificial Sequence
  Description of Artificial Sequence: Synthetic oligonucleotide
  Target: ATXN1; (+) strand; PAM type: NRG; PAM sequence: TGG
gggtccactaagcctgttcc

SEQ ID NO: 144010 - DNA, 20 bp, Artificial Sequence
  Description of Artificial Sequence: Synthetic oligonucleotide
  Target: ATXN1; (+) strand; PAM type: NRG; PAM sequence: AAG
cctggtaccccaatatcact

SEQ ID NO: 144011 - DNA, 20 bp, Artificial Sequence
  Description of Artificial Sequence: Synthetic oligonucleotide
  Target: ATXN1; (+) strand; PAM type: NRG; PAM sequence: TGG
ggtaccccaatatcactaag

SEQ ID NO: 144012 - DNA, 20 bp, Artificial Sequence
  Description of Artificial Sequence: Synthetic oligonucleotide
  Target: ATXN1; (+) strand; PAM type: NRG; PAM sequence: TAG
tatcactaagtggcccaact

SEQ ID NO: 144013 - DNA, 20 bp, Artificial Sequence
  Description of Artificial Sequence: Synthetic oligonucleotide
  Target: ATXN1; (+) strand; PAM type: NRG; PAM sequence: TAG
gtggcccaacttagaaatac

SEQ ID NO: 144014 - DNA, 20 bp, Artificial Sequence
  Description of Artificial Sequence: Synthetic oligonucleotide
  Target: ATXN1; (+) strand; PAM type: NRG; PAM sequence: CAG
ctgccttcccccttattcca

SEQ ID NO: 144015 - DNA, 20 bp, Artificial Sequence
  Description of Artificial Sequence: Synthetic oligonucleotide
  Target: ATXN1; (+) strand; PAM type: NRG; PAM sequence: AGG
tgccttcccccttattccac

SEQ ID NO: 144016 - DNA, 20 bp, Artificial Sequence
  Description of Artificial Sequence: Synthetic oligonucleotide
  Target: ATXN1; (+) strand; PAM type: NRG; PAM sequence: CAG
ttcccccttattccacaggt

SEQ ID NO: 144017 - DNA, 20 bp, Artificial Sequence
  Description of Artificial Sequence: Synthetic oligonucleotide
  Target: ATXN1; (+) strand; PAM type: NRG; PAM sequence: CAG
ccccttattccacaggtcag

SEQ ID NO: 144018 - DNA, 20 bp, Artificial Sequence
  Description of Artificial Sequence: Synthetic oligonucleotide
  Target: ATXN1; (+) strand; PAM type: NRG; PAM sequence: AGG
cccttattccacaggtcagc

SEQ ID NO: 144019 - DNA, 20 bp, Artificial Sequence
  Description of Artificial Sequence: Synthetic oligonucleotide
  Target: ATXN1; (+) strand; PAM type: NRG; PAM sequence: GGG
ccttattccacaggtcagca

SEQ ID NO: 144020 - DNA, 20 bp, Artificial Sequence
  Description of Artificial Sequence: Synthetic oligonucleotide
  Target: ATXN1; (+) strand; PAM type: NRG; PAM sequence: TGG
atcctatcaattctatttcc

SEQ ID NO: 144021 - DNA, 20 bp, Artificial Sequence
  Description of Artificial Sequence: Synthetic oligonucleotide
  Target: ATXN1; (+) strand; PAM type: NRG; PAM sequence: CAG
tccttccctttctgcctctc

SEQ ID NO: 144022 - DNA, 20 bp, Artificial Sequence
  Description of Artificial Sequence: Synthetic oligonucleotide
  Target: ATXN1; (+) strand; PAM type: NRG; PAM sequence: AAG
tccctttctgcctctccagc

SEQ ID NO: 144023 - DNA, 20 bp, Artificial Sequence
  Description of Artificial Sequence: Synthetic oligonucleotide
  Target: ATXN1; (+) strand; PAM type: NRG; PAM sequence: TGG
ttctgcctctccagcaagtc

SEQ ID NO: 144024 - DNA, 20 bp, Artificial Sequence
  Description of Artificial Sequence: Synthetic oligonucleotide
  Target: ATXN1; (+) strand; PAM type: NRG; PAM sequence: CAG
acccctcgtgccctctcacc

SEQ ID NO: 144025 - DNA, 20 bp, Artificial Sequence
  Description of Artificial Sequence: Synthetic oligonucleotide
  Target: ATXN1; (+) strand; PAM type: NRG; PAM sequence: TGG
cagatgtctgcctgctctca

SEQ ID NO: 144026 - DNA, 20 bp, Artificial Sequence
  Description of Artificial Sequence: Synthetic oligonucleotide
  Target: ATXN1; (+) strand; PAM type: NRG; PAM sequence: CAG
tggttctccaatcacctctc

SEQ ID NO: 144027 - DNA, 20 bp, Artificial Sequence
  Description of Artificial Sequence: Synthetic oligonucleotide
  Target: ATXN1; (+) strand; PAM type: NRG; PAM sequence: AAG
acctctccagaatgccacaa

SEQ ID NO: 144028 - DNA, 20 bp, Artificial Sequence
  Description of Artificial Sequence: Synthetic oligonucleotide
  Target: ATXN1; (+) strand; PAM type: NRG; PAM sequence: TGG
ctccagaatgccacaaaagc

SEQ ID NO: 144029 - DNA, 20 bp, Artificial Sequence
  Description of Artificial Sequence: Synthetic oligonucleotide
  Target: ATXN1; (+) strand; PAM type: NRG; PAM sequence: TAG
aatgccacaaaagctggctc

SEQ ID NO: 144030 - DNA, 20 bp, Artificial Sequence
  Description of Artificial Sequence: Synthetic oligonucleotide
  Target: ATXN1; (+) strand; PAM type: NRG; PAM sequence: CAG
aaagctggctctagaaaata

SEQ ID NO: 144031 - DNA, 20 bp, Artificial Sequence
  Description of Artificial Sequence: Synthetic oligonucleotide
  Target: ATXN1; (+) strand; PAM type: NRG; PAM sequence: TGG
actctccaaactgaaaacca

SEQ ID NO: 144032 - DNA, 20 bp, Artificial Sequence
  Description of Artificial Sequence: Synthetic oligonucleotide
  Target: ATXN1; (+) strand; PAM type: NRG; PAM sequence: CAG
actgaaaaccatggtgactg

SEQ ID NO: 144033 - DNA, 20 bp, Artificial Sequence
  Description of Artificial Sequence: Synthetic oligonucleotide
  Target: ATXN1; (+) strand; PAM type: NRG; PAM sequence: AAG
tactctccaaactatcacta

SEQ ID NO: 144034 - DNA, 20 bp, Artificial Sequence
  Description of Artificial Sequence: Synthetic oligonucleotide
  Target: ATXN1; (+) strand; PAM type: NRG; PAM sequence: GAG
ctctccaaactatcactaaa

SEQ ID NO: 144035 - DNA, 20 bp, Artificial Sequence
  Description of Artificial Sequence: Synthetic oligonucleotide
  Target: ATXN1; (+) strand; PAM type: NRG; PAM sequence: AGG
tctccaaactatcactaaag

SEQ ID NO: 144036 - DNA, 20 bp, Artificial Sequence
  Description of Artificial Sequence: Synthetic oligonucleotide
  Target: ATXN1; (+) strand; PAM type: NRG; PAM sequence: AAG
ccaaactatcactaaagagg

SEQ ID NO: 144037 - DNA, 20 bp, Artificial Sequence
  Description of Artificial Sequence: Synthetic oligonucleotide
  Target: ATXN1; (+) strand; PAM type: NRG; PAM sequence: AGG
caaactatcactaaagagga

SEQ ID NO: 144038 - DNA, 20 bp, Artificial Sequence
  Description of Artificial Sequence: Synthetic oligonucleotide
  Target: ATXN1; (+) strand; PAM type: NRG; PAM sequence: GGG
aaactatcactaaagaggaa

SEQ ID NO: 144039 - DNA, 20 bp, Artificial Sequence
  Description of Artificial Sequence: Synthetic oligonucleotide
  Target: ATXN1; (+) strand; PAM type: NRG; PAM sequence: GGG
aactatcactaaagaggaag

SEQ ID NO: 144040 - DNA, 20 bp, Artificial Sequence
  Description of Artificial Sequence: Synthetic oligonucleotide
  Target: ATXN1; (+) strand; PAM type: NRG; PAM sequence: GGG
actatcactaaagaggaagg

SEQ ID NO: 144041 - DNA, 20 bp, Artificial Sequence
  Description of Artificial Sequence: Synthetic oligonucleotide
  Target: ATXN1; (+) strand; PAM type: NRG; PAM sequence: CAG
agggggatgtgaaacatata

SEQ ID NO: 144042 - DNA, 20 bp, Artificial Sequence
  Description of Artificial Sequence: Synthetic oligonucleotide
  Target: ATXN1; (+) strand; PAM type: NRG; PAM sequence: AAG
tcttcctctgtgctatcaac

SEQ ID NO: 144043 - DNA, 20 bp, Artificial Sequence
  Description of Artificial Sequence: Synthetic oligonucleotide
  Target: ATXN1; (+) strand; PAM type: NRG; PAM sequence: AAG
cctctgtgctatcaacaagc

SEQ ID NO: 144044 - DNA, 20 bp, Artificial Sequence
  Description of Artificial Sequence: Synthetic oligonucleotide
  Target: ATXN1; (+) strand; PAM type: NRG; PAM sequence: AAG
gctatcaacaagcaagaaaa

SEQ ID NO: 144045 - DNA, 20 bp, Artificial Sequence
  Description of Artificial Sequence: Synthetic oligonucleotide
  Target: ATXN1; (+) strand; PAM type: NRG; PAM sequence: GAG
tatcaacaagcaagaaaaaa

SEQ ID NO: 144046 - DNA, 20 bp, Artificial Sequence
  Description of Artificial Sequence: Synthetic oligonucleotide
  Target: ATXN1; (+) strand; PAM type: NRG; PAM sequence: TGG
caagcaagaaaaaagagatc

SEQ ID NO: 144047 - DNA, 20 bp, Artificial Sequence
  Description of Artificial Sequence: Synthetic oligonucleotide
  Target: ATXN1; (+) strand; PAM type: NRG; PAM sequence: GAG
agcaagaaaaaagagatctg

SEQ ID NO: 144048 - DNA, 20 bp, Artificial Sequence
  Description of Artificial Sequence: Synthetic oligonucleotide
  Target: ATXN1; (+) strand; PAM type: NRG; PAM sequence: CAG
aaaaagagatctggagaaaa

SEQ ID NO: 144049 - DNA, 20 bp, Artificial Sequence
  Description of Artificial Sequence: Synthetic oligonucleotide
  Target: ATXN1; (+) strand; PAM type: NRG; PAM sequence: TGG
agatctggagaaaacagatg

SEQ ID NO: 144050 - DNA, 20 bp, Artificial Sequence
  Description of Artificial Sequence: Synthetic oligonucleotide
  Target: ATXN1; (+) strand; PAM type: NRG; PAM sequence: GAG
atctggagaaaacagatgtg

SEQ ID NO: 144051 - DNA, 20 bp, Artificial Sequence
  Description of Artificial Sequence: Synthetic oligonucleotide
  Target: ATXN1; (+) strand; PAM type: NRG; PAM sequence: AGG
tctggagaaaacagatgtgg

SEQ ID NO: 144052 - DNA, 20 bp, Artificial Sequence
  Description of Artificial Sequence: Synthetic oligonucleotide
  Target: ATXN1; (+) strand; PAM type: NRG; PAM sequence: CAG
acagatgtggaggatacatg

SEQ ID NO: 144053 - DNA, 20 bp, Artificial Sequence
  Description of Artificial Sequence: Synthetic oligonucleotide
  Target: ATXN1; (+) strand; PAM type: NRG; PAM sequence: GAG
agatgtggaggatacatgca

SEQ ID NO: 144054 - DNA, 20 bp, Artificial Sequence
  Description of Artificial Sequence: Synthetic oligonucleotide
  Target: ATXN1; (+) strand; PAM type: NRG; PAM sequence: AGG
gatgtggaggatacatgcag

SEQ ID NO: 144055 - DNA, 20 bp, Artificial Sequence
  Description of Artificial Sequence: Synthetic oligonucleotide
  Target: ATXN1; (+) strand; PAM type: NRG; PAM sequence: AAG
gaggatacatgcagaggacc

SEQ ID NO: 144056 - DNA, 20 bp, Artificial Sequence
  Description of Artificial Sequence: Synthetic oligonucleotide
  Target: ATXN1; (+) strand; PAM type: NRG; PAM sequence: AAG
catgcagaggaccaagaacc

SEQ ID NO: 144057 - DNA, 20 bp, Artificial Sequence
  Description of Artificial Sequence: Synthetic oligonucleotide
  Target: ATXN1; (+) strand; PAM type: NRG; PAM sequence: CAG
ccaagaaccaagattttatt

SEQ ID NO: 144058 - DNA, 20 bp, Artificial Sequence
  Description of Artificial Sequence: Synthetic oligonucleotide
  Target: ATXN1; (+) strand; PAM type: NRG; PAM sequence: TGG
gatttccttccgtttttact

SEQ ID NO: 144059 - DNA, 20 bp, Artificial Sequence
  Description of Artificial Sequence: Synthetic oligonucleotide
  Target: ATXN1; (+) strand; PAM type: NRG; PAM sequence: TGG
tacttggctcatctatattt

SEQ ID NO: 144060 - DNA, 20 bp, Artificial Sequence
  Description of Artificial Sequence: Synthetic oligonucleotide
  Target: ATXN1; (+) strand; PAM type: NRG; PAM sequence: GGG
acttggctcatctatatttt

SEQ ID NO: 144061 - DNA, 20 bp, Artificial Sequence
  Description of Artificial Sequence: Synthetic oligonucleotide
  Target: ATXN1; (+) strand; PAM type: NRG; PAM sequence: CAG
ggctcatctatattttgggt

SEQ ID NO: 144062 - DNA, 20 bp, Artificial Sequence
  Description of Artificial Sequence: Synthetic oligonucleotide
  Target: ATXN1; (+) strand; PAM type: NRG; PAM sequence: TAG
tatattttgggtcagttttt

SEQ ID NO: 144063 - DNA, 20 bp, Artificial Sequence
  Description of Artificial Sequence: Synthetic oligonucleotide
  Target: ATXN1; (+) strand; PAM type: NRG; PAM sequence: TAG
ttaatcattaaaaatgatcc

SEQ ID NO: 144064 - DNA, 20 bp, Artificial Sequence
  Description of Artificial Sequence: Synthetic oligonucleotide
  Target: ATXN1; (+) strand; PAM type: NRG; PAM sequence: AAG
atcattaaaaatgatcctag

SEQ ID NO: 144065 - DNA, 20 bp, Artificial Sequence
  Description of Artificial Sequence: Synthetic oligonucleotide
  Target: ATXN1; (+) strand; PAM type: NRG; PAM sequence: GAG
atcctagaagcatgtcctgt

SEQ ID NO: 144066 - DNA, 20 bp, Artificial Sequence
  Description of Artificial Sequence: Synthetic oligonucleotide
  Target: ATXN1; (+) strand; PAM type: NRG; PAM sequence: AGG
tcctagaagcatgtcctgtg

SEQ ID NO: 144067 - DNA, 20 bp, Artificial Sequence
  Description of Artificial Sequence: Synthetic oligonucleotide
  Target: ATXN1; (+) strand; PAM type: NRG; PAM sequence: AAG
atgtcctgtgaggcactgcc

SEQ ID NO: 144068 - DNA, 20 bp, Artificial Sequence
  Description of Artificial Sequence: Synthetic oligonucleotide
  Target: ATXN1; (+) strand; PAM type: NRG; PAM sequence: AAG
tgcatttcattactgcttga

SEQ ID NO: 144069 - DNA, 20 bp, Artificial Sequence
  Description of Artificial Sequence: Synthetic oligonucleotide
  Target: ATXN1; (+) strand; PAM type: NRG; PAM sequence: AGG
gcatttcattactgcttgaa

SEQ ID NO: 144070 - DNA, 20 bp, Artificial Sequence
  Description of Artificial Sequence: Synthetic oligonucleotide
  Target: ATXN1; (+) strand; PAM type: NRG; PAM sequence: TAG
ccacatattcaaaacactac

SEQ ID NO: 144071 - DNA, 20 bp, Artificial Sequence
  Description of Artificial Sequence: Synthetic oligonucleotide
  Target: ATXN1; (+) strand; PAM type: NRG; PAM sequence: AAG
catattcaaaacactactag

SEQ ID NO: 144072 - DNA, 20 bp, Artificial Sequence
  Description of Artificial Sequence: Synthetic oligonucleotide
  Target: ATXN1; (+) strand; PAM type: NRG; PAM sequence: CAG
ttcaaaacactactagaagt

SEQ ID NO: 144073 - DNA, 20 bp, Artificial Sequence
  Description of Artificial Sequence: Synthetic oligonucleotide
  Target: ATXN1; (+) strand; PAM type: NRG; PAM sequence: AGG
tcaaaacactactagaagtc

SEQ ID NO: 144074 - DNA, 20 bp, Artificial Sequence
  Description of Artificial Sequence: Synthetic oligonucleotide
  Target: ATXN1; (+) strand; PAM type: NRG; PAM sequence: AAG
cactactagaagtcaggcta

SEQ ID NO: 144075 - DNA, 20 bp, Artificial Sequence
  Description of Artificial Sequence: Synthetic oligonucleotide
  Target: ATXN1; (+) strand; PAM type: NRG; PAM sequence: TGG
taaagaaaataaaatgattt

SEQ ID NO: 144076 - DNA, 20 bp, Artificial Sequence
  Description of Artificial Sequence: Synthetic oligonucleotide
  Target: ATXN1; (+) strand; PAM type: NRG; PAM sequence: AAG
aaatgattttggatattttt

SEQ ID NO: 144077 - DNA, 20 bp, Artificial Sequence
  Description of Artificial Sequence: Synthetic oligonucleotide
  Target: ATXN1; (+) strand; PAM type: NRG; PAM sequence: CAG
tgattttggatatttttaag

SEQ ID NO: 144078 - DNA, 20 bp, Artificial Sequence
  Description of Artificial Sequence: Synthetic oligonucleotide
  Target: ATXN1; (+) strand; PAM type: NRG; PAM sequence: CAG
tttttaagcagttactaaaa

SEQ ID NO: 144079 - DNA, 20 bp, Artificial Sequence
  Description of Artificial Sequence: Synthetic oligonucleotide
  Target: ATXN1; (+) strand; PAM type: NRG; PAM sequence: TGG
caaatgttatttttaatctc

SEQ ID NO: 144080 - DNA, 20 bp, Artificial Sequence
  Description of Artificial Sequence: Synthetic oligonucleotide
  Target: ATXN1; (+) strand; PAM type: NRG; PAM sequence: AAG
ctggctcactgtaaactgac

SEQ ID NO: 144081 - DNA, 20 bp, Artificial Sequence
  Description of Artificial Sequence: Synthetic oligonucleotide
  Target: ATXN1; (+) strand; PAM type: NRG; PAM sequence: AAG
atatgaatatgaattttacc

SEQ ID NO: 144082 - DNA, 20 bp, Artificial Sequence
  Description of Artificial Sequence: Synthetic oligonucleotide
  Target: ATXN1; (+) strand; PAM type: NRG; PAM sequence: TGG
tttcatttcgatgttacatg

SEQ ID NO: 144083 - DNA, 20 bp, Artificial Sequence
  Description of Artificial Sequence: Synthetic oligonucleotide
  Target: ATXN1; (+) strand; PAM type: NRG; PAM sequence: TAG
tacatgtggaacatataatc

SEQ ID NO: 144084 - DNA, 20 bp, Artificial Sequence
  Description of Artificial Sequence: Synthetic oligonucleotide
  Target: ATXN1; (+) strand; PAM type: NRG; PAM sequence: CAG
attacaaaccatcctcatta

SEQ ID NO: 144085 - DNA, 20 bp, Artificial Sequence
  Description of Artificial Sequence: Synthetic oligonucleotide
  Target: ATXN1; (+) strand; PAM type: NRG; PAM sequence: TAG
tcattacagtccatttactc

SEQ ID NO: 144086 - DNA, 20 bp, Artificial Sequence
  Description of Artificial Sequence: Synthetic oligonucleotide
  Target: ATXN1; (+) strand; PAM type: NRG; PAM sequence: TAG
ttactctagctaatttttga

SEQ ID NO: 144087 - DNA, 20 bp, Artificial Sequence
  Description of Artificial Sequence: Synthetic oligonucleotide
  Target: ATXN1; (+) strand; PAM type: NRG; PAM sequence: TAG
ttttgatagcatgacatcat

SEQ ID NO: 144088 - DNA, 20 bp, Artificial Sequence
  Description of Artificial Sequence: Synthetic oligonucleotide
  Target: ATXN1; (+) strand; PAM type: NRG; PAM sequence: AAG
atgacatcattagcataaaa

SEQ ID NO: 144089 - DNA, 20 bp, Artificial Sequence
  Description of Artificial Sequence: Synthetic oligonucleotide
  Target: ATXN1; (+) strand; PAM type: NRG; PAM sequence: TAG
atcattagcataaaaaagct

SEQ ID NO: 144090 - DNA, 20 bp, Artificial Sequence
  Description of Artificial Sequence: Synthetic oligonucleotide
  Target: ATXN1; (+) strand; PAM type: NRG; PAM sequence: AAG
tctgaaatttgcttttataa

SEQ ID NO: 144091 - DNA, 20 bp, Artificial Sequence
  Description of Artificial Sequence: Synthetic oligonucleotide
  Target: ATXN1; (+) strand; PAM type: NRG; PAM sequence: AAG
cttttataaaagtccttgca

SEQ ID NO: 144092 - DNA, 20 bp, Artificial Sequence
  Description of Artificial Sequence: Synthetic oligonucleotide
  Target: ATXN1; (+) strand; PAM type: NRG; PAM sequence: AAG
aaagttttacatttctaaac

SEQ ID NO: 144093 - DNA, 20 bp, Artificial Sequence
  Description of Artificial Sequence: Synthetic oligonucleotide
  Target: ATXN1; (+) strand; PAM type: NRG; PAM sequence: TAG
tctaaacaagtgaaaaccaa

SEQ ID NO: 144094 - DNA, 20 bp, Artificial Sequence
  Description of Artificial Sequence: Synthetic oligonucleotide
  Target: ATXN1; (+) strand; PAM type: NRG; PAM sequence: AAG
accaatagctgaaaaattgt

SEQ ID NO: 144095 - DNA, 20 bp, Artificial Sequence
  Description of Artificial Sequence: Synthetic oligonucleotide
  Target: ATXN1; (+) strand; PAM type: NRG; PAM sequence: CAG
ataattgtccaaatgttgct

SEQ ID NO: 144096 - DNA, 20 bp, Artificial Sequence
  Description of Artificial Sequence: Synthetic oligonucleotide
  Target: ATXN1; (+) strand; PAM type: NRG; PAM sequence: CAG
aatgttgctcagttcaccaa

SEQ ID NO: 144097 - DNA, 20 bp, Artificial Sequence
  Description of Artificial Sequence: Synthetic oligonucleotide
  Target: ATXN1; (+) strand; PAM type: NRG; PAM sequence: AGG
atgttgctcagttcaccaac

SEQ ID NO: 144098 - DNA, 20 bp, Artificial Sequence
  Description of Artificial Sequence: Synthetic oligonucleotide
  Target: ATXN1; (+) strand; PAM type: NRG; PAM sequence: GAG
agttcaccaacaggcttact

SEQ ID NO: 144099 - DNA, 20 bp, Artificial Sequence
  Description of Artificial Sequence: Synthetic oligonucleotide
  Target: ATXN1; (+) strand; PAM type: NRG; PAM sequence: TAG
tcaccaacaggcttactgag

SEQ ID NO: 144100 - DNA, 20 bp, Artificial Sequence
  Description of Artificial Sequence: Synthetic oligonucleotide
  Target: ATXN1; (+) strand; PAM type: NRG; PAM sequence: AGG
caccaacaggcttactgagt

SEQ ID NO: 144101 - DNA, 20 bp, Artificial Sequence
  Description of Artificial Sequence: Synthetic oligonucleotide
  Target: ATXN1; (+) strand; PAM type: NRG; PAM sequence: TAG
ggcttactgagtaggttctt

SEQ ID NO: 144102 - DNA, 20 bp, Artificial Sequence
  Description of Artificial Sequence: Synthetic oligonucleotide
  Target: ATXN1; (+) strand; PAM type: NRG; PAM sequence: AAG
tactgagtaggttctttaga

SEQ ID NO: 144103 - DNA, 20 bp, Artificial Sequence
  Description of Artificial Sequence: Synthetic oligonucleotide
  Target: ATXN1; (+) strand; PAM type: NRG; PAM sequence: CAG
tctttagaaagaaattctgc

SEQ ID NO: 144104 - DNA, 20 bp, Artificial Sequence
  Description of Artificial Sequence: Synthetic oligonucleotide
  Target: ATXN1; (+) strand; PAM type: NRG; PAM sequence: AGG
ctttagaaagaaattctgcc

SEQ ID NO: 144105 - DNA, 20 bp, Artificial Sequence
  Description of Artificial Sequence: Synthetic oligonucleotide
  Target: ATXN1; (+) strand; PAM type: NRG; PAM sequence: TAG
tagaaagaaattctgccagg

SEQ ID NO: 144106 - DNA, 20 bp, Artificial Sequence
  Description of Artificial Sequence: Synthetic oligonucleotide
  Target: ATXN1; (+) strand; PAM type: NRG; PAM sequence: AAG
tctgccaggtagtttgtaat

SEQ ID NO: 144107 - DNA, 20 bp, Artificial Sequence
  Description of Artificial Sequence: Synthetic oligonucleotide
  Target: ATXN1; (+) strand; PAM type: NRG; PAM sequence: AAG
gccaggtagtttgtaataag

SEQ ID NO: 144108 - DNA, 20 bp, Artificial Sequence
  Description of Artificial Sequence: Synthetic oligonucleotide
  Target: ATXN1; (+) strand; PAM type: NRG; PAM sequence: TGG
gtaataagaagtatctgcta

SEQ ID NO: 144109 - DNA, 20 bp, Artificial Sequence
  Description of Artificial Sequence: Synthetic oligonucleotide
  Target: ATXN1; (+) strand; PAM type: NRG; PAM sequence: AAG
ctatggatcatgcctttaca

SEQ ID NO: 144110 - DNA, 20 bp, Artificial Sequence
  Description of Artificial Sequence: Synthetic oligonucleotide
  Target: ATXN1; (+) strand; PAM type: NRG; PAM sequence: CAG
cctttacaaagtttacattc

SEQ ID NO: 144111 - DNA, 20 bp, Artificial Sequence
  Description of Artificial Sequence: Synthetic oligonucleotide
  Target: ATXN1; (+) strand; PAM type: NRG; PAM sequence: CAG
ttacaaagtttacattccag

SEQ ID NO: 144112 - DNA, 20 bp, Artificial Sequence
  Description of Artificial Sequence: Synthetic oligonucleotide
  Target: ATXN1; (+) strand; PAM type: NRG; PAM sequence: AGG
tacaaagtttacattccagc

SEQ ID NO: 144113 - DNA, 20 bp, Artificial Sequence
  Description of Artificial Sequence: Synthetic oligonucleotide
  Target: ATXN1; (+) strand; PAM type: NRG; PAM sequence: GGG
acaaagtttacattccagca

SEQ ID NO: 144114 - DNA, 20 bp, Artificial Sequence
  Description of Artificial Sequence: Synthetic oligonucleotide
  Target: ATXN1; (+) strand; PAM type: NRG; PAM sequence: GAG
aaagtttacattccagcagg

SEQ ID NO: 144115 - DNA, 20 bp, Artificial Sequence
  Description of Artificial Sequence: Synthetic oligonucleotide
  Target: ATXN1; (+) strand; PAM type: NRG; PAM sequence: AGG
aagtttacattccagcaggg

SEQ ID NO: 144116 - DNA, 20 bp, Artificial Sequence
  Description of Artificial Sequence: Synthetic oligonucleotide
  Target: ATXN1; (+) strand; PAM type: NRG; PAM sequence: AAG
ttacattccagcagggagga

SEQ ID NO: 144117 - DNA, 20 bp, Artificial Sequence
  Description of Artificial Sequence: Synthetic oligonucleotide
  Target: ATXN1; (+) strand; PAM type: NRG; PAM sequence: TGG
gaggaaagcatgtacacaat

SEQ ID NO: 144118 - DNA, 20 bp, Artificial Sequence
  Description of Artificial Sequence: Synthetic oligonucleotide
  Target: ATXN1; (+) strand; PAM type: NRG; PAM sequence: CAG
tttctttttttttttttttg

SEQ ID NO: 144119 - DNA, 20 bp, Artificial Sequence
  Description of Artificial Sequence: Synthetic oligonucleotide
  Target: ATXN1; (+) strand; PAM type: NRG; PAM sequence: CAG
ttttttttgcagtaacgtaa

SEQ ID NO: 144120 - DNA, 20 bp, Artificial Sequence
  Description of Artificial Sequence: Synthetic oligonucleotide
  Target: ATXN1; (+) strand; PAM type: NRG; PAM sequence: AAG
ttgcagtaacgtaacagaat

SEQ ID NO: 144121 - DNA, 20 bp, Artificial Sequence
  Description of Artificial Sequence: Synthetic oligonucleotide
  Target: ATXN1; (+) strand; PAM type: NRG; PAM sequence: GAG
gcagtaacgtaacagaataa

SEQ ID NO: 144122 - DNA, 20 bp, Artificial Sequence
  Description of Artificial Sequence: Synthetic oligonucleotide
  Target: ATXN1; (+) strand; PAM type: NRG; PAM sequence: AAG
gtaacgtaacagaataagag

SEQ ID NO: 144123 - DNA, 20 bp, Artificial Sequence
  Description of Artificial Sequence: Synthetic oligonucleotide
  Target: ATXN1; (+) strand; PAM type: NRG; PAM sequence: AAG
acagaataagagaagtacaa

SEQ ID NO: 144124 - DNA, 20 bp, Artificial Sequence
  Description of Artificial Sequence: Synthetic oligonucleotide
  Target: ATXN1; (+) strand; PAM type: NRG; PAM sequence: GAG
agaataagagaagtacaaaa

SEQ ID NO: 144125 - DNA, 20 bp, Artificial Sequence
  Description of Artificial Sequence: Synthetic oligonucleotide
  Target: ATXN1; (+) strand; PAM type: NRG; PAM sequence: AAG
agaagtacaaaagagctaca

SEQ ID NO: 144126 - DNA, 20 bp, Artificial Sequence
  Description of Artificial Sequence: Synthetic oligonucleotide
  Target: ATXN1; (+) strand; PAM type: NRG; PAM sequence: AAG
aaagagctacaaagtctcaa

SEQ ID NO: 144127 - DNA, 20 bp, Artificial Sequence
  Description of Artificial Sequence: Synthetic oligonucleotide
  Target: ATXN1; (+) strand; PAM type: NRG; PAM sequence: GAG
agagctacaaagtctcaaaa

SEQ ID NO: 144128 - DNA, 20 bp, Artificial Sequence
  Description of Artificial Sequence: Synthetic oligonucleotide
  Target: ATXN1; (+) strand; PAM type: NRG; PAM sequence: AGG
gagctacaaagtctcaaaag

SEQ ID NO: 144129 - DNA, 20 bp, Artificial Sequence
  Description of Artificial Sequence: Synthetic oligonucleotide
  Target: ATXN1; (+) strand; PAM type: NRG; PAM sequence: CAG
aaaagaggaaccattttatg

SEQ ID NO: 144130 - DNA, 20 bp, Artificial Sequence
  Description of Artificial Sequence: Synthetic oligonucleotide
  Target: ATXN1; (+) strand; PAM type: NRG; PAM sequence: AGG
aaagaggaaccattttatgc

SEQ ID NO: 144131 - DNA, 20 bp, Artificial Sequence
  Description of Artificial Sequence: Synthetic oligonucleotide
  Target: ATXN1; (+) strand; PAM type: NRG; PAM sequence: GAG
agaggaaccattttatgcag

SEQ ID NO: 144132 - DNA, 20 bp, Artificial Sequence
  Description of Artificial Sequence: Synthetic oligonucleotide
  Target: ATXN1; (+) strand; PAM type: NRG; PAM sequence: GAG
aggaaccattttatgcagga

SEQ ID NO: 144133 - DNA, 20 bp, Artificial Sequence
  Description of Artificial Sequence: Synthetic oligonucleotide
  Target: ATXN1; (+) strand; PAM type: NRG; PAM sequence: AGG
ggaaccattttatgcaggag

SEQ ID NO: 144134 - DNA, 20 bp, Artificial Sequence
  Description of Artificial Sequence: Synthetic oligonucleotide
  Target: ATXN1; (+) strand; PAM type: NRG; PAM sequence: GGG
gaaccattttatgcaggaga

SEQ ID NO: 144135 - DNA, 20 bp, Artificial Sequence
  Description of Artificial Sequence: Synthetic oligonucleotide
  Target: ATXN1; (+) strand; PAM type: NRG; PAM sequence: CAG
ttttatgcaggagagggtat

SEQ ID NO: 144136 - DNA, 20 bp, Artificial Sequence
  Description of Artificial Sequence: Synthetic oligonucleotide
  Target: ATXN1; (+) strand; PAM type: NRG; PAM sequence: AGG
tttatgcaggagagggtatc

SEQ ID NO: 144137 - DNA, 20 bp, Artificial Sequence
  Description of Artificial Sequence: Synthetic oligonucleotide
  Target: ATXN1; (+) strand; PAM type: NRG; PAM sequence: AAG
tgcaggagagggtatcagga

SEQ ID NO: 144138 - DNA, 20 bp, Artificial Sequence
  Description of Artificial Sequence: Synthetic oligonucleotide
  Target: ATXN1; (+) strand; PAM type: NRG; PAM sequence: TGG
gagggtatcaggaaagattc

SEQ ID NO: 144139 - DNA, 20 bp, Artificial Sequence
  Description of Artificial Sequence: Synthetic oligonucleotide
  Target: ATXN1; (+) strand; PAM type: NRG; PAM sequence: AAG
gtatcaggaaagattctggt

SEQ ID NO: 144140 - DNA, 20 bp, Artificial Sequence
  Description of Artificial Sequence: Synthetic oligonucleotide
  Target: ATXN1; (+) strand; PAM type: NRG; PAM sequence: AAG
caggaaagattctggtaaga

SEQ ID NO: 144141 - DNA, 20 bp, Artificial Sequence
  Description of Artificial Sequence: Synthetic oligonucleotide
  Target: ATXN1; (+) strand; PAM type: NRG; PAM sequence: TGG
gaaagattctggtaagaaag

SEQ ID NO: 144142 - DNA, 20 bp, Artificial Sequence
  Description of Artificial Sequence: Synthetic oligonucleotide
  Target: ATXN1; (+) strand; PAM type: NRG; PAM sequence: GGG
aaagattctggtaagaaagt

SEQ ID NO: 144143 - DNA, 20 bp, Artificial Sequence
  Description of Artificial Sequence: Synthetic oligonucleotide
  Target: ATXN1; (+) strand; PAM type: NRG; PAM sequence: CAG
tctggtaagaaagtgggcct

SEQ ID NO: 144144 - DNA, 20 bp, Artificial Sequence
  Description of Artificial Sequence: Synthetic oligonucleotide
  Target: ATXN1; (+) strand; PAM type: NRG; PAM sequence: AGG
ctggtaagaaagtgggcctc

SEQ ID NO: 144145 - DNA, 20 bp, Artificial Sequence
  Description of Artificial Sequence: Synthetic oligonucleotide
  Target: ATXN1; (+) strand; PAM type: NRG; PAM sequence: GAG
ggtaagaaagtgggcctcag

SEQ ID NO: 144146 - DNA, 20 bp, Artificial Sequence
  Description of Artificial Sequence: Synthetic oligonucleotide
  Target: ATXN1; (+) strand; PAM type: NRG; PAM sequence: TAG
agaaagtgggcctcaggagc

SEQ ID NO: 144147 - DNA, 20 bp, Artificial Sequence
  Description of Artificial Sequence: Synthetic oligonucleotide
  Target: ATXN1; (+) strand; PAM type: NRG; PAM sequence: AGG
gaaagtgggcctcaggagct

SEQ ID NO: 144148 - DNA, 20 bp, Artificial Sequence
  Description of Artificial Sequence: Synthetic oligonucleotide
  Target: ATXN1; (+) strand; PAM type: NRG; PAM sequence: CAG
agtgggcctcaggagctagg

SEQ ID NO: 144149 - DNA, 20 bp, Artificial Sequence
  Description of Artificial Sequence: Synthetic oligonucleotide
  Target: ATXN1; (+) strand; PAM type: NRG; PAM sequence: TGG
ggcctcaggagctaggcaga

SEQ ID NO: 144150 - DNA, 20 bp, Artificial Sequence
  Description of Artificial Sequence: Synthetic oligonucleotide
  Target: ATXN1; (+) strand; PAM type: NRG; PAM sequence: GGG
gcctcaggagctaggcagat

SEQ ID NO: 144151 - DNA, 20 bp, Artificial Sequence
  Description of Artificial Sequence: Synthetic oligonucleotide
  Target: ATXN1; (+) strand; PAM type: NRG; PAM sequence: AAG
agatgggaattttgaactct

SEQ ID NO: 144152 - DNA, 20 bp, Artificial Sequence
  Description of Artificial Sequence: Synthetic oligonucleotide
  Target: ATXN1; (+) strand; PAM type: NRG; PAM sequence: AAG
actctaagtgtctatttctg

SEQ ID NO: 144153 - DNA, 20 bp, Artificial Sequence
  Description of Artificial Sequence: Synthetic oligonucleotide
  Target: ATXN1; (+) strand; PAM type: NRG; PAM sequence: CAG
aactaatcaatgtgtttcta

SEQ ID NO: 144154 - DNA, 20 bp, Artificial Sequence
  Description of Artificial Sequence: Synthetic oligonucleotide
  Target: ATXN1; (+) strand; PAM type: NRG; PAM sequence: GAG
ttctacagttaacatttatt

SEQ ID NO: 144155 - DNA, 20 bp, Artificial Sequence
  Description of Artificial Sequence: Synthetic oligonucleotide
  Target: ATXN1; (+) strand; PAM type: NRG; PAM sequence: AAG
agcaactactatgtgtcaca

SEQ ID NO: 144156 - DNA, 20 bp, Artificial Sequence
  Description of Artificial Sequence: Synthetic oligonucleotide
  Target: ATXN1; (+) strand; PAM type: NRG; PAM sequence: AAG
agttcataaatgttatctct

SEQ ID NO: 144157 - DNA, 20 bp, Artificial Sequence
  Description of Artificial Sequence: Synthetic oligonucleotide
  Target: ATXN1; (+) strand; PAM type: NRG; PAM sequence: TGG
tctaagcttccaaacaaaca

SEQ ID NO: 144158 - DNA, 20 bp, Artificial Sequence
  Description of Artificial Sequence: Synthetic oligonucleotide
  Target: ATXN1; (+) strand; PAM type: NRG; PAM sequence: CAG
tccaaacaaacatggaatga

SEQ ID NO: 144159 - DNA, 20 bp, Artificial Sequence
  Description of Artificial Sequence: Synthetic oligonucleotide
  Target: ATXN1; (+) strand; PAM type: NRG; PAM sequence: TGG
acaaacatggaatgacagcc

SEQ ID NO: 144160 - DNA, 20 bp, Artificial Sequence
  Description of Artificial Sequence: Synthetic oligonucleotide
  Target: ATXN1; (+) strand; PAM type: NRG; PAM sequence: AAG
cctggttacaaatgattaaa

SEQ ID NO: 144161 - DNA, 20 bp, Artificial Sequence
  Description of Artificial Sequence: Synthetic oligonucleotide
  Target: ATXN1; (+) strand; PAM type: NRG; PAM sequence: AGG
ctggttacaaatgattaaaa

SEQ ID NO: 144162 - DNA, 20 bp, Artificial Sequence
  Description of Artificial Sequence: Synthetic oligonucleotide
  Target: ATXN1; (+) strand; PAM type: NRG; PAM sequence: GGG
tggttacaaatgattaaaaa

SEQ ID NO: 144163 - DNA, 20 bp, Artificial Sequence
  Description of Artificial Sequence: Synthetic oligonucleotide
  Target: ATXN1; (+) strand; PAM type: NRG; PAM sequence: CAG
aatgattaaaaagggactca

SEQ ID NO: 144164 - DNA, 20 bp, Artificial Sequence
  Description of Artificial Sequence: Synthetic oligonucleotide
  Target: ATXN1; (+) strand; PAM type: NRG; PAM sequence: GAG
tgattaaaaagggactcaca

SEQ ID NO: 144165 - DNA, 20 bp, Artificial Sequence
  Description of Artificial Sequence: Synthetic oligonucleotide
  Target: ATXN1; (+) strand; PAM type: NRG; PAM sequence: AAG
cagagtctattaacattccc

SEQ ID NO: 144166 - DNA, 20 bp, Artificial Sequence
  Description of Artificial Sequence: Synthetic oligonucleotide
  Target: ATXN1; (+) strand; PAM type: NRG; PAM sequence: GAG
gagtctattaacattcccaa

SEQ ID NO: 144167 - DNA, 20 bp, Artificial Sequence
  Description of Artificial Sequence: Synthetic oligonucleotide
  Target: ATXN1; (+) strand; PAM type: NRG; PAM sequence: TAG
ttaacattcccaagagtcat

SEQ ID NO: 144168 - DNA, 20 bp, Artificial Sequence
  Description of Artificial Sequence: Synthetic oligonucleotide
  Target: ATXN1; (+) strand; PAM type: NRG; PAM sequence: TAG
cattagttcttactgaacat

SEQ ID NO: 144169 - DNA, 20 bp, Artificial Sequence
  Description of Artificial Sequence: Synthetic oligonucleotide
  Target: ATXN1; (+) strand; PAM type: NRG; PAM sequence: AAG
agttcttactgaacattagt

SEQ ID NO: 144170 - DNA, 20 bp, Artificial Sequence
  Description of Artificial Sequence: Synthetic oligonucleotide
  Target: ATXN1; (+) strand; PAM type: NRG; PAM sequence: AAG
tactgaacattagtaagcca

SEQ ID NO: 144171 - DNA, 20 bp, Artificial Sequence
  Description of Artificial Sequence: Synthetic oligonucleotide
  Target: ATXN1; (+) strand; PAM type: NRG; PAM sequence: AGG
actgaacattagtaagccaa

SEQ ID NO: 144172 - DNA, 20 bp, Artificial Sequence
  Description of Artificial Sequence: Synthetic oligonucleotide
  Target: ATXN1; (+) strand; PAM type: NRG; PAM sequence: AAG
aggcatatttatatcaacac

SEQ ID NO: 144173 - DNA, 20 bp, Artificial Sequence
  Description of Artificial Sequence: Synthetic oligonucleotide
  Target: ATXN1; (+) strand; PAM type: NRG; PAM sequence: GAG
gcatatttatatcaacacaa

SEQ ID NO: 144174 - DNA, 20 bp, Artificial Sequence
  Description of Artificial Sequence: Synthetic oligonucleotide
  Target: ATXN1; (+) strand; PAM type: NRG; PAM sequence: CAG
caacacaagagttaatcaca

SEQ ID NO: 144175 - DNA, 20 bp, Artificial Sequence
  Description of Artificial Sequence: Synthetic oligonucleotide
  Target: ATXN1; (+) strand; PAM type: NRG; PAM sequence: AAG
caagagttaatcacacagaa

SEQ ID NO: 144176 - DNA, 20 bp, Artificial Sequence
  Description of Artificial Sequence: Synthetic oligonucleotide
  Target: ATXN1; (+) strand; PAM type: NRG; PAM sequence: CAG
taatcacacagaaaagatga

SEQ ID NO: 144177 - DNA, 20 bp, Artificial Sequence
  Description of Artificial Sequence: Synthetic oligonucleotide
  Target: ATXN1; (+) strand; PAM type: NRG; PAM sequence: AAG
cagtcttaattcgaacaatc

SEQ ID NO: 144178 - DNA, 20 bp, Artificial Sequence
  Description of Artificial Sequence: Synthetic oligonucleotide
  Target: ATXN1; (+) strand; PAM type: NRG; PAM sequence: AGG
agtcttaattcgaacaatca

SEQ ID NO: 144179 - DNA, 20 bp, Artificial Sequence
  Description of Artificial Sequence: Synthetic oligonucleotide
  Target: ATXN1; (+) strand; PAM type: NRG; PAM sequence: GGG
gtcttaattcgaacaatcaa

SEQ ID NO: 144180 - DNA, 20 bp, Artificial Sequence
  Description of Artificial Sequence: Synthetic oligonucleotide
  Target: ATXN1; (+) strand; PAM type: NRG; PAM sequence: TGG
atatattttgaatacgaata

SEQ ID NO: 144181 - DNA, 20 bp, Artificial Sequence
  Description of Artificial Sequence: Synthetic oligonucleotide
  Target: ATXN1; (+) strand; PAM type: NRG; PAM sequence: AAG
cgaatatggttgaatatgac

SEQ ID NO: 144182 - DNA, 20 bp, Artificial Sequence
  Description of Artificial Sequence: Synthetic oligonucleotide
  Target: ATXN1; (+) strand; PAM type: NRG; PAM sequence: AGG
gaatatggttgaatatgaca

SEQ ID NO: 144183 - DNA, 20 bp, Artificial Sequence
  Description of Artificial Sequence: Synthetic oligonucleotide
  Target: ATXN1; (+) strand; PAM type: NRG; PAM sequence: AAG
tgacatgtaactgaaatgac

SEQ ID NO: 144184 - DNA, 20 bp, Artificial Sequence
  Description of Artificial Sequence: Synthetic oligonucleotide
  Target: ATXN1; (+) strand; PAM type: NRG; PAM sequence: AAG
actgaaatgacaagaatatc

SEQ ID NO: 144185 - DNA, 20 bp, Artificial Sequence
  Description of Artificial Sequence: Synthetic oligonucleotide
  Target: ATXN1; (+) strand; PAM type: NRG; PAM sequence: AAG
gacaagaatatcaagaactt

SEQ ID NO: 144186 - DNA, 20 bp, Artificial Sequence
  Description of Artificial Sequence: Synthetic oligonucleotide
  Target: ATXN1; (+) strand; PAM type: NRG; PAM sequence: CAG
tttattctaacctctaacat

SEQ ID NO: 144187 - DNA, 20 bp, Artificial Sequence
  Description of Artificial Sequence: Synthetic oligonucleotide
  Target: ATXN1; (+) strand; PAM type: NRG; PAM sequence: TAG
aatgtacctttgttttaaaa

SEQ ID NO: 144188 - DNA, 20 bp, Artificial Sequence
  Description of Artificial Sequence: Synthetic oligonucleotide
  Target: ATXN1; (+) strand; PAM type: NRG; PAM sequence: AGG
atgtacctttgttttaaaat

SEQ ID NO: 144189 - DNA, 20 bp, Artificial Sequence
  Description of Artificial Sequence: Synthetic oligonucleotide
  Target: ATXN1; (+) strand; PAM type: NRG; PAM sequence: GAG
ttgttttaaaataggtattt

SEQ ID NO: 144190 - DNA, 20 bp, Artificial Sequence
  Description of Artificial Sequence: Synthetic oligonucleotide
  Target: ATXN1; (+) strand; PAM type: NRG; PAM sequence: CAG
aataggtatttgagtttcta

SEQ ID NO: 144191 - DNA, 20 bp, Artificial Sequence
  Description of Artificial Sequence: Synthetic oligonucleotide
  Target: ATXN1; (+) strand; PAM type: NRG; PAM sequence: CAG
aggtatttgagtttctacag

SEQ ID NO: 144192 - DNA, 20 bp, Artificial Sequence
  Description of Artificial Sequence: Synthetic oligonucleotide
  Target: ATXN1; (+) strand; PAM type: NRG; PAM sequence: AAG
ttctacagcagtgtttctcc

SEQ ID NO: 144193 - DNA, 20 bp, Artificial Sequence
  Description of Artificial Sequence: Synthetic oligonucleotide
  Target: ATXN1; (+) strand; PAM type: NRG; PAM sequence: GAG
agcagtgtttctccaagtgt

SEQ ID NO: 144194 - DNA, 20 bp, Artificial Sequence
  Description of Artificial Sequence: Synthetic oligonucleotide
  Target: ATXN1; (+) strand; PAM type: NRG; PAM sequence: AAG
tgtttctccaagtgtgagcc

SEQ ID NO: 144195 - DNA, 20 bp, Artificial Sequence
  Description of Artificial Sequence: Synthetic oligonucleotide
  Target: ATXN1; (+) strand; PAM type: NRG; PAM sequence: AGG
gtttctccaagtgtgagcca

SEQ ID NO: 144196 - DNA, 20 bp, Artificial Sequence
  Description of Artificial Sequence: Synthetic oligonucleotide
  Target: ATXN1; (+) strand; PAM type: NRG; PAM sequence: CAG
cttttatgttaaatgaatca

SEQ ID NO: 144197 - DNA, 20 bp, Artificial Sequence
  Description of Artificial Sequence: Synthetic oligonucleotide
  Target: ATXN1; (+) strand; PAM type: NRG; PAM sequence: AGG
ttttatgttaaatgaatcac

SEQ ID NO: 144198 - DNA, 20 bp, Artificial Sequence
  Description of Artificial Sequence: Synthetic oligonucleotide
  Target: ATXN1; (+) strand; PAM type: NRG; PAM sequence: GAG
ttatgttaaatgaatcacag

SEQ ID NO: 144199 - DNA, 20 bp, Artificial Sequence
  Description of Artificial Sequence: Synthetic oligonucleotide
  Target: ATXN1; (+) strand; PAM type: NRG; PAM sequence: AGG
tatgttaaatgaatcacagg

SEQ ID NO: 144200 - DNA, 20 bp, Artificial Sequence
  Description of Artificial Sequence: Synthetic oligonucleotide
  Target: ATXN1; (+) strand; PAM type: NRG; PAM sequence: GGG
atgttaaatgaatcacagga

SEQ ID NO: 144201 - DNA, 20 bp, Artificial Sequence
  Description of Artificial Sequence: Synthetic oligonucleotide
  Target: ATXN1; (+) strand; PAM type: NRG; PAM sequence: AAG
cacaggagggtgctcgttaa

SEQ ID NO: 144202 - DNA, 20 bp, Artificial Sequence
  Description of Artificial Sequence: Synthetic oligonucleotide
  Target: ATXN1; (+) strand; PAM type: NRG; PAM sequence: TGG
ctcgttaaaagtacaactcc

SEQ ID NO: 144203 - DNA, 20 bp, Artificial Sequence
  Description of Artificial Sequence: Synthetic oligonucleotide
  Target: ATXN1; (+) strand; PAM type: NRG; PAM sequence: GGG
tcgttaaaagtacaactcct

SEQ ID NO: 144204 - DNA, 20 bp, Artificial Sequence
  Description of Artificial Sequence: Synthetic oligonucleotide
  Target: ATXN1; (+) strand; PAM type: NRG; PAM sequence: AAG
tgacctatttaacatacttt

SEQ ID NO: 144205 - DNA, 20 bp, Artificial Sequence
  Description of Artificial Sequence: Synthetic oligonucleotide
  Target: ATXN1; (+) strand; PAM type: NRG; PAM sequence: AGG
gacctatttaacatacttta

SEQ ID NO: 144206 - DNA, 20 bp, Artificial Sequence
  Description of Artificial Sequence: Synthetic oligonucleotide
  Target: ATXN1; (+) strand; PAM type: NRG; PAM sequence: CAG
atttaacatactttaaggcc

SEQ ID NO: 144207 - DNA, 20 bp, Artificial Sequence
  Description of Artificial Sequence: Synthetic oligonucleotide
  Target: ATXN1; (+) strand; PAM type: NRG; PAM sequence: AGG
tttaacatactttaaggccc

SEQ ID NO: 144208 - DNA, 20 bp, Artificial Sequence
  Description of Artificial Sequence: Synthetic oligonucleotide
  Target: ATXN1; (+) strand; PAM type: NRG; PAM sequence: CAG
ccaggaatctgaattttcaa

SEQ ID NO: 144209 - DNA, 20 bp, Artificial Sequence
  Description of Artificial Sequence: Synthetic oligonucleotide
  Target: ATXN1; (+) strand; PAM type: NRG; PAM sequence: AGG
caggaatctgaattttcaac

SEQ ID NO: 144210 - DNA, 20 bp, Artificial Sequence
  Description of Artificial Sequence: Synthetic oligonucleotide
  Target: ATXN1; (+) strand; PAM type: NRG; PAM sequence: AAG
tctgaattttcaacaggact

SEQ ID NO: 144211 - DNA, 20 bp, Artificial Sequence
  Description of Artificial Sequence: Synthetic oligonucleotide
  Target: ATXN1; (+) strand; PAM type: NRG; PAM sequence: AAG
caggactaagttgtatattc

SEQ ID NO: 144212 - DNA, 20 bp, Artificial Sequence
  Description of Artificial Sequence: Synthetic oligonucleotide
  Target: ATXN1; (+) strand; PAM type: NRG; PAM sequence: TAG
taagttgtatattcaagtcc

SEQ ID NO: 144213 - DNA, 20 bp, Artificial Sequence
  Description of Artificial Sequence: Synthetic oligonucleotide
  Target: ATXN1; (+) strand; PAM type: NRG; PAM sequence: AGG
aagttgtatattcaagtcct

SEQ ID NO: 144214 - DNA, 20 bp, Artificial Sequence
  Description of Artificial Sequence: Synthetic oligonucleotide
  Target: ATXN1; (+) strand; PAM type: NRG; PAM sequence: GGG
agttgtatattcaagtccta

SEQ ID NO: 144215 - DNA, 20 bp, Artificial Sequence
  Description of Artificial Sequence: Synthetic oligonucleotide
  Target: ATXN1; (+) strand; PAM type: NRG; PAM sequence: TGG
tattcaagtcctagggcctc

SEQ ID NO: 144216 - DNA, 20 bp, Artificial Sequence
  Description of Artificial Sequence: Synthetic oligonucleotide
  Target: ATXN1; (+) strand; PAM type: NRG; PAM sequence: TAG
aagtcctagggcctctggtc

SEQ ID NO: 144217 - DNA, 20 bp, Artificial Sequence
  Description of Artificial Sequence: Synthetic oligonucleotide
  Target: ATXN1; (+) strand; PAM type: NRG; PAM sequence: GAG
gtcctagggcctctggtcta

SEQ ID NO: 144218 - DNA, 20 bp, Artificial Sequence
  Description of Artificial Sequence: Synthetic oligonucleotide
  Target: ATXN1; (+) strand; PAM type: NRG; PAM sequence: AAG
tctgtgtcatactgcattaa

SEQ ID NO: 144219 - DNA, 20 bp, Artificial Sequence
  Description of Artificial Sequence: Synthetic oligonucleotide
  Target: ATXN1; (+) strand; PAM type: NRG; PAM sequence: CAG
taaacactaaaattatacca

SEQ ID NO: 144220 - DNA, 20 bp, Artificial Sequence
  Description of Artificial Sequence: Synthetic oligonucleotide
  Target: ATXN1; (+) strand; PAM type: NRG; PAM sequence: AGG
aaacactaaaattataccac

SEQ ID NO: 144221 - DNA, 20 bp, Artificial Sequence
  Description of Artificial Sequence: Synthetic oligonucleotide
  Target: ATXN1; (+) strand; PAM type: NRG; PAM sequence: AAG
attataccacaggaaaaaaa

SEQ ID NO: 144222 - DNA, 20 bp, Artificial Sequence
  Description of Artificial Sequence: Synthetic oligonucleotide
  Target: ATXN1; (+) strand; PAM type: NRG; PAM sequence: AGG
ttataccacaggaaaaaaaa

SEQ ID NO: 144223 - DNA, 20 bp, Artificial Sequence
  Description of Artificial Sequence: Synthetic oligonucleotide
  Target: ATXN1; (+) strand; PAM type: NRG; PAM sequence: TAG
aacacttcttttgctacatc

SEQ ID NO: 144224 - DNA, 20 bp, Artificial Sequence
  Description of Artificial Sequence: Synthetic oligonucleotide
  Target: ATXN1; (+) strand; PAM type: NRG; PAM sequence: AAG
tcttttgctacatctagctc

SEQ ID NO: 144225 - DNA, 20 bp, Artificial Sequence
  Description of Artificial Sequence: Synthetic oligonucleotide
  Target: ATXN1; (+) strand; PAM type: NRG; PAM sequence: CAG
ttgctacatctagctcaagt

SEQ ID NO: 144226 - DNA, 20 bp, Artificial Sequence
  Description of Artificial Sequence: Synthetic oligonucleotide
  Target: ATXN1; (+) strand; PAM type: NRG; PAM sequence: TGG
tagctcaagtcagcaaaatg

SEQ ID NO: 144227 - DNA, 20 bp, Artificial Sequence
  Description of Artificial Sequence: Synthetic oligonucleotide
  Target: ATXN1; (+) strand; PAM type: NRG; PAM sequence: TAG
aagtcagcaaaatgtggctc

SEQ ID NO: 144228 - DNA, 20 bp, Artificial Sequence
  Description of Artificial Sequence: Synthetic oligonucleotide
  Target: ATXN1; (+) strand; PAM type: NRG; PAM sequence: TGG
tgtggctctagtaaatgcct

SEQ ID NO: 144229 - DNA, 20 bp, Artificial Sequence
  Description of Artificial Sequence: Synthetic oligonucleotide
  Target: ATXN1; (+) strand; PAM type: NRG; PAM sequence: GAG
tggctctagtaaatgccttg

SEQ ID NO: 144230 - DNA, 20 bp, Artificial Sequence
  Description of Artificial Sequence: Synthetic oligonucleotide
  Target: ATXN1; (+) strand; PAM type: NRG; PAM sequence: TGG
agtaaatgccttggagtctg

SEQ ID NO: 144231 - DNA, 20 bp, Artificial Sequence
  Description of Artificial Sequence: Synthetic oligonucleotide
  Target: ATXN1; (+) strand; PAM type: NRG; PAM sequence: TAG
aaatgccttggagtctgtgg

SEQ ID NO: 144232 - DNA, 20 bp, Artificial Sequence
  Description of Artificial Sequence: Synthetic oligonucleotide
  Target: ATXN1; (+) strand; PAM type: NRG; PAM sequence: AGG
aatgccttggagtctgtggt

SEQ ID NO: 144233 - DNA, 20 bp, Artificial Sequence
  Description of Artificial Sequence: Synthetic oligonucleotide
  Target: ATXN1; (+) strand; PAM type: NRG; PAM sequence: AAG
gagtctgtggtaggcacaac

SEQ ID NO: 144234 - DNA, 20 bp, Artificial Sequence
  Description of Artificial Sequence: Synthetic oligonucleotide
  Target: ATXN1; (+) strand; PAM type: NRG; PAM sequence: AGG
agtctgtggtaggcacaaca

SEQ ID NO: 144235 - DNA, 20 bp, Artificial Sequence
  Description of Artificial Sequence: Synthetic oligonucleotide
  Target: ATXN1; (+) strand; PAM type: NRG; PAM sequence: GGG
gtctgtggtaggcacaacaa

SEQ ID NO: 144236 - DNA, 20 bp, Artificial Sequence
  Description of Artificial Sequence: Synthetic oligonucleotide
  Target: ATXN1; (+) strand; PAM type: NRG; PAM sequence: CAG
catacccacgtcctaatccc

SEQ ID NO: 144237 - DNA, 20 bp, Artificial Sequence
  Description of Artificial Sequence: Synthetic oligonucleotide
  Target: ATXN1; (+) strand; PAM type: NRG; PAM sequence: CAG
cacgtcctaatccccagaat

SEQ ID NO: 144238 - DNA, 20 bp, Artificial Sequence
  Description of Artificial Sequence: Synthetic oligonucleotide
  Target: ATXN1; (+) strand; PAM type: NRG; PAM sequence: TGG
agaatcagtctgtgaattcg

SEQ ID NO: 144239 - DNA, 20 bp, Artificial Sequence
  Description of Artificial Sequence: Synthetic oligonucleotide
  Target: ATXN1; (+) strand; PAM type: NRG; PAM sequence: AAG
agtctgtgaattcgtggtaa

SEQ ID NO: 144240 - DNA, 20 bp, Artificial Sequence
  Description of Artificial Sequence: Synthetic oligonucleotide
  Target: ATXN1; (+) strand; PAM type: NRG; PAM sequence: CAG
tcgtggtaaaagcgatttca

SEQ ID NO: 144241 - DNA, 20 bp, Artificial Sequence
  Description of Artificial Sequence: Synthetic oligonucleotide
  Target: ATXN1; (+) strand; PAM type: NRG; PAM sequence: AAG
ttcacagatgtgatgacatt

SEQ ID NO: 144242 - DNA, 20 bp, Artificial Sequence
  Description of Artificial Sequence: Synthetic oligonucleotide
  Target: ATXN1; (+) strand; PAM type: NRG; PAM sequence: AGG
tcacagatgtgatgacatta

SEQ ID NO: 144243 - DNA, 20 bp, Artificial Sequence
  Description of Artificial Sequence: Synthetic oligonucleotide
  Target: ATXN1; (+) strand; PAM type: NRG; PAM sequence: TGG
atgtgatgacattaaggatc

SEQ ID NO: 144244 - DNA, 20 bp, Artificial Sequence
  Description of Artificial Sequence: Synthetic oligonucleotide
  Target: ATXN1; (+) strand; PAM type: NRG; PAM sequence: GAG
gtgatgacattaaggatctg

SEQ ID NO: 144245 - DNA, 20 bp, Artificial Sequence
  Description of Artificial Sequence: Synthetic oligonucleotide
  Target: ATXN1; (+) strand; PAM type: NRG; PAM sequence: TGG
tgacattaaggatctggaga

SEQ ID NO: 144246 - DNA, 20 bp, Artificial Sequence
  Description of Artificial Sequence: Synthetic oligonucleotide
  Target: ATXN1; (+) strand; PAM type: NRG; PAM sequence: GGG
gacattaaggatctggagat

SEQ ID NO: 144247 - DNA, 20 bp, Artificial Sequence
  Description of Artificial Sequence: Synthetic oligonucleotide
  Target: ATXN1; (+) strand; PAM type: NRG; PAM sequence: GGG
acattaaggatctggagatg

SEQ ID NO: 144248 - DNA, 20 bp, Artificial Sequence
  Description of Artificial Sequence: Synthetic oligonucleotide
  Target: ATXN1; (+) strand; PAM type: NRG; PAM sequence: GAG
attaaggatctggagatggg

SEQ ID NO: 144249 - DNA, 20 bp, Artificial Sequence
  Description of Artificial Sequence: Synthetic oligonucleotide
  Target: ATXN1; (+) strand; PAM type: NRG; PAM sequence: CAG
ctggagatggggagatgata

SEQ ID NO: 144250 - DNA, 20 bp, Artificial Sequence
  Description of Artificial Sequence: Synthetic oligonucleotide
  Target: ATXN1; (+) strand; PAM type: NRG; PAM sequence: AGG
tggagatggggagatgatac

SEQ ID NO: 144251 - DNA, 20 bp, Artificial Sequence
  Description of Artificial Sequence: Synthetic oligonucleotide
  Target: ATXN1; (+) strand; PAM type: NRG; PAM sequence: TGG
agatggggagatgatacagg

SEQ ID NO: 144252 - DNA, 20 bp, Artificial Sequence
  Description of Artificial Sequence: Synthetic oligonucleotide
  Target: ATXN1; (+) strand; PAM type: NRG; PAM sequence: GGG
gatggggagatgatacaggt

SEQ ID NO: 144253 - DNA, 20 bp, Artificial Sequence
  Description of Artificial Sequence: Synthetic oligonucleotide
  Target: ATXN1; (+) strand; PAM type: NRG; PAM sequence: AAG
ggtgggtccaatgtaatcgc

SEQ ID NO: 144254 - DNA, 20 bp, Artificial Sequence
  Description of Artificial Sequence: Synthetic oligonucleotide
  Target: ATXN1; (+) strand; PAM type: NRG; PAM sequence: AGG
gtgggtccaatgtaatcgca

SEQ ID NO: 144255 - DNA, 20 bp, Artificial Sequence
  Description of Artificial Sequence: Synthetic oligonucleotide
  Target: ATXN1; (+) strand; PAM type: NRG; PAM sequence: AAG
ggtccaatgtaatcgcaagg

SEQ ID NO: 144256 - DNA, 20 bp, Artificial Sequence
  Description of Artificial Sequence: Synthetic oligonucleotide
  Target: ATXN1; (+) strand; PAM type: NRG; PAM sequence: AAG
gtaatcgcaaggaagtttaa

SEQ ID NO: 144257 - DNA, 20 bp, Artificial Sequence
  Description of Artificial Sequence: Synthetic oligonucleotide
  Target: ATXN1; (+) strand; PAM type: NRG; PAM sequence: GAG
gcaaggaagtttaaaagtct

SEQ ID NO: 144258 - DNA, 20 bp, Artificial Sequence
  Description of Artificial Sequence: Synthetic oligonucleotide
  Target: ATXN1; (+) strand; PAM type: NRG; PAM sequence: AAG
aggaagtttaaaagtctgag

SEQ ID NO: 144259 - DNA, 20 bp, Artificial Sequence
  Description of Artificial Sequence: Synthetic oligonucleotide
  Target: ATXN1; (+) strand; PAM type: NRG; PAM sequence: AGG
ggaagtttaaaagtctgaga

SEQ ID NO: 144260 - DNA, 20 bp, Artificial Sequence
  Description of Artificial Sequence: Synthetic oligonucleotide
  Target: ATXN1; (+) strand; PAM type: NRG; PAM sequence: GAG
aagtttaaaagtctgagaag

SEQ ID NO: 144261 - DNA, 20 bp, Artificial Sequence
  Description of Artificial Sequence: Synthetic oligonucleotide
  Target: ATXN1; (+) strand; PAM type: NRG; PAM sequence: AGG
agtttaaaagtctgagaagg

SEQ ID NO: 144262 - DNA, 20 bp, Artificial Sequence
  Description of Artificial Sequence: Synthetic oligonucleotide
  Target: ATXN1; (+) strand; PAM type: NRG; PAM sequence: AAG
ttaaaagtctgagaaggagg

SEQ ID NO: 144263 - DNA, 20 bp, Artificial Sequence
  Description of Artificial Sequence: Synthetic oligonucleotide
  Target: ATXN1; (+) strand; PAM type: NRG; PAM sequence: AAG
aaagtctgagaaggaggaag

SEQ ID NO: 144264 - DNA, 20 bp, Artificial Sequence
  Description of Artificial Sequence: Synthetic oligonucleotide
  Target: ATXN1; (+) strand; PAM type: NRG; PAM sequence: CAG
tgagaaggaggaagaagtgt

SEQ ID NO: 144265 - DNA, 20 bp, Artificial Sequence
  Description of Artificial Sequence: Synthetic oligonucleotide
  Target: ATXN1; (+) strand; PAM type: NRG; PAM sequence: GAG
agaaggaggaagaagtgtca

SEQ ID NO: 144266 - DNA, 20 bp, Artificial Sequence
  Description of Artificial Sequence: Synthetic oligonucleotide
  Target: ATXN1; (+) strand; PAM type: NRG; PAM sequence: AGG
gaaggaggaagaagtgtcag

SEQ ID NO: 144267 - DNA, 20 bp, Artificial Sequence
  Description of Artificial Sequence: Synthetic oligonucleotide
  Target: ATXN1; (+) strand; PAM type: NRG; PAM sequence: AAG
ggaggaagaagtgtcagagg

SEQ ID NO: 144268 - DNA, 20 bp, Artificial Sequence
  Description of Artificial Sequence: Synthetic oligonucleotide
  Target: ATXN1; (+) strand; PAM type: NRG; PAM sequence: TGG
gtcagaggaagattcaacta

SEQ ID NO: 144269 - DNA, 20 bp, Artificial Sequence
  Description of Artificial Sequence: Synthetic oligonucleotide
  Target: ATXN1; (+) strand; PAM type: NRG; PAM sequence: CAG
aagattcaactatggaaaca

SEQ ID NO: 144270 - DNA, 20 bp, Artificial Sequence
  Description of Artificial Sequence: Synthetic oligonucleotide
  Target: ATXN1; (+) strand; PAM type: NRG; PAM sequence: CAG
tcaactatggaaacacagca

SEQ ID NO: 144271 - DNA, 20 bp, Artificial Sequence
  Description of Artificial Sequence: Synthetic oligonucleotide
  Target: ATXN1; (+) strand; PAM type: NRG; PAM sequence: GAG
aactatggaaacacagcaca

SEQ ID NO: 144272 - DNA, 20 bp, Artificial Sequence
  Description of Artificial Sequence: Synthetic oligonucleotide
  Target: ATXN1; (+) strand; PAM type: NRG; PAM sequence: GAG
ctatggaaacacagcacaga

SEQ ID NO: 144273 - DNA, 20 bp, Artificial Sequence
  Description of Artificial Sequence: Synthetic oligonucleotide
  Target: ATXN1; (+) strand; PAM type: NRG; PAM sequence: TGG
acagagagatgcaacattga

SEQ ID NO: 144274 - DNA, 20 bp, Artificial Sequence
  Description of Artificial Sequence: Synthetic oligonucleotide
  Target: ATXN1; (+) strand; PAM type: NRG; PAM sequence: AAG
atgcaacattgatggctttg

SEQ ID NO: 144275 - DNA, 20 bp, Artificial Sequence
  Description of Artificial Sequence: Synthetic oligonucleotide
  Target: ATXN1; (+) strand; PAM type: NRG; PAM sequence: TAG
aacattgatggctttgaaga

SEQ ID NO: 144276 - DNA, 20 bp, Artificial Sequence
  Description of Artificial Sequence: Synthetic oligonucleotide
  Target: ATXN1; (+) strand; PAM type: NRG; PAM sequence: AGG
acattgatggctttgaagat

SEQ ID NO: 144277 - DNA, 20 bp, Artificial Sequence
  Description of Artificial Sequence: Synthetic oligonucleotide
  Target: ATXN1; (+) strand; PAM type: NRG; PAM sequence: GGG
cattgatggctttgaagata

SEQ ID NO: 144278 - DNA, 20 bp, Artificial Sequence
  Description of Artificial Sequence: Synthetic oligonucleotide
  Target: ATXN1; (+) strand; PAM type: NRG; PAM sequence: GGG
attgatggctttgaagatag

SEQ ID NO: 144279 - DNA, 20 bp, Artificial Sequence
  Description of Artificial Sequence: Synthetic oligonucleotide
  Target: ATXN1; (+) strand; PAM type: NRG; PAM sequence: AAG
gatggctttgaagatagggg

SEQ ID NO: 144280 - DNA, 20 bp, Artificial Sequence
  Description of Artificial Sequence: Synthetic oligonucleotide
  Target: ATXN1; (+) strand; PAM type: NRG; PAM sequence: AGG
atggctttgaagatagggga

SEQ ID NO: 144281 - DNA, 20 bp, Artificial Sequence
  Description of Artificial Sequence: Synthetic oligonucleotide
  Target: ATXN1; (+) strand; PAM type: NRG; PAM sequence: GGG
tggctttgaagataggggaa

SEQ ID NO: 144282 - DNA, 20 bp, Artificial Sequence
  Description of Artificial Sequence: Synthetic oligonucleotide
  Target: ATXN1; (+) strand; PAM type: NRG; PAM sequence: GGG
ggctttgaagataggggaag

SEQ ID NO: 144283 - DNA, 20 bp, Artificial Sequence
  Description of Artificial Sequence: Synthetic oligonucleotide
  Target: ATXN1; (+) strand; PAM type: NRG; PAM sequence: CAG
ttgaagataggggaaggggc

SEQ ID NO: 144284 - DNA, 20 bp, Artificial Sequence
  Description of Artificial Sequence: Synthetic oligonucleotide
  Target: ATXN1; (+) strand; PAM type: NRG; PAM sequence: AGG
tgaagataggggaaggggcc

SEQ ID NO: 144285 - DNA, 20 bp, Artificial Sequence
  Description of Artificial Sequence: Synthetic oligonucleotide
  Target: ATXN1; (+) strand; PAM type: NRG; PAM sequence: GAG
aagataggggaaggggccag

SEQ ID NO: 144286 - DNA, 20 bp, Artificial Sequence
  Description of Artificial Sequence: Synthetic oligonucleotide
  Target: ATXN1; (+) strand; PAM type: NRG; PAM sequence: AAG
aggggaaggggccaggagcc

SEQ ID NO: 144287 - DNA, 20 bp, Artificial Sequence
  Description of Artificial Sequence: Synthetic oligonucleotide
  Target: ATXN1; (+) strand; PAM type: NRG; PAM sequence: TGG
ccaggagccaagaaatacaa

SEQ ID NO: 144288 - DNA, 20 bp, Artificial Sequence
  Description of Artificial Sequence: Synthetic oligonucleotide
  Target: ATXN1; (+) strand; PAM type: NRG; PAM sequence: TAG
ccaagaaatacaatggcatc

SEQ ID NO: 144289 - DNA, 20 bp, Artificial Sequence
  Description of Artificial Sequence: Synthetic oligonucleotide
  Target: ATXN1; (+) strand; PAM type: NRG; PAM sequence: TGG
atacaatggcatctagacaa

SEQ ID NO: 144290 - DNA, 20 bp, Artificial Sequence
  Description of Artificial Sequence: Synthetic oligonucleotide
  Target: ATXN1; (+) strand; PAM type: NRG; PAM sequence: AAG
tggcatctagacaatggaaa

SEQ ID NO: 144291 - DNA, 20 bp, Artificial Sequence
  Description of Artificial Sequence: Synthetic oligonucleotide
  Target: ATXN1; (+) strand; PAM type: NRG; PAM sequence: AGG
ggcatctagacaatggaaaa

SEQ ID NO: 144292 - DNA, 20 bp, Artificial Sequence
  Description of Artificial Sequence: Synthetic oligonucleotide
  Target: ATXN1; (+) strand; PAM type: NRG; PAM sequence: TGG
atctagacaatggaaaaagg

SEQ ID NO: 144293 - DNA, 20 bp, Artificial Sequence
  Description of Artificial Sequence: Synthetic oligonucleotide
  Target: ATXN1; (+) strand; PAM type: NRG; PAM sequence: GGG
tctagacaatggaaaaaggt

SEQ ID NO: 144294 - DNA, 20 bp, Artificial Sequence
  Description of Artificial Sequence: Synthetic oligonucleotide
  Target: ATXN1; (+) strand; PAM type: NRG; PAM sequence: CAG
gacaatggaaaaaggtgggc

SEQ ID NO: 144295 - DNA, 20 bp, Artificial Sequence
  Description of Artificial Sequence: Synthetic oligonucleotide
  Target: ATXN1; (+) strand; PAM type: NRG; PAM sequence: AGG
acaatggaaaaaggtgggcc

SEQ ID NO: 144296 - DNA, 20 bp, Artificial Sequence
  Description of Artificial Sequence: Synthetic oligonucleotide
  Target: ATXN1; (+) strand; PAM type: NRG; PAM sequence: TGG
aaaaggtgggccaggcacga

SEQ ID NO: 144297 - DNA, 20 bp, Artificial Sequence
  Description of Artificial Sequence: Synthetic oligonucleotide
  Target: ATXN1; (+) strand; PAM type: NRG; PAM sequence: CAG
atggttcatgcctgtgatcc

SEQ ID NO: 144298 - DNA, 20 bp, Artificial Sequence
  Description of Artificial Sequence: Synthetic oligonucleotide
  Target: ATXN1; (+) strand; PAM type: NRG; PAM sequence: TGG
tgcctgtgatcccagcactc

SEQ ID NO: 144299 - DNA, 20 bp, Artificial Sequence
  Description of Artificial Sequence: Synthetic oligonucleotide
  Target: ATXN1; (+) strand; PAM type: NRG; PAM sequence: GGG
gcctgtgatcccagcactct

SEQ ID NO: 144300 - DNA, 20 bp, Artificial Sequence
  Description of Artificial Sequence: Synthetic oligonucleotide
  Target: ATXN1; (+) strand; PAM type: NRG; PAM sequence: GAG
ctgtgatcccagcactctgg

SEQ ID NO: 144301 - DNA, 20 bp, Artificial Sequence
  Description of Artificial Sequence: Synthetic oligonucleotide
  Target: ATXN1; (+) strand; PAM type: NRG; PAM sequence: AGG
tgtgatcccagcactctggg

SEQ ID NO: 144302 - DNA, 20 bp, Artificial Sequence
  Description of Artificial Sequence: Synthetic oligonucleotide
  Target: ATXN1; (+) strand; PAM type: NRG; PAM sequence: GAG
tcccagcactctgggaggcc

SEQ ID NO: 144303 - DNA, 20 bp, Artificial Sequence
  Description of Artificial Sequence: Synthetic oligonucleotide
  Target: ATXN1; (+) strand; PAM type: NRG; PAM sequence: AGG
cccagcactctgggaggccg

SEQ ID NO: 144304 - DNA, 20 bp, Artificial Sequence
  Description of Artificial Sequence: Synthetic oligonucleotide
  Target: ATXN1; (+) strand; PAM type: NRG; PAM sequence: CGG
agcactctgggaggccgagg

SEQ ID NO: 144305 - DNA, 20 bp, Artificial Sequence
  Description of Artificial Sequence: Synthetic oligonucleotide
  Target: ATXN1; (+) strand; PAM type: NRG; PAM sequence: GGG
gcactctgggaggccgaggc

SEQ ID NO: 144306 - DNA, 20 bp, Artificial Sequence
  Description of Artificial Sequence: Synthetic oligonucleotide
  Target: ATXN1; (+) strand; PAM type: NRG; PAM sequence: TGG
ctctgggaggccgaggcggg

SEQ ID NO: 144307 - DNA, 20 bp, Artificial Sequence
  Description of Artificial Sequence: Synthetic oligonucleotide
  Target: ATXN1; (+) strand; PAM type: NRG; PAM sequence: GAG
ccgaggcgggtggatcgcct

SEQ ID NO: 144308 - DNA, 20 bp, Artificial Sequence
  Description of Artificial Sequence: Synthetic oligonucleotide
  Target: ATXN1; (+) strand; PAM type: NRG; PAM sequence: AGG
cgaggcgggtggatcgcctg

SEQ ID NO: 144309 - DNA, 20 bp, Artificial Sequence
  Description of Artificial Sequence: Synthetic oligonucleotide
  Target: ATXN1; (+) strand; PAM type: NRG; PAM sequence: GAG
cgggtggatcgcctgaggtc

SEQ ID NO: 144310 - DNA, 20 bp, Artificial Sequence
  Description of Artificial Sequence: Synthetic oligonucleotide
  Target: ATXN1; (+) strand; PAM type: NRG; PAM sequence: GAG
ggtggatcgcctgaggtcga

SEQ ID NO: 144311 - DNA, 20 bp, Artificial Sequence
  Description of Artificial Sequence: Synthetic oligonucleotide
  Target: ATXN1; (+) strand; PAM type: NRG; PAM sequence: GAG
tcgcctgaggtcgagagttc

SEQ ID NO: 144312 - DNA, 20 bp, Artificial Sequence
  Description of Artificial Sequence: Synthetic oligonucleotide
  Target: ATXN1; (+) strand; PAM type: NRG; PAM sequence: CAG
tgaggtcgagagttcgagac

SEQ ID NO: 144313 - DNA, 20 bp, Artificial Sequence
  Description of Artificial Sequence: Synthetic oligonucleotide
  Target: ATXN1; (+) strand; PAM type: NRG; PAM sequence: TGG
tcgagagttcgagaccagcc

SEQ ID NO: 144314 - DNA, 20 bp, Artificial Sequence
  Description of Artificial Sequence: Synthetic oligonucleotide
  Target: ATXN1; (+) strand; PAM type: NRG; PAM sequence: TGG
cgagaccagcctggccaaca

SEQ ID NO: 144315 - DNA, 20 bp, Artificial Sequence
  Description of Artificial Sequence: Synthetic oligonucleotide
  Target: ATXN1; (+) strand; PAM type: NRG; PAM sequence: GAG
agaccagcctggccaacatg

SEQ ID NO: 144316 - DNA, 20 bp, Artificial Sequence
  Description of Artificial Sequence: Synthetic oligonucleotide
  Target: ATXN1; (+) strand; PAM type: NRG; PAM sequence: TAG
aacatggagaaaccccactc

SEQ ID NO: 144317 - DNA, 20 bp, Artificial Sequence
  Description of Artificial Sequence: Synthetic oligonucleotide
  Target: ATXN1; (+) strand; PAM type: NRG; PAM sequence: TAG
tctagtaaaaatataaaatt

SEQ ID NO: 144318 - DNA, 20 bp, Artificial Sequence
  Description of Artificial Sequence: Synthetic oligonucleotide
  Target: ATXN1; (+) strand; PAM type: NRG; PAM sequence: TGG
gtaaaaatataaaatttagt

SEQ ID NO: 144319 - DNA, 20 bp, Artificial Sequence
  Description of Artificial Sequence: Synthetic oligonucleotide
  Target: ATXN1; (+) strand; PAM type: NRG; PAM sequence: GGG
taaaaatataaaatttagtt

SEQ ID NO: 144320 - DNA, 20 bp, Artificial Sequence
  Description of Artificial Sequence: Synthetic oligonucleotide
  Target: ATXN1; (+) strand; PAM type: NRG; PAM sequence: TGG
atataaaatttagttgggta

SEQ ID NO: 144321 - DNA, 20 bp, Artificial Sequence
  Description of Artificial Sequence: Synthetic oligonucleotide
  Target: ATXN1; (+) strand; PAM type: NRG; PAM sequence: TGG
aatttagttgggtatggtgc

SEQ ID NO: 144322 - DNA, 20 bp, Artificial Sequence
  Description of Artificial Sequence: Synthetic oligonucleotide
  Target: ATXN1; (+) strand; PAM type: NRG; PAM sequence: GGG
atttagttgggtatggtgct

SEQ ID NO: 144323 - DNA, 20 bp, Artificial Sequence
  Description of Artificial Sequence: Synthetic oligonucleotide
  Target: ATXN1; (+) strand; PAM type: NRG; PAM sequence: CAG
gtatggtgctgggctactcc

SEQ ID NO: 144324 - DNA, 20 bp, Artificial Sequence
  Description of Artificial Sequence: Synthetic oligonucleotide
  Target: ATXN1; (+) strand; PAM type: NRG; PAM sequence: TGG
ctgggctactcccagctact

SEQ ID NO: 144325 - DNA, 20 bp, Artificial Sequence
  Description of Artificial Sequence: Synthetic oligonucleotide
  Target: ATXN1; (+) strand; PAM type: NRG; PAM sequence: GGG
tgggctactcccagctactt

SEQ ID NO: 144326 - DNA, 20 bp, Artificial Sequence
  Description of Artificial Sequence: Synthetic oligonucleotide
  Target: ATXN1; (+) strand; PAM type: NRG; PAM sequence: GAG
ggctactcccagctacttgg

SEQ ID NO: 144327 - DNA, 20 bp, Artificial Sequence
  Description of Artificial Sequence: Synthetic oligonucleotide
  Target: ATXN1; (+) strand; PAM type: NRG; PAM sequence: AGG
gctactcccagctacttggg

SEQ ID NO: 144328 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 144329 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggctg

SEQ ID NO: 144330 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgagg

SEQ ID NO: 144331 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggctgaggc

SEQ ID NO: 144332 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctgaggcag

SEQ ID NO: 144333 - DNA, 20 bp, Artificial Sequence
  Description of Artificial Sequence: Synthetic oligonucleotide
  Target: ATXN1; (+) strand; PAM type: NRG; PAM sequence: TGG
caggagaattgcttgaacct

SEQ ID NO: 144334 - DNA, 20 bp, Artificial Sequence
  Description of Artificial Sequence: Synthetic oligonucleotide
  Target: ATXN1; (+) strand; PAM type: NRG; PAM sequence: GAG
ggagaattgcttgaaccttg

SEQ ID NO: 144335 - DNA, 20 bp, Artificial Sequence
  Description of Artificial Sequence: Synthetic oligonucleotide
  Target: ATXN1; (+) strand; PAM type: NRG; PAM sequence: CGG
aattgcttgaaccttggaga

SEQ ID NO: 144336 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaaccttggagacg

SEQ ID NO: 144337 - DNA, 20 bp, Artificial Sequence
  Description of Artificial Sequence: Synthetic oligonucleotide
  Target: ATXN1; (+) strand; PAM type: NRG; PAM sequence: AGG
tgcttgaaccttggagacgg

SEQ ID NO: 144338 - DNA, 20 bp, Artificial Sequence
  Description of Artificial Sequence: Synthetic oligonucleotide
  Target: ATXN1; (+) strand; PAM type: NRG; PAM sequence: TGG
ttgaaccttggagacggagg

SEQ ID NO: 144339 - DNA, 20 bp, Artificial Sequence
  Description of Artificial Sequence: Synthetic oligonucleotide
  Target: ATXN1; (+) strand; PAM type: NRG; PAM sequence: GAG
ttggagacggaggtggcact

SEQ ID NO: 144340 - DNA, 20 bp, Artificial Sequence
  Description of Artificial Sequence: Synthetic oligonucleotide
  Target: ATXN1; (+) strand; PAM type: NRG; PAM sequence: CAG
caatatgtgccactgcactc

SEQ ID NO: 144341 - DNA, 20 bp, Artificial Sequence
  Description of Artificial Sequence: Synthetic oligonucleotide
  Target: ATXN1; (+) strand; PAM type: NRG; PAM sequence: TGG
tgtgccactgcactccagcc

SEQ ID NO: 144342 - DNA, 20 bp, Artificial Sequence
  Description of Artificial Sequence: Synthetic oligonucleotide
  Target: ATXN1; (+) strand; PAM type: NRG; PAM sequence: GGG
gtgccactgcactccagcct

SEQ ID NO: 144343 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggcga

SEQ ID NO: 144344 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggcgacagaat

SEQ ID NO: 144345 - DNA, 20 bp, Artificial Sequence
  Description of Artificial Sequence: Synthetic oligonucleotide
  Target: ATXN1; (+) strand; PAM type: NRG; PAM sequence: AAG
cccgccaaaaaaaaaaaaaa

SEQ ID NO: 144346 - DNA, 20 bp, Artificial Sequence
  Description of Artificial Sequence: Synthetic oligonucleotide
  Target: ATXN1; (+) strand; PAM type: NRG; PAM sequence: AAG
caaaaaaaaaaaaaaaagaa

SEQ ID NO: 144347 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaagaaaagaa

SEQ ID NO: 144348 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaagaaaagaaaaga

SEQ ID NO: 144349 - DNA, 20 bp, Artificial Sequence
  Description of Artificial Sequence: Synthetic oligonucleotide
  Target: ATXN1; (+) strand; PAM type: NRG; PAM sequence: CGG
agaaaagaaaagaaagaaaa

SEQ ID NO: 144350 - DNA, 20 bp, Artificial Sequence
  Description of Artificial Sequence: Synthetic oligonucleotide
  Target: ATXN1; (+) strand; PAM type: NRG; PAM sequence: AAG
agaaaagaaagaaaacggaa

SEQ ID NO: 144351 - DNA, 20 bp, Artificial Sequence
  Description of Artificial Sequence: Synthetic oligonucleotide
  Target: ATXN1; (+) strand; PAM type: NRG; PAM sequence: AGG
gaaaagaaagaaaacggaaa

SEQ ID NO: 144352 - DNA, 20 bp, Artificial Sequence
  Description of Artificial Sequence: Synthetic oligonucleotide
  Target: ATXN1; (+) strand; PAM type: NRG; PAM sequence: AAG
agaaagaaaacggaaaaggc

SEQ ID NO: 144353 - DNA, 20 bp, Artificial Sequence
  Description of Artificial Sequence: Synthetic oligonucleotide
  Target: ATXN1; (+) strand; PAM type: NRG; PAM sequence: AGG
gaaagaaaacggaaaaggca

SEQ ID NO: 144354 - DNA, 20 bp, Artificial Sequence
  Description of Artificial Sequence: Synthetic oligonucleotide
  Target: ATXN1; (+) strand; PAM type: NRG; PAM sequence: TAG
caaggatatgaattattctc

SEQ ID NO: 144355 - DNA, 20 bp, Artificial Sequence
  Description of Artificial Sequence: Synthetic oligonucleotide
  Target: ATXN1; (+) strand; PAM type: NRG; PAM sequence: GAG
aggatatgaattattctcta

SEQ ID NO: 144356 - DNA, 20 bp, Artificial Sequence
  Description of Artificial Sequence: Synthetic oligonucleotide
  Target: ATXN1; (+) strand; PAM type: NRG; PAM sequence: CAG
attattctctagagtcccta

SEQ ID NO: 144357 - DNA, 20 bp, Artificial Sequence
  Description of Artificial Sequence: Synthetic oligonucleotide
  Target: ATXN1; (+) strand; PAM type: NRG; PAM sequence: GAG
tattctctagagtccctaca

SEQ ID NO: 144358 - DNA, 20 bp, Artificial Sequence
  Description of Artificial Sequence: Synthetic oligonucleotide
  Target: ATXN1; (+) strand; PAM type: NRG; PAM sequence: GAG
ctagagtccctacagagaat

SEQ ID NO: 144359 - DNA, 20 bp, Artificial Sequence
  Description of Artificial Sequence: Synthetic oligonucleotide
  Target: ATXN1; (+) strand; PAM type: NRG; PAM sequence: TGG
gtccctacagagaatgagcc

SEQ ID NO: 144360 - DNA, 20 bp, Artificial Sequence
  Description of Artificial Sequence: Synthetic oligonucleotide
  Target: ATXN1; (+) strand; PAM type: NRG; PAM sequence: CAG
cctggctgacactttgattt

SEQ ID NO: 144361 - DNA, 20 bp, Artificial Sequence
  Description of Artificial Sequence: Synthetic oligonucleotide
  Target: ATXN1; (+) strand; PAM type: NRG; PAM sequence: TGG
ctgacactttgatttcagcc

SEQ ID NO: 144362 - DNA, 20 bp, Artificial Sequence
  Description of Artificial Sequence: Synthetic oligonucleotide
  Target: ATXN1; (+) strand; PAM type: NRG; PAM sequence: GAG
cactttgatttcagcctggt

SEQ ID NO: 144363 - DNA, 20 bp, Artificial Sequence
  Description of Artificial Sequence: Synthetic oligonucleotide
  Target: ATXN1; (+) strand; PAM type: NRG; PAM sequence: TGG
cagcctggtgagacctgtat

SEQ ID NO: 144364 - DNA, 20 bp, Artificial Sequence
  Description of Artificial Sequence: Synthetic oligonucleotide
  Target: ATXN1; (+) strand; PAM type: NRG; PAM sequence: CAG
tgtattggatttctgacctg

SEQ ID NO: 144365 - DNA, 20 bp, Artificial Sequence
  Description of Artificial Sequence: Synthetic oligonucleotide
  Target: ATXN1; (+) strand; PAM type: NRG; PAM sequence: CAG
tttctgacctgcagaactgt

SEQ ID NO: 144366 - DNA, 20 bp, Artificial Sequence
  Description of Artificial Sequence: Synthetic oligonucleotide
  Target: ATXN1; (+) strand; PAM type: NRG; PAM sequence: CAG
gcagaactgtcagataaaaa

SEQ ID NO: 144367 - DNA, 20 bp, Artificial Sequence
  Description of Artificial Sequence: Synthetic oligonucleotide
  Target: ATXN1; (+) strand; PAM type: NRG; PAM sequence: AAG
cagataaaaacagttgcttt

SEQ ID NO: 144368 - DNA, 20 bp, Artificial Sequence
  Description of Artificial Sequence: Synthetic oligonucleotide
  Target: ATXN1; (+) strand; PAM type: NRG; PAM sequence: AAG
aacagttgctttaagccaca

SEQ ID NO: 144369 - DNA, 20 bp, Artificial Sequence
  Description of Artificial Sequence: Synthetic oligonucleotide
  Target: ATXN1; (+) strand; PAM type: NRG; PAM sequence: AAG
taagccacaaagttcctgat

SEQ ID NO: 144370 - DNA, 20 bp, Artificial Sequence
  Description of Artificial Sequence: Synthetic oligonucleotide
  Target: ATXN1; (+) strand; PAM type: NRG; PAM sequence: CAG
aagttcctgataagttgtta

SEQ ID NO: 144371 - DNA, 20 bp, Artificial Sequence
  Description of Artificial Sequence: Synthetic oligonucleotide
  Target: ATXN1; (+) strand; PAM type: NRG; PAM sequence: CAG
ttcctgataagttgttacag

SEQ ID NO: 144372 - DNA, 20 bp, Artificial Sequence
  Description of Artificial Sequence: Synthetic oligonucleotide
  Target: ATXN1; (+) strand; PAM type: NRG; PAM sequence: CAG
gcagcaatgaaaaactaaca

SEQ ID NO: 144373 - DNA, 20 bp, Artificial Sequence
  Description of Artificial Sequence: Synthetic oligonucleotide
  Target: ATXN1; (+) strand; PAM type: NRG; PAM sequence: AGG
cagcaatgaaaaactaacac

SEQ ID NO: 144374 - DNA, 20 bp, Artificial Sequence
  Description of Artificial Sequence: Synthetic oligonucleotide
  Target: ATXN1; (+) strand; PAM type: NRG; PAM sequence: AAG
aaactaacacaggtgctttg

SEQ ID NO: 144375 - DNA, 20 bp, Artificial Sequence
  Description of Artificial Sequence: Synthetic oligonucleotide
  Target: ATXN1; (+) strand; PAM type: NRG; PAM sequence: CAG
acaggtgctttgaagaaact

SEQ ID NO: 144376 - DNA, 20 bp, Artificial Sequence
  Description of Artificial Sequence: Synthetic oligonucleotide
  Target: ATXN1; (+) strand; PAM type: NRG; PAM sequence: AGG
caggtgctttgaagaaactc

SEQ ID NO: 144377 - DNA, 20 bp, Artificial Sequence
  Description of Artificial Sequence: Synthetic oligonucleotide
  Target: ATXN1; (+) strand; PAM type: NRG; PAM sequence: AAG
ctcaggtcacctctaacaca

SEQ ID NO: 144378 - DNA, 20 bp, Artificial Sequence
  Description of Artificial Sequence: Synthetic oligonucleotide
  Target: ATXN1; (+) strand; PAM type: NRG; PAM sequence: AGG
tcaggtcacctctaacacaa

SEQ ID NO: 144379 - DNA, 20 bp, Artificial Sequence
  Description of Artificial Sequence: Synthetic oligonucleotide
  Target: ATXN1; (+) strand; PAM type: NRG; PAM sequence: TGG
cacctctaacacaaaggcca

SEQ ID NO: 144380 - DNA, 20 bp, Artificial Sequence
  Description of Artificial Sequence: Synthetic oligonucleotide
  Target: ATXN1; (+) strand; PAM type: NRG; PAM sequence: CAG
ctaacacaaaggccatggcc

SEQ ID NO: 144381 - DNA, 20 bp, Artificial Sequence
  Description of Artificial Sequence: Synthetic oligonucleotide
  Target: ATXN1; (+) strand; PAM type: NRG; PAM sequence: CAG
cacaaaggccatggcccagc

SEQ ID NO: 144382 - DNA, 20 bp, Artificial Sequence
  Description of Artificial Sequence: Synthetic oligonucleotide
  Target: ATXN1; (+) strand; PAM type: NRG; PAM sequence: CGG
ccagccacccacatactttc

SEQ ID NO: 144383 - DNA, 20 bp, Artificial Sequence
  Description of Artificial Sequence: Synthetic oligonucleotide
  Target: ATXN1; (+) strand; PAM type: NRG; PAM sequence: AAG
ccggctttaccaaacacata

SEQ ID NO: 144384 - DNA, 20 bp, Artificial Sequence
  Description of Artificial Sequence: Synthetic oligonucleotide
  Target: ATXN1; (+) strand; PAM type: NRG; PAM sequence: CAG
ctttaccaaacacataaaga

SEQ ID NO: 144385 - DNA, 20 bp, Artificial Sequence
  Description of Artificial Sequence: Synthetic oligonucleotide
  Target: ATXN1; (+) strand; PAM type: NRG; PAM sequence: TGG
cagaatcccaaatattaatt

SEQ ID NO: 144386 - DNA, 20 bp, Artificial Sequence
  Description of Artificial Sequence: Synthetic oligonucleotide
  Target: ATXN1; (+) strand; PAM type: NRG; PAM sequence: TGG
aaatattaatttggcacaaa

SEQ ID NO: 144387 - DNA, 20 bp, Artificial Sequence
  Description of Artificial Sequence: Synthetic oligonucleotide
  Target: ATXN1; (+) strand; PAM type: NRG; PAM sequence: GGG
aatattaatttggcacaaat

SEQ ID NO: 144388 - DNA, 20 bp, Artificial Sequence
  Description of Artificial Sequence: Synthetic oligonucleotide
  Target: ATXN1; (+) strand; PAM type: NRG; PAM sequence: TGG
aatttggcacaaatgggata

SEQ ID NO: 144389 - DNA, 20 bp, Artificial Sequence
  Description of Artificial Sequence: Synthetic oligonucleotide
  Target: ATXN1; (+) strand; PAM type: NRG; PAM sequence: CGG
ggcacaaatgggatatggcc

SEQ ID NO: 144390 - DNA, 20 bp, Artificial Sequence
  Description of Artificial Sequence: Synthetic oligonucleotide
  Target: ATXN1; (+) strand; PAM type: NRG; PAM sequence: GGG
gcacaaatgggatatggccc

SEQ ID NO: 144391 - DNA, 20 bp, Artificial Sequence
  Description of Artificial Sequence: Synthetic oligonucleotide
  Target: ATXN1; (+) strand; PAM type: NRG; PAM sequence: TAG
caaatgggatatggcccggg

SEQ ID NO: 144392 - DNA, 20 bp, Artificial Sequence
  Description of Artificial Sequence: Synthetic oligonucleotide
  Target: ATXN1; (+) strand; PAM type: NRG; PAM sequence: CAG
gctcttcccactcacgcctg

SEQ ID NO: 144393 - DNA, 20 bp, Artificial Sequence
  Description of Artificial Sequence: Synthetic oligonucleotide
  Target: ATXN1; (+) strand; PAM type: NRG; PAM sequence: AAG
cttacctcctcacctttgtc

SEQ ID NO: 144394 - DNA, 20 bp, Artificial Sequence
  Description of Artificial Sequence: Synthetic oligonucleotide
  Target: ATXN1; (+) strand; PAM type: NRG; PAM sequence: AGG
ttacctcctcacctttgtca

SEQ ID NO: 144395 - DNA, 20 bp, Artificial Sequence
  Description of Artificial Sequence: Synthetic oligonucleotide
  Target: ATXN1; (+) strand; PAM type: NRG; PAM sequence: CAG
cctcctcacctttgtcaagg

SEQ ID NO: 144396 - DNA, 20 bp, Artificial Sequence
  Description of Artificial Sequence: Synthetic oligonucleotide
  Target: ATXN1; (+) strand; PAM type: NRG; PAM sequence: AGG
ctcctcacctttgtcaaggc

SEQ ID NO: 144397 - DNA, 20 bp, Artificial Sequence
  Description of Artificial Sequence: Synthetic oligonucleotide
  Target: ATXN1; (+) strand; PAM type: NRG; PAM sequence: CAG
gtcaaggcaggctgatttat

SEQ ID NO: 144398 - DNA, 20 bp, Artificial Sequence
  Description of Artificial Sequence: Synthetic oligonucleotide
  Target: ATXN1; (+) strand; PAM type: NRG; PAM sequence: TGG
ggcaggctgatttatcagct

SEQ ID NO: 144399 - DNA, 20 bp, Artificial Sequence
  Description of Artificial Sequence: Synthetic oligonucleotide
  Target: ATXN1; (+) strand; PAM type: NRG; PAM sequence: GAG
tttatcagcttggaaactat

SEQ ID NO: 144400 - DNA, 20 bp, Artificial Sequence
  Description of Artificial Sequence: Synthetic oligonucleotide
  Target: ATXN1; (+) strand; PAM type: NRG; PAM sequence: AAG
atcagcttggaaactatgag

SEQ ID NO: 144401 - DNA, 20 bp, Artificial Sequence
  Description of Artificial Sequence: Synthetic oligonucleotide
  Target: ATXN1; (+) strand; PAM type: NRG; PAM sequence: AGG
tcagcttggaaactatgaga

SEQ ID NO: 144402 - DNA, 20 bp, Artificial Sequence
  Description of Artificial Sequence: Synthetic oligonucleotide
  Target: ATXN1; (+) strand; PAM type: NRG; PAM sequence: AAG
cttggaaactatgagaagga

SEQ ID NO: 144403 - DNA, 20 bp, Artificial Sequence
  Description of Artificial Sequence: Synthetic oligonucleotide
  Target: ATXN1; (+) strand; PAM type: NRG; PAM sequence: AGG
ttggaaactatgagaaggaa

SEQ ID NO: 144404 - DNA, 20 bp, Artificial Sequence
  Description of Artificial Sequence: Synthetic oligonucleotide
  Target: ATXN1; (+) strand; PAM type: NRG; PAM sequence: GGG
tggaaactatgagaaggaaa

SEQ ID NO: 144405 - DNA, 20 bp, Artificial Sequence
  Description of Artificial Sequence: Synthetic oligonucleotide
  Target: ATXN1; (+) strand; PAM type: NRG; PAM sequence: AAG
ctatgagaaggaaagggtct

SEQ ID NO: 144406 - DNA, 20 bp, Artificial Sequence
  Description of Artificial Sequence: Synthetic oligonucleotide
  Target: ATXN1; (+) strand; PAM type: NRG; PAM sequence: AGG
tatgagaaggaaagggtcta

SEQ ID NO: 144407 - DNA, 20 bp, Artificial Sequence
  Description of Artificial Sequence: Synthetic oligonucleotide
  Target: ATXN1; (+) strand; PAM type: NRG; PAM sequence: CAG
gagaaggaaagggtctaagg

SEQ ID NO: 144408 - DNA, 20 bp, Artificial Sequence
  Description of Artificial Sequence: Synthetic oligonucleotide
  Target: ATXN1; (+) strand; PAM type: NRG; PAM sequence: AGG
agaaggaaagggtctaaggc

SEQ ID NO: 144409 - DNA, 20 bp, Artificial Sequence
  Description of Artificial Sequence: Synthetic oligonucleotide
  Target: ATXN1; (+) strand; PAM type: NRG; PAM sequence: GGG
gaaggaaagggtctaaggca

SEQ ID NO: 144410 - DNA, 20 bp, Artificial Sequence
  Description of Artificial Sequence: Synthetic oligonucleotide
  Target: ATXN1; (+) strand; PAM type: NRG; PAM sequence: CAG
aaggcagggtttctcaactc

SEQ ID NO: 144411 - DNA, 20 bp, Artificial Sequence
  Description of Artificial Sequence: Synthetic oligonucleotide
  Target: ATXN1; (+) strand; PAM type: NRG; PAM sequence: TGG
ctccagcactattaacattt

SEQ ID NO: 144412 - DNA, 20 bp, Artificial Sequence
  Description of Artificial Sequence: Synthetic oligonucleotide
  Target: ATXN1; (+) strand; PAM type: NRG; PAM sequence: GGG
tccagcactattaacatttt

SEQ ID NO: 144413 - DNA, 20 bp, Artificial Sequence
  Description of Artificial Sequence: Synthetic oligonucleotide
  Target: ATXN1; (+) strand; PAM type: NRG; PAM sequence: CAG
gcactattaacattttgggc

SEQ ID NO: 144414 - DNA, 20 bp, Artificial Sequence
  Description of Artificial Sequence: Synthetic oligonucleotide
  Target: ATXN1; (+) strand; PAM type: NRG; PAM sequence: TGG
attttgggccagatgatcct

SEQ ID NO: 144415 - DNA, 20 bp, Artificial Sequence
  Description of Artificial Sequence: Synthetic oligonucleotide
  Target: ATXN1; (+) strand; PAM type: NRG; PAM sequence: GAG
gggccagatgatccttggtt

SEQ ID NO: 144416 - DNA, 20 bp, Artificial Sequence
  Description of Artificial Sequence: Synthetic oligonucleotide
  Target: ATXN1; (+) strand; PAM type: NRG; PAM sequence: AGG
ggccagatgatccttggttg

SEQ ID NO: 144417 - DNA, 20 bp, Artificial Sequence
  Description of Artificial Sequence: Synthetic oligonucleotide
  Target: ATXN1; (+) strand; PAM type: NRG; PAM sequence: CAG
cagatgatccttggttgagg

SEQ ID NO: 144418 - DNA, 20 bp, Artificial Sequence
  Description of Artificial Sequence: Synthetic oligonucleotide
  Target: ATXN1; (+) strand; PAM type: NRG; PAM sequence: GAG
gatgatccttggttgaggca

SEQ ID NO: 144419 - DNA, 20 bp, Artificial Sequence
  Description of Artificial Sequence: Synthetic oligonucleotide
  Target: ATXN1; (+) strand; PAM type: NRG; PAM sequence: AGG
atgatccttggttgaggcag

SEQ ID NO: 144420 - DNA, 20 bp, Artificial Sequence
  Description of Artificial Sequence: Synthetic oligonucleotide
  Target: ATXN1; (+) strand; PAM type: NRG; PAM sequence: TGG
ggttgaggcagaggactgtt

SEQ ID NO: 144421 - DNA, 20 bp, Artificial Sequence
  Description of Artificial Sequence: Synthetic oligonucleotide
  Target: ATXN1; (+) strand; PAM type: NRG; PAM sequence: TAG
gaggactgtttggtgcattg

SEQ ID NO: 144422 - DNA, 20 bp, Artificial Sequence
  Description of Artificial Sequence: Synthetic oligonucleotide
  Target: ATXN1; (+) strand; PAM type: NRG; PAM sequence: AGG
aggactgtttggtgcattgt

SEQ ID NO: 144423 - DNA, 20 bp, Artificial Sequence
  Description of Artificial Sequence: Synthetic oligonucleotide
  Target: ATXN1; (+) strand; PAM type: NRG; PAM sequence: AAG
attcattcattcattcattc

SEQ ID NO: 144424 - DNA, 20 bp, Artificial Sequence
  Description of Artificial Sequence: Synthetic oligonucleotide
  Target: ATXN1; (+) strand; PAM type: NRG; PAM sequence: GAG
tcattcattcattcattcaa

SEQ ID NO: 144425 - DNA, 20 bp, Artificial Sequence
  Description of Artificial Sequence: Synthetic oligonucleotide
  Target: ATXN1; (+) strand; PAM type: NRG; PAM sequence: CAG
agacccctgactctgctgcc

SEQ ID NO: 144426 - DNA, 20 bp, Artificial Sequence
  Description of Artificial Sequence: Synthetic oligonucleotide
  Target: ATXN1; (+) strand; PAM type: NRG; PAM sequence: AGG
gacccctgactctgctgccc

SEQ ID NO: 144427 - DNA, 20 bp, Artificial Sequence
  Description of Artificial Sequence: Synthetic oligonucleotide
  Target: ATXN1; (+) strand; PAM type: NRG; PAM sequence: TGG
cctgactctgctgcccaggc

SEQ ID NO: 144428 - DNA, 20 bp, Artificial Sequence
  Description of Artificial Sequence: Synthetic oligonucleotide
  Target: ATXN1; (+) strand; PAM type: NRG; PAM sequence: GAG
tgactctgctgcccaggctg

SEQ ID NO: 144429 - DNA, 20 bp, Artificial Sequence
  Description of Artificial Sequence: Synthetic oligonucleotide
  Target: ATXN1; (+) strand; PAM type: NRG; PAM sequence: TAG
ctgctgcccaggctggagtg

SEQ ID NO: 144430 - DNA, 20 bp, Artificial Sequence
  Description of Artificial Sequence: Synthetic oligonucleotide
  Target: ATXN1; (+) strand; PAM type: NRG; PAM sequence: CAG
ggagtgtagtgacgccatca

SEQ ID NO: 144431 - DNA, 20 bp, Artificial Sequence
  Description of Artificial Sequence: Synthetic oligonucleotide
  Target: ATXN1; (+) strand; PAM type: NRG; PAM sequence: CAG
gacgccatcacagctcactg

SEQ ID NO: 144432 - DNA, 20 bp, Artificial Sequence
  Description of Artificial Sequence: Synthetic oligonucleotide
  Target: ATXN1; (+) strand; PAM type: NRG; PAM sequence: GAG
cactgcagcctcaaactcct

SEQ ID NO: 144433 - DNA, 20 bp, Artificial Sequence
  Description of Artificial Sequence: Synthetic oligonucleotide
  Target: ATXN1; (+) strand; PAM type: NRG; PAM sequence: CAG
cagcctcaaactcctgagct

SEQ ID NO: 144434 - DNA, 20 bp, Artificial Sequence
  Description of Artificial Sequence: Synthetic oligonucleotide
  Target: ATXN1; (+) strand; PAM type: NRG; PAM sequence: AGG
agcctcaaactcctgagctc

SEQ ID NO: 144435 - DNA, 20 bp, Artificial Sequence
  Description of Artificial Sequence: Synthetic oligonucleotide
  Target: ATXN1; (+) strand; PAM type: NRG; PAM sequence: AAG
cctcctgcctcgacctccta

SEQ ID NO: 144436 - DNA, 20 bp, Artificial Sequence
  Description of Artificial Sequence: Synthetic oligonucleotide
  Target: ATXN1; (+) strand; PAM type: NRG; PAM sequence: TGG
gcctcgacctcctaaagtgc

SEQ ID NO: 144437 - DNA, 20 bp, Artificial Sequence
  Description of Artificial Sequence: Synthetic oligonucleotide
  Target: ATXN1; (+) strand; PAM type: NRG; PAM sequence: GGG
cctcgacctcctaaagtgct

SEQ ID NO: 144438 - DNA, 20 bp, Artificial Sequence
  Description of Artificial Sequence: Synthetic oligonucleotide
  Target: ATXN1; (+) strand; PAM type: NRG; PAM sequence: CAG
ctcctaaagtgctgggatta

SEQ ID NO: 144439 - DNA, 20 bp, Artificial Sequence
  Description of Artificial Sequence: Synthetic oligonucleotide
  Target: ATXN1; (+) strand; PAM type: NRG; PAM sequence: AGG
tcctaaagtgctgggattac

SEQ ID NO: 144440 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggtgt

SEQ ID NO: 144441 - DNA, 20 bp, Artificial Sequence
  Description of Artificial Sequence: Synthetic oligonucleotide
  Target: ATXN1; (+) strand; PAM type: NRG; PAM sequence: CAG
caggtgtgagccaatgcccc

SEQ ID NO: 144442 - DNA, 20 bp, Artificial Sequence
  Description of Artificial Sequence: Synthetic oligonucleotide
  Target: ATXN1; (+) strand; PAM type: NRG; PAM sequence: CAG
caatgcccccagccccattg

SEQ ID NO: 144443 - DNA, 20 bp, Artificial Sequence
  Description of Artificial Sequence: Synthetic oligonucleotide
  Target: ATXN1; (+) strand; PAM type: NRG; PAM sequence: AGG
aatgcccccagccccattgc

SEQ ID NO: 144444 - DNA, 20 bp, Artificial Sequence
  Description of Artificial Sequence: Synthetic oligonucleotide
  Target: ATXN1; (+) strand; PAM type: NRG; PAM sequence: CAG
cagccccattgcaggatgtt

SEQ ID NO: 144445 - DNA, 20 bp, Artificial Sequence
  Description of Artificial Sequence: Synthetic oligonucleotide
  Target: ATXN1; (+) strand; PAM type: NRG; PAM sequence: CAG
ccccattgcaggatgttcag

SEQ ID NO: 144446 - DNA, 20 bp, Artificial Sequence
  Description of Artificial Sequence: Synthetic oligonucleotide
  Target: ATXN1; (+) strand; PAM type: NRG; PAM sequence: TGG
aggatgttcagcagcatttc

SEQ ID NO: 144447 - DNA, 20 bp, Artificial Sequence
  Description of Artificial Sequence: Synthetic oligonucleotide
  Target: ATXN1; (+) strand; PAM type: NRG; PAM sequence: TAG
catttctggcctctactcac

SEQ ID NO: 144448 - DNA, 20 bp, Artificial Sequence
  Description of Artificial Sequence: Synthetic oligonucleotide
  Target: ATXN1; (+) strand; PAM type: NRG; PAM sequence: CAG
ggcctctactcactagatgc

SEQ ID NO: 144449 - DNA, 20 bp, Artificial Sequence
  Description of Artificial Sequence: Synthetic oligonucleotide
  Target: ATXN1; (+) strand; PAM type: NRG; PAM sequence: TGG
tgctaccttgttttcccatt

SEQ ID NO: 144450 - DNA, 20 bp, Artificial Sequence
  Description of Artificial Sequence: Synthetic oligonucleotide
  Target: ATXN1; (+) strand; PAM type: NRG; PAM sequence: GGG
gctaccttgttttcccattt

SEQ ID NO: 144451 - DNA, 20 bp, Artificial Sequence
  Description of Artificial Sequence: Synthetic oligonucleotide
  Target: ATXN1; (+) strand; PAM type: NRG; PAM sequence: AAG
tcccatttgggacgatcaaa

SEQ ID NO: 144452 - DNA, 20 bp, Artificial Sequence
  Description of Artificial Sequence: Synthetic oligonucleotide
  Target: ATXN1; (+) strand; PAM type: NRG; PAM sequence: GAG
caaacattgccaaatgtcct

SEQ ID NO: 144453 - DNA, 20 bp, Artificial Sequence
  Description of Artificial Sequence: Synthetic oligonucleotide
  Target: ATXN1; (+) strand; PAM type: NRG; PAM sequence: GAG
aacattgccaaatgtcctga

SEQ ID NO: 144454 - DNA, 20 bp, Artificial Sequence
  Description of Artificial Sequence: Synthetic oligonucleotide
  Target: ATXN1; (+) strand; PAM type: NRG; PAM sequence: AGG
acattgccaaatgtcctgag

SEQ ID NO: 144455 - DNA, 20 bp, Artificial Sequence
  Description of Artificial Sequence: Synthetic oligonucleotide
  Target: ATXN1; (+) strand; PAM type: NRG; PAM sequence: GGG
cattgccaaatgtcctgaga

SEQ ID NO: 144456 - DNA, 20 bp, Artificial Sequence
  Description of Artificial Sequence: Synthetic oligonucleotide
  Target: ATXN1; (+) strand; PAM type: NRG; PAM sequence: TGG
aatgtcctgagagggcaaaa

SEQ ID NO: 144457 - DNA, 20 bp, Artificial Sequence
  Description of Artificial Sequence: Synthetic oligonucleotide
  Target: ATXN1; (+) strand; PAM type: NRG; PAM sequence: CAG
tgagagggcaaaatggtccc

SEQ ID NO: 144458 - DNA, 20 bp, Artificial Sequence
  Description of Artificial Sequence: Synthetic oligonucleotide
  Target: ATXN1; (+) strand; PAM type: NRG; PAM sequence: GAG
gggcaaaatggtccccagtt

SEQ ID NO: 144459 - DNA, 20 bp, Artificial Sequence
  Description of Artificial Sequence: Synthetic oligonucleotide
  Target: ATXN1; (+) strand; PAM type: NRG; PAM sequence: TGG
ggtccccagttgagatccac

SEQ ID NO: 144460 - DNA, 20 bp, Artificial Sequence
  Description of Artificial Sequence: Synthetic oligonucleotide
  Target: ATXN1; (+) strand; PAM type: NRG; PAM sequence: CAG
agttgagatccactggttga

SEQ ID NO: 144461 - DNA, 20 bp, Artificial Sequence
  Description of Artificial Sequence: Synthetic oligonucleotide
  Target: ATXN1; (+) strand; PAM type: NRG; PAM sequence: TGG
atccactggttgacagcatg

SEQ ID NO: 144462 - DNA, 20 bp, Artificial Sequence
  Description of Artificial Sequence: Synthetic oligonucleotide
  Target: ATXN1; (+) strand; PAM type: NRG; PAM sequence: CAG
cactggttgacagcatgtgg

SEQ ID NO: 144463 - DNA, 20 bp, Artificial Sequence
  Description of Artificial Sequence: Synthetic oligonucleotide
  Target: ATXN1; (+) strand; PAM type: NRG; PAM sequence: TGG
acagcatgtggcagttaatg

SEQ ID NO: 144464 - DNA, 20 bp, Artificial Sequence
  Description of Artificial Sequence: Synthetic oligonucleotide
  Target: ATXN1; (+) strand; PAM type: NRG; PAM sequence: TGG
gcatgtggcagttaatgtgg

SEQ ID NO: 144465 - DNA, 20 bp, Artificial Sequence
  Description of Artificial Sequence: Synthetic oligonucleotide
  Target: ATXN1; (+) strand; PAM type: NRG; PAM sequence: CAG
gtggtctgtgttctctccat

SEQ ID NO: 144466 - DNA, 20 bp, Artificial Sequence
  Description of Artificial Sequence: Synthetic oligonucleotide
  Target: ATXN1; (+) strand; PAM type: NRG; PAM sequence: TGG
catcagttccctcccataca

SEQ ID NO: 144467 - DNA, 20 bp, Artificial Sequence
  Description of Artificial Sequence: Synthetic oligonucleotide
  Target: ATXN1; (+) strand; PAM type: NRG; PAM sequence: TGG
atatattcttacattgctgc

SEQ ID NO: 144468 - DNA, 20 bp, Artificial Sequence
  Description of Artificial Sequence: Synthetic oligonucleotide
  Target: ATXN1; (+) strand; PAM type: NRG; PAM sequence: GAG
gctgctggtctcattcaaat

SEQ ID NO: 144469 - DNA, 20 bp, Artificial Sequence
  Description of Artificial Sequence: Synthetic oligonucleotide
  Target: ATXN1; (+) strand; PAM type: NRG; PAM sequence: AAG
ctcattcaaatgagtctccc

SEQ ID NO: 144470 - DNA, 20 bp, Artificial Sequence
  Description of Artificial Sequence: Synthetic oligonucleotide
  Target: ATXN1; (+) strand; PAM type: NRG; PAM sequence: AGG
tcattcaaatgagtctccca

SEQ ID NO: 144471 - DNA, 20 bp, Artificial Sequence
  Description of Artificial Sequence: Synthetic oligonucleotide
  Target: ATXN1; (+) strand; PAM type: NRG; PAM sequence: CAG
aaatgagtctcccaaggatt

SEQ ID NO: 144472 - DNA, 20 bp, Artificial Sequence
  Description of Artificial Sequence: Synthetic oligonucleotide
  Target: ATXN1; (+) strand; PAM type: NRG; PAM sequence: CAG
gtctgtttgacattttaaaa

SEQ ID NO: 144473 - DNA, 20 bp, Artificial Sequence
  Description of Artificial Sequence: Synthetic oligonucleotide
  Target: ATXN1; (+) strand; PAM type: NRG; PAM sequence: CAG
attttaaaacagctcaaact

SEQ ID NO: 144474 - DNA, 20 bp, Artificial Sequence
  Description of Artificial Sequence: Synthetic oligonucleotide
  Target: ATXN1; (+) strand; PAM type: NRG; PAM sequence: CAG
tcaaactcagaattcaacca

SEQ ID NO: 144475 - DNA, 20 bp, Artificial Sequence
  Description of Artificial Sequence: Synthetic oligonucleotide
  Target: ATXN1; (+) strand; PAM type: NRG; PAM sequence: AGG
caaactcagaattcaaccac

SEQ ID NO: 144476 - DNA, 20 bp, Artificial Sequence
  Description of Artificial Sequence: Synthetic oligonucleotide
  Target: ATXN1; (+) strand; PAM type: NRG; PAM sequence: TGG
cacaggacttttttttaaaa

SEQ ID NO: 144477 - DNA, 20 bp, Artificial Sequence
  Description of Artificial Sequence: Synthetic oligonucleotide
  Target: ATXN1; (+) strand; PAM type: NRG; PAM sequence: CAG
ggccccactatacttattcc

SEQ ID NO: 144478 - DNA, 20 bp, Artificial Sequence
  Description of Artificial Sequence: Synthetic oligonucleotide
  Target: ATXN1; (+) strand; PAM type: NRG; PAM sequence: CAG
actatacttattcccagcca

SEQ ID NO: 144479 - DNA, 20 bp, Artificial Sequence
  Description of Artificial Sequence: Synthetic oligonucleotide
  Target: ATXN1; (+) strand; PAM type: NRG; PAM sequence: AGG
ctatacttattcccagccac

SEQ ID NO: 144480 - DNA, 20 bp, Artificial Sequence
  Description of Artificial Sequence: Synthetic oligonucleotide
  Target: ATXN1; (+) strand; PAM type: NRG; PAM sequence: AAG
acttattcccagccacaggc

SEQ ID NO: 144481 - DNA, 20 bp, Artificial Sequence
  Description of Artificial Sequence: Synthetic oligonucleotide
  Target: ATXN1; (+) strand; PAM type: NRG; PAM sequence: AGG
cttattcccagccacaggca

SEQ ID NO: 144482 - DNA, 20 bp, Artificial Sequence
  Description of Artificial Sequence: Synthetic oligonucleotide
  Target: ATXN1; (+) strand; PAM type: NRG; PAM sequence: GGG
ttattcccagccacaggcaa

SEQ ID NO: 144483 - DNA, 20 bp, Artificial Sequence
  Description of Artificial Sequence: Synthetic oligonucleotide
  Target: ATXN1; (+) strand; PAM type: NRG; PAM sequence: TGG
agccacaggcaagggaaaca

SEQ ID NO: 144484 - DNA, 20 bp, Artificial Sequence
  Description of Artificial Sequence: Synthetic oligonucleotide
  Target: ATXN1; (+) strand; PAM type: NRG; PAM sequence: CAG
ggcttttccacaatgacccg

SEQ ID NO: 144485 - DNA, 20 bp, Artificial Sequence
  Description of Artificial Sequence: Synthetic oligonucleotide
  Target: ATXN1; (+) strand; PAM type: NRG; PAM sequence: TAG
caatgacccgcagcccaacc

SEQ ID NO: 144486 - DNA, 20 bp, Artificial Sequence
  Description of Artificial Sequence: Synthetic oligonucleotide
  Target: ATXN1; (+) strand; PAM type: NRG; PAM sequence: AAG
cgcagcccaacctagccaac

SEQ ID NO: 144487 - DNA, 20 bp, Artificial Sequence
  Description of Artificial Sequence: Synthetic oligonucleotide
  Target: ATXN1; (+) strand; PAM type: NRG; PAM sequence: CAG
attcatccatactgctgcta

SEQ ID NO: 144488 - DNA, 20 bp, Artificial Sequence
  Description of Artificial Sequence: Synthetic oligonucleotide
  Target: ATXN1; (+) strand; PAM type: NRG; PAM sequence: GAG
tcatccatactgctgctaca

SEQ ID NO: 144489 - DNA, 20 bp, Artificial Sequence
  Description of Artificial Sequence: Synthetic oligonucleotide
  Target: ATXN1; (+) strand; PAM type: NRG; PAM sequence: AGG
catccatactgctgctacag

SEQ ID NO: 144490 - DNA, 20 bp, Artificial Sequence
  Description of Artificial Sequence: Synthetic oligonucleotide
  Target: ATXN1; (+) strand; PAM type: NRG; PAM sequence: CAG
tactgctgctacagaggcga

SEQ ID NO: 144491 - DNA, 20 bp, Artificial Sequence
  Description of Artificial Sequence: Synthetic oligonucleotide
  Target: ATXN1; (+) strand; PAM type: NRG; PAM sequence: GAG
ctgctgctacagaggcgaca

SEQ ID NO: 144492 - DNA, 20 bp, Artificial Sequence
  Description of Artificial Sequence: Synthetic oligonucleotide
  Target: ATXN1; (+) strand; PAM type: NRG; PAM sequence: AGG
tgctgctacagaggcgacag

SEQ ID NO: 144493 - DNA, 20 bp, Artificial Sequence
  Description of Artificial Sequence: Synthetic oligonucleotide
  Target: ATXN1; (+) strand; PAM type: NRG; PAM sequence: CAG
gctacagaggcgacagaggt

SEQ ID NO: 144494 - DNA, 20 bp, Artificial Sequence
  Description of Artificial Sequence: Synthetic oligonucleotide
  Target: ATXN1; (+) strand; PAM type: NRG; PAM sequence: CAG
cacttgctatttgactgtta

SEQ ID NO: 144495 - DNA, 20 bp, Artificial Sequence
  Description of Artificial Sequence: Synthetic oligonucleotide
  Target: ATXN1; (+) strand; PAM type: NRG; PAM sequence: GAG
cttgctatttgactgttaca

SEQ ID NO: 144496 - DNA, 20 bp, Artificial Sequence
  Description of Artificial Sequence: Synthetic oligonucleotide
  Target: ATXN1; (+) strand; PAM type: NRG; PAM sequence: GAG
tttttttttttttttttttt

SEQ ID NO: 144497 - DNA, 20 bp, Artificial Sequence
  Description of Artificial Sequence: Synthetic oligonucleotide
  Target: ATXN1; (+) strand; PAM type: NRG; PAM sequence: CGG
ttttttttttttttttgaga

SEQ ID NO: 144498 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttttgagacg

SEQ ID NO: 144499 - DNA, 20 bp, Artificial Sequence
  Description of Artificial Sequence: Synthetic oligonucleotide
  Target: ATXN1; (+) strand; PAM type: NRG; PAM sequence: CAG
acggagtctcgctctgttgc

SEQ ID NO: 144500 - DNA, 20 bp, Artificial Sequence
  Description of Artificial Sequence: Synthetic oligonucleotide
  Target: ATXN1; (+) strand; PAM type: NRG; PAM sequence: AGG
cggagtctcgctctgttgcc

SEQ ID NO: 144501 - DNA, 20 bp, Artificial Sequence
  Description of Artificial Sequence: Synthetic oligonucleotide
  Target: ATXN1; (+) strand; PAM type: NRG; PAM sequence: TGG
gtctcgctctgttgccaggc

SEQ ID NO: 144502 - DNA, 20 bp, Artificial Sequence
  Description of Artificial Sequence: Synthetic oligonucleotide
  Target: ATXN1; (+) strand; PAM type: NRG; PAM sequence: GAG
ctcgctctgttgccaggctg

SEQ ID NO: 144503 - DNA, 20 bp, Artificial Sequence
  Description of Artificial Sequence: Synthetic oligonucleotide
  Target: ATXN1; (+) strand; PAM type: NRG; PAM sequence: CAG
tctgttgccaggctggagtg

SEQ ID NO: 144504 - DNA, 20 bp, Artificial Sequence
  Description of Artificial Sequence: Synthetic oligonucleotide
  Target: ATXN1; (+) strand; PAM type: NRG; PAM sequence: TGG
gttgccaggctggagtgcag

SEQ ID NO: 144505 - DNA, 20 bp, Artificial Sequence
  Description of Artificial Sequence: Synthetic oligonucleotide
  Target: ATXN1; (+) strand; PAM type: NRG; PAM sequence: CGG
ggagtgcagtggtgtgatct

SEQ ID NO: 144506 - DNA, 20 bp, Artificial Sequence
  Description of Artificial Sequence: Synthetic oligonucleotide
  Target: ATXN1; (+) strand; PAM type: NRG; PAM sequence: AAG
tcggctcactgcaacactgc

SEQ ID NO: 144507 - DNA, 20 bp, Artificial Sequence
  Description of Artificial Sequence: Synthetic oligonucleotide
  Target: ATXN1; (+) strand; PAM type: NRG; PAM sequence: TGG
acactgcaagctccgcctca

SEQ ID NO: 144508 - DNA, 20 bp, Artificial Sequence
  Description of Artificial Sequence: Synthetic oligonucleotide
  Target: ATXN1; (+) strand; PAM type: NRG; PAM sequence: GGG
cactgcaagctccgcctcat

SEQ ID NO: 144509 - DNA, 20 bp, Artificial Sequence
  Description of Artificial Sequence: Synthetic oligonucleotide
  Target: ATXN1; (+) strand; PAM type: NRG; PAM sequence: AAG
aagctccgcctcatgggttc

SEQ ID NO: 144510 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgattctcctgcct

SEQ ID NO: 144511 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcctcagcctccc

SEQ ID NO: 144512 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccaag

SEQ ID NO: 144513 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtagc

SEQ ID NO: 144514 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagct

SEQ ID NO: 144515 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggatta

SEQ ID NO: 144516 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggattac

SEQ ID NO: 144517 - DNA, 20 bp, Artificial Sequence
  Description of Artificial Sequence: Synthetic oligonucleotide
  Target: ATXN1; (+) strand; PAM type: NRG; PAM sequence: CAG
caggcgcccaccaccacgcc

SEQ ID NO: 144518 - DNA, 20 bp, Artificial Sequence
  Description of Artificial Sequence: Synthetic oligonucleotide
  Target: ATXN1; (+) strand; PAM type: NRG; PAM sequence: TAG
tttttttttttttgtatttt

SEQ ID NO: 144519 - DNA, 20 bp, Artificial Sequence
  Description of Artificial Sequence: Synthetic oligonucleotide
  Target: ATXN1; (+) strand; PAM type: NRG; PAM sequence: TAG
ttttttttttgtatttttag

SEQ ID NO: 144520 - DNA, 20 bp, Artificial Sequence
  Description of Artificial Sequence: Synthetic oligonucleotide
  Target: ATXN1; (+) strand; PAM type: NRG; PAM sequence: GAG
ttttttttgtatttttagta

SEQ ID NO: 144521 - DNA, 20 bp, Artificial Sequence
  Description of Artificial Sequence: Synthetic oligonucleotide
  Target: ATXN1; (+) strand; PAM type: NRG; PAM sequence: CGG
ttttgtatttttagtagaga

SEQ ID NO: 144522 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagac

SEQ ID NO: 144523 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagacg

SEQ ID NO: 144524 - DNA, 20 bp, Artificial Sequence
  Description of Artificial Sequence: Synthetic oligonucleotide
  Target: ATXN1; (+) strand; PAM type: NRG; PAM sequence: TAG
gagacggggtttcactgtat

SEQ ID NO: 144525 - DNA, 20 bp, Artificial Sequence
  Description of Artificial Sequence: Synthetic oligonucleotide
  Target: ATXN1; (+) strand; PAM type: NRG; PAM sequence: TAG
cggggtttcactgtattagc

SEQ ID NO: 144526 - DNA, 20 bp, Artificial Sequence
  Description of Artificial Sequence: Synthetic oligonucleotide
  Target: ATXN1; (+) strand; PAM type: NRG; PAM sequence: AGG
ggggtttcactgtattagct

SEQ ID NO: 144527 - DNA, 20 bp, Artificial Sequence
  Description of Artificial Sequence: Synthetic oligonucleotide
  Target: ATXN1; (+) strand; PAM type: NRG; PAM sequence: TGG
tttcactgtattagctaggc

SEQ ID NO: 144528 - DNA, 20 bp, Artificial Sequence
  Description of Artificial Sequence: Synthetic oligonucleotide
  Target: ATXN1; (+) strand; PAM type: NRG; PAM sequence: TGG
acctcatgatctgcccacct

SEQ ID NO: 144529 - DNA, 20 bp, Artificial Sequence
  Description of Artificial Sequence: Synthetic oligonucleotide
  Target: ATXN1; (+) strand; PAM type: NRG; PAM sequence: TGG
accttggcctccgaaaatgc

SEQ ID NO: 144530 - DNA, 20 bp, Artificial Sequence
  Description of Artificial Sequence: Synthetic oligonucleotide
  Target: ATXN1; (+) strand; PAM type: NRG; PAM sequence: GGG
ccttggcctccgaaaatgct

SEQ ID NO: 144531 - DNA, 20 bp, Artificial Sequence
  Description of Artificial Sequence: Synthetic oligonucleotide
  Target: ATXN1; (+) strand; PAM type: NRG; PAM sequence: TAG
ctccgaaaatgctgggatta

SEQ ID NO: 144532 - DNA, 20 bp, Artificial Sequence
  Description of Artificial Sequence: Synthetic oligonucleotide
  Target: ATXN1; (+) strand; PAM type: NRG; PAM sequence: AGG
tccgaaaatgctgggattat

SEQ ID NO: 144533 - DNA, 20 bp, Artificial Sequence
  Description of Artificial Sequence: Synthetic oligonucleotide
  Target: ATXN1; (+) strand; PAM type: NRG; PAM sequence: GAG
aatgctgggattataggctt

SEQ ID NO: 144534 - DNA, 20 bp, Artificial Sequence
  Description of Artificial Sequence: Synthetic oligonucleotide
  Target: ATXN1; (+) strand; PAM type: NRG; PAM sequence: CAG
gagccaccacgccctgccta

SEQ ID NO: 144535 - DNA, 20 bp, Artificial Sequence
  Description of Artificial Sequence: Synthetic oligonucleotide
  Target: ATXN1; (+) strand; PAM type: NRG; PAM sequence: GAG
gccaccacgccctgcctaca

SEQ ID NO: 144536 - DNA, 20 bp, Artificial Sequence
  Description of Artificial Sequence: Synthetic oligonucleotide
  Target: ATXN1; (+) strand; PAM type: NRG; PAM sequence: AAG
tgcctacagagaacttccta

SEQ ID NO: 144537 - DNA, 20 bp, Artificial Sequence
  Description of Artificial Sequence: Synthetic oligonucleotide
  Target: ATXN1; (+) strand; PAM type: NRG; PAM sequence: TAG
ttcactgcaactttattacc

SEQ ID NO: 144538 - DNA, 20 bp, Artificial Sequence
  Description of Artificial Sequence: Synthetic oligonucleotide
  Target: ATXN1; (+) strand; PAM type: NRG; PAM sequence: CAG
ttaataaaaatcctttcaat

SEQ ID NO: 144539 - DNA, 20 bp, Artificial Sequence
  Description of Artificial Sequence: Synthetic oligonucleotide
  Target: ATXN1; (+) strand; PAM type: NRG; PAM sequence: AAG
ataaaaatcctttcaatcag

SEQ ID NO: 144540 - DNA, 20 bp, Artificial Sequence
  Description of Artificial Sequence: Synthetic oligonucleotide
  Target: ATXN1; (+) strand; PAM type: NRG; PAM sequence: AGG
taaaaatcctttcaatcaga

SEQ ID NO: 144541 - DNA, 20 bp, Artificial Sequence
  Description of Artificial Sequence: Synthetic oligonucleotide
  Target: ATXN1; (+) strand; PAM type: NRG; PAM sequence: TAG
atcctttcaatcagaaggtt

SEQ ID NO: 144542 - DNA, 20 bp, Artificial Sequence
  Description of Artificial Sequence: Synthetic oligonucleotide
  Target: ATXN1; (+) strand; PAM type: NRG; PAM sequence: CAG
ttcaatcagaaggtttagca

SEQ ID NO: 144543 - DNA, 20 bp, Artificial Sequence
  Description of Artificial Sequence: Synthetic oligonucleotide
  Target: ATXN1; (+) strand; PAM type: NRG; PAM sequence: TAG
tcagaaggtttagcacagtg

SEQ ID NO: 144544 - DNA, 20 bp, Artificial Sequence
  Description of Artificial Sequence: Synthetic oligonucleotide
  Target: ATXN1; (+) strand; PAM type: NRG; PAM sequence: AAG
gtttagcacagtgtagacca

SEQ ID NO: 144545 - DNA, 20 bp, Artificial Sequence
  Description of Artificial Sequence: Synthetic oligonucleotide
  Target: ATXN1; (+) strand; PAM type: NRG; PAM sequence: GAG
ttagcacagtgtagaccaaa

SEQ ID NO: 144546 - DNA, 20 bp, Artificial Sequence
  Description of Artificial Sequence: Synthetic oligonucleotide
  Target: ATXN1; (+) strand; PAM type: NRG; PAM sequence: AAG
ccaaagagatcattcactga

SEQ ID NO: 144547 - DNA, 20 bp, Artificial Sequence
  Description of Artificial Sequence: Synthetic oligonucleotide
  Target: ATXN1; (+) strand; PAM type: NRG; PAM sequence: AGG
caaagagatcattcactgaa

SEQ ID NO: 144548 - DNA, 20 bp, Artificial Sequence
  Description of Artificial Sequence: Synthetic oligonucleotide
  Target: ATXN1; (+) strand; PAM type: NRG; PAM sequence: TGG
gagatcattcactgaaaggc

SEQ ID NO: 144549 - DNA, 20 bp, Artificial Sequence
  Description of Artificial Sequence: Synthetic oligonucleotide
  Target: ATXN1; (+) strand; PAM type: NRG; PAM sequence: TGG
cactgaaaggctggctctga

SEQ ID NO: 144550 - DNA, 20 bp, Artificial Sequence
  Description of Artificial Sequence: Synthetic oligonucleotide
  Target: ATXN1; (+) strand; PAM type: NRG; PAM sequence: CAG
ggctggctctgatggcaaaa

SEQ ID NO: 144551 - DNA, 20 bp, Artificial Sequence
  Description of Artificial Sequence: Synthetic oligonucleotide
  Target: ATXN1; (+) strand; PAM type: NRG; PAM sequence: TGG
ggctctgatggcaaaacaga

SEQ ID NO: 144552 - DNA, 20 bp, Artificial Sequence
  Description of Artificial Sequence: Synthetic oligonucleotide
  Target: ATXN1; (+) strand; PAM type: NRG; PAM sequence: TGG
tgatggcaaaacagatggtt

SEQ ID NO: 144553 - DNA, 20 bp, Artificial Sequence
  Description of Artificial Sequence: Synthetic oligonucleotide
  Target: ATXN1; (+) strand; PAM type: NRG; PAM sequence: GAG
caaaacagatggtttggaat

SEQ ID NO: 144554 - DNA, 20 bp, Artificial Sequence
  Description of Artificial Sequence: Synthetic oligonucleotide
  Target: ATXN1; (+) strand; PAM type: NRG; PAM sequence: TGG
gatggtttggaatgagatcc

SEQ ID NO: 144555 - DNA, 20 bp, Artificial Sequence
  Description of Artificial Sequence: Synthetic oligonucleotide
  Target: ATXN1; (+) strand; PAM type: NRG; PAM sequence: GGG
atggtttggaatgagatcct

SEQ ID NO: 144556 - DNA, 20 bp, Artificial Sequence
  Description of Artificial Sequence: Synthetic oligonucleotide
  Target: ATXN1; (+) strand; PAM type: NRG; PAM sequence: TGG
tggaatgagatcctgggaaa

SEQ ID NO: 144557 - DNA, 20 bp, Artificial Sequence
  Description of Artificial Sequence: Synthetic oligonucleotide
  Target: ATXN1; (+) strand; PAM type: NRG; PAM sequence: TGG
ctgggaaatggccactgtac

SEQ ID NO: 144558 - DNA, 20 bp, Artificial Sequence
  Description of Artificial Sequence: Synthetic oligonucleotide
  Target: ATXN1; (+) strand; PAM type: NRG; PAM sequence: GAG
gggaaatggccactgtactg

SEQ ID NO: 144559 - DNA, 20 bp, Artificial Sequence
  Description of Artificial Sequence: Synthetic oligonucleotide
  Target: ATXN1; (+) strand; PAM type: NRG; PAM sequence: AAG
aatggccactgtactggagt

SEQ ID NO: 144560 - DNA, 20 bp, Artificial Sequence
  Description of Artificial Sequence: Synthetic oligonucleotide
  Target: ATXN1; (+) strand; PAM type: NRG; PAM sequence: TAG
gagtaagaaatcaatgctcc

SEQ ID NO: 144561 - DNA, 20 bp, Artificial Sequence
  Description of Artificial Sequence: Synthetic oligonucleotide
  Target: ATXN1; (+) strand; PAM type: NRG; PAM sequence: GAG
gtaagaaatcaatgctccta

SEQ ID NO: 144562 - DNA, 20 bp, Artificial Sequence
  Description of Artificial Sequence: Synthetic oligonucleotide
  Target: ATXN1; (+) strand; PAM type: NRG; PAM sequence: CAG
aatcaatgctcctagagaaa

SEQ ID NO: 144563 - DNA, 20 bp, Artificial Sequence
  Description of Artificial Sequence: Synthetic oligonucleotide
  Target: ATXN1; (+) strand; PAM type: NRG; PAM sequence: CAG
agagaaacagatcatttcct

SEQ ID NO: 144564 - DNA, 20 bp, Artificial Sequence
  Description of Artificial Sequence: Synthetic oligonucleotide
  Target: ATXN1; (+) strand; PAM type: NRG; PAM sequence: AAG
aaacagatcatttcctcagc

SEQ ID NO: 144565 - DNA, 20 bp, Artificial Sequence
  Description of Artificial Sequence: Synthetic oligonucleotide
  Target: ATXN1; (+) strand; PAM type: NRG; PAM sequence: AAG
ttcctcagcaagtttttgcc

SEQ ID NO: 144566 - DNA, 20 bp, Artificial Sequence
  Description of Artificial Sequence: Synthetic oligonucleotide
  Target: ATXN1; (+) strand; PAM type: NRG; PAM sequence: AAG
gacttaaacaaacatgtgaa

SEQ ID NO: 144567 - DNA, 20 bp, Artificial Sequence
  Description of Artificial Sequence: Synthetic oligonucleotide
  Target: ATXN1; (+) strand; PAM type: NRG; PAM sequence: TAG
tgaaaagatcctgttttgtg

SEQ ID NO: 144568 - DNA, 20 bp, Artificial Sequence
  Description of Artificial Sequence: Synthetic oligonucleotide
  Target: ATXN1; (+) strand; PAM type: NRG; PAM sequence: CAG
gtgtagttctgaattctgct

SEQ ID NO: 144569 - DNA, 20 bp, Artificial Sequence
  Description of Artificial Sequence: Synthetic oligonucleotide
  Target: ATXN1; (+) strand; PAM type: NRG; PAM sequence: AAG
ctttcaatttcaaaataaca

SEQ ID NO: 144570 - DNA, 20 bp, Artificial Sequence
  Description of Artificial Sequence: Synthetic oligonucleotide
  Target: ATXN1; (+) strand; PAM type: NRG; PAM sequence: CAG
tcaatttcaaaataacaaag

SEQ ID NO: 144571 - DNA, 20 bp, Artificial Sequence
  Description of Artificial Sequence: Synthetic oligonucleotide
  Target: ATXN1; (+) strand; PAM type: NRG; PAM sequence: TGG
aaaataacaaagcagtaaac

SEQ ID NO: 144572 - DNA, 20 bp, Artificial Sequence
  Description of Artificial Sequence: Synthetic oligonucleotide
  Target: ATXN1; (+) strand; PAM type: NRG; PAM sequence: TAG
aaagcagtaaactggaaaca

SEQ ID NO: 144573 - DNA, 20 bp, Artificial Sequence
  Description of Artificial Sequence: Synthetic oligonucleotide
  Target: ATXN1; (+) strand; PAM type: NRG; PAM sequence: CAG
attctttctgaaatcttaaa

SEQ ID NO: 144574 - DNA, 20 bp, Artificial Sequence
  Description of Artificial Sequence: Synthetic oligonucleotide
  Target: ATXN1; (+) strand; PAM type: NRG; PAM sequence: CAG
ctgaaatcttaaacagactg

SEQ ID NO: 144575 - DNA, 20 bp, Artificial Sequence
  Description of Artificial Sequence: Synthetic oligonucleotide
  Target: ATXN1; (+) strand; PAM type: NRG; PAM sequence: AAG
ttaaacagactgcagcttcc

SEQ ID NO: 144576 - DNA, 20 bp, Artificial Sequence
  Description of Artificial Sequence: Synthetic oligonucleotide
  Target: ATXN1; (+) strand; PAM type: NRG; PAM sequence: AGG
taaacagactgcagcttcca

SEQ ID NO: 144577 - DNA, 20 bp, Artificial Sequence
  Description of Artificial Sequence: Synthetic oligonucleotide
  Target: ATXN1; (+) strand; PAM type: NRG; PAM sequence: TGG
cagactgcagcttccaaggt

SEQ ID NO: 144578 - DNA, 20 bp, Artificial Sequence
  Description of Artificial Sequence: Synthetic oligonucleotide
  Target: ATXN1; (+) strand; PAM type: NRG; PAM sequence: CAG
ccaaggttggatgtgaaatt

SEQ ID NO: 144579 - DNA, 20 bp, Artificial Sequence
  Description of Artificial Sequence: Synthetic oligonucleotide
  Target: ATXN1; (+) strand; PAM type: NRG; PAM sequence: GAG
aaggttggatgtgaaattca

SEQ ID NO: 144580 - DNA, 20 bp, Artificial Sequence
  Description of Artificial Sequence: Synthetic oligonucleotide
  Target: ATXN1; (+) strand; PAM type: NRG; PAM sequence: AGG
aggttggatgtgaaattcag

SEQ ID NO: 144581 - DNA, 20 bp, Artificial Sequence
  Description of Artificial Sequence: Synthetic oligonucleotide
  Target: ATXN1; (+) strand; PAM type: NRG; PAM sequence: TGG
tcagaggcacacaactcttt

SEQ ID NO: 144582 - DNA, 20 bp, Artificial Sequence
  Description of Artificial Sequence: Synthetic oligonucleotide
  Target: ATXN1; (+) strand; PAM type: NRG; PAM sequence: TAG
gaggcacacaactcttttgg

SEQ ID NO: 144583 - DNA, 20 bp, Artificial Sequence
  Description of Artificial Sequence: Synthetic oligonucleotide
  Target: ATXN1; (+) strand; PAM type: NRG; PAM sequence: AAG
cacacaactcttttggtaga

SEQ ID NO: 144584 - DNA, 20 bp, Artificial Sequence
  Description of Artificial Sequence: Synthetic oligonucleotide
  Target: ATXN1; (+) strand; PAM type: NRG; PAM sequence: CAG
actcttttggtagaaagctg

SEQ ID NO: 144585 - DNA, 20 bp, Artificial Sequence
  Description of Artificial Sequence: Synthetic oligonucleotide
  Target: ATXN1; (+) strand; PAM type: NRG; PAM sequence: CAG
tttggtagaaagctgcagcc

SEQ ID NO: 144586 - DNA, 20 bp, Artificial Sequence
  Description of Artificial Sequence: Synthetic oligonucleotide
  Target: ATXN1; (+) strand; PAM type: NRG; PAM sequence: CAG
ggtagaaagctgcagcccag

SEQ ID NO: 144587 - DNA, 20 bp, Artificial Sequence
  Description of Artificial Sequence: Synthetic oligonucleotide
  Target: ATXN1; (+) strand; PAM type: NRG; PAM sequence: GAG
tagaaagctgcagcccagca

SEQ ID NO: 144588 - DNA, 20 bp, Artificial Sequence
  Description of Artificial Sequence: Synthetic oligonucleotide
  Target: ATXN1; (+) strand; PAM type: NRG; PAM sequence: AAG
cagcccagcagagctctctg

SEQ ID NO: 144589 - DNA, 20 bp, Artificial Sequence
  Description of Artificial Sequence: Synthetic oligonucleotide
  Target: ATXN1; (+) strand; PAM type: NRG; PAM sequence: TAG
cagcagagctctctgaagtc

SEQ ID NO: 144590 - DNA, 20 bp, Artificial Sequence
  Description of Artificial Sequence: Synthetic oligonucleotide
  Target: ATXN1; (+) strand; PAM type: NRG; PAM sequence: AGG
agcagagctctctgaagtct

SEQ ID NO: 144591 - DNA, 20 bp, Artificial Sequence
  Description of Artificial Sequence: Synthetic oligonucleotide
  Target: ATXN1; (+) strand; PAM type: NRG; PAM sequence: GGG
gcagagctctctgaagtcta

SEQ ID NO: 144592 - DNA, 20 bp, Artificial Sequence
  Description of Artificial Sequence: Synthetic oligonucleotide
  Target: ATXN1; (+) strand; PAM type: NRG; PAM sequence: GGG
cagagctctctgaagtctag

SEQ ID NO: 144593 - DNA, 20 bp, Artificial Sequence
  Description of Artificial Sequence: Synthetic oligonucleotide
  Target: ATXN1; (+) strand; PAM type: NRG; PAM sequence: GGG
agagctctctgaagtctagg

SEQ ID NO: 144594 - DNA, 20 bp, Artificial Sequence
  Description of Artificial Sequence: Synthetic oligonucleotide
  Target: ATXN1; (+) strand; PAM type: NRG; PAM sequence: GAG
agctctctgaagtctagggg

SEQ ID NO: 144595 - DNA, 20 bp, Artificial Sequence
  Description of Artificial Sequence: Synthetic oligonucleotide
  Target: ATXN1; (+) strand; PAM type: NRG; PAM sequence: AGG
gctctctgaagtctaggggg

SEQ ID NO: 144596 - DNA, 20 bp, Artificial Sequence
  Description of Artificial Sequence: Synthetic oligonucleotide
  Target: ATXN1; (+) strand; PAM type: NRG; PAM sequence: TGG
ctctgaagtctagggggagg

SEQ ID NO: 144597 - DNA, 20 bp, Artificial Sequence
  Description of Artificial Sequence: Synthetic oligonucleotide
  Target: ATXN1; (+) strand; PAM type: NRG; PAM sequence: GGG
tctgaagtctagggggaggt

SEQ ID NO: 144598 - DNA, 20 bp, Artificial Sequence
  Description of Artificial Sequence: Synthetic oligonucleotide
  Target: ATXN1; (+) strand; PAM type: NRG; PAM sequence: TAG
ggaggtgggtgtctgtgttg

SEQ ID NO: 144599 - DNA, 20 bp, Artificial Sequence
  Description of Artificial Sequence: Synthetic oligonucleotide
  Target: ATXN1; (+) strand; PAM type: NRG; PAM sequence: TGG
tgggtgtctgtgttgtagat

SEQ ID NO: 144600 - DNA, 20 bp, Artificial Sequence
  Description of Artificial Sequence: Synthetic oligonucleotide
  Target: ATXN1; (+) strand; PAM type: NRG; PAM sequence: TAG
gttgtagattggtgacttta

SEQ ID NO: 144601 - DNA, 20 bp, Artificial Sequence
  Description of Artificial Sequence: Synthetic oligonucleotide
  Target: ATXN1; (+) strand; PAM type: NRG; PAM sequence: CAG
gactttatagaatgtgcttc

SEQ ID NO: 144602 - DNA, 20 bp, Artificial Sequence
  Description of Artificial Sequence: Synthetic oligonucleotide
  Target: ATXN1; (+) strand; PAM type: NRG; PAM sequence: AGG
actttatagaatgtgcttcc

SEQ ID NO: 144603 - DNA, 20 bp, Artificial Sequence
  Description of Artificial Sequence: Synthetic oligonucleotide
  Target: ATXN1; (+) strand; PAM type: NRG; PAM sequence: GAG
gaatgtgcttccaggaatgt

SEQ ID NO: 144604 - DNA, 20 bp, Artificial Sequence
  Description of Artificial Sequence: Synthetic oligonucleotide
  Target: ATXN1; (+) strand; PAM type: NRG; PAM sequence: TGG
aatgtgagcatacacacccc

SEQ ID NO: 144605 - DNA, 20 bp, Artificial Sequence
  Description of Artificial Sequence: Synthetic oligonucleotide
  Target: ATXN1; (+) strand; PAM type: NRG; PAM sequence: AAG
tacacacccctggcaactga

SEQ ID NO: 144606 - DNA, 20 bp, Artificial Sequence
  Description of Artificial Sequence: Synthetic oligonucleotide
  Target: ATXN1; (+) strand; PAM type: NRG; PAM sequence: TGG
tggcaactgaaagtaaccaa

SEQ ID NO: 144607 - DNA, 20 bp, Artificial Sequence
  Description of Artificial Sequence: Synthetic oligonucleotide
  Target: ATXN1; (+) strand; PAM type: NRG; PAM sequence: CAG
agtaaccaatggctttttaa

SEQ ID NO: 144608 - DNA, 20 bp, Artificial Sequence
  Description of Artificial Sequence: Synthetic oligonucleotide
  Target: ATXN1; (+) strand; PAM type: NRG; PAM sequence: TGG
atccactttatttcaacgtt

SEQ ID NO: 144609 - DNA, 20 bp, Artificial Sequence
  Description of Artificial Sequence: Synthetic oligonucleotide
  Target: ATXN1; (+) strand; PAM type: NRG; PAM sequence: GAG
ccactttatttcaacgtttg

SEQ ID NO: 144610 - DNA, 20 bp, Artificial Sequence
  Description of Artificial Sequence: Synthetic oligonucleotide
  Target: ATXN1; (+) strand; PAM type: NRG; PAM sequence: GAG
gcaatcaaatactgccgtat

SEQ ID NO: 144611 - DNA, 20 bp, Artificial Sequence
  Description of Artificial Sequence: Synthetic oligonucleotide
  Target: ATXN1; (+) strand; PAM type: NRG; PAM sequence: AAG
ctgccgtatgagtccgtgct

SEQ ID NO: 144612 - DNA, 20 bp, Artificial Sequence
  Description of Artificial Sequence: Synthetic oligonucleotide
  Target: ATXN1; (+) strand; PAM type: NRG; PAM sequence: AAG
catttcacattttctgtcaa

SEQ ID NO: 144613 - DNA, 20 bp, Artificial Sequence
  Description of Artificial Sequence: Synthetic oligonucleotide
  Target: ATXN1; (+) strand; PAM type: NRG; PAM sequence: TAG
gcctttcttcaattgcacca

SEQ ID NO: 144614 - DNA, 20 bp, Artificial Sequence
  Description of Artificial Sequence: Synthetic oligonucleotide
  Target: ATXN1; (+) strand; PAM type: NRG; PAM sequence: GAG
tctgaaaatatcacatgact

SEQ ID NO: 144615 - DNA, 20 bp, Artificial Sequence
  Description of Artificial Sequence: Synthetic oligonucleotide
  Target: ATXN1; (+) strand; PAM type: NRG; PAM sequence: AGG
ctgaaaatatcacatgactg

SEQ ID NO: 144616 - DNA, 20 bp, Artificial Sequence
  Description of Artificial Sequence: Synthetic oligonucleotide
  Target: ATXN1; (+) strand; PAM type: NRG; PAM sequence: AAG
tatcacatgactgaggatct

SEQ ID NO: 144617 - DNA, 20 bp, Artificial Sequence
  Description of Artificial Sequence: Synthetic oligonucleotide
  Target: ATXN1; (+) strand; PAM type: NRG; PAM sequence: GAG
tcacatgactgaggatctaa

SEQ ID NO: 144618 - DNA, 20 bp, Artificial Sequence
  Description of Artificial Sequence: Synthetic oligonucleotide
  Target: ATXN1; (+) strand; PAM type: NRG; PAM sequence: AAG
tgactgaggatctaagagcc

SEQ ID NO: 144619 - DNA, 20 bp, Artificial Sequence
  Description of Artificial Sequence: Synthetic oligonucleotide
  Target: ATXN1; (+) strand; PAM type: NRG; PAM sequence: AGG
gactgaggatctaagagcca

SEQ ID NO: 144620 - DNA, 20 bp, Artificial Sequence
  Description of Artificial Sequence: Synthetic oligonucleotide
  Target: ATXN1; (+) strand; PAM type: NRG; PAM sequence: TAG
gaatcacacaacatactcat

SEQ ID NO: 144621 - DNA, 20 bp, Artificial Sequence
  Description of Artificial Sequence: Synthetic oligonucleotide
  Target: ATXN1; (+) strand; PAM type: NRG; PAM sequence: AGG
aatcacacaacatactcatt

SEQ ID NO: 144622 - DNA, 20 bp, Artificial Sequence
  Description of Artificial Sequence: Synthetic oligonucleotide
  Target: ATXN1; (+) strand; PAM type: NRG; PAM sequence: GGG
atcacacaacatactcatta

SEQ ID NO: 144623 - DNA, 20 bp, Artificial Sequence
  Description of Artificial Sequence: Synthetic oligonucleotide
  Target: ATXN1; (+) strand; PAM type: NRG; PAM sequence: CAG
tcttctccctttcccccttt

SEQ ID NO: 144624 - DNA, 20 bp, Artificial Sequence
  Description of Artificial Sequence: Synthetic oligonucleotide
  Target: ATXN1; (+) strand; PAM type: NRG; PAM sequence: AAG
gatattttaaaattaaaacg

SEQ ID NO: 144625 - DNA, 20 bp, Artificial Sequence
  Description of Artificial Sequence: Synthetic oligonucleotide
  Target: ATXN1; (+) strand; PAM type: NRG; PAM sequence: AGG
atattttaaaattaaaacga

SEQ ID NO: 144626 - DNA, 20 bp, Artificial Sequence
  Description of Artificial Sequence: Synthetic oligonucleotide
  Target: ATXN1; (+) strand; PAM type: NRG; PAM sequence: GGG
tattttaaaattaaaacgaa

SEQ ID NO: 144627 - DNA, 20 bp, Artificial Sequence
  Description of Artificial Sequence: Synthetic oligonucleotide
  Target: ATXN1; (+) strand; PAM type: NRG; PAM sequence: TGG
tttaaaattaaaacgaaggg

SEQ ID NO: 144628 - DNA, 20 bp, Artificial Sequence
  Description of Artificial Sequence: Synthetic oligonucleotide
  Target: ATXN1; (+) strand; PAM type: NRG; PAM sequence: GAG
taaaattaaaacgaagggtg

SEQ ID NO: 144629 - DNA, 20 bp, Artificial Sequence
  Description of Artificial Sequence: Synthetic oligonucleotide
  Target: ATXN1; (+) strand; PAM type: NRG; PAM sequence: AGG
aaaattaaaacgaagggtgg

SEQ ID NO: 144630 - DNA, 20 bp, Artificial Sequence
  Description of Artificial Sequence: Synthetic oligonucleotide
  Target: ATXN1; (+) strand; PAM type: NRG; PAM sequence: GGG
aaattaaaacgaagggtgga

SEQ ID NO: 144631 - DNA, 20 bp, Artificial Sequence
  Description of Artificial Sequence: Synthetic oligonucleotide
  Target: ATXN1; (+) strand; PAM type: NRG; PAM sequence: TGG
gaatttatatgtaatgatat

SEQ ID NO: 144632 - DNA, 20 bp, Artificial Sequence
  Description of Artificial Sequence: Synthetic oligonucleotide
  Target: ATXN1; (+) strand; PAM type: NRG; PAM sequence: TGG
atgtaatgatattggcctga

SEQ ID NO: 144633 - DNA, 20 bp, Artificial Sequence
  Description of Artificial Sequence: Synthetic oligonucleotide
  Target: ATXN1; (+) strand; PAM type: NRG; PAM sequence: CAG
taatgatattggcctgatgg

SEQ ID NO: 144634 - DNA, 20 bp, Artificial Sequence
  Description of Artificial Sequence: Synthetic oligonucleotide
  Target: ATXN1; (+) strand; PAM type: NRG; PAM sequence: TGG
gcctgatggcagtcaactta

SEQ ID NO: 144635 - DNA, 20 bp, Artificial Sequence
  Description of Artificial Sequence: Synthetic oligonucleotide
  Target: ATXN1; (+) strand; PAM type: NRG; PAM sequence: AAG
gtcaacttatggcacacatg

SEQ ID NO: 144636 - DNA, 20 bp, Artificial Sequence
  Description of Artificial Sequence: Synthetic oligonucleotide
  Target: ATXN1; (+) strand; PAM type: NRG; PAM sequence: AGG
tcaacttatggcacacatga

SEQ ID NO: 144637 - DNA, 20 bp, Artificial Sequence
  Description of Artificial Sequence: Synthetic oligonucleotide
  Target: ATXN1; (+) strand; PAM type: NRG; PAM sequence: AAG
tatggcacacatgaaggcga

SEQ ID NO: 144638 - DNA, 20 bp, Artificial Sequence
  Description of Artificial Sequence: Synthetic oligonucleotide
  Target: ATXN1; (+) strand; PAM type: NRG; PAM sequence: AGG
atggcacacatgaaggcgaa

SEQ ID NO: 144639 - DNA, 20 bp, Artificial Sequence
  Description of Artificial Sequence: Synthetic oligonucleotide
  Target: ATXN1; (+) strand; PAM type: NRG; PAM sequence: GAG
ggcacacatgaaggcgaaag

SEQ ID NO: 144640 - DNA, 20 bp, Artificial Sequence
  Description of Artificial Sequence: Synthetic oligonucleotide
  Target: ATXN1; (+) strand; PAM type: NRG; PAM sequence: CAG
acacatgaaggcgaaaggag

SEQ ID NO: 144641 - DNA, 20 bp, Artificial Sequence
  Description of Artificial Sequence: Synthetic oligonucleotide
  Target: ATXN1; (+) strand; PAM type: NRG; PAM sequence: AGG
cacatgaaggcgaaaggagc

SEQ ID NO: 144642 - DNA, 20 bp, Artificial Sequence
  Description of Artificial Sequence: Synthetic oligonucleotide
  Target: ATXN1; (+) strand; PAM type: NRG; PAM sequence: GGG
acatgaaggcgaaaggagca

SEQ ID NO: 144643 - DNA, 20 bp, Artificial Sequence
  Description of Artificial Sequence: Synthetic oligonucleotide
  Target: ATXN1; (+) strand; PAM type: NRG; PAM sequence: AAG
gaaggcgaaaggagcaggga

SEQ ID NO: 144644 - DNA, 20 bp, Artificial Sequence
  Description of Artificial Sequence: Synthetic oligonucleotide
  Target: ATXN1; (+) strand; PAM type: NRG; PAM sequence: CAG
aggagcagggaaagtttttt

SEQ ID NO: 144645 - DNA, 20 bp, Artificial Sequence
  Description of Artificial Sequence: Synthetic oligonucleotide
  Target: ATXN1; (+) strand; PAM type: NRG; PAM sequence: AGG
ggagcagggaaagttttttc

SEQ ID NO: 144646 - DNA, 20 bp, Artificial Sequence
  Description of Artificial Sequence: Synthetic oligonucleotide
  Target: ATXN1; (+) strand; PAM type: NRG; PAM sequence: GGG
gagcagggaaagttttttca

SEQ ID NO: 144647 - DNA, 20 bp, Artificial Sequence
  Description of Artificial Sequence: Synthetic oligonucleotide
  Target: ATXN1; (+) strand; PAM type: NRG; PAM sequence: GAG
gcagggaaagttttttcagg

SEQ ID NO: 144648 - DNA, 20 bp, Artificial Sequence
  Description of Artificial Sequence: Synthetic oligonucleotide
  Target: ATXN1; (+) strand; PAM type: NRG; PAM sequence: GAG
agggaaagttttttcaggga

SEQ ID NO: 144649 - DNA, 20 bp, Artificial Sequence
  Description of Artificial Sequence: Synthetic oligonucleotide
  Target: ATXN1; (+) strand; PAM type: NRG; PAM sequence: AGG
gggaaagttttttcagggag

SEQ ID NO: 144650 - DNA, 20 bp, Artificial Sequence
  Description of Artificial Sequence: Synthetic oligonucleotide
  Target: ATXN1; (+) strand; PAM type: NRG; PAM sequence: TGG
aaagttttttcagggagagg

SEQ ID NO: 144651 - DNA, 20 bp, Artificial Sequence
  Description of Artificial Sequence: Synthetic oligonucleotide
  Target: ATXN1; (+) strand; PAM type: NRG; PAM sequence: GAG
agttttttcagggagaggtg

SEQ ID NO: 144652 - DNA, 20 bp, Artificial Sequence
  Description of Artificial Sequence: Synthetic oligonucleotide
  Target: ATXN1; (+) strand; PAM type: NRG; PAM sequence: TGG
ttttcagggagaggtggaga

SEQ ID NO: 144653 - DNA, 20 bp, Artificial Sequence
  Description of Artificial Sequence: Synthetic oligonucleotide
  Target: ATXN1; (+) strand; PAM type: NRG; PAM sequence: GAG
ttcagggagaggtggagatg

SEQ ID NO: 144654 - DNA, 20 bp, Artificial Sequence
  Description of Artificial Sequence: Synthetic oligonucleotide
  Target: ATXN1; (+) strand; PAM type: NRG; PAM sequence: TGG
agcctacatatatttaaaat

SEQ ID NO: 144655 - DNA, 20 bp, Artificial Sequence
  Description of Artificial Sequence: Synthetic oligonucleotide
  Target: ATXN1; (+) strand; PAM type: NRG; PAM sequence: GAG
cctacatatatttaaaattg

SEQ ID NO: 144656 - DNA, 20 bp, Artificial Sequence
  Description of Artificial Sequence: Synthetic oligonucleotide
  Target: ATXN1; (+) strand; PAM type: NRG; PAM sequence: AGG
ctacatatatttaaaattgg

SEQ ID NO: 144657 - DNA, 20 bp, Artificial Sequence
  Description of Artificial Sequence: Synthetic oligonucleotide
  Target: ATXN1; (+) strand; PAM type: NRG; PAM sequence: CAG
atatatttaaaattggaggc

SEQ ID NO: 144658 - DNA, 20 bp, Artificial Sequence
  Description of Artificial Sequence: Synthetic oligonucleotide
  Target: ATXN1; (+) strand; PAM type: NRG; PAM sequence: AGG
tatatttaaaattggaggcc

SEQ ID NO: 144659 - DNA, 20 bp, Artificial Sequence
  Description of Artificial Sequence: Synthetic oligonucleotide
  Target: ATXN1; (+) strand; PAM type: NRG; PAM sequence: CGG
ttaaaattggaggccaggtg

SEQ ID NO: 144660 - DNA, 20 bp, Artificial Sequence
  Description of Artificial Sequence: Synthetic oligonucleotide
  Target: ATXN1; (+) strand; PAM type: NRG; PAM sequence: TGG
aaattggaggccaggtgcgg

SEQ ID NO: 144661 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 144662 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 144663 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 144664 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 144665 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 144666 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggct

SEQ ID NO: 144667 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggctg

SEQ ID NO: 144668 - DNA, 20 bp, Artificial Sequence
  Description of Artificial Sequence: Synthetic oligonucleotide
  Target: ATXN1; (+) strand; PAM type: NRG; PAM sequence: TGG
gcactttgggaggctgaggc

SEQ ID NO: 144669 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggctgaggctgg

SEQ ID NO: 144670 - DNA, 20 bp, Artificial Sequence
  Description of Artificial Sequence: Synthetic oligonucleotide
  Target: ATXN1; (+) strand; PAM type: NRG; PAM sequence: GAG
ctgaggctggcggatcattt

SEQ ID NO: 144671 - DNA, 20 bp, Artificial Sequence
  Description of Artificial Sequence: Synthetic oligonucleotide
  Target: ATXN1; (+) strand; PAM type: NRG; PAM sequence: AGG
tgaggctggcggatcatttg

SEQ ID NO: 144672 - DNA, 20 bp, Artificial Sequence
  Description of Artificial Sequence: Synthetic oligonucleotide
  Target: ATXN1; (+) strand; PAM type: NRG; PAM sequence: CAG
gctggcggatcatttgaggt

SEQ ID NO: 144673 - DNA, 20 bp, Artificial Sequence
  Description of Artificial Sequence: Synthetic oligonucleotide
  Target: ATXN1; (+) strand; PAM type: NRG; PAM sequence: AGG
ctggcggatcatttgaggtc

SEQ ID NO: 144674 - DNA, 20 bp, Artificial Sequence
  Description of Artificial Sequence: Synthetic oligonucleotide
  Target: ATXN1; (+) strand; PAM type: NRG; PAM sequence: GAG
ggcggatcatttgaggtcag

SEQ ID NO: 144675 - DNA, 20 bp, Artificial Sequence
  Description of Artificial Sequence: Synthetic oligonucleotide
  Target: ATXN1; (+) strand; PAM type: NRG; PAM sequence: AAG
tcatttgaggtcaggagttc

SEQ ID NO: 144676 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcaagac

SEQ ID NO: 144677 - DNA, 20 bp, Artificial Sequence
  Description of Artificial Sequence: Synthetic oligonucleotide
  Target: ATXN1; (+) strand; PAM type: NRG; PAM sequence: TGG
caagaccagtctgactgaca

SEQ ID NO: 144678 - DNA, 20 bp, Artificial Sequence
  Description of Artificial Sequence: Synthetic oligonucleotide
  Target: ATXN1; (+) strand; PAM type: NRG; PAM sequence: AAG
ccagtctgactgacatggtg

SEQ ID NO: 144679 - DNA, 20 bp, Artificial Sequence
  Description of Artificial Sequence: Synthetic oligonucleotide
  Target: ATXN1; (+) strand; PAM type: NRG; PAM sequence: TAG
aaaaaatatataaaaaaaat

SEQ ID NO: 144680 - DNA, 20 bp, Artificial Sequence
  Description of Artificial Sequence: Synthetic oligonucleotide
  Target: ATXN1; (+) strand; PAM type: NRG; PAM sequence: CAG
aatatataaaaaaaattagc

SEQ ID NO: 144681 - DNA, 20 bp, Artificial Sequence
  Description of Artificial Sequence: Synthetic oligonucleotide
  Target: ATXN1; (+) strand; PAM type: NRG; PAM sequence: AGG
atatataaaaaaaattagcc

SEQ ID NO: 144682 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccaggcattg

SEQ ID NO: 144683 - DNA, 20 bp, Artificial Sequence
  Description of Artificial Sequence: Synthetic oligonucleotide
  Target: ATXN1; (+) strand; PAM type: NRG; PAM sequence: TAG
ggcattgtggtgcatacctg

SEQ ID NO: 144684 - DNA, 20 bp, Artificial Sequence
  Description of Artificial Sequence: Synthetic oligonucleotide
  Target: ATXN1; (+) strand; PAM type: NRG; PAM sequence: CAG
gtggtgcatacctgtagtcc

SEQ ID NO: 144685 - DNA, 20 bp, Artificial Sequence
  Description of Artificial Sequence: Synthetic oligonucleotide
  Target: ATXN1; (+) strand; PAM type: NRG; PAM sequence: CGG
tacctgtagtcccagcgact

SEQ ID NO: 144686 - DNA, 20 bp, Artificial Sequence
  Description of Artificial Sequence: Synthetic oligonucleotide
  Target: ATXN1; (+) strand; PAM type: NRG; PAM sequence: GGG
acctgtagtcccagcgactc

SEQ ID NO: 144687 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagcgactcgg

SEQ ID NO: 144688 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagcgactcggg

SEQ ID NO: 144689 - DNA, 20 bp, Artificial Sequence
  Description of Artificial Sequence: Synthetic oligonucleotide
  Target: ATXN1; (+) strand; PAM type: NRG; PAM sequence: GAG
tcccagcgactcgggaggct

SEQ ID NO: 144690 - DNA, 20 bp, Artificial Sequence
  Description of Artificial Sequence: Synthetic oligonucleotide
  Target: ATXN1; (+) strand; PAM type: NRG; PAM sequence: AGG
cccagcgactcgggaggctg

SEQ ID NO: 144691 - DNA, 20 bp, Artificial Sequence
  Description of Artificial Sequence: Synthetic oligonucleotide
  Target: ATXN1; (+) strand; PAM type: NRG; PAM sequence: CAG
agcgactcgggaggctgagg

SEQ ID NO: 144692 - DNA, 20 bp, Artificial Sequence
  Description of Artificial Sequence: Synthetic oligonucleotide
  Target: ATXN1; (+) strand; PAM type: NRG; PAM sequence: AGG
gcgactcgggaggctgaggc

SEQ ID NO: 144693 - DNA, 20 bp, Artificial Sequence
  Description of Artificial Sequence: Synthetic oligonucleotide
  Target: ATXN1; (+) strand; PAM type: NRG; PAM sequence: GAG
gactcgggaggctgaggcag

SEQ ID NO: 144694 - DNA, 20 bp, Artificial Sequence
  Description of Artificial Sequence: Synthetic oligonucleotide
  Target: ATXN1; (+) strand; PAM type: NRG; PAM sequence: TGG
gcaggagaatcacttgaacc

SEQ ID NO: 144695 - DNA, 20 bp, Artificial Sequence
  Description of Artificial Sequence: Synthetic oligonucleotide
  Target: ATXN1; (+) strand; PAM type: NRG; PAM sequence: GGG
caggagaatcacttgaacct

SEQ ID NO: 144696 - DNA, 20 bp, Artificial Sequence
  Description of Artificial Sequence: Synthetic oligonucleotide
  Target: ATXN1; (+) strand; PAM type: NRG; PAM sequence: GAG
ggagaatcacttgaacctgg

SEQ ID NO: 144697 - DNA, 20 bp, Artificial Sequence
  Description of Artificial Sequence: Synthetic oligonucleotide
  Target: ATXN1; (+) strand; PAM type: NRG; PAM sequence: AGG
gagaatcacttgaacctggg

SEQ ID NO: 144698 - DNA, 20 bp, Artificial Sequence
  Description of Artificial Sequence: Synthetic oligonucleotide
  Target: ATXN1; (+) strand; PAM type: NRG; PAM sequence: TGG
aatcacttgaacctgggagg

SEQ ID NO: 144699 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacctgggaggtg

SEQ ID NO: 144700 - DNA, 20 bp, Artificial Sequence
  Description of Artificial Sequence: Synthetic oligonucleotide
  Target: ATXN1; (+) strand; PAM type: NRG; PAM sequence: AGG
cacttgaacctgggaggtgg

SEQ ID NO: 144701 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggtggaggctg

SEQ ID NO: 144702 - DNA, 20 bp, Artificial Sequence
  Description of Artificial Sequence: Synthetic oligonucleotide
  Target: ATXN1; (+) strand; PAM type: NRG; PAM sequence: GAG
tgggaggtggaggctgcagt

SEQ ID NO: 144703 - DNA, 20 bp, Artificial Sequence
  Description of Artificial Sequence: Synthetic oligonucleotide
  Target: ATXN1; (+) strand; PAM type: NRG; PAM sequence: AAG
ggtggaggctgcagtgagcc

SEQ ID NO: 144704 - DNA, 20 bp, Artificial Sequence
  Description of Artificial Sequence: Synthetic oligonucleotide
  Target: ATXN1; (+) strand; PAM type: NRG; PAM sequence: CAG
aagattgcaccactgcactc

SEQ ID NO: 144705 - DNA, 20 bp, Artificial Sequence
  Description of Artificial Sequence: Synthetic oligonucleotide
  Target: ATXN1; (+) strand; PAM type: NRG; PAM sequence: TGG
tgcaccactgcactccagcc

SEQ ID NO: 144706 - DNA, 20 bp, Artificial Sequence
  Description of Artificial Sequence: Synthetic oligonucleotide
  Target: ATXN1; (+) strand; PAM type: NRG; PAM sequence: GGG
gcaccactgcactccagcct

SEQ ID NO: 144707 - DNA, 20 bp, Artificial Sequence
  Description of Artificial Sequence: Synthetic oligonucleotide
  Target: ATXN1; (+) strand; PAM type: NRG; PAM sequence: CGG
ctgcactccagcctgggtga

SEQ ID NO: 144708 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggtgacg

SEQ ID NO: 144709 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggtgacggagt

SEQ ID NO: 144710 - DNA, 20 bp, Artificial Sequence
  Description of Artificial Sequence: Synthetic oligonucleotide
  Target: ATXN1; (+) strand; PAM type: NRG; PAM sequence: AAG
ataaaataaaattgtgatgc

SEQ ID NO: 144711 - DNA, 20 bp, Artificial Sequence
  Description of Artificial Sequence: Synthetic oligonucleotide
  Target: ATXN1; (+) strand; PAM type: NRG; PAM sequence: AAG
tgtgatgcaagacactgcca

SEQ ID NO: 144712 - DNA, 20 bp, Artificial Sequence
  Description of Artificial Sequence: Synthetic oligonucleotide
  Target: ATXN1; (+) strand; PAM type: NRG; PAM sequence: AGG
gtgatgcaagacactgccaa

SEQ ID NO: 144713 - DNA, 20 bp, Artificial Sequence
  Description of Artificial Sequence: Synthetic oligonucleotide
  Target: ATXN1; (+) strand; PAM type: NRG; PAM sequence: GAG
gatgcaagacactgccaaag

SEQ ID NO: 144714 - DNA, 20 bp, Artificial Sequence
  Description of Artificial Sequence: Synthetic oligonucleotide
  Target: ATXN1; (+) strand; PAM type: NRG; PAM sequence: AAG
gcaagacactgccaaaggag

SEQ ID NO: 144715 - DNA, 20 bp, Artificial Sequence
  Description of Artificial Sequence: Synthetic oligonucleotide
  Target: ATXN1; (+) strand; PAM type: NRG; PAM sequence: CGG
agacactgccaaaggagaag

SEQ ID NO: 144716 - DNA, 20 bp, Artificial Sequence
  Description of Artificial Sequence: Synthetic oligonucleotide
  Target: ATXN1; (+) strand; PAM type: NRG; PAM sequence: CAG
actgccaaaggagaagcgga

SEQ ID NO: 144717 - DNA, 20 bp, Artificial Sequence
  Description of Artificial Sequence: Synthetic oligonucleotide
  Target: ATXN1; (+) strand; PAM type: NRG; PAM sequence: AGG
ctgccaaaggagaagcggac

SEQ ID NO: 144718 - DNA, 20 bp, Artificial Sequence
  Description of Artificial Sequence: Synthetic oligonucleotide
  Target: ATXN1; (+) strand; PAM type: NRG; PAM sequence: GGG
tgccaaaggagaagcggaca

SEQ ID NO: 144719 - DNA, 20 bp, Artificial Sequence
  Description of Artificial Sequence: Synthetic oligonucleotide
  Target: ATXN1; (+) strand; PAM type: NRG; PAM sequence: TGG
aggagaagcggacagggtta

SEQ ID NO: 144720 - DNA, 20 bp, Artificial Sequence
  Description of Artificial Sequence: Synthetic oligonucleotide
  Target: ATXN1; (+) strand; PAM type: NRG; PAM sequence: GGG
ggagaagcggacagggttat

SEQ ID NO: 144721 - DNA, 20 bp, Artificial Sequence
  Description of Artificial Sequence: Synthetic oligonucleotide
  Target: ATXN1; (+) strand; PAM type: NRG; PAM sequence: GGG
gagaagcggacagggttatg

SEQ ID NO: 144722 - DNA, 20 bp, Artificial Sequence
  Description of Artificial Sequence: Synthetic oligonucleotide
  Target: ATXN1; (+) strand; PAM type: NRG; PAM sequence: AAG
aagcggacagggttatgggg

SEQ ID NO: 144723 - DNA, 20 bp, Artificial Sequence
  Description of Artificial Sequence: Synthetic oligonucleotide
  Target: ATXN1; (+) strand; PAM type: NRG; PAM sequence: AGG
agcggacagggttatgggga

SEQ ID NO: 144724 - DNA, 20 bp, Artificial Sequence
  Description of Artificial Sequence: Synthetic oligonucleotide
  Target: ATXN1; (+) strand; PAM type: NRG; PAM sequence: TAG
catcatacatgtctccaata

SEQ ID NO: 144725 - DNA, 20 bp, Artificial Sequence
  Description of Artificial Sequence: Synthetic oligonucleotide
  Target: ATXN1; (+) strand; PAM type: NRG; PAM sequence: AAG
gcattatgaatgaaaacatc

SEQ ID NO: 144726 - DNA, 20 bp, Artificial Sequence
  Description of Artificial Sequence: Synthetic oligonucleotide
  Target: ATXN1; (+) strand; PAM type: NRG; PAM sequence: AGG
cattatgaatgaaaacatca

SEQ ID NO: 144727 - DNA, 20 bp, Artificial Sequence
  Description of Artificial Sequence: Synthetic oligonucleotide
  Target: ATXN1; (+) strand; PAM type: NRG; PAM sequence: CAG
tatgaatgaaaacatcaagg

SEQ ID NO: 144728 - DNA, 20 bp, Artificial Sequence
  Description of Artificial Sequence: Synthetic oligonucleotide
  Target: ATXN1; (+) strand; PAM type: NRG; PAM sequence: AGG
atgaatgaaaacatcaaggc

SEQ ID NO: 144729 - DNA, 20 bp, Artificial Sequence
  Description of Artificial Sequence: Synthetic oligonucleotide
  Target: ATXN1; (+) strand; PAM type: NRG; PAM sequence: AAG
tcaaggcaggtaacaccatg

SEQ ID NO: 144730 - DNA, 20 bp, Artificial Sequence
  Description of Artificial Sequence: Synthetic oligonucleotide
  Target: ATXN1; (+) strand; PAM type: NRG; PAM sequence: TGG
tgaagcctgtgtctctaatc

SEQ ID NO: 144731 - DNA, 20 bp, Artificial Sequence
  Description of Artificial Sequence: Synthetic oligonucleotide
  Target: ATXN1; (+) strand; PAM type: NRG; PAM sequence: AAG
tctaatctggctacccaaat

SEQ ID NO: 144732 - DNA, 20 bp, Artificial Sequence
  Description of Artificial Sequence: Synthetic oligonucleotide
  Target: ATXN1; (+) strand; PAM type: NRG; PAM sequence: AGG
ctaatctggctacccaaata

SEQ ID NO: 144733 - DNA, 20 bp, Artificial Sequence
  Description of Artificial Sequence: Synthetic oligonucleotide
  Target: ATXN1; (+) strand; PAM type: NRG; PAM sequence: CAG
aggctactaatgctcatcaa

SEQ ID NO: 144734 - DNA, 20 bp, Artificial Sequence
  Description of Artificial Sequence: Synthetic oligonucleotide
  Target: ATXN1; (+) strand; PAM type: NRG; PAM sequence: AGG
ggctactaatgctcatcaac

SEQ ID NO: 144735 - DNA, 20 bp, Artificial Sequence
  Description of Artificial Sequence: Synthetic oligonucleotide
  Target: ATXN1; (+) strand; PAM type: NRG; PAM sequence: GGG
gctactaatgctcatcaaca

SEQ ID NO: 144736 - DNA, 20 bp, Artificial Sequence
  Description of Artificial Sequence: Synthetic oligonucleotide
  Target: ATXN1; (+) strand; PAM type: NRG; PAM sequence: TAG
actaatgctcatcaacaggg

SEQ ID NO: 144737 - DNA, 20 bp, Artificial Sequence
  Description of Artificial Sequence: Synthetic oligonucleotide
  Target: ATXN1; (+) strand; PAM type: NRG; PAM sequence: TGG
tcaacagggtagtattacat

SEQ ID NO: 144738 - DNA, 20 bp, Artificial Sequence
  Description of Artificial Sequence: Synthetic oligonucleotide
  Target: ATXN1; (+) strand; PAM type: NRG; PAM sequence: AAG
cagggtagtattacattggt

SEQ ID NO: 144739 - DNA, 20 bp, Artificial Sequence
  Description of Artificial Sequence: Synthetic oligonucleotide
  Target: ATXN1; (+) strand; PAM type: NRG; PAM sequence: GAG
agtattacattggtaagtgt

SEQ ID NO: 144740 - DNA, 20 bp, Artificial Sequence
  Description of Artificial Sequence: Synthetic oligonucleotide
  Target: ATXN1; (+) strand; PAM type: NRG; PAM sequence: GAG
ttacattggtaagtgtgagt

SEQ ID NO: 144741 - DNA, 20 bp, Artificial Sequence
  Description of Artificial Sequence: Synthetic oligonucleotide
  Target: ATXN1; (+) strand; PAM type: NRG; PAM sequence: AAG
aaaaaatatatatacaactg

SEQ ID NO: 144742 - DNA, 20 bp, Artificial Sequence
  Description of Artificial Sequence: Synthetic oligonucleotide
  Target: ATXN1; (+) strand; PAM type: NRG; PAM sequence: AAG
atacaactgaagatttctaa

SEQ ID NO: 144743 - DNA, 20 bp, Artificial Sequence
  Description of Artificial Sequence: Synthetic oligonucleotide
  Target: ATXN1; (+) strand; PAM type: NRG; PAM sequence: TGG
cttacattcacccttttaca

SEQ ID NO: 144744 - DNA, 20 bp, Artificial Sequence
  Description of Artificial Sequence: Synthetic oligonucleotide
  Target: ATXN1; (+) strand; PAM type: NRG; PAM sequence: TAG
cattcacccttttacatggc

SEQ ID NO: 144745 - DNA, 20 bp, Artificial Sequence
  Description of Artificial Sequence: Synthetic oligonucleotide
  Target: ATXN1; (+) strand; PAM type: NRG; PAM sequence: AAG
acccttttacatggctagtc

SEQ ID NO: 144746 - DNA, 20 bp, Artificial Sequence
  Description of Artificial Sequence: Synthetic oligonucleotide
  Target: ATXN1; (+) strand; PAM type: NRG; PAM sequence: AAG
cttttacatggctagtcaag

SEQ ID NO: 144747 - DNA, 20 bp, Artificial Sequence
  Description of Artificial Sequence: Synthetic oligonucleotide
  Target: ATXN1; (+) strand; PAM type: NRG; PAM sequence: GAG
tttacatggctagtcaagaa

SEQ ID NO: 144748 - DNA, 20 bp, Artificial Sequence
  Description of Artificial Sequence: Synthetic oligonucleotide
  Target: ATXN1; (+) strand; PAM type: NRG; PAM sequence: AAG
tggctagtcaagaagagcaa

SEQ ID NO: 144749 - DNA, 20 bp, Artificial Sequence
  Description of Artificial Sequence: Synthetic oligonucleotide
  Target: ATXN1; (+) strand; PAM type: NRG; PAM sequence: TGG
agcaaaagaatgctcttaca

SEQ ID NO: 144750 - DNA, 20 bp, Artificial Sequence
  Description of Artificial Sequence: Synthetic oligonucleotide
  Target: ATXN1; (+) strand; PAM type: NRG; PAM sequence: GAG
agaatgctcttacatggact

SEQ ID NO: 144751 - DNA, 20 bp, Artificial Sequence
  Description of Artificial Sequence: Synthetic oligonucleotide
  Target: ATXN1; (+) strand; PAM type: NRG; PAM sequence: CAG
ctcttacatggactgagact

SEQ ID NO: 144752 - DNA, 20 bp, Artificial Sequence
  Description of Artificial Sequence: Synthetic oligonucleotide
  Target: ATXN1; (+) strand; PAM type: NRG; PAM sequence: AGG
tcttacatggactgagactc

SEQ ID NO: 144753 - DNA, 20 bp, Artificial Sequence
  Description of Artificial Sequence: Synthetic oligonucleotide
  Target: ATXN1; (+) strand; PAM type: NRG; PAM sequence: AAG
tggactgagactcaggtttt

SEQ ID NO: 144754 - DNA, 20 bp, Artificial Sequence
  Description of Artificial Sequence: Synthetic oligonucleotide
  Target: ATXN1; (+) strand; PAM type: NRG; PAM sequence: CAG
ctcaggttttaagaccctgc

SEQ ID NO: 144755 - DNA, 20 bp, Artificial Sequence
  Description of Artificial Sequence: Synthetic oligonucleotide
  Target: ATXN1; (+) strand; PAM type: NRG; PAM sequence: AAG
cctctaactttttaccttga

SEQ ID NO: 144756 - DNA, 20 bp, Artificial Sequence
  Description of Artificial Sequence: Synthetic oligonucleotide
  Target: ATXN1; (+) strand; PAM type: NRG; PAM sequence: AAG
ttttaccttgaaagttactg

SEQ ID NO: 144757 - DNA, 20 bp, Artificial Sequence
  Description of Artificial Sequence: Synthetic oligonucleotide
  Target: ATXN1; (+) strand; PAM type: NRG; PAM sequence: CAG
agttactgaagtatataaca

SEQ ID NO: 144758 - DNA, 20 bp, Artificial Sequence
  Description of Artificial Sequence: Synthetic oligonucleotide
  Target: ATXN1; (+) strand; PAM type: NRG; PAM sequence: AAG
ttgtataaaatcaatgtaca

SEQ ID NO: 144759 - DNA, 20 bp, Artificial Sequence
  Description of Artificial Sequence: Synthetic oligonucleotide
  Target: ATXN1; (+) strand; PAM type: NRG; PAM sequence: TAG
tataaaatcaatgtacaaag

SEQ ID NO: 144760 - DNA, 20 bp, Artificial Sequence
  Description of Artificial Sequence: Synthetic oligonucleotide
  Target: ATXN1; (+) strand; PAM type: NRG; PAM sequence: CAG
atttcaaaacccacaattaa

SEQ ID NO: 144761 - DNA, 20 bp, Artificial Sequence
  Description of Artificial Sequence: Synthetic oligonucleotide
  Target: ATXN1; (+) strand; PAM type: NRG; PAM sequence: TGG
ctatgaaaaccaactctttc

SEQ ID NO: 144762 - DNA, 20 bp, Artificial Sequence
  Description of Artificial Sequence: Synthetic oligonucleotide
  Target: ATXN1; (+) strand; PAM type: NRG; PAM sequence: TAG
aaaccaactctttctggtat

SEQ ID NO: 144763 - DNA, 20 bp, Artificial Sequence
  Description of Artificial Sequence: Synthetic oligonucleotide
  Target: ATXN1; (+) strand; PAM type: NRG; PAM sequence: TAG
actctttctggtattagcac

SEQ ID NO: 144764 - DNA, 20 bp, Artificial Sequence
  Description of Artificial Sequence: Synthetic oligonucleotide
  Target: ATXN1; (+) strand; PAM type: NRG; PAM sequence: TAG
tcatacatccttttaaatgt

SEQ ID NO: 144765 - DNA, 20 bp, Artificial Sequence
  Description of Artificial Sequence: Synthetic oligonucleotide
  Target: ATXN1; (+) strand; PAM type: NRG; PAM sequence: AGG
catacatccttttaaatgtt

SEQ ID NO: 144766 - DNA, 20 bp, Artificial Sequence
  Description of Artificial Sequence: Synthetic oligonucleotide
  Target: ATXN1; (+) strand; PAM type: NRG; PAM sequence: GGG
atacatccttttaaatgtta

SEQ ID NO: 144767 - DNA, 20 bp, Artificial Sequence
  Description of Artificial Sequence: Synthetic oligonucleotide
  Target: ATXN1; (+) strand; PAM type: NRG; PAM sequence: GAG
catcttacttcttcattact

SEQ ID NO: 144768 - DNA, 20 bp, Artificial Sequence
  Description of Artificial Sequence: Synthetic oligonucleotide
  Target: ATXN1; (+) strand; PAM type: NRG; PAM sequence: TAG
actgagtgcctactttgtgc

SEQ ID NO: 144769 - DNA, 20 bp, Artificial Sequence
  Description of Artificial Sequence: Synthetic oligonucleotide
  Target: ATXN1; (+) strand; PAM type: NRG; PAM sequence: AGG
ctgagtgcctactttgtgct

SEQ ID NO: 144770 - DNA, 20 bp, Artificial Sequence
  Description of Artificial Sequence: Synthetic oligonucleotide
  Target: ATXN1; (+) strand; PAM type: NRG; PAM sequence: GAG
cctactttgtgctaggccct

SEQ ID NO: 144771 - DNA, 20 bp, Artificial Sequence
  Description of Artificial Sequence: Synthetic oligonucleotide
  Target: ATXN1; (+) strand; PAM type: NRG; PAM sequence: AGG
ctactttgtgctaggccctg

SEQ ID NO: 144772 - DNA, 20 bp, Artificial Sequence
  Description of Artificial Sequence: Synthetic oligonucleotide
  Target: ATXN1; (+) strand; PAM type: NRG; PAM sequence: GAG
taggccctgaggatacacat

SEQ ID NO: 144773 - DNA, 20 bp, Artificial Sequence
  Description of Artificial Sequence: Synthetic oligonucleotide
  Target: ATXN1; (+) strand; PAM type: NRG; PAM sequence: TGG
ggatacacatgagtaaaata

SEQ ID NO: 144774 - DNA, 20 bp, Artificial Sequence
  Description of Artificial Sequence: Synthetic oligonucleotide
  Target: ATXN1; (+) strand; PAM type: NRG; PAM sequence: TAG
tggtccttgcactctccatc

SEQ ID NO: 144775 - DNA, 20 bp, Artificial Sequence
  Description of Artificial Sequence: Synthetic oligonucleotide
  Target: ATXN1; (+) strand; PAM type: NRG; PAM sequence: TGG
ttgcactctccatctagttg

SEQ ID NO: 144776 - DNA, 20 bp, Artificial Sequence
  Description of Artificial Sequence: Synthetic oligonucleotide
  Target: ATXN1; (+) strand; PAM type: NRG; PAM sequence: GGG
tgcactctccatctagttgt

SEQ ID NO: 144777 - DNA, 20 bp, Artificial Sequence
  Description of Artificial Sequence: Synthetic oligonucleotide
  Target: ATXN1; (+) strand; PAM type: NRG; PAM sequence: GGG
gcactctccatctagttgtg

SEQ ID NO: 144778 - DNA, 20 bp, Artificial Sequence
  Description of Artificial Sequence: Synthetic oligonucleotide
  Target: ATXN1; (+) strand; PAM type: NRG; PAM sequence: TGG
tggggaaaataaacaaacaa

SEQ ID NO: 144779 - DNA, 20 bp, Artificial Sequence
  Description of Artificial Sequence: Synthetic oligonucleotide
  Target: ATXN1; (+) strand; PAM type: NRG; PAM sequence: CAG
ggaaaataaacaaacaatgg

SEQ ID NO: 144780 - DNA, 20 bp, Artificial Sequence
  Description of Artificial Sequence: Synthetic oligonucleotide
  Target: ATXN1; (+) strand; PAM type: NRG; PAM sequence: GAG
aaaataaacaaacaatggca

SEQ ID NO: 144781 - DNA, 20 bp, Artificial Sequence
  Description of Artificial Sequence: Synthetic oligonucleotide
  Target: ATXN1; (+) strand; PAM type: NRG; PAM sequence: AAG
agagtatgccacgattatga

SEQ ID NO: 144782 - DNA, 20 bp, Artificial Sequence
  Description of Artificial Sequence: Synthetic oligonucleotide
  Target: ATXN1; (+) strand; PAM type: NRG; PAM sequence: GAG
agtatgccacgattatgaaa

SEQ ID NO: 144783 - DNA, 20 bp, Artificial Sequence
  Description of Artificial Sequence: Synthetic oligonucleotide
  Target: ATXN1; (+) strand; PAM type: NRG; PAM sequence: AGG
gtatgccacgattatgaaag

SEQ ID NO: 144784 - DNA, 20 bp, Artificial Sequence
  Description of Artificial Sequence: Synthetic oligonucleotide
  Target: ATXN1; (+) strand; PAM type: NRG; PAM sequence: AAG
gccacgattatgaaagagga

SEQ ID NO: 144785 - DNA, 20 bp, Artificial Sequence
  Description of Artificial Sequence: Synthetic oligonucleotide
  Target: ATXN1; (+) strand; PAM type: NRG; PAM sequence: CAG
acgattatgaaagaggaaag

SEQ ID NO: 144786 - DNA, 20 bp, Artificial Sequence
  Description of Artificial Sequence: Synthetic oligonucleotide
  Target: ATXN1; (+) strand; PAM type: NRG; PAM sequence: GAG
atgaaagaggaaagcagtct

SEQ ID NO: 144787 - DNA, 20 bp, Artificial Sequence
  Description of Artificial Sequence: Synthetic oligonucleotide
  Target: ATXN1; (+) strand; PAM type: NRG; PAM sequence: TGG
aaagaggaaagcagtctgag

SEQ ID NO: 144788 - DNA, 20 bp, Artificial Sequence
  Description of Artificial Sequence: Synthetic oligonucleotide
  Target: ATXN1; (+) strand; PAM type: NRG; PAM sequence: TGG
gaggaaagcagtctgagtgg

SEQ ID NO: 144789 - DNA, 20 bp, Artificial Sequence
  Description of Artificial Sequence: Synthetic oligonucleotide
  Target: ATXN1; (+) strand; PAM type: NRG; PAM sequence: TGG
aagcagtctgagtggtggaa

SEQ ID NO: 144790 - DNA, 20 bp, Artificial Sequence
  Description of Artificial Sequence: Synthetic oligonucleotide
  Target: ATXN1; (+) strand; PAM type: NRG; PAM sequence: AAG
tggattcttcttcctataaa

SEQ ID NO: 144791 - DNA, 20 bp, Artificial Sequence
  Description of Artificial Sequence: Synthetic oligonucleotide
  Target: ATXN1; (+) strand; PAM type: NRG; PAM sequence: TGG
ctataaaaagaatataaaat

SEQ ID NO: 144792 - DNA, 20 bp, Artificial Sequence
  Description of Artificial Sequence: Synthetic oligonucleotide
  Target: ATXN1; (+) strand; PAM type: NRG; PAM sequence: GGG
tataaaaagaatataaaatt

SEQ ID NO: 144793 - DNA, 20 bp, Artificial Sequence
  Description of Artificial Sequence: Synthetic oligonucleotide
  Target: ATXN1; (+) strand; PAM type: NRG; PAM sequence: AAG
gattcccaactcacaaatta

SEQ ID NO: 144794 - DNA, 20 bp, Artificial Sequence
  Description of Artificial Sequence: Synthetic oligonucleotide
  Target: ATXN1; (+) strand; PAM type: NRG; PAM sequence: CGG
caactcacaaattaaagttt

SEQ ID NO: 144795 - DNA, 20 bp, Artificial Sequence
  Description of Artificial Sequence: Synthetic oligonucleotide
  Target: ATXN1; (+) strand; PAM type: NRG; PAM sequence: TGG
acaaattaaagtttcggtta

SEQ ID NO: 144796 - DNA, 20 bp, Artificial Sequence
  Description of Artificial Sequence: Synthetic oligonucleotide
  Target: ATXN1; (+) strand; PAM type: NRG; PAM sequence: TAG
ttgttgtgataaaataattt

SEQ ID NO: 144797 - DNA, 20 bp, Artificial Sequence
  Description of Artificial Sequence: Synthetic oligonucleotide
  Target: ATXN1; (+) strand; PAM type: NRG; PAM sequence: TGG
aattttagtatgattccttc

SEQ ID NO: 144798 - DNA, 20 bp, Artificial Sequence
  Description of Artificial Sequence: Synthetic oligonucleotide
  Target: ATXN1; (+) strand; PAM type: NRG; PAM sequence: TGG
ttagtatgattccttctggt

SEQ ID NO: 144799 - DNA, 20 bp, Artificial Sequence
  Description of Artificial Sequence: Synthetic oligonucleotide
  Target: ATXN1; (+) strand; PAM type: NRG; PAM sequence: CAG
ggttggaaacatcttcctac

SEQ ID NO: 144800 - DNA, 20 bp, Artificial Sequence
  Description of Artificial Sequence: Synthetic oligonucleotide
  Target: ATXN1; (+) strand; PAM type: NRG; PAM sequence: TGG
tacaaaactgacctctactc

SEQ ID NO: 144801 - DNA, 20 bp, Artificial Sequence
  Description of Artificial Sequence: Synthetic oligonucleotide
  Target: ATXN1; (+) strand; PAM type: NRG; PAM sequence: TGG
tctactctggaatgttcaac

SEQ ID NO: 144802 - DNA, 20 bp, Artificial Sequence
  Description of Artificial Sequence: Synthetic oligonucleotide
  Target: ATXN1; (+) strand; PAM type: NRG; PAM sequence: AAG
tctggaatgttcaactggcc

SEQ ID NO: 144803 - DNA, 20 bp, Artificial Sequence
  Description of Artificial Sequence: Synthetic oligonucleotide
  Target: ATXN1; (+) strand; PAM type: NRG; PAM sequence: AAG
aatgttcaactggccaagaa

SEQ ID NO: 144804 - DNA, 20 bp, Artificial Sequence
  Description of Artificial Sequence: Synthetic oligonucleotide
  Target: ATXN1; (+) strand; PAM type: NRG; PAM sequence: AAG
ttttttttctattccatcac

SEQ ID NO: 144805 - DNA, 20 bp, Artificial Sequence
  Description of Artificial Sequence: Synthetic oligonucleotide
  Target: ATXN1; (+) strand; PAM type: NRG; PAM sequence: TGG
tttctattccatcacaagat

SEQ ID NO: 144806 - DNA, 20 bp, Artificial Sequence
  Description of Artificial Sequence: Synthetic oligonucleotide
  Target: ATXN1; (+) strand; PAM type: NRG; PAM sequence: GGG
ttctattccatcacaagatt

SEQ ID NO: 144807 - DNA, 20 bp, Artificial Sequence
  Description of Artificial Sequence: Synthetic oligonucleotide
  Target: ATXN1; (+) strand; PAM type: NRG; PAM sequence: GGG
tctattccatcacaagattg

SEQ ID NO: 144808 - DNA, 20 bp, Artificial Sequence
  Description of Artificial Sequence: Synthetic oligonucleotide
  Target: ATXN1; (+) strand; PAM type: NRG; PAM sequence: TAG
gaaccctctgctgtattttg

SEQ ID NO: 144809 - DNA, 20 bp, Artificial Sequence
  Description of Artificial Sequence: Synthetic oligonucleotide
  Target: ATXN1; (+) strand; PAM type: NRG; PAM sequence: CAG
tgctgtattttgtagccttt

SEQ ID NO: 144810 - DNA, 20 bp, Artificial Sequence
  Description of Artificial Sequence: Synthetic oligonucleotide
  Target: ATXN1; (+) strand; PAM type: NRG; PAM sequence: TAG
attttgtagcctttcagatc

SEQ ID NO: 144811 - DNA, 20 bp, Artificial Sequence
  Description of Artificial Sequence: Synthetic oligonucleotide
  Target: ATXN1; (+) strand; PAM type: NRG; PAM sequence: AGG
ttttgtagcctttcagatct

SEQ ID NO: 144812 - DNA, 20 bp, Artificial Sequence
  Description of Artificial Sequence: Synthetic oligonucleotide
  Target: ATXN1; (+) strand; PAM type: NRG; PAM sequence: TAG
tcattttattttcacttaac

SEQ ID NO: 144813 - DNA, 20 bp, Artificial Sequence
  Description of Artificial Sequence: Synthetic oligonucleotide
  Target: ATXN1; (+) strand; PAM type: NRG; PAM sequence: TAG
caatgaatgaatcatgtctg

SEQ ID NO: 144814 - DNA, 20 bp, Artificial Sequence
  Description of Artificial Sequence: Synthetic oligonucleotide
  Target: ATXN1; (+) strand; PAM type: NRG; PAM sequence: TGG
tgaatgaatcatgtctgtag

SEQ ID NO: 144815 - DNA, 20 bp, Artificial Sequence
  Description of Artificial Sequence: Synthetic oligonucleotide
  Target: ATXN1; (+) strand; PAM type: NRG; PAM sequence: GAG
atgtctgtagtggccactgc

SEQ ID NO: 144816 - DNA, 20 bp, Artificial Sequence
  Description of Artificial Sequence: Synthetic oligonucleotide
  Target: ATXN1; (+) strand; PAM type: NRG; PAM sequence: AAG
tgtagtggccactgcgagca

SEQ ID NO: 144817 - DNA, 20 bp, Artificial Sequence
  Description of Artificial Sequence: Synthetic oligonucleotide
  Target: ATXN1; (+) strand; PAM type: NRG; PAM sequence: TGG
ccactgcgagcaaagcacca

SEQ ID NO: 144818 - DNA, 20 bp, Artificial Sequence
  Description of Artificial Sequence: Synthetic oligonucleotide
  Target: ATXN1; (+) strand; PAM type: NRG; PAM sequence: GGG
cactgcgagcaaagcaccat

SEQ ID NO: 144819 - DNA, 20 bp, Artificial Sequence
  Description of Artificial Sequence: Synthetic oligonucleotide
  Target: ATXN1; (+) strand; PAM type: NRG; PAM sequence: AAG
agcaccatgggaaatgtaaa

SEQ ID NO: 144820 - DNA, 20 bp, Artificial Sequence
  Description of Artificial Sequence: Synthetic oligonucleotide
  Target: ATXN1; (+) strand; PAM type: NRG; PAM sequence: AGG
gcaccatgggaaatgtaaaa

SEQ ID NO: 144821 - DNA, 20 bp, Artificial Sequence
  Description of Artificial Sequence: Synthetic oligonucleotide
  Target: ATXN1; (+) strand; PAM type: NRG; PAM sequence: AAG
tgggaaatgtaaaaaggaac

SEQ ID NO: 144822 - DNA, 20 bp, Artificial Sequence
  Description of Artificial Sequence: Synthetic oligonucleotide
  Target: ATXN1; (+) strand; PAM type: NRG; PAM sequence: GAG
ggaaatgtaaaaaggaacaa

SEQ ID NO: 144823 - DNA, 20 bp, Artificial Sequence
  Description of Artificial Sequence: Synthetic oligonucleotide
  Target: ATXN1; (+) strand; PAM type: NRG; PAM sequence: AGG
gaaatgtaaaaaggaacaag

SEQ ID NO: 144824 - DNA, 20 bp, Artificial Sequence
  Description of Artificial Sequence: Synthetic oligonucleotide
  Target: ATXN1; (+) strand; PAM type: NRG; PAM sequence: AAG
agaggttgtccttgtcctta

SEQ ID NO: 144825 - DNA, 20 bp, Artificial Sequence
  Description of Artificial Sequence: Synthetic oligonucleotide
  Target: ATXN1; (+) strand; PAM type: NRG; PAM sequence: GAG
tccttaaagatttccaacct

SEQ ID NO: 144826 - DNA, 20 bp, Artificial Sequence
  Description of Artificial Sequence: Synthetic oligonucleotide
  Target: ATXN1; (+) strand; PAM type: NRG; PAM sequence: CAG
taaagatttccaacctgagt

SEQ ID NO: 144827 - DNA, 20 bp, Artificial Sequence
  Description of Artificial Sequence: Synthetic oligonucleotide
  Target: ATXN1; (+) strand; PAM type: NRG; PAM sequence: AGG
aaagatttccaacctgagtc

SEQ ID NO: 144828 - DNA, 20 bp, Artificial Sequence
  Description of Artificial Sequence: Synthetic oligonucleotide
  Target: ATXN1; (+) strand; PAM type: NRG; PAM sequence: GGG
aagatttccaacctgagtca

SEQ ID NO: 144829 - DNA, 20 bp, Artificial Sequence
  Description of Artificial Sequence: Synthetic oligonucleotide
  Target: ATXN1; (+) strand; PAM type: NRG; PAM sequence: GAG
gatttccaacctgagtcagg

SEQ ID NO: 144830 - DNA, 20 bp, Artificial Sequence
  Description of Artificial Sequence: Synthetic oligonucleotide
  Target: ATXN1; (+) strand; PAM type: NRG; PAM sequence: CGG
aaacatgtaaacaaacaata

SEQ ID NO: 144831 - DNA, 20 bp, Artificial Sequence
  Description of Artificial Sequence: Synthetic oligonucleotide
  Target: ATXN1; (+) strand; PAM type: NRG; PAM sequence: AAG
caaacaatacggtgtgaatc

SEQ ID NO: 144832 - DNA, 20 bp, Artificial Sequence
  Description of Artificial Sequence: Synthetic oligonucleotide
  Target: ATXN1; (+) strand; PAM type: NRG; PAM sequence: AGG
aaacaatacggtgtgaatca

SEQ ID NO: 144833 - DNA, 20 bp, Artificial Sequence
  Description of Artificial Sequence: Synthetic oligonucleotide
  Target: ATXN1; (+) strand; PAM type: NRG; PAM sequence: GGG
aacaatacggtgtgaatcaa

SEQ ID NO: 144834 - DNA, 20 bp, Artificial Sequence
  Description of Artificial Sequence: Synthetic oligonucleotide
  Target: ATXN1; (+) strand; PAM type: NRG; PAM sequence: GGG
acaatacggtgtgaatcaag

SEQ ID NO: 144835 - DNA, 20 bp, Artificial Sequence
  Description of Artificial Sequence: Synthetic oligonucleotide
  Target: ATXN1; (+) strand; PAM type: NRG; PAM sequence: TGG
ggtgtgaatcaaggggaatg

SEQ ID NO: 144836 - DNA, 20 bp, Artificial Sequence
  Description of Artificial Sequence: Synthetic oligonucleotide
  Target: ATXN1; (+) strand; PAM type: NRG; PAM sequence: GGG
gtgtgaatcaaggggaatgt

SEQ ID NO: 144837 - DNA, 20 bp, Artificial Sequence
  Description of Artificial Sequence: Synthetic oligonucleotide
  Target: ATXN1; (+) strand; PAM type: NRG; PAM sequence: GAG
gaatcaaggggaatgtgggt

SEQ ID NO: 144838 - DNA, 20 bp, Artificial Sequence
  Description of Artificial Sequence: Synthetic oligonucleotide
  Target: ATXN1; (+) strand; PAM type: NRG; PAM sequence: GAG
ggggaatgtgggtgagcgct

SEQ ID NO: 144839 - DNA, 20 bp, Artificial Sequence
  Description of Artificial Sequence: Synthetic oligonucleotide
  Target: ATXN1; (+) strand; PAM type: NRG; PAM sequence: GAG
ggaatgtgggtgagcgctga

SEQ ID NO: 144840 - DNA, 20 bp, Artificial Sequence
  Description of Artificial Sequence: Synthetic oligonucleotide
  Target: ATXN1; (+) strand; PAM type: NRG; PAM sequence: GAG
ggtgagcgctgagagatgac

SEQ ID NO: 144841 - DNA, 20 bp, Artificial Sequence
  Description of Artificial Sequence: Synthetic oligonucleotide
  Target: ATXN1; (+) strand; PAM type: NRG; PAM sequence: AAG
gcgctgagagatgacgagca

SEQ ID NO: 144842 - DNA, 20 bp, Artificial Sequence
  Description of Artificial Sequence: Synthetic oligonucleotide
  Target: ATXN1; (+) strand; PAM type: NRG; PAM sequence: TGG
tgacgagcaaagaactctgc

SEQ ID NO: 144843 - DNA, 20 bp, Artificial Sequence
  Description of Artificial Sequence: Synthetic oligonucleotide
  Target: ATXN1; (+) strand; PAM type: NRG; PAM sequence: CAG
cgagcaaagaactctgctgg

SEQ ID NO: 144844 - DNA, 20 bp, Artificial Sequence
  Description of Artificial Sequence: Synthetic oligonucleotide
  Target: ATXN1; (+) strand; PAM type: NRG; PAM sequence: GAG
agcaaagaactctgctggca

SEQ ID NO: 144845 - DNA, 20 bp, Artificial Sequence
  Description of Artificial Sequence: Synthetic oligonucleotide
  Target: ATXN1; (+) strand; PAM type: NRG; PAM sequence: GAG
caaagaactctgctggcaga

SEQ ID NO: 144846 - DNA, 20 bp, Artificial Sequence
  Description of Artificial Sequence: Synthetic oligonucleotide
  Target: ATXN1; (+) strand; PAM type: NRG; PAM sequence: CAG
ctctgctggcagagagctcc

SEQ ID NO: 144847 - DNA, 20 bp, Artificial Sequence
  Description of Artificial Sequence: Synthetic oligonucleotide
  Target: ATXN1; (+) strand; PAM type: NRG; PAM sequence: CAG
gagagctcccagctgcaaca

SEQ ID NO: 144848 - DNA, 20 bp, Artificial Sequence
  Description of Artificial Sequence: Synthetic oligonucleotide
  Target: ATXN1; (+) strand; PAM type: NRG; PAM sequence: AGG
agagctcccagctgcaacac

SEQ ID NO: 144849 - DNA, 20 bp, Artificial Sequence
  Description of Artificial Sequence: Synthetic oligonucleotide
  Target: ATXN1; (+) strand; PAM type: NRG; PAM sequence: TGG
ggcattaattacgtgtgctc

SEQ ID NO: 144850 - DNA, 20 bp, Artificial Sequence
  Description of Artificial Sequence: Synthetic oligonucleotide
  Target: ATXN1; (+) strand; PAM type: NRG; PAM sequence: GGG
gcattaattacgtgtgctct

SEQ ID NO: 144851 - DNA, 20 bp, Artificial Sequence
  Description of Artificial Sequence: Synthetic oligonucleotide
  Target: ATXN1; (+) strand; PAM type: NRG; PAM sequence: GAG
attaattacgtgtgctctgg

SEQ ID NO: 144852 - DNA, 20 bp, Artificial Sequence
  Description of Artificial Sequence: Synthetic oligonucleotide
  Target: ATXN1; (+) strand; PAM type: NRG; PAM sequence: GAG
taattacgtgtgctctggga

SEQ ID NO: 144853 - DNA, 20 bp, Artificial Sequence
  Description of Artificial Sequence: Synthetic oligonucleotide
  Target: ATXN1; (+) strand; PAM type: NRG; PAM sequence: AGG
aattacgtgtgctctgggag

SEQ ID NO: 144854 - DNA, 20 bp, Artificial Sequence
  Description of Artificial Sequence: Synthetic oligonucleotide
  Target: ATXN1; (+) strand; PAM type: NRG; PAM sequence: GGG
attacgtgtgctctgggaga

SEQ ID NO: 144855 - DNA, 20 bp, Artificial Sequence
  Description of Artificial Sequence: Synthetic oligonucleotide
  Target: ATXN1; (+) strand; PAM type: NRG; PAM sequence: GGG
ttacgtgtgctctgggagag

SEQ ID NO: 144856 - DNA, 20 bp, Artificial Sequence
  Description of Artificial Sequence: Synthetic oligonucleotide
  Target: ATXN1; (+) strand; PAM type: NRG; PAM sequence: GAG
acgtgtgctctgggagaggg

SEQ ID NO: 144857 - DNA, 20 bp, Artificial Sequence
  Description of Artificial Sequence: Synthetic oligonucleotide
  Target: ATXN1; (+) strand; PAM type: NRG; PAM sequence: CAG
tattttttgattcccctccc

SEQ ID NO: 144858 - DNA, 20 bp, Artificial Sequence
  Description of Artificial Sequence: Synthetic oligonucleotide
  Target: ATXN1; (+) strand; PAM type: NRG; PAM sequence: CAG
ttgattcccctccccagaat

SEQ ID NO: 144859 - DNA, 20 bp, Artificial Sequence
  Description of Artificial Sequence: Synthetic oligonucleotide
  Target: ATXN1; (+) strand; PAM type: NRG; PAM sequence: TAG
tgctatttgaaaatcccacg

SEQ ID NO: 144860 - DNA, 20 bp, Artificial Sequence
  Description of Artificial Sequence: Synthetic oligonucleotide
  Target: ATXN1; (+) strand; PAM type: NRG; PAM sequence: AGG
gctatttgaaaatcccacgt

SEQ ID NO: 144861 - DNA, 20 bp, Artificial Sequence
  Description of Artificial Sequence: Synthetic oligonucleotide
  Target: ATXN1; (+) strand; PAM type: NRG; PAM sequence: AAG
tttgaaaatcccacgtaggt

SEQ ID NO: 144862 - DNA, 20 bp, Artificial Sequence
  Description of Artificial Sequence: Synthetic oligonucleotide
  Target: ATXN1; (+) strand; PAM type: NRG; PAM sequence: GAG
tgaaaatcccacgtaggtaa

SEQ ID NO: 144863 - DNA, 20 bp, Artificial Sequence
  Description of Artificial Sequence: Synthetic oligonucleotide
  Target: ATXN1; (+) strand; PAM type: NRG; PAM sequence: AGG
gaaaatcccacgtaggtaag

SEQ ID NO: 144864 - DNA, 20 bp, Artificial Sequence
  Description of Artificial Sequence: Synthetic oligonucleotide
  Target: ATXN1; (+) strand; PAM type: NRG; PAM sequence: CAG
atcccacgtaggtaagagga

SEQ ID NO: 144865 - DNA, 20 bp, Artificial Sequence
  Description of Artificial Sequence: Synthetic oligonucleotide
  Target: ATXN1; (+) strand; PAM type: NRG; PAM sequence: AGG
tcccacgtaggtaagaggac

SEQ ID NO: 144866 - DNA, 20 bp, Artificial Sequence
  Description of Artificial Sequence: Synthetic oligonucleotide
  Target: ATXN1; (+) strand; PAM type: NRG; PAM sequence: GGG
cccacgtaggtaagaggaca

SEQ ID NO: 144867 - DNA, 20 bp, Artificial Sequence
  Description of Artificial Sequence: Synthetic oligonucleotide
  Target: ATXN1; (+) strand; PAM type: NRG; PAM sequence: GAG
cacgtaggtaagaggacagg

SEQ ID NO: 144868 - DNA, 20 bp, Artificial Sequence
  Description of Artificial Sequence: Synthetic oligonucleotide
  Target: ATXN1; (+) strand; PAM type: NRG; PAM sequence: AGG
acgtaggtaagaggacaggg

SEQ ID NO: 144869 - DNA, 20 bp, Artificial Sequence
  Description of Artificial Sequence: Synthetic oligonucleotide
  Target: ATXN1; (+) strand; PAM type: NRG; PAM sequence: AAG
agaggacagggaggcataca

SEQ ID NO: 144870 - DNA, 20 bp, Artificial Sequence
  Description of Artificial Sequence: Synthetic oligonucleotide
  Target: ATXN1; (+) strand; PAM type: NRG; PAM sequence: TAG
acagggaggcatacaaagcc

SEQ ID NO: 144871 - DNA, 20 bp, Artificial Sequence
  Description of Artificial Sequence: Synthetic oligonucleotide
  Target: ATXN1; (+) strand; PAM type: NRG; PAM sequence: AAG
cctagccatgttatttttac

SEQ ID NO: 144872 - DNA, 20 bp, Artificial Sequence
  Description of Artificial Sequence: Synthetic oligonucleotide
  Target: ATXN1; (+) strand; PAM type: NRG; PAM sequence: TAG
tactgcgtttatctaatact

SEQ ID NO: 144873 - DNA, 20 bp, Artificial Sequence
  Description of Artificial Sequence: Synthetic oligonucleotide
  Target: ATXN1; (+) strand; PAM type: NRG; PAM sequence: CAG
cttagataaaaattattttt

SEQ ID NO: 144874 - DNA, 20 bp, Artificial Sequence
  Description of Artificial Sequence: Synthetic oligonucleotide
  Target: ATXN1; (+) strand; PAM type: NRG; PAM sequence: AGG
ttagataaaaattatttttc

SEQ ID NO: 144875 - DNA, 20 bp, Artificial Sequence
  Description of Artificial Sequence: Synthetic oligonucleotide
  Target: ATXN1; (+) strand; PAM type: NRG; PAM sequence: TAG
tctctctgtgtcctcatcat

SEQ ID NO: 144876 - DNA, 20 bp, Artificial Sequence
  Description of Artificial Sequence: Synthetic oligonucleotide
  Target: ATXN1; (+) strand; PAM type: NRG; PAM sequence: AGG
ctctctgtgtcctcatcatt

SEQ ID NO: 144877 - DNA, 20 bp, Artificial Sequence
  Description of Artificial Sequence: Synthetic oligonucleotide
  Target: ATXN1; (+) strand; PAM type: NRG; PAM sequence: CAG
ctgtgtcctcatcattaggt

SEQ ID NO: 144878 - DNA, 20 bp, Artificial Sequence
  Description of Artificial Sequence: Synthetic oligonucleotide
  Target: ATXN1; (+) strand; PAM type: NRG; PAM sequence: AGG
tgtgtcctcatcattaggtc

SEQ ID NO: 144879 - DNA, 20 bp, Artificial Sequence
  Description of Artificial Sequence: Synthetic oligonucleotide
  Target: ATXN1; (+) strand; PAM type: NRG; PAM sequence: GAG
tgtcctcatcattaggtcag

SEQ ID NO: 144880 - DNA, 20 bp, Artificial Sequence
  Description of Artificial Sequence: Synthetic oligonucleotide
  Target: ATXN1; (+) strand; PAM type: NRG; PAM sequence: TGG
cctcatcattaggtcaggag

SEQ ID NO: 144881 - DNA, 20 bp, Artificial Sequence
  Description of Artificial Sequence: Synthetic oligonucleotide
  Target: ATXN1; (+) strand; PAM type: NRG; PAM sequence: CAG
attaggtcaggagtggtttc

SEQ ID NO: 144882 - DNA, 20 bp, Artificial Sequence
  Description of Artificial Sequence: Synthetic oligonucleotide
  Target: ATXN1; (+) strand; PAM type: NRG; PAM sequence: TAG
aggtcaggagtggtttccag

SEQ ID NO: 144883 - DNA, 20 bp, Artificial Sequence
  Description of Artificial Sequence: Synthetic oligonucleotide
  Target: ATXN1; (+) strand; PAM type: NRG; PAM sequence: AGG
ggtcaggagtggtttccagt

SEQ ID NO: 144884 - DNA, 20 bp, Artificial Sequence
  Description of Artificial Sequence: Synthetic oligonucleotide
  Target: ATXN1; (+) strand; PAM type: NRG; PAM sequence: AAG
tttccagtaggtgctccaca

SEQ ID NO: 144885 - DNA, 20 bp, Artificial Sequence
  Description of Artificial Sequence: Synthetic oligonucleotide
  Target: ATXN1; (+) strand; PAM type: NRG; PAM sequence: GAG
tccagtaggtgctccacaaa

SEQ ID NO: 144886 - DNA, 20 bp, Artificial Sequence
  Description of Artificial Sequence: Synthetic oligonucleotide
  Target: ATXN1; (+) strand; PAM type: NRG; PAM sequence: AAG
ggtgctccacaaagagcaaa

SEQ ID NO: 144887 - DNA, 20 bp, Artificial Sequence
  Description of Artificial Sequence: Synthetic oligonucleotide
  Target: ATXN1; (+) strand; PAM type: NRG; PAM sequence: TGG
ctccacaaagagcaaaaaga

SEQ ID NO: 144888 - DNA, 20 bp, Artificial Sequence
  Description of Artificial Sequence: Synthetic oligonucleotide
  Target: ATXN1; (+) strand; PAM type: NRG; PAM sequence: GGG
tccacaaagagcaaaaagat

SEQ ID NO: 144889 - DNA, 20 bp, Artificial Sequence
  Description of Artificial Sequence: Synthetic oligonucleotide
  Target: ATXN1; (+) strand; PAM type: NRG; PAM sequence: GGG
ccacaaagagcaaaaagatg

SEQ ID NO: 144890 - DNA, 20 bp, Artificial Sequence
  Description of Artificial Sequence: Synthetic oligonucleotide
  Target: ATXN1; (+) strand; PAM type: NRG; PAM sequence: TAG
atggggatacaaaacttgta

SEQ ID NO: 144891 - DNA, 20 bp, Artificial Sequence
  Description of Artificial Sequence: Synthetic oligonucleotide
  Target: ATXN1; (+) strand; PAM type: NRG; PAM sequence: TAG
gggatacaaaacttgtatag

SEQ ID NO: 144892 - DNA, 20 bp, Artificial Sequence
  Description of Artificial Sequence: Synthetic oligonucleotide
  Target: ATXN1; (+) strand; PAM type: NRG; PAM sequence: AAG
tatagtagaattttttttcc

SEQ ID NO: 144893 - DNA, 20 bp, Artificial Sequence
  Description of Artificial Sequence: Synthetic oligonucleotide
  Target: ATXN1; (+) strand; PAM type: NRG; PAM sequence: CAG
gtatcttgcttcattcacac

SEQ ID NO: 144894 - DNA, 20 bp, Artificial Sequence
  Description of Artificial Sequence: Synthetic oligonucleotide
  Target: ATXN1; (+) strand; PAM type: NRG; PAM sequence: AAG
tgcttcattcacaccagaaa

SEQ ID NO: 144895 - DNA, 20 bp, Artificial Sequence
  Description of Artificial Sequence: Synthetic oligonucleotide
  Target: ATXN1; (+) strand; PAM type: NRG; PAM sequence: AAG
atttgtgccgttgtctgctg

SEQ ID NO: 144896 - DNA, 20 bp, Artificial Sequence
  Description of Artificial Sequence: Synthetic oligonucleotide
  Target: ATXN1; (+) strand; PAM type: NRG; PAM sequence: AGG
tttgtgccgttgtctgctga

SEQ ID NO: 144897 - DNA, 20 bp, Artificial Sequence
  Description of Artificial Sequence: Synthetic oligonucleotide
  Target: ATXN1; (+) strand; PAM type: NRG; PAM sequence: TAG
tgccgttgtctgctgaaggt

SEQ ID NO: 144898 - DNA, 20 bp, Artificial Sequence
  Description of Artificial Sequence: Synthetic oligonucleotide
  Target: ATXN1; (+) strand; PAM type: NRG; PAM sequence: AAG
acatgaacatttgtcctttc

SEQ ID NO: 144899 - DNA, 20 bp, Artificial Sequence
  Description of Artificial Sequence: Synthetic oligonucleotide
  Target: ATXN1; (+) strand; PAM type: NRG; PAM sequence: CAG
tgaacatttgtcctttcaag

SEQ ID NO: 144900 - DNA, 20 bp, Artificial Sequence
  Description of Artificial Sequence: Synthetic oligonucleotide
  Target: ATXN1; (+) strand; PAM type: NRG; PAM sequence: AAG
caagcagctaattccttttt

SEQ ID NO: 144901 - DNA, 20 bp, Artificial Sequence
  Description of Artificial Sequence: Synthetic oligonucleotide
  Target: ATXN1; (+) strand; PAM type: NRG; PAM sequence: CAG
gcagctaattcctttttaag

SEQ ID NO: 144902 - DNA, 20 bp, Artificial Sequence
  Description of Artificial Sequence: Synthetic oligonucleotide
  Target: ATXN1; (+) strand; PAM type: NRG; PAM sequence: CGG
atgttcacctatgtctttca

SEQ ID NO: 144903 - DNA, 20 bp, Artificial Sequence
  Description of Artificial Sequence: Synthetic oligonucleotide
  Target: ATXN1; (+) strand; PAM type: NRG; PAM sequence: GGG
tgttcacctatgtctttcac

SEQ ID NO: 144904 - DNA, 20 bp, Artificial Sequence
  Description of Artificial Sequence: Synthetic oligonucleotide
  Target: ATXN1; (+) strand; PAM type: NRG; PAM sequence: AAG
ggatgactaattgtgaatgt

SEQ ID NO: 144905 - DNA, 20 bp, Artificial Sequence
  Description of Artificial Sequence: Synthetic oligonucleotide
  Target: ATXN1; (+) strand; PAM type: NRG; PAM sequence: AAG
gactaattgtgaatgtaagc

SEQ ID NO: 144906 - DNA, 20 bp, Artificial Sequence
  Description of Artificial Sequence: Synthetic oligonucleotide
  Target: ATXN1; (+) strand; PAM type: NRG; PAM sequence: CAG
gcaagacaactgatgaaatt

SEQ ID NO: 144907 - DNA, 20 bp, Artificial Sequence
  Description of Artificial Sequence: Synthetic oligonucleotide
  Target: ATXN1; (+) strand; PAM type: NRG; PAM sequence: CAG
taccctattttctatattta

SEQ ID NO: 144908 - DNA, 20 bp, Artificial Sequence
  Description of Artificial Sequence: Synthetic oligonucleotide
  Target: ATXN1; (+) strand; PAM type: NRG; PAM sequence: TGG
tgcaacttaaaaaaattaaa

SEQ ID NO: 144909 - DNA, 20 bp, Artificial Sequence
  Description of Artificial Sequence: Synthetic oligonucleotide
  Target: ATXN1; (+) strand; PAM type: NRG; PAM sequence: AAG
aaattaaatggtcatctgaa

SEQ ID NO: 144910 - DNA, 20 bp, Artificial Sequence
  Description of Artificial Sequence: Synthetic oligonucleotide
  Target: ATXN1; (+) strand; PAM type: NRG; PAM sequence: TGG
atggtcatctgaaaagtgtt

SEQ ID NO: 144911 - DNA, 20 bp, Artificial Sequence
  Description of Artificial Sequence: Synthetic oligonucleotide
  Target: ATXN1; (+) strand; PAM type: NRG; PAM sequence: GAG
agtgtttggtgcactcgaat

SEQ ID NO: 144912 - DNA, 20 bp, Artificial Sequence
  Description of Artificial Sequence: Synthetic oligonucleotide
  Target: ATXN1; (+) strand; PAM type: NRG; PAM sequence: CAG
ttttttcttgcaacttttat

SEQ ID NO: 144913 - DNA, 20 bp, Artificial Sequence
  Description of Artificial Sequence: Synthetic oligonucleotide
  Target: ATXN1; (+) strand; PAM type: NRG; PAM sequence: AGG
tttttcttgcaacttttatc

SEQ ID NO: 144914 - DNA, 20 bp, Artificial Sequence
  Description of Artificial Sequence: Synthetic oligonucleotide
  Target: ATXN1; (+) strand; PAM type: NRG; PAM sequence: GGG
ttttcttgcaacttttatca

SEQ ID NO: 144915 - DNA, 20 bp, Artificial Sequence
  Description of Artificial Sequence: Synthetic oligonucleotide
  Target: ATXN1; (+) strand; PAM type: NRG; PAM sequence: GGG
tttcttgcaacttttatcag

SEQ ID NO: 144916 - DNA, 20 bp, Artificial Sequence
  Description of Artificial Sequence: Synthetic oligonucleotide
  Target: ATXN1; (+) strand; PAM type: NRG; PAM sequence: TAG
tgcctaaaaacttgctgctc

SEQ ID NO: 144917 - DNA, 20 bp, Artificial Sequence
  Description of Artificial Sequence: Synthetic oligonucleotide
  Target: ATXN1; (+) strand; PAM type: NRG; PAM sequence: TAG
tgctctagccaaaatgtttt

SEQ ID NO: 144918 - DNA, 20 bp, Artificial Sequence
  Description of Artificial Sequence: Synthetic oligonucleotide
  Target: ATXN1; (+) strand; PAM type: NRG; PAM sequence: TAG
atgtttttagcacaaaattc

SEQ ID NO: 144919 - DNA, 20 bp, Artificial Sequence
  Description of Artificial Sequence: Synthetic oligonucleotide
  Target: ATXN1; (+) strand; PAM type: NRG; PAM sequence: CAG
caaaattctagcaataacct

SEQ ID NO: 144920 - DNA, 20 bp, Artificial Sequence
  Description of Artificial Sequence: Synthetic oligonucleotide
  Target: ATXN1; (+) strand; PAM type: NRG; PAM sequence: GAG
aaattctagcaataacctca

SEQ ID NO: 144921 - DNA, 20 bp, Artificial Sequence
  Description of Artificial Sequence: Synthetic oligonucleotide
  Target: ATXN1; (+) strand; PAM type: NRG; PAM sequence: AAG
ctttgccacttaattttacc

SEQ ID NO: 144922 - DNA, 20 bp, Artificial Sequence
  Description of Artificial Sequence: Synthetic oligonucleotide
  Target: ATXN1; (+) strand; PAM type: NRG; PAM sequence: GAG
ttgccacttaattttaccaa

SEQ ID NO: 144923 - DNA, 20 bp, Artificial Sequence
  Description of Artificial Sequence: Synthetic oligonucleotide
  Target: ATXN1; (+) strand; PAM type: NRG; PAM sequence: AAG
ttaattttaccaagagcaaa

SEQ ID NO: 144924 - DNA, 20 bp, Artificial Sequence
  Description of Artificial Sequence: Synthetic oligonucleotide
  Target: ATXN1; (+) strand; PAM type: NRG; PAM sequence: AAG
attttaccaagagcaaaaag

SEQ ID NO: 144925 - DNA, 20 bp, Artificial Sequence
  Description of Artificial Sequence: Synthetic oligonucleotide
  Target: ATXN1; (+) strand; PAM type: NRG; PAM sequence: AGG
ttttaccaagagcaaaaaga

SEQ ID NO: 144926 - DNA, 20 bp, Artificial Sequence
  Description of Artificial Sequence: Synthetic oligonucleotide
  Target: ATXN1; (+) strand; PAM type: NRG; PAM sequence: GGG
tttaccaagagcaaaaagaa

SEQ ID NO: 144927 - DNA, 20 bp, Artificial Sequence
  Description of Artificial Sequence: Synthetic oligonucleotide
  Target: ATXN1; (+) strand; PAM type: NRG; PAM sequence: AAG
agcaaaaagaagggaaaaaa

SEQ ID NO: 144928 - DNA, 20 bp, Artificial Sequence
  Description of Artificial Sequence: Synthetic oligonucleotide
  Target: ATXN1; (+) strand; PAM type: NRG; PAM sequence: TGG
ctcttcattttgccattgca

SEQ ID NO: 144929 - DNA, 20 bp, Artificial Sequence
  Description of Artificial Sequence: Synthetic oligonucleotide
  Target: ATXN1; (+) strand; PAM type: NRG; PAM sequence: TGG
acattaacttaactcttcta

SEQ ID NO: 144930 - DNA, 20 bp, Artificial Sequence
  Description of Artificial Sequence: Synthetic oligonucleotide
  Target: ATXN1; (+) strand; PAM type: NRG; PAM sequence: CAG
ttaacttaactcttctatgg

SEQ ID NO: 144931 - DNA, 20 bp, Artificial Sequence
  Description of Artificial Sequence: Synthetic oligonucleotide
  Target: ATXN1; (+) strand; PAM type: NRG; PAM sequence: AAG
tatgtccaatgccaatgttt

SEQ ID NO: 144932 - DNA, 20 bp, Artificial Sequence
  Description of Artificial Sequence: Synthetic oligonucleotide
  Target: ATXN1; (+) strand; PAM type: NRG; PAM sequence: TAG
gccaatgtttaagttacttt

SEQ ID NO: 144933 - DNA, 20 bp, Artificial Sequence
  Description of Artificial Sequence: Synthetic oligonucleotide
  Target: ATXN1; (+) strand; PAM type: NRG; PAM sequence: AGG
ccaatgtttaagttactttt

SEQ ID NO: 144934 - DNA, 20 bp, Artificial Sequence
  Description of Artificial Sequence: Synthetic oligonucleotide
  Target: ATXN1; (+) strand; PAM type: NRG; PAM sequence: TGG
tttttcataatctgacttct

SEQ ID NO: 144935 - DNA, 20 bp, Artificial Sequence
  Description of Artificial Sequence: Synthetic oligonucleotide
  Target: ATXN1; (+) strand; PAM type: NRG; PAM sequence: GAG
attttaattcttttgatttt

SEQ ID NO: 144936 - DNA, 20 bp, Artificial Sequence
  Description of Artificial Sequence: Synthetic oligonucleotide
  Target: ATXN1; (+) strand; PAM type: NRG; PAM sequence: AAG
acatgtttgtaccaattcta

SEQ ID NO: 144937 - DNA, 20 bp, Artificial Sequence
  Description of Artificial Sequence: Synthetic oligonucleotide
  Target: ATXN1; (+) strand; PAM type: NRG; PAM sequence: CAG
ttgtaccaattctaaagtct

SEQ ID NO: 144938 - DNA, 20 bp, Artificial Sequence
  Description of Artificial Sequence: Synthetic oligonucleotide
  Target: ATXN1; (+) strand; PAM type: NRG; PAM sequence: CAG
agccaactattcaatatttt

SEQ ID NO: 144939 - DNA, 20 bp, Artificial Sequence
  Description of Artificial Sequence: Synthetic oligonucleotide
  Target: ATXN1; (+) strand; PAM type: NRG; PAM sequence: TAG
attcaatattttcagcgatt

SEQ ID NO: 144940 - DNA, 20 bp, Artificial Sequence
  Description of Artificial Sequence: Synthetic oligonucleotide
  Target: ATXN1; (+) strand; PAM type: NRG; PAM sequence: AGG
ttcaatattttcagcgattt

SEQ ID NO: 144941 - DNA, 20 bp, Artificial Sequence
  Description of Artificial Sequence: Synthetic oligonucleotide
  Target: ATXN1; (+) strand; PAM type: NRG; PAM sequence: TAG
ttcttactaacaatgccaca

SEQ ID NO: 144942 - DNA, 20 bp, Artificial Sequence
  Description of Artificial Sequence: Synthetic oligonucleotide
  Target: ATXN1; (+) strand; PAM type: NRG; PAM sequence: TAG
atttttattctatcttatat

SEQ ID NO: 144943 - DNA, 20 bp, Artificial Sequence
  Description of Artificial Sequence: Synthetic oligonucleotide
  Target: ATXN1; (+) strand; PAM type: NRG; PAM sequence: AAG
tttattctatcttatattag

SEQ ID NO: 144944 - DNA, 20 bp, Artificial Sequence
  Description of Artificial Sequence: Synthetic oligonucleotide
  Target: ATXN1; (+) strand; PAM type: NRG; PAM sequence: TGG
ttctatcttatattagaaga

SEQ ID NO: 144945 - DNA, 20 bp, Artificial Sequence
  Description of Artificial Sequence: Synthetic oligonucleotide
  Target: ATXN1; (+) strand; PAM type: NRG; PAM sequence: AAG
tatattagaagatggctttt

SEQ ID NO: 144946 - DNA, 20 bp, Artificial Sequence
  Description of Artificial Sequence: Synthetic oligonucleotide
  Target: ATXN1; (+) strand; PAM type: NRG; PAM sequence: CAG
gccaaaatgttattttctta

SEQ ID NO: 144947 - DNA, 20 bp, Artificial Sequence
  Description of Artificial Sequence: Synthetic oligonucleotide
  Target: ATXN1; (+) strand; PAM type: NRG; PAM sequence: TAG
aaatgttattttcttacagt

SEQ ID NO: 144948 - DNA, 20 bp, Artificial Sequence
  Description of Artificial Sequence: Synthetic oligonucleotide
  Target: ATXN1; (+) strand; PAM type: NRG; PAM sequence: CAG
agtttgatatgctatgctca

SEQ ID NO: 144949 - DNA, 20 bp, Artificial Sequence
  Description of Artificial Sequence: Synthetic oligonucleotide
  Target: ATXN1; (+) strand; PAM type: NRG; PAM sequence: GAG
tttgatatgctatgctcaca

SEQ ID NO: 144950 - DNA, 20 bp, Artificial Sequence
  Description of Artificial Sequence: Synthetic oligonucleotide
  Target: ATXN1; (+) strand; PAM type: NRG; PAM sequence: TGG
tgctatgctcacagagaacc

SEQ ID NO: 144951 - DNA, 20 bp, Artificial Sequence
  Description of Artificial Sequence: Synthetic oligonucleotide
  Target: ATXN1; (+) strand; PAM type: NRG; PAM sequence: TGG
cagagaacctggctgtcttt

SEQ ID NO: 144952 - DNA, 20 bp, Artificial Sequence
  Description of Artificial Sequence: Synthetic oligonucleotide
  Target: ATXN1; (+) strand; PAM type: NRG; PAM sequence: TGG
gaacctggctgtcttttggc

SEQ ID NO: 144953 - DNA, 20 bp, Artificial Sequence
  Description of Artificial Sequence: Synthetic oligonucleotide
  Target: ATXN1; (+) strand; PAM type: NRG; PAM sequence: GGG
aacctggctgtcttttggct

SEQ ID NO: 144954 - DNA, 20 bp, Artificial Sequence
  Description of Artificial Sequence: Synthetic oligonucleotide
  Target: ATXN1; (+) strand; PAM type: NRG; PAM sequence: CAG
tcttttggctgggatgttcc

SEQ ID NO: 144955 - DNA, 20 bp, Artificial Sequence
  Description of Artificial Sequence: Synthetic oligonucleotide
  Target: ATXN1; (+) strand; PAM type: NRG; PAM sequence: GAG
ggatgttcccagctaaaaat

SEQ ID NO: 144956 - DNA, 20 bp, Artificial Sequence
  Description of Artificial Sequence: Synthetic oligonucleotide
  Target: ATXN1; (+) strand; PAM type: NRG; PAM sequence: CAG
cccagctaaaaatgagaaat

SEQ ID NO: 144957 - DNA, 20 bp, Artificial Sequence
  Description of Artificial Sequence: Synthetic oligonucleotide
  Target: ATXN1; (+) strand; PAM type: NRG; PAM sequence: GAG
cagctaaaaatgagaaatca

SEQ ID NO: 144958 - DNA, 20 bp, Artificial Sequence
  Description of Artificial Sequence: Synthetic oligonucleotide
  Target: ATXN1; (+) strand; PAM type: NRG; PAM sequence: CAG
taaaaatgagaaatcagaga

SEQ ID NO: 144959 - DNA, 20 bp, Artificial Sequence
  Description of Artificial Sequence: Synthetic oligonucleotide
  Target: ATXN1; (+) strand; PAM type: NRG; PAM sequence: AAG
aatgagaaatcagagacaga

SEQ ID NO: 144960 - DNA, 20 bp, Artificial Sequence
  Description of Artificial Sequence: Synthetic oligonucleotide
  Target: ATXN1; (+) strand; PAM type: NRG; PAM sequence: GAG
gaaatcagagacagaaagct

SEQ ID NO: 144961 - DNA, 20 bp, Artificial Sequence
  Description of Artificial Sequence: Synthetic oligonucleotide
  Target: ATXN1; (+) strand; PAM type: NRG; PAM sequence: TAG
atcagagacagaaagctgag

SEQ ID NO: 144962 - DNA, 20 bp, Artificial Sequence
  Description of Artificial Sequence: Synthetic oligonucleotide
  Target: ATXN1; (+) strand; PAM type: NRG; PAM sequence: AGG
tcagagacagaaagctgagt

SEQ ID NO: 144963 - DNA, 20 bp, Artificial Sequence
  Description of Artificial Sequence: Synthetic oligonucleotide
  Target: ATXN1; (+) strand; PAM type: NRG; PAM sequence: TAG
cagaaagctgagtaggaaca

SEQ ID NO: 144964 - DNA, 20 bp, Artificial Sequence
  Description of Artificial Sequence: Synthetic oligonucleotide
  Target: ATXN1; (+) strand; PAM type: NRG; PAM sequence: AGG
agaaagctgagtaggaacat

SEQ ID NO: 144965 - DNA, 20 bp, Artificial Sequence
  Description of Artificial Sequence: Synthetic oligonucleotide
  Target: ATXN1; (+) strand; PAM type: NRG; PAM sequence: TGG
ctgagtaggaacataggatg

SEQ ID NO: 144966 - DNA, 20 bp, Artificial Sequence
  Description of Artificial Sequence: Synthetic oligonucleotide
  Target: ATXN1; (+) strand; PAM type: NRG; PAM sequence: AAG
ggaacataggatgtggaatt

SEQ ID NO: 144967 - DNA, 20 bp, Artificial Sequence
  Description of Artificial Sequence: Synthetic oligonucleotide
  Target: ATXN1; (+) strand; PAM type: NRG; PAM sequence: TAG
ggaattaagattgaccttta

SEQ ID NO: 144968 - DNA, 20 bp, Artificial Sequence
  Description of Artificial Sequence: Synthetic oligonucleotide
  Target: ATXN1; (+) strand; PAM type: NRG; PAM sequence: AAG
agaatatttttatcattcct

SEQ ID NO: 144969 - DNA, 20 bp, Artificial Sequence
  Description of Artificial Sequence: Synthetic oligonucleotide
  Target: ATXN1; (+) strand; PAM type: NRG; PAM sequence: GAG
aatatttttatcattcctaa

SEQ ID NO: 144970 - DNA, 20 bp, Artificial Sequence
  Description of Artificial Sequence: Synthetic oligonucleotide
  Target: ATXN1; (+) strand; PAM type: NRG; PAM sequence: TGG
ttttatcattcctaagagat

SEQ ID NO: 144971 - DNA, 20 bp, Artificial Sequence
  Description of Artificial Sequence: Synthetic oligonucleotide
  Target: ATXN1; (+) strand; PAM type: NRG; PAM sequence: CAG
tcctaagagattggaatatt

SEQ ID NO: 144972 - DNA, 20 bp, Artificial Sequence
  Description of Artificial Sequence: Synthetic oligonucleotide
  Target: ATXN1; (+) strand; PAM type: NRG; PAM sequence: AAG
taattttctgatttaaatat

SEQ ID NO: 144973 - DNA, 20 bp, Artificial Sequence
  Description of Artificial Sequence: Synthetic oligonucleotide
  Target: ATXN1; (+) strand; PAM type: NRG; PAM sequence: TAG
ttttctgatttaaatataag

SEQ ID NO: 144974 - DNA, 20 bp, Artificial Sequence
  Description of Artificial Sequence: Synthetic oligonucleotide
  Target: ATXN1; (+) strand; PAM type: NRG; PAM sequence: AAG
tttcaccaaaaaaaatgttt

SEQ ID NO: 144975 - DNA, 20 bp, Artificial Sequence
  Description of Artificial Sequence: Synthetic oligonucleotide
  Target: ATXN1; (+) strand; PAM type: NRG; PAM sequence: AAG
tgtttaagttaatttatcaa

SEQ ID NO: 144976 - DNA, 20 bp, Artificial Sequence
  Description of Artificial Sequence: Synthetic oligonucleotide
  Target: ATXN1; (+) strand; PAM type: NRG; PAM sequence: AGG
gtttaagttaatttatcaaa

SEQ ID NO: 144977 - DNA, 20 bp, Artificial Sequence
  Description of Artificial Sequence: Synthetic oligonucleotide
  Target: ATXN1; (+) strand; PAM type: NRG; PAM sequence: AAG
taagttaatttatcaaaagg

SEQ ID NO: 144978 - DNA, 20 bp, Artificial Sequence
  Description of Artificial Sequence: Synthetic oligonucleotide
  Target: ATXN1; (+) strand; PAM type: NRG; PAM sequence: AGG
aagttaatttatcaaaagga

SEQ ID NO: 144979 - DNA, 20 bp, Artificial Sequence
  Description of Artificial Sequence: Synthetic oligonucleotide
  Target: ATXN1; (+) strand; PAM type: NRG; PAM sequence: CAG
ttaatttatcaaaaggaagg

SEQ ID NO: 144980 - DNA, 20 bp, Artificial Sequence
  Description of Artificial Sequence: Synthetic oligonucleotide
  Target: ATXN1; (+) strand; PAM type: NRG; PAM sequence: AGG
taatttatcaaaaggaaggc

SEQ ID NO: 144981 - DNA, 20 bp, Artificial Sequence
  Description of Artificial Sequence: Synthetic oligonucleotide
  Target: ATXN1; (+) strand; PAM type: NRG; PAM sequence: GGG
aatttatcaaaaggaaggca

SEQ ID NO: 144982 - DNA, 20 bp, Artificial Sequence
  Description of Artificial Sequence: Synthetic oligonucleotide
  Target: ATXN1; (+) strand; PAM type: NRG; PAM sequence: AAG
tatcaaaaggaaggcaggga

SEQ ID NO: 144983 - DNA, 20 bp, Artificial Sequence
  Description of Artificial Sequence: Synthetic oligonucleotide
  Target: ATXN1; (+) strand; PAM type: NRG; PAM sequence: GAG
tcaaaaggaaggcagggaaa

SEQ ID NO: 144984 - DNA, 20 bp, Artificial Sequence
  Description of Artificial Sequence: Synthetic oligonucleotide
  Target: ATXN1; (+) strand; PAM type: NRG; PAM sequence: AAG
ggaaggcagggaaagagaaa

SEQ ID NO: 144985 - DNA, 20 bp, Artificial Sequence
  Description of Artificial Sequence: Synthetic oligonucleotide
  Target: ATXN1; (+) strand; PAM type: NRG; PAM sequence: AAG
ggcagggaaagagaaaaaga

SEQ ID NO: 144986 - DNA, 20 bp, Artificial Sequence
  Description of Artificial Sequence: Synthetic oligonucleotide
  Target: ATXN1; (+) strand; PAM type: NRG; PAM sequence: AGG
gcagggaaagagaaaaagaa

SEQ ID NO: 144987 - DNA, 20 bp, Artificial Sequence
  Description of Artificial Sequence: Synthetic oligonucleotide
  Target: ATXN1; (+) strand; PAM type: NRG; PAM sequence: GAG
agggaaagagaaaaagaaag

SEQ ID NO: 144988 - DNA, 20 bp, Artificial Sequence
  Description of Artificial Sequence: Synthetic oligonucleotide
  Target: ATXN1; (+) strand; PAM type: NRG; PAM sequence: AAG
aagagaaaaagaaaggagtg

SEQ ID NO: 144989 - DNA, 20 bp, Artificial Sequence
  Description of Artificial Sequence: Synthetic oligonucleotide
  Target: ATXN1; (+) strand; PAM type: NRG; PAM sequence: AGG
agagaaaaagaaaggagtga

SEQ ID NO: 144990 - DNA, 20 bp, Artificial Sequence
  Description of Artificial Sequence: Synthetic oligonucleotide
  Target: ATXN1; (+) strand; PAM type: NRG; PAM sequence: GGG
gagaaaaagaaaggagtgaa

SEQ ID NO: 144991 - DNA, 20 bp, Artificial Sequence
  Description of Artificial Sequence: Synthetic oligonucleotide
  Target: ATXN1; (+) strand; PAM type: NRG; PAM sequence: GGG
agaaaaagaaaggagtgaag

SEQ ID NO: 144992 - DNA, 20 bp, Artificial Sequence
  Description of Artificial Sequence: Synthetic oligonucleotide
  Target: ATXN1; (+) strand; PAM type: NRG; PAM sequence: TGG
aaagaaaggagtgaaggggc

SEQ ID NO: 144993 - DNA, 20 bp, Artificial Sequence
  Description of Artificial Sequence: Synthetic oligonucleotide
  Target: ATXN1; (+) strand; PAM type: NRG; PAM sequence: GGG
aagaaaggagtgaaggggct

SEQ ID NO: 144994 - DNA, 20 bp, Artificial Sequence
  Description of Artificial Sequence: Synthetic oligonucleotide
  Target: ATXN1; (+) strand; PAM type: NRG; PAM sequence: CGG
aggagtgaaggggctgggtg

SEQ ID NO: 144995 - DNA, 20 bp, Artificial Sequence
  Description of Artificial Sequence: Synthetic oligonucleotide
  Target: ATXN1; (+) strand; PAM type: NRG; PAM sequence: TGG
agtgaaggggctgggtgcgg

SEQ ID NO: 144996 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 144997 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 144998 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 144999 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 145000 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 145001 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 145002 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 145003 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggccgagg

SEQ ID NO: 145004 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccgaggc

SEQ ID NO: 145005 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccgaggcggg

SEQ ID NO: 145006 - DNA, 20 bp, Artificial Sequence
  Description of Artificial Sequence: Synthetic oligonucleotide
  Target: ATXN1; (+) strand; PAM type: NRG; PAM sequence: GAG
ccgaggcgggtggatcacct

SEQ ID NO: 145007 - DNA, 20 bp, Artificial Sequence
  Description of Artificial Sequence: Synthetic oligonucleotide
  Target: ATXN1; (+) strand; PAM type: NRG; PAM sequence: AGG
cgaggcgggtggatcacctg

SEQ ID NO: 145008 - DNA, 20 bp, Artificial Sequence
  Description of Artificial Sequence: Synthetic oligonucleotide
  Target: ATXN1; (+) strand; PAM type: NRG; PAM sequence: CAG
gcgggtggatcacctgaggt

SEQ ID NO: 145009 - DNA, 20 bp, Artificial Sequence
  Description of Artificial Sequence: Synthetic oligonucleotide
  Target: ATXN1; (+) strand; PAM type: NRG; PAM sequence: AGG
cgggtggatcacctgaggtc

SEQ ID NO: 145010 - DNA, 20 bp, Artificial Sequence
  Description of Artificial Sequence: Synthetic oligonucleotide
  Target: ATXN1; (+) strand; PAM type: NRG; PAM sequence: GAG
ggtggatcacctgaggtcag

SEQ ID NO: 145011 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtcaggagttc

SEQ ID NO: 145012 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcgagac

SEQ ID NO: 145013 - DNA, 20 bp, Artificial Sequence
  Description of Artificial Sequence: Synthetic oligonucleotide
  Target: ATXN1; (+) strand; PAM type: NRG; PAM sequence: TGG
cgagaccagcctgaccaaca

SEQ ID NO: 145014 - DNA, 20 bp, Artificial Sequence
  Description of Artificial Sequence: Synthetic oligonucleotide
  Target: ATXN1; (+) strand; PAM type: NRG; PAM sequence: TAG
tctacaaaaacatacaaaat

SEQ ID NO: 145015 - DNA, 20 bp, Artificial Sequence
  Description of Artificial Sequence: Synthetic oligonucleotide
  Target: ATXN1; (+) strand; PAM type: NRG; PAM sequence: TGG
caaaaacatacaaaattagc

SEQ ID NO: 145016 - DNA, 20 bp, Artificial Sequence
  Description of Artificial Sequence: Synthetic oligonucleotide
  Target: ATXN1; (+) strand; PAM type: NRG; PAM sequence: TGG
catacaaaattagctggctg

SEQ ID NO: 145017 - DNA, 20 bp, Artificial Sequence
  Description of Artificial Sequence: Synthetic oligonucleotide
  Target: ATXN1; (+) strand; PAM type: NRG; PAM sequence: TGG
acaaaattagctggctgtgg

SEQ ID NO: 145018 - DNA, 20 bp, Artificial Sequence
  Description of Artificial Sequence: Synthetic oligonucleotide
  Target: ATXN1; (+) strand; PAM type: NRG; PAM sequence: GAG
aaaattagctggctgtggtg

SEQ ID NO: 145019 - DNA, 20 bp, Artificial Sequence
  Description of Artificial Sequence: Synthetic oligonucleotide
  Target: ATXN1; (+) strand; PAM type: NRG; PAM sequence: CAG
gtggagcatgcctataatcc

SEQ ID NO: 145020 - DNA, 20 bp, Artificial Sequence
  Description of Artificial Sequence: Synthetic oligonucleotide
  Target: ATXN1; (+) strand; PAM type: NRG; PAM sequence: TGG
tgcctataatcccagctact

SEQ ID NO: 145021 - DNA, 20 bp, Artificial Sequence
  Description of Artificial Sequence: Synthetic oligonucleotide
  Target: ATXN1; (+) strand; PAM type: NRG; PAM sequence: GGG
gcctataatcccagctactt

SEQ ID NO: 145022 - DNA, 20 bp, Artificial Sequence
  Description of Artificial Sequence: Synthetic oligonucleotide
  Target: ATXN1; (+) strand; PAM type: NRG; PAM sequence: GAG
ctataatcccagctacttgg

SEQ ID NO: 145023 - DNA, 20 bp, Artificial Sequence
  Description of Artificial Sequence: Synthetic oligonucleotide
  Target: ATXN1; (+) strand; PAM type: NRG; PAM sequence: AGG
tataatcccagctacttggg

SEQ ID NO: 145024 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 145025 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggctg

SEQ ID NO: 145026 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgagg

SEQ ID NO: 145027 - DNA, 20 bp, Artificial Sequence
  Description of Artificial Sequence: Synthetic oligonucleotide
  Target: ATXN1; (+) strand; PAM type: NRG; PAM sequence: TAG
tacttgggaggctgaggcag

SEQ ID NO: 145028 - DNA, 20 bp, Artificial Sequence
  Description of Artificial Sequence: Synthetic oligonucleotide
  Target: ATXN1; (+) strand; PAM type: NRG; PAM sequence: GAG
cagtagaatcgcttgaactc

SEQ ID NO: 145029 - DNA, 20 bp, Artificial Sequence
  Description of Artificial Sequence: Synthetic oligonucleotide
  Target: ATXN1; (+) strand; PAM type: NRG; PAM sequence: GAG
gtagaatcgcttgaactcga

SEQ ID NO: 145030 - DNA, 20 bp, Artificial Sequence
  Description of Artificial Sequence: Synthetic oligonucleotide
  Target: ATXN1; (+) strand; PAM type: NRG; PAM sequence: CAG
aatcgcttgaactcgagaga

SEQ ID NO: 145031 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaactcgagagaca

SEQ ID NO: 145032 - DNA, 20 bp, Artificial Sequence
  Description of Artificial Sequence: Synthetic oligonucleotide
  Target: ATXN1; (+) strand; PAM type: NRG; PAM sequence: AGG
cgcttgaactcgagagacag

SEQ ID NO: 145033 - DNA, 20 bp, Artificial Sequence
  Description of Artificial Sequence: Synthetic oligonucleotide
  Target: ATXN1; (+) strand; PAM type: NRG; PAM sequence: CGG
aactcgagagacagaggttg

SEQ ID NO: 145034 - DNA, 20 bp, Artificial Sequence
  Description of Artificial Sequence: Synthetic oligonucleotide
  Target: ATXN1; (+) strand; PAM type: NRG; PAM sequence: AAG
cgagagacagaggttgcggt

SEQ ID NO: 145035 - DNA, 20 bp, Artificial Sequence
  Description of Artificial Sequence: Synthetic oligonucleotide
  Target: ATXN1; (+) strand; PAM type: NRG; PAM sequence: GAG
gacagaggttgcggtaagcc

SEQ ID NO: 145036 - DNA, 20 bp, Artificial Sequence
  Description of Artificial Sequence: Synthetic oligonucleotide
  Target: ATXN1; (+) strand; PAM type: NRG; PAM sequence: CAG
gagatcacgccactgcaccc

SEQ ID NO: 145037 - DNA, 20 bp, Artificial Sequence
  Description of Artificial Sequence: Synthetic oligonucleotide
  Target: ATXN1; (+) strand; PAM type: NRG; PAM sequence: TGG
cacgccactgcaccccagcc

SEQ ID NO: 145038 - DNA, 20 bp, Artificial Sequence
  Description of Artificial Sequence: Synthetic oligonucleotide
  Target: ATXN1; (+) strand; PAM type: NRG; PAM sequence: GGG
acgccactgcaccccagcct

SEQ ID NO: 145039 - DNA, 20 bp, Artificial Sequence
  Description of Artificial Sequence: Synthetic oligonucleotide
  Target: ATXN1; (+) strand; PAM type: NRG; PAM sequence: AAG
tgcaccccagcctgggcaac

SEQ ID NO: 145040 - DNA, 20 bp, Artificial Sequence
  Description of Artificial Sequence: Synthetic oligonucleotide
  Target: ATXN1; (+) strand; PAM type: NRG; PAM sequence: GAG
caccccagcctgggcaacaa

SEQ ID NO: 145041 - DNA, 20 bp, Artificial Sequence
  Description of Artificial Sequence: Synthetic oligonucleotide
  Target: ATXN1; (+) strand; PAM type: NRG; PAM sequence: AAG
ctccatctcaaaaaaaaaaa

SEQ ID NO: 145042 - DNA, 20 bp, Artificial Sequence
  Description of Artificial Sequence: Synthetic oligonucleotide
  Target: ATXN1; (+) strand; PAM type: NRG; PAM sequence: AAG
atctcaaaaaaaaaaaaaga

SEQ ID NO: 145043 - DNA, 20 bp, Artificial Sequence
  Description of Artificial Sequence: Synthetic oligonucleotide
  Target: ATXN1; (+) strand; PAM type: NRG; PAM sequence: AGG
tctcaaaaaaaaaaaaagaa

SEQ ID NO: 145044 - DNA, 20 bp, Artificial Sequence
  Description of Artificial Sequence: Synthetic oligonucleotide
  Target: ATXN1; (+) strand; PAM type: NRG; PAM sequence: GAG
tcaaaaaaaaaaaaagaaag

SEQ ID NO: 145045 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaagaaaggagtga

SEQ ID NO: 145046 - DNA, 20 bp, Artificial Sequence
  Description of Artificial Sequence: Synthetic oligonucleotide
  Target: ATXN1; (+) strand; PAM type: NRG; PAM sequence: AAG
aaaaaagaaaggagtgatgg

SEQ ID NO: 145047 - DNA, 20 bp, Artificial Sequence
  Description of Artificial Sequence: Synthetic oligonucleotide
  Target: ATXN1; (+) strand; PAM type: NRG; PAM sequence: AAG
agaaaggagtgatggaagaa

SEQ ID NO: 145048 - DNA, 20 bp, Artificial Sequence
  Description of Artificial Sequence: Synthetic oligonucleotide
  Target: ATXN1; (+) strand; PAM type: NRG; PAM sequence: TGG
aggagtgatggaagaaaaga

SEQ ID NO: 145049 - DNA, 20 bp, Artificial Sequence
  Description of Artificial Sequence: Synthetic oligonucleotide
  Target: ATXN1; (+) strand; PAM type: NRG; PAM sequence: TGG
gtgatggaagaaaagatgga

SEQ ID NO: 145050 - DNA, 20 bp, Artificial Sequence
  Description of Artificial Sequence: Synthetic oligonucleotide
  Target: ATXN1; (+) strand; PAM type: NRG; PAM sequence: TGG
tggaagaaaagatggatgga

SEQ ID NO: 145051 - DNA, 20 bp, Artificial Sequence
  Description of Artificial Sequence: Synthetic oligonucleotide
  Target: ATXN1; (+) strand; PAM type: NRG; PAM sequence: TAG
aagatggatggatggatgaa

SEQ ID NO: 145052 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatgaataga

SEQ ID NO: 145053 - DNA, 20 bp, Artificial Sequence
  Description of Artificial Sequence: Synthetic oligonucleotide
  Target: ATXN1; (+) strand; PAM type: NRG; PAM sequence: TGG
tggatggatgaatagatgga

SEQ ID NO: 145054 - DNA, 20 bp, Artificial Sequence
  Description of Artificial Sequence: Synthetic oligonucleotide
  Target: ATXN1; (+) strand; PAM type: NRG; PAM sequence: TAG
tggatgaatagatggatgga

SEQ ID NO: 145055 - DNA, 20 bp, Artificial Sequence
  Description of Artificial Sequence: Synthetic oligonucleotide
  Target: ATXN1; (+) strand; PAM type: NRG; PAM sequence: AGG
ggatgaatagatggatggat

SEQ ID NO: 145056 - DNA, 20 bp, Artificial Sequence
  Description of Artificial Sequence: Synthetic oligonucleotide
  Target: ATXN1; (+) strand; PAM type: NRG; PAM sequence: TGG
tgaatagatggatggatagg

SEQ ID NO: 145057 - DNA, 20 bp, Artificial Sequence
  Description of Artificial Sequence: Synthetic oligonucleotide
  Target: ATXN1; (+) strand; PAM type: NRG; PAM sequence: GGG
gaatagatggatggataggt

SEQ ID NO: 145058 - DNA, 20 bp, Artificial Sequence
  Description of Artificial Sequence: Synthetic oligonucleotide
  Target: ATXN1; (+) strand; PAM type: NRG; PAM sequence: GAG
atagatggatggataggtgg

SEQ ID NO: 145059 - DNA, 20 bp, Artificial Sequence
  Description of Artificial Sequence: Synthetic oligonucleotide
  Target: ATXN1; (+) strand; PAM type: NRG; PAM sequence: AGG
tagatggatggataggtggg

SEQ ID NO: 145060 - DNA, 20 bp, Artificial Sequence
  Description of Artificial Sequence: Synthetic oligonucleotide
  Target: ATXN1; (+) strand; PAM type: NRG; PAM sequence: GGG
agatggatggataggtggga

SEQ ID NO: 145061 - DNA, 20 bp, Artificial Sequence
  Description of Artificial Sequence: Synthetic oligonucleotide
  Target: ATXN1; (+) strand; PAM type: NRG; PAM sequence: TGG
tggatggataggtgggaggg

SEQ ID NO: 145062 - DNA, 20 bp, Artificial Sequence
  Description of Artificial Sequence: Synthetic oligonucleotide
  Target: ATXN1; (+) strand; PAM type: NRG; PAM sequence: TGG
tggataggtgggagggtgga

SEQ ID NO: 145063 - DNA, 20 bp, Artificial Sequence
  Description of Artificial Sequence: Synthetic oligonucleotide
  Target: ATXN1; (+) strand; PAM type: NRG; PAM sequence: TGG
taggtgggagggtggatgga

SEQ ID NO: 145064 - DNA, 20 bp, Artificial Sequence
  Description of Artificial Sequence: Synthetic oligonucleotide
  Target: ATXN1; (+) strand; PAM type: NRG; PAM sequence: TAG
agggtggatggatggacaaa

SEQ ID NO: 145065 - DNA, 20 bp, Artificial Sequence
  Description of Artificial Sequence: Synthetic oligonucleotide
  Target: ATXN1; (+) strand; PAM type: NRG; PAM sequence: TAG
tggatggatggacaaataga

SEQ ID NO: 145066 - DNA, 20 bp, Artificial Sequence
  Description of Artificial Sequence: Synthetic oligonucleotide
  Target: ATXN1; (+) strand; PAM type: NRG; PAM sequence: TGG
tggatggacaaatagataga

SEQ ID NO: 145067 - DNA, 20 bp, Artificial Sequence
  Description of Artificial Sequence: Synthetic oligonucleotide
  Target: ATXN1; (+) strand; PAM type: NRG; PAM sequence: TGG
caaatagatagatggatgaa

SEQ ID NO: 145068 - DNA, 20 bp, Artificial Sequence
  Description of Artificial Sequence: Synthetic oligonucleotide
  Target: ATXN1; (+) strand; PAM type: NRG; PAM sequence: TGG
tagatagatggatgaatgga

SEQ ID NO: 145069 - DNA, 20 bp, Artificial Sequence
  Description of Artificial Sequence: Synthetic oligonucleotide
  Target: ATXN1; (+) strand; PAM type: NRG; PAM sequence: GGG
agatagatggatgaatggat

SEQ ID NO: 145070 - DNA, 20 bp, Artificial Sequence
  Description of Artificial Sequence: Synthetic oligonucleotide
  Target: ATXN1; (+) strand; PAM type: NRG; PAM sequence: TGG
tagatggatgaatggatggg

SEQ ID NO: 145071 - DNA, 20 bp, Artificial Sequence
  Description of Artificial Sequence: Synthetic oligonucleotide
  Target: ATXN1; (+) strand; PAM type: NRG; PAM sequence: TGG
tggatgaatggatgggtgga

SEQ ID NO: 145072 - DNA, 20 bp, Artificial Sequence
  Description of Artificial Sequence: Synthetic oligonucleotide
  Target: ATXN1; (+) strand; PAM type: NRG; PAM sequence: TAG
tggatgggtggatggatgaa

SEQ ID NO: 145073 - DNA, 20 bp, Artificial Sequence
  Description of Artificial Sequence: Synthetic oligonucleotide
  Target: ATXN1; (+) strand; PAM type: NRG; PAM sequence: TGG
tgggtggatggatgaataga

SEQ ID NO: 145074 - DNA, 20 bp, Artificial Sequence
  Description of Artificial Sequence: Synthetic oligonucleotide
  Target: ATXN1; (+) strand; PAM type: NRG; PAM sequence: TGG
tggatggatgaatagatgga

SEQ ID NO: 145075 - DNA, 20 bp, Artificial Sequence
  Description of Artificial Sequence: Synthetic oligonucleotide
  Target: ATXN1; (+) strand; PAM type: NRG; PAM sequence: AAG
atggatgaatagatggatgg

SEQ ID NO: 145076 - DNA, 20 bp, Artificial Sequence
  Description of Artificial Sequence: Synthetic oligonucleotide
  Target: ATXN1; (+) strand; PAM type: NRG; PAM sequence: AGG
tggatgaatagatggatgga

SEQ ID NO: 145077 - DNA, 20 bp, Artificial Sequence
  Description of Artificial Sequence: Synthetic oligonucleotide
  Target: ATXN1; (+) strand; PAM type: NRG; PAM sequence: TAG
tgaatagatggatggaagga

SEQ ID NO: 145078 - DNA, 20 bp, Artificial Sequence
  Description of Artificial Sequence: Synthetic oligonucleotide
  Target: ATXN1; (+) strand; PAM type: NRG; PAM sequence: TGG
tggatggaaggatagatgaa

SEQ ID NO: 145079 - DNA, 20 bp, Artificial Sequence
  Description of Artificial Sequence: Synthetic oligonucleotide
  Target: ATXN1; (+) strand; PAM type: NRG; PAM sequence: TGG
tggaaggatagatgaatgga

SEQ ID NO: 145080 - DNA, 20 bp, Artificial Sequence
  Description of Artificial Sequence: Synthetic oligonucleotide
  Target: ATXN1; (+) strand; PAM type: NRG; PAM sequence: GGG
ggaaggatagatgaatggat

SEQ ID NO: 145081 - DNA, 20 bp, Artificial Sequence
  Description of Artificial Sequence: Synthetic oligonucleotide
  Target: ATXN1; (+) strand; PAM type: NRG; PAM sequence: TGG
aggatagatgaatggatggg

SEQ ID NO: 145082 - DNA, 20 bp, Artificial Sequence
  Description of Artificial Sequence: Synthetic oligonucleotide
  Target: ATXN1; (+) strand; PAM type: NRG; PAM sequence: GGG
ggatagatgaatggatgggt

SEQ ID NO: 145083 - DNA, 20 bp, Artificial Sequence
  Description of Artificial Sequence: Synthetic oligonucleotide
  Target: ATXN1; (+) strand; PAM type: NRG; PAM sequence: TGG
tagatgaatggatgggtggg

SEQ ID NO: 145084 - DNA, 20 bp, Artificial Sequence
  Description of Artificial Sequence: Synthetic oligonucleotide
  Target: ATXN1; (+) strand; PAM type: NRG; PAM sequence: GGG
agatgaatggatgggtgggt

SEQ ID NO: 145085 - DNA, 20 bp, Artificial Sequence
  Description of Artificial Sequence: Synthetic oligonucleotide
  Target: ATXN1; (+) strand; PAM type: NRG; PAM sequence: TGG
tgaatggatgggtgggtggg

SEQ ID NO: 145086 - DNA, 20 bp, Artificial Sequence
  Description of Artificial Sequence: Synthetic oligonucleotide
  Target: ATXN1; (+) strand; PAM type: NRG; PAM sequence: CGG
tggatgggtgggtgggtgga

SEQ ID NO: 145087 - DNA, 20 bp, Artificial Sequence
  Description of Artificial Sequence: Synthetic oligonucleotide
  Target: ATXN1; (+) strand; PAM type: NRG; PAM sequence: TGG
tgggtgggtgggtggacgga

SEQ ID NO: 145088 - DNA, 20 bp, Artificial Sequence
  Description of Artificial Sequence: Synthetic oligonucleotide
  Target: ATXN1; (+) strand; PAM type: NRG; PAM sequence: GGG
gggtgggtgggtggacggat

SEQ ID NO: 145089 - DNA, 20 bp, Artificial Sequence
  Description of Artificial Sequence: Synthetic oligonucleotide
  Target: ATXN1; (+) strand; PAM type: NRG; PAM sequence: TGG
tgggtgggtggacggatggg

SEQ ID NO: 145090 - DNA, 20 bp, Artificial Sequence
  Description of Artificial Sequence: Synthetic oligonucleotide
  Target: ATXN1; (+) strand; PAM type: NRG; PAM sequence: AAG
gtgggtggacggatgggtgg

SEQ ID NO: 145091 - DNA, 20 bp, Artificial Sequence
  Description of Artificial Sequence: Synthetic oligonucleotide
  Target: ATXN1; (+) strand; PAM type: NRG; PAM sequence: AGG
tgggtggacggatgggtgga

SEQ ID NO: 145092 - DNA, 20 bp, Artificial Sequence
  Description of Artificial Sequence: Synthetic oligonucleotide
  Target: ATXN1; (+) strand; PAM type: NRG; PAM sequence: TAG
cggatgggtggaaggatgaa

SEQ ID NO: 145093 - DNA, 20 bp, Artificial Sequence
  Description of Artificial Sequence: Synthetic oligonucleotide
  Target: ATXN1; (+) strand; PAM type: NRG; PAM sequence: TGG
tgggtggaaggatgaataga

SEQ ID NO: 145094 - DNA, 20 bp, Artificial Sequence
  Description of Artificial Sequence: Synthetic oligonucleotide
  Target: ATXN1; (+) strand; PAM type: NRG; PAM sequence: TGG
tggaaggatgaatagatgga

SEQ ID NO: 145095 - DNA, 20 bp, Artificial Sequence
  Description of Artificial Sequence: Synthetic oligonucleotide
  Target: ATXN1; (+) strand; PAM type: NRG; PAM sequence: TGG
aggatgaatagatggatgga

SEQ ID NO: 145096 - DNA, 20 bp, Artificial Sequence
  Description of Artificial Sequence: Synthetic oligonucleotide
  Target: ATXN1; (+) strand; PAM type: NRG; PAM sequence: GGG
ggatgaatagatggatggat

SEQ ID NO: 145097 - DNA, 20 bp, Artificial Sequence
  Description of Artificial Sequence: Synthetic oligonucleotide
  Target: ATXN1; (+) strand; PAM type: NRG; PAM sequence: TGG
tgaatagatggatggatggg

SEQ ID NO: 145098 - DNA, 20 bp, Artificial Sequence
  Description of Artificial Sequence: Synthetic oligonucleotide
  Target: ATXN1; (+) strand; PAM type: NRG; PAM sequence: GGG
gaatagatggatggatgggt

SEQ ID NO: 145099 - DNA, 20 bp, Artificial Sequence
  Description of Artificial Sequence: Synthetic oligonucleotide
  Target: ATXN1; (+) strand; PAM type: NRG; PAM sequence: TGG
tagatggatggatgggtggg

SEQ ID NO: 145100 - DNA, 20 bp, Artificial Sequence
  Description of Artificial Sequence: Synthetic oligonucleotide
  Target: ATXN1; (+) strand; PAM type: NRG; PAM sequence: TGG
tggatggatgggtgggtgga

SEQ ID NO: 145101 - DNA, 20 bp, Artificial Sequence
  Description of Artificial Sequence: Synthetic oligonucleotide
  Target: ATXN1; (+) strand; PAM type: NRG; PAM sequence: TGG
tggatgggtgggtggatgga

SEQ ID NO: 145102 - DNA, 20 bp, Artificial Sequence
  Description of Artificial Sequence: Synthetic oligonucleotide
  Target: ATXN1; (+) strand; PAM type: NRG; PAM sequence: TGG
tgggtgggtggatggatgga

SEQ ID NO: 145103 - DNA, 20 bp, Artificial Sequence
  Description of Artificial Sequence: Synthetic oligonucleotide
  Target: ATXN1; (+) strand; PAM type: NRG; PAM sequence: GAG
gggtggatggatggatggat

SEQ ID NO: 145104 - DNA, 20 bp, Artificial Sequence
  Description of Artificial Sequence: Synthetic oligonucleotide
  Target: ATXN1; (+) strand; PAM type: NRG; PAM sequence: TAG
ggatggatggatggatgagt

SEQ ID NO: 145105 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatgagttag

SEQ ID NO: 145106 - DNA, 20 bp, Artificial Sequence
  Description of Artificial Sequence: Synthetic oligonucleotide
  Target: ATXN1; (+) strand; PAM type: NRG; PAM sequence: GGG
ggatggatggatgagttagt

SEQ ID NO: 145107 - DNA, 20 bp, Artificial Sequence
  Description of Artificial Sequence: Synthetic oligonucleotide
  Target: ATXN1; (+) strand; PAM type: NRG; PAM sequence: TGG
tggatggatgagttagtggg

SEQ ID NO: 145108 - DNA, 20 bp, Artificial Sequence
  Description of Artificial Sequence: Synthetic oligonucleotide
  Target: ATXN1; (+) strand; PAM type: NRG; PAM sequence: TGG
tggatgagttagtgggtgga

SEQ ID NO: 145109 - DNA, 20 bp, Artificial Sequence
  Description of Artificial Sequence: Synthetic oligonucleotide
  Target: ATXN1; (+) strand; PAM type: NRG; PAM sequence: TGG
tgagttagtgggtggatgga

SEQ ID NO: 145110 - DNA, 20 bp, Artificial Sequence
  Description of Artificial Sequence: Synthetic oligonucleotide
  Target: ATXN1; (+) strand; PAM type: NRG; PAM sequence: TGG
ttagtgggtggatggatgga

SEQ ID NO: 145111 - DNA, 20 bp, Artificial Sequence
  Description of Artificial Sequence: Synthetic oligonucleotide
  Target: ATXN1; (+) strand; PAM type: NRG; PAM sequence: TGG
tgggtggatggatggatgga

SEQ ID NO: 145112 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatggatgga

SEQ ID NO: 145113 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatggatgga

SEQ ID NO: 145114 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatggatgga

SEQ ID NO: 145115 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatggatgga

SEQ ID NO: 145116 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatggatgga

SEQ ID NO: 145117 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatggatata

SEQ ID NO: 145118 - DNA, 20 bp, Artificial Sequence
  Description of Artificial Sequence: Synthetic oligonucleotide
  Target: ATXN1; (+) strand; PAM type: NRG; PAM sequence: GGG
ggatggatggatggatatat

SEQ ID NO: 145119 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatatatggg

SEQ ID NO: 145120 - DNA, 20 bp, Artificial Sequence
  Description of Artificial Sequence: Synthetic oligonucleotide
  Target: ATXN1; (+) strand; PAM type: NRG; PAM sequence: GGG
ggatggatggatatatgggt

SEQ ID NO: 145121 - DNA, 20 bp, Artificial Sequence
  Description of Artificial Sequence: Synthetic oligonucleotide
  Target: ATXN1; (+) strand; PAM type: NRG; PAM sequence: TGG
tggatggatatatgggtggg

SEQ ID NO: 145122 - DNA, 20 bp, Artificial Sequence
  Description of Artificial Sequence: Synthetic oligonucleotide
  Target: ATXN1; (+) strand; PAM type: NRG; PAM sequence: TAG
tggatatatgggtgggtgga

SEQ ID NO: 145123 - DNA, 20 bp, Artificial Sequence
  Description of Artificial Sequence: Synthetic oligonucleotide
  Target: ATXN1; (+) strand; PAM type: NRG; PAM sequence: AGG
ggatatatgggtgggtggat

SEQ ID NO: 145124 - DNA, 20 bp, Artificial Sequence
  Description of Artificial Sequence: Synthetic oligonucleotide
  Target: ATXN1; (+) strand; PAM type: NRG; PAM sequence: TGG
tatatgggtgggtggatagg

SEQ ID NO: 145125 - DNA, 20 bp, Artificial Sequence
  Description of Artificial Sequence: Synthetic oligonucleotide
  Target: ATXN1; (+) strand; PAM type: NRG; PAM sequence: TGG
tgggtgggtggataggtgga

SEQ ID NO: 145126 - DNA, 20 bp, Artificial Sequence
  Description of Artificial Sequence: Synthetic oligonucleotide
  Target: ATXN1; (+) strand; PAM type: NRG; PAM sequence: GGG
gggtgggtggataggtggat

SEQ ID NO: 145127 - DNA, 20 bp, Artificial Sequence
  Description of Artificial Sequence: Synthetic oligonucleotide
  Target: ATXN1; (+) strand; PAM type: NRG; PAM sequence: GAG
gtgggtggataggtggatgg

SEQ ID NO: 145128 - DNA, 20 bp, Artificial Sequence
  Description of Artificial Sequence: Synthetic oligonucleotide
  Target: ATXN1; (+) strand; PAM type: NRG; PAM sequence: AGG
tgggtggataggtggatggg

SEQ ID NO: 145129 - DNA, 20 bp, Artificial Sequence
  Description of Artificial Sequence: Synthetic oligonucleotide
  Target: ATXN1; (+) strand; PAM type: NRG; PAM sequence: TAG
tggataggtggatgggagga

SEQ ID NO: 145130 - DNA, 20 bp, Artificial Sequence
  Description of Artificial Sequence: Synthetic oligonucleotide
  Target: ATXN1; (+) strand; PAM type: NRG; PAM sequence: TAG
taggtggatgggaggataga

SEQ ID NO: 145131 - DNA, 20 bp, Artificial Sequence
  Description of Artificial Sequence: Synthetic oligonucleotide
  Target: ATXN1; (+) strand; PAM type: NRG; PAM sequence: TGG
tggatgggaggatagataga

SEQ ID NO: 145132 - DNA, 20 bp, Artificial Sequence
  Description of Artificial Sequence: Synthetic oligonucleotide
  Target: ATXN1; (+) strand; PAM type: NRG; PAM sequence: TAG
tgggaggatagatagatgga

SEQ ID NO: 145133 - DNA, 20 bp, Artificial Sequence
  Description of Artificial Sequence: Synthetic oligonucleotide
  Target: ATXN1; (+) strand; PAM type: NRG; PAM sequence: AGG
gggaggatagatagatggat

SEQ ID NO: 145134 - DNA, 20 bp, Artificial Sequence
  Description of Artificial Sequence: Synthetic oligonucleotide
  Target: ATXN1; (+) strand; PAM type: NRG; PAM sequence: TGG
aggatagatagatggatagg

SEQ ID NO: 145135 - DNA, 20 bp, Artificial Sequence
  Description of Artificial Sequence: Synthetic oligonucleotide
  Target: ATXN1; (+) strand; PAM type: NRG; PAM sequence: GGG
ggatagatagatggataggt

SEQ ID NO: 145136 - DNA, 20 bp, Artificial Sequence
  Description of Artificial Sequence: Synthetic oligonucleotide
  Target: ATXN1; (+) strand; PAM type: NRG; PAM sequence: TGG
tagatagatggataggtggg

SEQ ID NO: 145137 - DNA, 20 bp, Artificial Sequence
  Description of Artificial Sequence: Synthetic oligonucleotide
  Target: ATXN1; (+) strand; PAM type: NRG; PAM sequence: GGG
agatagatggataggtgggt

SEQ ID NO: 145138 - DNA, 20 bp, Artificial Sequence
  Description of Artificial Sequence: Synthetic oligonucleotide
  Target: ATXN1; (+) strand; PAM type: NRG; PAM sequence: TGG
tagatggataggtgggtggg

SEQ ID NO: 145139 - DNA, 20 bp, Artificial Sequence
  Description of Artificial Sequence: Synthetic oligonucleotide
  Target: ATXN1; (+) strand; PAM type: NRG; PAM sequence: TGG
tggataggtgggtgggtgga

SEQ ID NO: 145140 - DNA, 20 bp, Artificial Sequence
  Description of Artificial Sequence: Synthetic oligonucleotide
  Target: ATXN1; (+) strand; PAM type: NRG; PAM sequence: TGG
taggtgggtgggtggatgga

SEQ ID NO: 145141 - DNA, 20 bp, Artificial Sequence
  Description of Artificial Sequence: Synthetic oligonucleotide
  Target: ATXN1; (+) strand; PAM type: NRG; PAM sequence: TGG
tgggtgggtggatggatgga

SEQ ID NO: 145142 - DNA, 20 bp, Artificial Sequence
  Description of Artificial Sequence: Synthetic oligonucleotide
  Target: ATXN1; (+) strand; PAM type: NRG; PAM sequence: TGG
tgggtggatggatggatgga

SEQ ID NO: 145143 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatggatgga

SEQ ID NO: 145144 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatggatgga

SEQ ID NO: 145145 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatggatgga

SEQ ID NO: 145146 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatggatgga

SEQ ID NO: 145147 - DNA, 20 bp, Artificial Sequence
  Description of Artificial Sequence: Synthetic oligonucleotide
  Target: ATXN1; (+) strand; PAM type: NRG; PAM sequence: TGG
tggatggatggatggatgga

SEQ ID NO: 145148 - DNA, 20 bp, Artificial Sequence
  Description of Artificial Sequence: Synthetic oligonucleotide
  Target: ATXN1; (+) strand; PAM type: NRG; PAM sequence: AAG
atggatggatggatggatgg

SEQ ID NO: 145149 - DNA, 20 bp, Artificial Sequence
  Description of Artificial Sequence: Synthetic oligonucleotide
  Target: ATXN1; (+) strand; PAM type: NRG; PAM sequence: AAG
atggatggatggaagaatac

SEQ ID NO: 145150 - DNA, 20 bp, Artificial Sequence
  Description of Artificial Sequence: Synthetic oligonucleotide
  Target: ATXN1; (+) strand; PAM type: NRG; PAM sequence: AGG
tggatggatggaagaataca

SEQ ID NO: 145151 - DNA, 20 bp, Artificial Sequence
  Description of Artificial Sequence: Synthetic oligonucleotide
  Target: ATXN1; (+) strand; PAM type: NRG; PAM sequence: GGG
ggatggatggaagaatacaa

SEQ ID NO: 145152 - DNA, 20 bp, Artificial Sequence
  Description of Artificial Sequence: Synthetic oligonucleotide
  Target: ATXN1; (+) strand; PAM type: NRG; PAM sequence: GAG
atggatggaagaatacaagg

SEQ ID NO: 145153 - DNA, 20 bp, Artificial Sequence
  Description of Artificial Sequence: Synthetic oligonucleotide
  Target: ATXN1; (+) strand; PAM type: NRG; PAM sequence: AGG
tggatggaagaatacaaggg

SEQ ID NO: 145154 - DNA, 20 bp, Artificial Sequence
  Description of Artificial Sequence: Synthetic oligonucleotide
  Target: ATXN1; (+) strand; PAM type: NRG; PAM sequence: AAG
atggaagaatacaagggagg

SEQ ID NO: 145155 - DNA, 20 bp, Artificial Sequence
  Description of Artificial Sequence: Synthetic oligonucleotide
  Target: ATXN1; (+) strand; PAM type: NRG; PAM sequence: AGG
tggaagaatacaagggagga

SEQ ID NO: 145156 - DNA, 20 bp, Artificial Sequence
  Description of Artificial Sequence: Synthetic oligonucleotide
  Target: ATXN1; (+) strand; PAM type: NRG; PAM sequence: AAG
atacaagggaggaaggaaaa

SEQ ID NO: 145157 - DNA, 20 bp, Artificial Sequence
  Description of Artificial Sequence: Synthetic oligonucleotide
  Target: ATXN1; (+) strand; PAM type: NRG; PAM sequence: AGG
tacaagggaggaaggaaaaa

SEQ ID NO: 145158 - DNA, 20 bp, Artificial Sequence
  Description of Artificial Sequence: Synthetic oligonucleotide
  Target: ATXN1; (+) strand; PAM type: NRG; PAM sequence: GGG
acaagggaggaaggaaaaaa

SEQ ID NO: 145159 - DNA, 20 bp, Artificial Sequence
  Description of Artificial Sequence: Synthetic oligonucleotide
  Target: ATXN1; (+) strand; PAM type: NRG; PAM sequence: GAG
aagggaggaaggaaaaaagg

SEQ ID NO: 145160 - DNA, 20 bp, Artificial Sequence
  Description of Artificial Sequence: Synthetic oligonucleotide
  Target: ATXN1; (+) strand; PAM type: NRG; PAM sequence: AAG
gaggaaggaaaaaagggaga

SEQ ID NO: 145161 - DNA, 20 bp, Artificial Sequence
  Description of Artificial Sequence: Synthetic oligonucleotide
  Target: ATXN1; (+) strand; PAM type: NRG; PAM sequence: AGG
aggaaggaaaaaagggagaa

SEQ ID NO: 145162 - DNA, 20 bp, Artificial Sequence
  Description of Artificial Sequence: Synthetic oligonucleotide
  Target: ATXN1; (+) strand; PAM type: NRG; PAM sequence: GGG
ggaaggaaaaaagggagaaa

SEQ ID NO: 145163 - DNA, 20 bp, Artificial Sequence
  Description of Artificial Sequence: Synthetic oligonucleotide
  Target: ATXN1; (+) strand; PAM type: NRG; PAM sequence: GGG
gaaggaaaaaagggagaaag

SEQ ID NO: 145164 - DNA, 20 bp, Artificial Sequence
  Description of Artificial Sequence: Synthetic oligonucleotide
  Target: ATXN1; (+) strand; PAM type: NRG; PAM sequence: GGG
aaggaaaaaagggagaaagg

SEQ ID NO: 145165 - DNA, 20 bp, Artificial Sequence
  Description of Artificial Sequence: Synthetic oligonucleotide
  Target: ATXN1; (+) strand; PAM type: NRG; PAM sequence: GGG
aggaaaaaagggagaaaggg

SEQ ID NO: 145166 - DNA, 20 bp, Artificial Sequence
  Description of Artificial Sequence: Synthetic oligonucleotide
  Target: ATXN1; (+) strand; PAM type: NRG; PAM sequence: CAG
aaaaagggagaaagggggga

SEQ ID NO: 145167 - DNA, 20 bp, Artificial Sequence
  Description of Artificial Sequence: Synthetic oligonucleotide
  Target: ATXN1; (+) strand; PAM type: NRG; PAM sequence: AAG
aagggagaaaggggggacag

SEQ ID NO: 145168 - DNA, 20 bp, Artificial Sequence
  Description of Artificial Sequence: Synthetic oligonucleotide
  Target: ATXN1; (+) strand; PAM type: NRG; PAM sequence: TAG
ggagaaaggggggacagaag

SEQ ID NO: 145169 - DNA, 20 bp, Artificial Sequence
  Description of Artificial Sequence: Synthetic oligonucleotide
  Target: ATXN1; (+) strand; PAM type: NRG; PAM sequence: AGG
gagaaaggggggacagaagt

SEQ ID NO: 145170 - DNA, 20 bp, Artificial Sequence
  Description of Artificial Sequence: Synthetic oligonucleotide
  Target: ATXN1; (+) strand; PAM type: NRG; PAM sequence: GGG
agaaaggggggacagaagta

SEQ ID NO: 145171 - DNA, 20 bp, Artificial Sequence
  Description of Artificial Sequence: Synthetic oligonucleotide
  Target: ATXN1; (+) strand; PAM type: NRG; PAM sequence: GAG
aaaggggggacagaagtagg

SEQ ID NO: 145172 - DNA, 20 bp, Artificial Sequence
  Description of Artificial Sequence: Synthetic oligonucleotide
  Target: ATXN1; (+) strand; PAM type: NRG; PAM sequence: AGG
aaggggggacagaagtaggg

SEQ ID NO: 145173 - DNA, 20 bp, Artificial Sequence
  Description of Artificial Sequence: Synthetic oligonucleotide
  Target: ATXN1; (+) strand; PAM type: NRG; PAM sequence: AAG
gggacagaagtagggaggca

SEQ ID NO: 145174 - DNA, 20 bp, Artificial Sequence
  Description of Artificial Sequence: Synthetic oligonucleotide
  Target: ATXN1; (+) strand; PAM type: NRG; PAM sequence: GAG
gacagaagtagggaggcaaa

SEQ ID NO: 145175 - DNA, 20 bp, Artificial Sequence
  Description of Artificial Sequence: Synthetic oligonucleotide
  Target: ATXN1; (+) strand; PAM type: NRG; PAM sequence: AAG
agaagtagggaggcaaagag

SEQ ID NO: 145176 - DNA, 20 bp, Artificial Sequence
  Description of Artificial Sequence: Synthetic oligonucleotide
  Target: ATXN1; (+) strand; PAM type: NRG; PAM sequence: AGG
gaagtagggaggcaaagaga

SEQ ID NO: 145177 - DNA, 20 bp, Artificial Sequence
  Description of Artificial Sequence: Synthetic oligonucleotide
  Target: ATXN1; (+) strand; PAM type: NRG; PAM sequence: GGG
aagtagggaggcaaagagaa

SEQ ID NO: 145178 - DNA, 20 bp, Artificial Sequence
  Description of Artificial Sequence: Synthetic oligonucleotide
  Target: ATXN1; (+) strand; PAM type: NRG; PAM sequence: TAG
aggcaaagagaagggaaata

SEQ ID NO: 145179 - DNA, 20 bp, Artificial Sequence
  Description of Artificial Sequence: Synthetic oligonucleotide
  Target: ATXN1; (+) strand; PAM type: NRG; PAM sequence: TGG
caaagagaagggaaatatag

SEQ ID NO: 145180 - DNA, 20 bp, Artificial Sequence
  Description of Artificial Sequence: Synthetic oligonucleotide
  Target: ATXN1; (+) strand; PAM type: NRG; PAM sequence: GAG
aagagaagggaaatatagtg

SEQ ID NO: 145181 - DNA, 20 bp, Artificial Sequence
  Description of Artificial Sequence: Synthetic oligonucleotide
  Target: ATXN1; (+) strand; PAM type: NRG; PAM sequence: GAG
gaagggaaatatagtggagt

SEQ ID NO: 145182 - DNA, 20 bp, Artificial Sequence
  Description of Artificial Sequence: Synthetic oligonucleotide
  Target: ATXN1; (+) strand; PAM type: NRG; PAM sequence: TGG
tagtggagtgagtttttatg

SEQ ID NO: 145183 - DNA, 20 bp, Artificial Sequence
  Description of Artificial Sequence: Synthetic oligonucleotide
  Target: ATXN1; (+) strand; PAM type: NRG; PAM sequence: GGG
agtggagtgagtttttatgt

SEQ ID NO: 145184 - DNA, 20 bp, Artificial Sequence
  Description of Artificial Sequence: Synthetic oligonucleotide
  Target: ATXN1; (+) strand; PAM type: NRG; PAM sequence: CGG
ggagtgagtttttatgtggg

SEQ ID NO: 145185 - DNA, 20 bp, Artificial Sequence
  Description of Artificial Sequence: Synthetic oligonucleotide
  Target: ATXN1; (+) strand; PAM type: NRG; PAM sequence: AAG
gagtttttatgtgggcggtt

SEQ ID NO: 145186 - DNA, 20 bp, Artificial Sequence
  Description of Artificial Sequence: Synthetic oligonucleotide
  Target: ATXN1; (+) strand; PAM type: NRG; PAM sequence: AAG
atgtgggcggttaagttcaa

SEQ ID NO: 145187 - DNA, 20 bp, Artificial Sequence
  Description of Artificial Sequence: Synthetic oligonucleotide
  Target: ATXN1; (+) strand; PAM type: NRG; PAM sequence: AAG
ggcggttaagttcaaaagtt

SEQ ID NO: 145188 - DNA, 20 bp, Artificial Sequence
  Description of Artificial Sequence: Synthetic oligonucleotide
  Target: ATXN1; (+) strand; PAM type: NRG; PAM sequence: AAG
taagttcaaaagttaagcaa

SEQ ID NO: 145189 - DNA, 20 bp, Artificial Sequence
  Description of Artificial Sequence: Synthetic oligonucleotide
  Target: ATXN1; (+) strand; PAM type: NRG; PAM sequence: TAG
agttaagcaaaagtcatata

SEQ ID NO: 145190 - DNA, 20 bp, Artificial Sequence
  Description of Artificial Sequence: Synthetic oligonucleotide
  Target: ATXN1; (+) strand; PAM type: NRG; PAM sequence: TGG
aattaactttgaaaatcctt

SEQ ID NO: 145191 - DNA, 20 bp, Artificial Sequence
  Description of Artificial Sequence: Synthetic oligonucleotide
  Target: ATXN1; (+) strand; PAM type: NRG; PAM sequence: AAG
aaatcctttggctttcccac

SEQ ID NO: 145192 - DNA, 20 bp, Artificial Sequence
  Description of Artificial Sequence: Synthetic oligonucleotide
  Target: ATXN1; (+) strand; PAM type: NRG; PAM sequence: CAG
ttcccacaagacactccaca

SEQ ID NO: 145193 - DNA, 20 bp, Artificial Sequence
  Description of Artificial Sequence: Synthetic oligonucleotide
  Target: ATXN1; (+) strand; PAM type: NRG; PAM sequence: AGG
tcccacaagacactccacac

SEQ ID NO: 145194 - DNA, 20 bp, Artificial Sequence
  Description of Artificial Sequence: Synthetic oligonucleotide
  Target: ATXN1; (+) strand; PAM type: NRG; PAM sequence: AAG
tgcacttttcatgtacactg

SEQ ID NO: 145195 - DNA, 20 bp, Artificial Sequence
  Description of Artificial Sequence: Synthetic oligonucleotide
  Target: ATXN1; (+) strand; PAM type: NRG; PAM sequence: TGG
cactgaagtgtgataactat

SEQ ID NO: 145196 - DNA, 20 bp, Artificial Sequence
  Description of Artificial Sequence: Synthetic oligonucleotide
  Target: ATXN1; (+) strand; PAM type: NRG; PAM sequence: GGG
actgaagtgtgataactatt

SEQ ID NO: 145197 - DNA, 20 bp, Artificial Sequence
  Description of Artificial Sequence: Synthetic oligonucleotide
  Target: ATXN1; (+) strand; PAM type: NRG; PAM sequence: TAG
aagtgtgataactattgggt

SEQ ID NO: 145198 - DNA, 20 bp, Artificial Sequence
  Description of Artificial Sequence: Synthetic oligonucleotide
  Target: ATXN1; (+) strand; PAM type: NRG; PAM sequence: AAG
taactattgggttagactac

SEQ ID NO: 145199 - DNA, 20 bp, Artificial Sequence
  Description of Artificial Sequence: Synthetic oligonucleotide
  Target: ATXN1; (+) strand; PAM type: NRG; PAM sequence: AAG
tattgggttagactacaaga

SEQ ID NO: 145200 - DNA, 20 bp, Artificial Sequence
  Description of Artificial Sequence: Synthetic oligonucleotide
  Target: ATXN1; (+) strand; PAM type: NRG; PAM sequence: TGG
gactacaagaaagaactcaa

SEQ ID NO: 145201 - DNA, 20 bp, Artificial Sequence
  Description of Artificial Sequence: Synthetic oligonucleotide
  Target: ATXN1; (+) strand; PAM type: NRG; PAM sequence: AAG
tacaagaaagaactcaatgg

SEQ ID NO: 145202 - DNA, 20 bp, Artificial Sequence
  Description of Artificial Sequence: Synthetic oligonucleotide
  Target: ATXN1; (+) strand; PAM type: NRG; PAM sequence: AAG
caatggaagaacacatgtaa

SEQ ID NO: 145203 - DNA, 20 bp, Artificial Sequence
  Description of Artificial Sequence: Synthetic oligonucleotide
  Target: ATXN1; (+) strand; PAM type: NRG; PAM sequence: AAG
accattcctcttttaaaatt

SEQ ID NO: 145204 - DNA, 20 bp, Artificial Sequence
  Description of Artificial Sequence: Synthetic oligonucleotide
  Target: ATXN1; (+) strand; PAM type: NRG; PAM sequence: CAG
aattaagtattgtatcacta

SEQ ID NO: 145205 - DNA, 20 bp, Artificial Sequence
  Description of Artificial Sequence: Synthetic oligonucleotide
  Target: ATXN1; (+) strand; PAM type: NRG; PAM sequence: CGG
attgtatcactacagttaaa

SEQ ID NO: 145206 - DNA, 20 bp, Artificial Sequence
  Description of Artificial Sequence: Synthetic oligonucleotide
  Target: ATXN1; (+) strand; PAM type: NRG; PAM sequence: GGG
ttgtatcactacagttaaac

SEQ ID NO: 145207 - DNA, 20 bp, Artificial Sequence
  Description of Artificial Sequence: Synthetic oligonucleotide
  Target: ATXN1; (+) strand; PAM type: NRG; PAM sequence: GGG
tgtatcactacagttaaacg

SEQ ID NO: 145208 - DNA, 20 bp, Artificial Sequence
  Description of Artificial Sequence: Synthetic oligonucleotide
  Target: ATXN1; (+) strand; PAM type: NRG; PAM sequence: GGG
gtatcactacagttaaacgg

SEQ ID NO: 145209 - DNA, 20 bp, Artificial Sequence
  Description of Artificial Sequence: Synthetic oligonucleotide
  Target: ATXN1; (+) strand; PAM type: NRG; PAM sequence: GGG
tatcactacagttaaacggg

SEQ ID NO: 145210 - DNA, 20 bp, Artificial Sequence
  Description of Artificial Sequence: Synthetic oligonucleotide
  Target: ATXN1; (+) strand; PAM type: NRG; PAM sequence: TAG
ctacagttaaacggggggat

SEQ ID NO: 145211 - DNA, 20 bp, Artificial Sequence
  Description of Artificial Sequence: Synthetic oligonucleotide
  Target: ATXN1; (+) strand; PAM type: NRG; PAM sequence: AAG
ttaaacggggggattagata

SEQ ID NO: 145212 - DNA, 20 bp, Artificial Sequence
  Description of Artificial Sequence: Synthetic oligonucleotide
  Target: ATXN1; (+) strand; PAM type: NRG; PAM sequence: AAG
cggggggattagataaagat

SEQ ID NO: 145213 - DNA, 20 bp, Artificial Sequence
  Description of Artificial Sequence: Synthetic oligonucleotide
  Target: ATXN1; (+) strand; PAM type: NRG; PAM sequence: TGG
gataaagataagtaaaatat

SEQ ID NO: 145214 - DNA, 20 bp, Artificial Sequence
  Description of Artificial Sequence: Synthetic oligonucleotide
  Target: ATXN1; (+) strand; PAM type: NRG; PAM sequence: CAG
agtaaaatattggtgttttc

SEQ ID NO: 145215 - DNA, 20 bp, Artificial Sequence
  Description of Artificial Sequence: Synthetic oligonucleotide
  Target: ATXN1; (+) strand; PAM type: NRG; PAM sequence: AAG
aaatattggtgttttccagc

SEQ ID NO: 145216 - DNA, 20 bp, Artificial Sequence
  Description of Artificial Sequence: Synthetic oligonucleotide
  Target: ATXN1; (+) strand; PAM type: NRG; PAM sequence: TAG
attacttcattctgttgtaa

SEQ ID NO: 145217 - DNA, 20 bp, Artificial Sequence
  Description of Artificial Sequence: Synthetic oligonucleotide
  Target: ATXN1; (+) strand; PAM type: NRG; PAM sequence: AAG
cttcattctgttgtaatagt

SEQ ID NO: 145218 - DNA, 20 bp, Artificial Sequence
  Description of Artificial Sequence: Synthetic oligonucleotide
  Target: ATXN1; (+) strand; PAM type: NRG; PAM sequence: AAG
taacaaatgtactgttgtta

SEQ ID NO: 145219 - DNA, 20 bp, Artificial Sequence
  Description of Artificial Sequence: Synthetic oligonucleotide
  Target: ATXN1; (+) strand; PAM type: NRG; PAM sequence: AAG
atgtactgttgttaaagtta

SEQ ID NO: 145220 - DNA, 20 bp, Artificial Sequence
  Description of Artificial Sequence: Synthetic oligonucleotide
  Target: ATXN1; (+) strand; PAM type: NRG; PAM sequence: AGG
tgtactgttgttaaagttaa

SEQ ID NO: 145221 - DNA, 20 bp, Artificial Sequence
  Description of Artificial Sequence: Synthetic oligonucleotide
  Target: ATXN1; (+) strand; PAM type: NRG; PAM sequence: TAG
tgttaaagttaaaggaactg

SEQ ID NO: 145222 - DNA, 20 bp, Artificial Sequence
  Description of Artificial Sequence: Synthetic oligonucleotide
  Target: ATXN1; (+) strand; PAM type: NRG; PAM sequence: AGG
gttaaagttaaaggaactgt

SEQ ID NO: 145223 - DNA, 20 bp, Artificial Sequence
  Description of Artificial Sequence: Synthetic oligonucleotide
  Target: ATXN1; (+) strand; PAM type: NRG; PAM sequence: GAG
gaactgtaggatctcctatt

SEQ ID NO: 145224 - DNA, 20 bp, Artificial Sequence
  Description of Artificial Sequence: Synthetic oligonucleotide
  Target: ATXN1; (+) strand; PAM type: NRG; PAM sequence: TGG
ctcctattgagttcataatg

SEQ ID NO: 145225 - DNA, 20 bp, Artificial Sequence
  Description of Artificial Sequence: Synthetic oligonucleotide
  Target: ATXN1; (+) strand; PAM type: NRG; PAM sequence: AAG
gttcataatgtggtaatatt

SEQ ID NO: 145226 - DNA, 20 bp, Artificial Sequence
  Description of Artificial Sequence: Synthetic oligonucleotide
  Target: ATXN1; (+) strand; PAM type: NRG; PAM sequence: GAG
tcataatgtggtaatattaa

SEQ ID NO: 145227 - DNA, 20 bp, Artificial Sequence
  Description of Artificial Sequence: Synthetic oligonucleotide
  Target: ATXN1; (+) strand; PAM type: NRG; PAM sequence: AAG
ttttaaaataatttctttta

SEQ ID NO: 145228 - DNA, 20 bp, Artificial Sequence
  Description of Artificial Sequence: Synthetic oligonucleotide
  Target: ATXN1; (+) strand; PAM type: NRG; PAM sequence: AAG
atattatctgccttttcaaa

SEQ ID NO: 145229 - DNA, 20 bp, Artificial Sequence
  Description of Artificial Sequence: Synthetic oligonucleotide
  Target: ATXN1; (+) strand; PAM type: NRG; PAM sequence: AAG
tctgccttttcaaaaagtta

SEQ ID NO: 145230 - DNA, 20 bp, Artificial Sequence
  Description of Artificial Sequence: Synthetic oligonucleotide
  Target: ATXN1; (+) strand; PAM type: NRG; PAM sequence: TAG
tttcaaaaagttaaagcaca

SEQ ID NO: 145231 - DNA, 20 bp, Artificial Sequence
  Description of Artificial Sequence: Synthetic oligonucleotide
  Target: ATXN1; (+) strand; PAM type: NRG; PAM sequence: AAG
aaaagttaaagcacatagtc

SEQ ID NO: 145232 - DNA, 20 bp, Artificial Sequence
  Description of Artificial Sequence: Synthetic oligonucleotide
  Target: ATXN1; (+) strand; PAM type: NRG; PAM sequence: AAG
gttaaagcacatagtcaagt

SEQ ID NO: 145233 - DNA, 20 bp, Artificial Sequence
  Description of Artificial Sequence: Synthetic oligonucleotide
  Target: ATXN1; (+) strand; PAM type: NRG; PAM sequence: AAG
gtaagtgtcaaaaatttgcc

SEQ ID NO: 145234 - DNA, 20 bp, Artificial Sequence
  Description of Artificial Sequence: Synthetic oligonucleotide
  Target: ATXN1; (+) strand; PAM type: NRG; PAM sequence: AGG
taagtgtcaaaaatttgcca

SEQ ID NO: 145235 - DNA, 20 bp, Artificial Sequence
  Description of Artificial Sequence: Synthetic oligonucleotide
  Target: ATXN1; (+) strand; PAM type: NRG; PAM sequence: TAG
acacctttatttttctttcc

SEQ ID NO: 145236 - DNA, 20 bp, Artificial Sequence
  Description of Artificial Sequence: Synthetic oligonucleotide
  Target: ATXN1; (+) strand; PAM type: NRG; PAM sequence: AAG
cctagtttttcactgtcttg

SEQ ID NO: 145237 - DNA, 20 bp, Artificial Sequence
  Description of Artificial Sequence: Synthetic oligonucleotide
  Target: ATXN1; (+) strand; PAM type: NRG; PAM sequence: CAG
gtcttgaagtcttttaccca

SEQ ID NO: 145238 - DNA, 20 bp, Artificial Sequence
  Description of Artificial Sequence: Synthetic oligonucleotide
  Target: ATXN1; (+) strand; PAM type: NRG; PAM sequence: CAG
acagtctcccatattcaata

SEQ ID NO: 145239 - DNA, 20 bp, Artificial Sequence
  Description of Artificial Sequence: Synthetic oligonucleotide
  Target: ATXN1; (+) strand; PAM type: NRG; PAM sequence: CAG
atacagataataaattctat

SEQ ID NO: 145240 - DNA, 20 bp, Artificial Sequence
  Description of Artificial Sequence: Synthetic oligonucleotide
  Target: ATXN1; (+) strand; PAM type: NRG; PAM sequence: AAG
aaattctatcagaatgtgta

SEQ ID NO: 145241 - DNA, 20 bp, Artificial Sequence
  Description of Artificial Sequence: Synthetic oligonucleotide
  Target: ATXN1; (+) strand; PAM type: NRG; PAM sequence: TAG
cagaatgtgtaaagttcaaa

SEQ ID NO: 145242 - DNA, 20 bp, Artificial Sequence
  Description of Artificial Sequence: Synthetic oligonucleotide
  Target: ATXN1; (+) strand; PAM type: NRG; PAM sequence: AGG
agaatgtgtaaagttcaaat

SEQ ID NO: 145243 - DNA, 20 bp, Artificial Sequence
  Description of Artificial Sequence: Synthetic oligonucleotide
  Target: ATXN1; (+) strand; PAM type: NRG; PAM sequence: CAG
tgtaaagttcaaataggtat

SEQ ID NO: 145244 - DNA, 20 bp, Artificial Sequence
  Description of Artificial Sequence: Synthetic oligonucleotide
  Target: ATXN1; (+) strand; PAM type: NRG; PAM sequence: GAG
taaagttcaaataggtatca

SEQ ID NO: 145245 - DNA, 20 bp, Artificial Sequence
  Description of Artificial Sequence: Synthetic oligonucleotide
  Target: ATXN1; (+) strand; PAM type: NRG; PAM sequence: AGG
aaagttcaaataggtatcag

SEQ ID NO: 145246 - DNA, 20 bp, Artificial Sequence
  Description of Artificial Sequence: Synthetic oligonucleotide
  Target: ATXN1; (+) strand; PAM type: NRG; PAM sequence: TGG
tctgtactcttgtttttttc

SEQ ID NO: 145247 - DNA, 20 bp, Artificial Sequence
  Description of Artificial Sequence: Synthetic oligonucleotide
  Target: ATXN1; (+) strand; PAM type: NRG; PAM sequence: TGG
gtactcttgtttttttctgg

SEQ ID NO: 145248 - DNA, 20 bp, Artificial Sequence
  Description of Artificial Sequence: Synthetic oligonucleotide
  Target: ATXN1; (+) strand; PAM type: NRG; PAM sequence: GGG
tactcttgtttttttctggt

SEQ ID NO: 145249 - DNA, 20 bp, Artificial Sequence
  Description of Artificial Sequence: Synthetic oligonucleotide
  Target: ATXN1; (+) strand; PAM type: NRG; PAM sequence: GAG
ctcttgtttttttctggtgg

SEQ ID NO: 145250 - DNA, 20 bp, Artificial Sequence
  Description of Artificial Sequence: Synthetic oligonucleotide
  Target: ATXN1; (+) strand; PAM type: NRG; PAM sequence: CAG
ttgtttttttctggtgggag

SEQ ID NO: 145251 - DNA, 20 bp, Artificial Sequence
  Description of Artificial Sequence: Synthetic oligonucleotide
  Target: ATXN1; (+) strand; PAM type: NRG; PAM sequence: TGG
ttttctggtgggagcagaat

SEQ ID NO: 145252 - DNA, 20 bp, Artificial Sequence
  Description of Artificial Sequence: Synthetic oligonucleotide
  Target: ATXN1; (+) strand; PAM type: NRG; PAM sequence: TAG
gggagcagaattggcctgtg

SEQ ID NO: 145253 - DNA, 20 bp, Artificial Sequence
  Description of Artificial Sequence: Synthetic oligonucleotide
  Target: ATXN1; (+) strand; PAM type: NRG; PAM sequence: GAG
gagcagaattggcctgtgta

SEQ ID NO: 145254 - DNA, 20 bp, Artificial Sequence
  Description of Artificial Sequence: Synthetic oligonucleotide
  Target: ATXN1; (+) strand; PAM type: NRG; PAM sequence: AGG
agcagaattggcctgtgtag

SEQ ID NO: 145255 - DNA, 20 bp, Artificial Sequence
  Description of Artificial Sequence: Synthetic oligonucleotide
  Target: ATXN1; (+) strand; PAM type: NRG; PAM sequence: GGG
gcagaattggcctgtgtaga

SEQ ID NO: 145256 - DNA, 20 bp, Artificial Sequence
  Description of Artificial Sequence: Synthetic oligonucleotide
  Target: ATXN1; (+) strand; PAM type: NRG; PAM sequence: CAG
aattggcctgtgtagagggt

SEQ ID NO: 145257 - DNA, 20 bp, Artificial Sequence
  Description of Artificial Sequence: Synthetic oligonucleotide
  Target: ATXN1; (+) strand; PAM type: NRG; PAM sequence: AGG
attggcctgtgtagagggtc

SEQ ID NO: 145258 - DNA, 20 bp, Artificial Sequence
  Description of Artificial Sequence: Synthetic oligonucleotide
  Target: ATXN1; (+) strand; PAM type: NRG; PAM sequence: GGG
ttggcctgtgtagagggtca

SEQ ID NO: 145259 - DNA, 20 bp, Artificial Sequence
  Description of Artificial Sequence: Synthetic oligonucleotide
  Target: ATXN1; (+) strand; PAM type: NRG; PAM sequence: GGG
tggcctgtgtagagggtcag

SEQ ID NO: 145260 - DNA, 20 bp, Artificial Sequence
  Description of Artificial Sequence: Synthetic oligonucleotide
  Target: ATXN1; (+) strand; PAM type: NRG; PAM sequence: TAG
cctgtgtagagggtcagggg

SEQ ID NO: 145261 - DNA, 20 bp, Artificial Sequence
  Description of Artificial Sequence: Synthetic oligonucleotide
  Target: ATXN1; (+) strand; PAM type: NRG; PAM sequence: CAG
tagagggtcaggggtagacc

SEQ ID NO: 145262 - DNA, 20 bp, Artificial Sequence
  Description of Artificial Sequence: Synthetic oligonucleotide
  Target: ATXN1; (+) strand; PAM type: NRG; PAM sequence: AGG
agagggtcaggggtagaccc

SEQ ID NO: 145263 - DNA, 20 bp, Artificial Sequence
  Description of Artificial Sequence: Synthetic oligonucleotide
  Target: ATXN1; (+) strand; PAM type: NRG; PAM sequence: TGG
ggggtagacccaggcatctt

SEQ ID NO: 145264 - DNA, 20 bp, Artificial Sequence
  Description of Artificial Sequence: Synthetic oligonucleotide
  Target: ATXN1; (+) strand; PAM type: NRG; PAM sequence: GGG
gggtagacccaggcatcttt

SEQ ID NO: 145265 - DNA, 20 bp, Artificial Sequence
  Description of Artificial Sequence: Synthetic oligonucleotide
  Target: ATXN1; (+) strand; PAM type: NRG; PAM sequence: CAG
attatcacaacatttgcttt

SEQ ID NO: 145266 - DNA, 20 bp, Artificial Sequence
  Description of Artificial Sequence: Synthetic oligonucleotide
  Target: ATXN1; (+) strand; PAM type: NRG; PAM sequence: AAG
atcacaacatttgctttcag

SEQ ID NO: 145267 - DNA, 20 bp, Artificial Sequence
  Description of Artificial Sequence: Synthetic oligonucleotide
  Target: ATXN1; (+) strand; PAM type: NRG; PAM sequence: CAG
acatttgctttcagaagccc

SEQ ID NO: 145268 - DNA, 20 bp, Artificial Sequence
  Description of Artificial Sequence: Synthetic oligonucleotide
  Target: ATXN1; (+) strand; PAM type: NRG; PAM sequence: AAG
ttgctttcagaagccccaga

SEQ ID NO: 145269 - DNA, 20 bp, Artificial Sequence
  Description of Artificial Sequence: Synthetic oligonucleotide
  Target: ATXN1; (+) strand; PAM type: NRG; PAM sequence: AGG
tgctttcagaagccccagaa

SEQ ID NO: 145270 - DNA, 20 bp, Artificial Sequence
  Description of Artificial Sequence: Synthetic oligonucleotide
  Target: ATXN1; (+) strand; PAM type: NRG; PAM sequence: CAG
tcttttccttctctaatcta

SEQ ID NO: 145271 - DNA, 20 bp, Artificial Sequence
  Description of Artificial Sequence: Synthetic oligonucleotide
  Target: ATXN1; (+) strand; PAM type: NRG; PAM sequence: GAG
tctctaatctacagtgtgct

SEQ ID NO: 145272 - DNA, 20 bp, Artificial Sequence
  Description of Artificial Sequence: Synthetic oligonucleotide
  Target: ATXN1; (+) strand; PAM type: NRG; PAM sequence: AAG
ctacagtgtgctgagttcca

SEQ ID NO: 145273 - DNA, 20 bp, Artificial Sequence
  Description of Artificial Sequence: Synthetic oligonucleotide
  Target: ATXN1; (+) strand; PAM type: NRG; PAM sequence: CAG
ttctcatccattatactttt

SEQ ID NO: 145274 - DNA, 20 bp, Artificial Sequence
  Description of Artificial Sequence: Synthetic oligonucleotide
  Target: ATXN1; (+) strand; PAM type: NRG; PAM sequence: CGG
ttttgaaacatacattcctc

SEQ ID NO: 145275 - DNA, 20 bp, Artificial Sequence
  Description of Artificial Sequence: Synthetic oligonucleotide
  Target: ATXN1; (+) strand; PAM type: NRG; PAM sequence: GGG
tttgaaacatacattcctcc

SEQ ID NO: 145276 - DNA, 20 bp, Artificial Sequence
  Description of Artificial Sequence: Synthetic oligonucleotide
  Target: ATXN1; (+) strand; PAM type: NRG; PAM sequence: GAG
tgaaacatacattcctccgg

SEQ ID NO: 145277 - DNA, 20 bp, Artificial Sequence
  Description of Artificial Sequence: Synthetic oligonucleotide
  Target: ATXN1; (+) strand; PAM type: NRG; PAM sequence: AGG
gaaacatacattcctccggg

SEQ ID NO: 145278 - DNA, 20 bp, Artificial Sequence
  Description of Artificial Sequence: Synthetic oligonucleotide
  Target: ATXN1; (+) strand; PAM type: NRG; PAM sequence: GAG
tccgggaggattaacaaact

SEQ ID NO: 145279 - DNA, 20 bp, Artificial Sequence
  Description of Artificial Sequence: Synthetic oligonucleotide
  Target: ATXN1; (+) strand; PAM type: NRG; PAM sequence: AAG
taacaaactgagatactaac

SEQ ID NO: 145280 - DNA, 20 bp, Artificial Sequence
  Description of Artificial Sequence: Synthetic oligonucleotide
  Target: ATXN1; (+) strand; PAM type: NRG; PAM sequence: TGG
tgagatactaacaagctgtg

SEQ ID NO: 145281 - DNA, 20 bp, Artificial Sequence
  Description of Artificial Sequence: Synthetic oligonucleotide
  Target: ATXN1; (+) strand; PAM type: NRG; PAM sequence: CAG
aagctgtgtggttcattcat

SEQ ID NO: 145282 - DNA, 20 bp, Artificial Sequence
  Description of Artificial Sequence: Synthetic oligonucleotide
  Target: ATXN1; (+) strand; PAM type: NRG; PAM sequence: AAG
gttcattcatcagacccttc

SEQ ID NO: 145283 - DNA, 20 bp, Artificial Sequence
  Description of Artificial Sequence: Synthetic oligonucleotide
  Target: ATXN1; (+) strand; PAM type: NRG; PAM sequence: AGG
ttcattcatcagacccttca

SEQ ID NO: 145284 - DNA, 20 bp, Artificial Sequence
  Description of Artificial Sequence: Synthetic oligonucleotide
  Target: ATXN1; (+) strand; PAM type: NRG; PAM sequence: GGG
tcattcatcagacccttcaa

SEQ ID NO: 145285 - DNA, 20 bp, Artificial Sequence
  Description of Artificial Sequence: Synthetic oligonucleotide
  Target: ATXN1; (+) strand; PAM type: NRG; PAM sequence: AAG
ttcatcagacccttcaaggg

SEQ ID NO: 145286 - DNA, 20 bp, Artificial Sequence
  Description of Artificial Sequence: Synthetic oligonucleotide
  Target: ATXN1; (+) strand; PAM type: NRG; PAM sequence: AAG
atcagacccttcaagggaag

SEQ ID NO: 145287 - DNA, 20 bp, Artificial Sequence
  Description of Artificial Sequence: Synthetic oligonucleotide
  Target: ATXN1; (+) strand; PAM type: NRG; PAM sequence: AGG
tcagacccttcaagggaaga

SEQ ID NO: 145288 - DNA, 20 bp, Artificial Sequence
  Description of Artificial Sequence: Synthetic oligonucleotide
  Target: ATXN1; (+) strand; PAM type: NRG; PAM sequence: CAG
ccttcaagggaagaaggacc

SEQ ID NO: 145289 - DNA, 20 bp, Artificial Sequence
  Description of Artificial Sequence: Synthetic oligonucleotide
  Target: ATXN1; (+) strand; PAM type: NRG; PAM sequence: AGG
cttcaagggaagaaggaccc

SEQ ID NO: 145290 - DNA, 20 bp, Artificial Sequence
  Description of Artificial Sequence: Synthetic oligonucleotide
  Target: ATXN1; (+) strand; PAM type: NRG; PAM sequence: GGG
ttcaagggaagaaggaccca

SEQ ID NO: 145291 - DNA, 20 bp, Artificial Sequence
  Description of Artificial Sequence: Synthetic oligonucleotide
  Target: ATXN1; (+) strand; PAM type: NRG; PAM sequence: CAG
aagggaagaaggacccaggg

SEQ ID NO: 145292 - DNA, 20 bp, Artificial Sequence
  Description of Artificial Sequence: Synthetic oligonucleotide
  Target: ATXN1; (+) strand; PAM type: NRG; PAM sequence: TGG
acccagggcagctctgacac

SEQ ID NO: 145293 - DNA, 20 bp, Artificial Sequence
  Description of Artificial Sequence: Synthetic oligonucleotide
  Target: ATXN1; (+) strand; PAM type: NRG; PAM sequence: GGG
cccagggcagctctgacact

SEQ ID NO: 145294 - DNA, 20 bp, Artificial Sequence
  Description of Artificial Sequence: Synthetic oligonucleotide
  Target: ATXN1; (+) strand; PAM type: NRG; PAM sequence: GGG
ccagggcagctctgacactg

SEQ ID NO: 145295 - DNA, 20 bp, Artificial Sequence
  Description of Artificial Sequence: Synthetic oligonucleotide
  Target: ATXN1; (+) strand; PAM type: NRG; PAM sequence: CAG
gggcagctctgacactgggg

SEQ ID NO: 145296 - DNA, 20 bp, Artificial Sequence
  Description of Artificial Sequence: Synthetic oligonucleotide
  Target: ATXN1; (+) strand; PAM type: NRG; PAM sequence: AGG
ggcagctctgacactggggc

SEQ ID NO: 145297 - DNA, 20 bp, Artificial Sequence
  Description of Artificial Sequence: Synthetic oligonucleotide
  Target: ATXN1; (+) strand; PAM type: NRG; PAM sequence: GGG
gcagctctgacactggggca

SEQ ID NO: 145298 - DNA, 20 bp, Artificial Sequence
  Description of Artificial Sequence: Synthetic oligonucleotide
  Target: ATXN1; (+) strand; PAM type: NRG; PAM sequence: GGG
cagctctgacactggggcag

SEQ ID NO: 145299 - DNA, 20 bp, Artificial Sequence
  Description of Artificial Sequence: Synthetic oligonucleotide
  Target: ATXN1; (+) strand; PAM type: NRG; PAM sequence: GAG
tctgacactggggcaggggt

SEQ ID NO: 145300 - DNA, 20 bp, Artificial Sequence
  Description of Artificial Sequence: Synthetic oligonucleotide
  Target: ATXN1; (+) strand; PAM type: NRG; PAM sequence: AGG
ctgacactggggcaggggtg

SEQ ID NO: 145301 - DNA, 20 bp, Artificial Sequence
  Description of Artificial Sequence: Synthetic oligonucleotide
  Target: ATXN1; (+) strand; PAM type: NRG; PAM sequence: AAG
gcaggggtgaggcatcaccc

SEQ ID NO: 145302 - DNA, 20 bp, Artificial Sequence
  Description of Artificial Sequence: Synthetic oligonucleotide
  Target: ATXN1; (+) strand; PAM type: NRG; PAM sequence: GAG
aggggtgaggcatcacccaa

SEQ ID NO: 145303 - DNA, 20 bp, Artificial Sequence
  Description of Artificial Sequence: Synthetic oligonucleotide
  Target: ATXN1; (+) strand; PAM type: NRG; PAM sequence: GAG
gggtgaggcatcacccaaga

SEQ ID NO: 145304 - DNA, 20 bp, Artificial Sequence
  Description of Artificial Sequence: Synthetic oligonucleotide
  Target: ATXN1; (+) strand; PAM type: NRG; PAM sequence: GAG
gtgaggcatcacccaagaga

SEQ ID NO: 145305 - DNA, 20 bp, Artificial Sequence
  Description of Artificial Sequence: Synthetic oligonucleotide
  Target: ATXN1; (+) strand; PAM type: NRG; PAM sequence: AAG
ggcatcacccaagagagagc

SEQ ID NO: 145306 - DNA, 20 bp, Artificial Sequence
  Description of Artificial Sequence: Synthetic oligonucleotide
  Target: ATXN1; (+) strand; PAM type: NRG; PAM sequence: AGG
gcatcacccaagagagagca

SEQ ID NO: 145307 - DNA, 20 bp, Artificial Sequence
  Description of Artificial Sequence: Synthetic oligonucleotide
  Target: ATXN1; (+) strand; PAM type: NRG; PAM sequence: GGG
catcacccaagagagagcaa

SEQ ID NO: 145308 - DNA, 20 bp, Artificial Sequence
  Description of Artificial Sequence: Synthetic oligonucleotide
  Target: ATXN1; (+) strand; PAM type: NRG; PAM sequence: GGG
atcacccaagagagagcaag

SEQ ID NO: 145309 - DNA, 20 bp, Artificial Sequence
  Description of Artificial Sequence: Synthetic oligonucleotide
  Target: ATXN1; (+) strand; PAM type: NRG; PAM sequence: CAG
acccaagagagagcaagggg

SEQ ID NO: 145310 - DNA, 20 bp, Artificial Sequence
  Description of Artificial Sequence: Synthetic oligonucleotide
  Target: ATXN1; (+) strand; PAM type: NRG; PAM sequence: AGG
cccaagagagagcaaggggc

SEQ ID NO: 145311 - DNA, 20 bp, Artificial Sequence
  Description of Artificial Sequence: Synthetic oligonucleotide
  Target: ATXN1; (+) strand; PAM type: NRG; PAM sequence: CAG
agagagcaaggggcaggttc

SEQ ID NO: 145312 - DNA, 20 bp, Artificial Sequence
  Description of Artificial Sequence: Synthetic oligonucleotide
  Target: ATXN1; (+) strand; PAM type: NRG; PAM sequence: AAG
aggggcaggttccagaaaac

SEQ ID NO: 145313 - DNA, 20 bp, Artificial Sequence
  Description of Artificial Sequence: Synthetic oligonucleotide
  Target: ATXN1; (+) strand; PAM type: NRG; PAM sequence: AGG
ggggcaggttccagaaaaca

SEQ ID NO: 145314 - DNA, 20 bp, Artificial Sequence
  Description of Artificial Sequence: Synthetic oligonucleotide
  Target: ATXN1; (+) strand; PAM type: NRG; PAM sequence: GGG
gggcaggttccagaaaacaa

SEQ ID NO: 145315 - DNA, 20 bp, Artificial Sequence
  Description of Artificial Sequence: Synthetic oligonucleotide
  Target: ATXN1; (+) strand; PAM type: NRG; PAM sequence: CAG
ttccagaaaacaagggaaac

SEQ ID NO: 145316 - DNA, 20 bp, Artificial Sequence
  Description of Artificial Sequence: Synthetic oligonucleotide
  Target: ATXN1; (+) strand; PAM type: NRG; PAM sequence: AAG
ccttaaaatgaaacaaatac

SEQ ID NO: 145317 - DNA, 20 bp, Artificial Sequence
  Description of Artificial Sequence: Synthetic oligonucleotide
  Target: ATXN1; (+) strand; PAM type: NRG; PAM sequence: TGG
aatgaaacaaatacaagtaa

SEQ ID NO: 145318 - DNA, 20 bp, Artificial Sequence
  Description of Artificial Sequence: Synthetic oligonucleotide
  Target: ATXN1; (+) strand; PAM type: NRG; PAM sequence: GGG
atgaaacaaatacaagtaat

SEQ ID NO: 145319 - DNA, 20 bp, Artificial Sequence
  Description of Artificial Sequence: Synthetic oligonucleotide
  Target: ATXN1; (+) strand; PAM type: NRG; PAM sequence: AAG
tgtttttcactgttatatac

SEQ ID NO: 145320 - DNA, 20 bp, Artificial Sequence
  Description of Artificial Sequence: Synthetic oligonucleotide
  Target: ATXN1; (+) strand; PAM type: NRG; PAM sequence: AGG
gtttttcactgttatataca

SEQ ID NO: 145321 - DNA, 20 bp, Artificial Sequence
  Description of Artificial Sequence: Synthetic oligonucleotide
  Target: ATXN1; (+) strand; PAM type: NRG; PAM sequence: CAG
tttcactgttatatacaagg

SEQ ID NO: 145322 - DNA, 20 bp, Artificial Sequence
  Description of Artificial Sequence: Synthetic oligonucleotide
  Target: ATXN1; (+) strand; PAM type: NRG; PAM sequence: TGG
ttatatacaaggcagcctat

SEQ ID NO: 145323 - DNA, 20 bp, Artificial Sequence
  Description of Artificial Sequence: Synthetic oligonucleotide
  Target: ATXN1; (+) strand; PAM type: NRG; PAM sequence: CAG
ccacataattcttaaacaac

SEQ ID NO: 145324 - DNA, 20 bp, Artificial Sequence
  Description of Artificial Sequence: Synthetic oligonucleotide
  Target: ATXN1; (+) strand; PAM type: NRG; PAM sequence: AAG
attcttaaacaaccagaaaa

SEQ ID NO: 145325 - DNA, 20 bp, Artificial Sequence
  Description of Artificial Sequence: Synthetic oligonucleotide
  Target: ATXN1; (+) strand; PAM type: NRG; PAM sequence: AAG
aaacaaccagaaaaaagctg

SEQ ID NO: 145326 - DNA, 20 bp, Artificial Sequence
  Description of Artificial Sequence: Synthetic oligonucleotide
  Target: ATXN1; (+) strand; PAM type: NRG; PAM sequence: CGG
ctgaagtatgaccatcaata

SEQ ID NO: 145327 - DNA, 20 bp, Artificial Sequence
  Description of Artificial Sequence: Synthetic oligonucleotide
  Target: ATXN1; (+) strand; PAM type: NRG; PAM sequence: GGG
tgaagtatgaccatcaatac

SEQ ID NO: 145328 - DNA, 20 bp, Artificial Sequence
  Description of Artificial Sequence: Synthetic oligonucleotide
  Target: ATXN1; (+) strand; PAM type: NRG; PAM sequence: TGG
atgaccatcaatacgggaca

SEQ ID NO: 145329 - DNA, 20 bp, Artificial Sequence
  Description of Artificial Sequence: Synthetic oligonucleotide
  Target: ATXN1; (+) strand; PAM type: NRG; PAM sequence: AAG
cgggacatggaacatgccaa

SEQ ID NO: 145330 - DNA, 20 bp, Artificial Sequence
  Description of Artificial Sequence: Synthetic oligonucleotide
  Target: ATXN1; (+) strand; PAM type: NRG; PAM sequence: AAG
ggaacatgccaaaagatcga

SEQ ID NO: 145331 - DNA, 20 bp, Artificial Sequence
  Description of Artificial Sequence: Synthetic oligonucleotide
  Target: ATXN1; (+) strand; PAM type: NRG; PAM sequence: TAG
gattctttcttccccctctt

SEQ ID NO: 145332 - DNA, 20 bp, Artificial Sequence
  Description of Artificial Sequence: Synthetic oligonucleotide
  Target: ATXN1; (+) strand; PAM type: NRG; PAM sequence: AGG
attctttcttccccctcttt

SEQ ID NO: 145333 - DNA, 20 bp, Artificial Sequence
  Description of Artificial Sequence: Synthetic oligonucleotide
  Target: ATXN1; (+) strand; PAM type: NRG; PAM sequence: CAG
tccccctctttaggactaaa

SEQ ID NO: 145334 - DNA, 20 bp, Artificial Sequence
  Description of Artificial Sequence: Synthetic oligonucleotide
  Target: ATXN1; (+) strand; PAM type: NRG; PAM sequence: TGG
tctttaggactaaacagctg

SEQ ID NO: 145335 - DNA, 20 bp, Artificial Sequence
  Description of Artificial Sequence: Synthetic oligonucleotide
  Target: ATXN1; (+) strand; PAM type: NRG; PAM sequence: GGG
ctttaggactaaacagctgt

SEQ ID NO: 145336 - DNA, 20 bp, Artificial Sequence
  Description of Artificial Sequence: Synthetic oligonucleotide
  Target: ATXN1; (+) strand; PAM type: NRG; PAM sequence: AAG
actaaacagctgtgggcata

SEQ ID NO: 145337 - DNA, 20 bp, Artificial Sequence
  Description of Artificial Sequence: Synthetic oligonucleotide
  Target: ATXN1; (+) strand; PAM type: NRG; PAM sequence: TAG
aaaaataaattccattattt

SEQ ID NO: 145338 - DNA, 20 bp, Artificial Sequence
  Description of Artificial Sequence: Synthetic oligonucleotide
  Target: ATXN1; (+) strand; PAM type: NRG; PAM sequence: AAG
ataaattccattattttaga

SEQ ID NO: 145339 - DNA, 20 bp, Artificial Sequence
  Description of Artificial Sequence: Synthetic oligonucleotide
  Target: ATXN1; (+) strand; PAM type: NRG; PAM sequence: GAG
ccacccttcattatttcttt

SEQ ID NO: 145340 - DNA, 20 bp, Artificial Sequence
  Description of Artificial Sequence: Synthetic oligonucleotide
  Target: ATXN1; (+) strand; PAM type: NRG; PAM sequence: TGG
cttcattatttctttgagaa

SEQ ID NO: 145341 - DNA, 20 bp, Artificial Sequence
  Description of Artificial Sequence: Synthetic oligonucleotide
  Target: ATXN1; (+) strand; PAM type: NRG; PAM sequence: TGG
attatttctttgagaatggt

SEQ ID NO: 145342 - DNA, 20 bp, Artificial Sequence
  Description of Artificial Sequence: Synthetic oligonucleotide
  Target: ATXN1; (+) strand; PAM type: NRG; PAM sequence: GAG
gttggaattattacatctac

SEQ ID NO: 145343 - DNA, 20 bp, Artificial Sequence
  Description of Artificial Sequence: Synthetic oligonucleotide
  Target: ATXN1; (+) strand; PAM type: NRG; PAM sequence: GAG
tggaattattacatctacga

SEQ ID NO: 145344 - DNA, 20 bp, Artificial Sequence
  Description of Artificial Sequence: Synthetic oligonucleotide
  Target: ATXN1; (+) strand; PAM type: NRG; PAM sequence: AGG
ggaattattacatctacgag

SEQ ID NO: 145345 - DNA, 20 bp, Artificial Sequence
  Description of Artificial Sequence: Synthetic oligonucleotide
  Target: ATXN1; (+) strand; PAM type: NRG; PAM sequence: TAG
ttattacatctacgagaggt

SEQ ID NO: 145346 - DNA, 20 bp, Artificial Sequence
  Description of Artificial Sequence: Synthetic oligonucleotide
  Target: ATXN1; (+) strand; PAM type: NRG; PAM sequence: GAG
gaggttagcctctatcgatt

SEQ ID NO: 145347 - DNA, 20 bp, Artificial Sequence
  Description of Artificial Sequence: Synthetic oligonucleotide
  Target: ATXN1; (+) strand; PAM type: NRG; PAM sequence: CAG
tttcattaaaaaaattaaac

SEQ ID NO: 145348 - DNA, 20 bp, Artificial Sequence
  Description of Artificial Sequence: Synthetic oligonucleotide
  Target: ATXN1; (+) strand; PAM type: NRG; PAM sequence: GAG
aaaaaattaaaccagtgatt

SEQ ID NO: 145349 - DNA, 20 bp, Artificial Sequence
  Description of Artificial Sequence: Synthetic oligonucleotide
  Target: ATXN1; (+) strand; PAM type: NRG; PAM sequence: GAG
accagtgattgagctaaaat

SEQ ID NO: 145350 - DNA, 20 bp, Artificial Sequence
  Description of Artificial Sequence: Synthetic oligonucleotide
  Target: ATXN1; (+) strand; PAM type: NRG; PAM sequence: TGG
agtgattgagctaaaatgag

SEQ ID NO: 145351 - DNA, 20 bp, Artificial Sequence
  Description of Artificial Sequence: Synthetic oligonucleotide
  Target: ATXN1; (+) strand; PAM type: NRG; PAM sequence: AAG
ttgagctaaaatgagtggcc

SEQ ID NO: 145352 - DNA, 20 bp, Artificial Sequence
  Description of Artificial Sequence: Synthetic oligonucleotide
  Target: ATXN1; (+) strand; PAM type: NRG; PAM sequence: AAG
aaaatgagtggccaagctac

SEQ ID NO: 145353 - DNA, 20 bp, Artificial Sequence
  Description of Artificial Sequence: Synthetic oligonucleotide
  Target: ATXN1; (+) strand; PAM type: NRG; PAM sequence: TGG
acaagaccaaaaattgtgtg

SEQ ID NO: 145354 - DNA, 20 bp, Artificial Sequence
  Description of Artificial Sequence: Synthetic oligonucleotide
  Target: ATXN1; (+) strand; PAM type: NRG; PAM sequence: CAG
caaaaattgtgtgtggtcaa

SEQ ID NO: 145355 - DNA, 20 bp, Artificial Sequence
  Description of Artificial Sequence: Synthetic oligonucleotide
  Target: ATXN1; (+) strand; PAM type: NRG; PAM sequence: AGG
aaaaattgtgtgtggtcaac

SEQ ID NO: 145356 - DNA, 20 bp, Artificial Sequence
  Description of Artificial Sequence: Synthetic oligonucleotide
  Target: ATXN1; (+) strand; PAM type: NRG; PAM sequence: GAG
attgtgtgtggtcaacaggt

SEQ ID NO: 145357 - DNA, 20 bp, Artificial Sequence
  Description of Artificial Sequence: Synthetic oligonucleotide
  Target: ATXN1; (+) strand; PAM type: NRG; PAM sequence: GAG
tgtgtgtggtcaacaggtga

SEQ ID NO: 145358 - DNA, 20 bp, Artificial Sequence
  Description of Artificial Sequence: Synthetic oligonucleotide
  Target: ATXN1; (+) strand; PAM type: NRG; PAM sequence: AGG
gtgtgtggtcaacaggtgag

SEQ ID NO: 145359 - DNA, 20 bp, Artificial Sequence
  Description of Artificial Sequence: Synthetic oligonucleotide
  Target: ATXN1; (+) strand; PAM type: NRG; PAM sequence: TGG
gtcaacaggtgagaggaatg

SEQ ID NO: 145360 - DNA, 20 bp, Artificial Sequence
  Description of Artificial Sequence: Synthetic oligonucleotide
  Target: ATXN1; (+) strand; PAM type: NRG; PAM sequence: TAG
ggtgagaggaatgtggaata

SEQ ID NO: 145361 - DNA, 20 bp, Artificial Sequence
  Description of Artificial Sequence: Synthetic oligonucleotide
  Target: ATXN1; (+) strand; PAM type: NRG; PAM sequence: AGG
gtgagaggaatgtggaatat

SEQ ID NO: 145362 - DNA, 20 bp, Artificial Sequence
  Description of Artificial Sequence: Synthetic oligonucleotide
  Target: ATXN1; (+) strand; PAM type: NRG; PAM sequence: GAG
gagaggaatgtggaatatag

SEQ ID NO: 145363 - DNA, 20 bp, Artificial Sequence
  Description of Artificial Sequence: Synthetic oligonucleotide
  Target: ATXN1; (+) strand; PAM type: NRG; PAM sequence: AAG
gagctacctaatcaattcca

SEQ ID NO: 145364 - DNA, 20 bp, Artificial Sequence
  Description of Artificial Sequence: Synthetic oligonucleotide
  Target: ATXN1; (+) strand; PAM type: NRG; PAM sequence: AGG
agctacctaatcaattccaa

SEQ ID NO: 145365 - DNA, 20 bp, Artificial Sequence
  Description of Artificial Sequence: Synthetic oligonucleotide
  Target: ATXN1; (+) strand; PAM type: NRG; PAM sequence: AAG
tacctaatcaattccaaagg

SEQ ID NO: 145366 - DNA, 20 bp, Artificial Sequence
  Description of Artificial Sequence: Synthetic oligonucleotide
  Target: ATXN1; (+) strand; PAM type: NRG; PAM sequence: AGG
acctaatcaattccaaagga

SEQ ID NO: 145367 - DNA, 20 bp, Artificial Sequence
  Description of Artificial Sequence: Synthetic oligonucleotide
  Target: ATXN1; (+) strand; PAM type: NRG; PAM sequence: GGG
cctaatcaattccaaaggaa

SEQ ID NO: 145368 - DNA, 20 bp, Artificial Sequence
  Description of Artificial Sequence: Synthetic oligonucleotide
  Target: ATXN1; (+) strand; PAM type: NRG; PAM sequence: GAG
taatcaattccaaaggaagg

SEQ ID NO: 145369 - DNA, 20 bp, Artificial Sequence
  Description of Artificial Sequence: Synthetic oligonucleotide
  Target: ATXN1; (+) strand; PAM type: NRG; PAM sequence: TGG
ttgttatttctccccaccaa

SEQ ID NO: 145370 - DNA, 20 bp, Artificial Sequence
  Description of Artificial Sequence: Synthetic oligonucleotide
  Target: ATXN1; (+) strand; PAM type: NRG; PAM sequence: GGG
tgttatttctccccaccaat

SEQ ID NO: 145371 - DNA, 20 bp, Artificial Sequence
  Description of Artificial Sequence: Synthetic oligonucleotide
  Target: ATXN1; (+) strand; PAM type: NRG; PAM sequence: CAG
atttctccccaccaatggga

SEQ ID NO: 145372 - DNA, 20 bp, Artificial Sequence
  Description of Artificial Sequence: Synthetic oligonucleotide
  Target: ATXN1; (+) strand; PAM type: NRG; PAM sequence: CAG
ccaccaatgggacagtgctc

SEQ ID NO: 145373 - DNA, 20 bp, Artificial Sequence
  Description of Artificial Sequence: Synthetic oligonucleotide
  Target: ATXN1; (+) strand; PAM type: NRG; PAM sequence: TAG
ccaatgggacagtgctccag

SEQ ID NO: 145374 - DNA, 20 bp, Artificial Sequence
  Description of Artificial Sequence: Synthetic oligonucleotide
  Target: ATXN1; (+) strand; PAM type: NRG; PAM sequence: CAG
gacagtgctccagtagaccc

SEQ ID NO: 145375 - DNA, 20 bp, Artificial Sequence
  Description of Artificial Sequence: Synthetic oligonucleotide
  Target: ATXN1; (+) strand; PAM type: NRG; PAM sequence: AGG
acagtgctccagtagacccc

SEQ ID NO: 145376 - DNA, 20 bp, Artificial Sequence
  Description of Artificial Sequence: Synthetic oligonucleotide
  Target: ATXN1; (+) strand; PAM type: NRG; PAM sequence: TGG
ccccaggatcttctatttaa

SEQ ID NO: 145377 - DNA, 20 bp, Artificial Sequence
  Description of Artificial Sequence: Synthetic oligonucleotide
  Target: ATXN1; (+) strand; PAM type: NRG; PAM sequence: AAG
ttctatttaatggctgttgt

SEQ ID NO: 145378 - DNA, 20 bp, Artificial Sequence
  Description of Artificial Sequence: Synthetic oligonucleotide
  Target: ATXN1; (+) strand; PAM type: NRG; PAM sequence: TGG
gactctatctctgttcctct

SEQ ID NO: 145379 - DNA, 20 bp, Artificial Sequence
  Description of Artificial Sequence: Synthetic oligonucleotide
  Target: ATXN1; (+) strand; PAM type: NRG; PAM sequence: AAG
tctatctctgttcctcttgg

SEQ ID NO: 145380 - DNA, 20 bp, Artificial Sequence
  Description of Artificial Sequence: Synthetic oligonucleotide
  Target: ATXN1; (+) strand; PAM type: NRG; PAM sequence: AAG
ctctgttcctcttggaagaa

SEQ ID NO: 145381 - DNA, 20 bp, Artificial Sequence
  Description of Artificial Sequence: Synthetic oligonucleotide
  Target: ATXN1; (+) strand; PAM type: NRG; PAM sequence: AGG
tctgttcctcttggaagaaa

SEQ ID NO: 145382 - DNA, 20 bp, Artificial Sequence
  Description of Artificial Sequence: Synthetic oligonucleotide
  Target: ATXN1; (+) strand; PAM type: NRG; PAM sequence: GAG
ttggaagaaaaggtgccact

SEQ ID NO: 145383 - DNA, 20 bp, Artificial Sequence
  Description of Artificial Sequence: Synthetic oligonucleotide
  Target: ATXN1; (+) strand; PAM type: NRG; PAM sequence: AGG
tggaagaaaaggtgccactg

SEQ ID NO: 145384 - DNA, 20 bp, Artificial Sequence
  Description of Artificial Sequence: Synthetic oligonucleotide
  Target: ATXN1; (+) strand; PAM type: NRG; PAM sequence: AAG
gaaaaggtgccactgaggac

SEQ ID NO: 145385 - DNA, 20 bp, Artificial Sequence
  Description of Artificial Sequence: Synthetic oligonucleotide
  Target: ATXN1; (+) strand; PAM type: NRG; PAM sequence: AGG
aaaaggtgccactgaggaca

SEQ ID NO: 145386 - DNA, 20 bp, Artificial Sequence
  Description of Artificial Sequence: Synthetic oligonucleotide
  Target: ATXN1; (+) strand; PAM type: NRG; PAM sequence: GGG
aaaggtgccactgaggacaa

SEQ ID NO: 145387 - DNA, 20 bp, Artificial Sequence
  Description of Artificial Sequence: Synthetic oligonucleotide
  Target: ATXN1; (+) strand; PAM type: NRG; PAM sequence: AAG
gccactgaggacaagggaac

SEQ ID NO: 145388 - DNA, 20 bp, Artificial Sequence
  Description of Artificial Sequence: Synthetic oligonucleotide
  Target: ATXN1; (+) strand; PAM type: NRG; PAM sequence: AAG
gtcaatcaacaatgcccctg

SEQ ID NO: 145389 - DNA, 20 bp, Artificial Sequence
  Description of Artificial Sequence: Synthetic oligonucleotide
  Target: ATXN1; (+) strand; PAM type: NRG; PAM sequence: CAG
acaatgcccctgaagtaaac

SEQ ID NO: 145390 - DNA, 20 bp, Artificial Sequence
  Description of Artificial Sequence: Synthetic oligonucleotide
  Target: ATXN1; (+) strand; PAM type: NRG; PAM sequence: AGG
caatgcccctgaagtaaacc

SEQ ID NO: 145391 - DNA, 20 bp, Artificial Sequence
  Description of Artificial Sequence: Synthetic oligonucleotide
  Target: ATXN1; (+) strand; PAM type: NRG; PAM sequence: CAG
tgcccctgaagtaaaccagg

SEQ ID NO: 145392 - DNA, 20 bp, Artificial Sequence
  Description of Artificial Sequence: Synthetic oligonucleotide
  Target: ATXN1; (+) strand; PAM type: NRG; PAM sequence: AGG
gcccctgaagtaaaccaggc

SEQ ID NO: 145393 - DNA, 20 bp, Artificial Sequence
  Description of Artificial Sequence: Synthetic oligonucleotide
  Target: ATXN1; (+) strand; PAM type: NRG; PAM sequence: CAG
ccaggcaggtccgcactgca

SEQ ID NO: 145394 - DNA, 20 bp, Artificial Sequence
  Description of Artificial Sequence: Synthetic oligonucleotide
  Target: ATXN1; (+) strand; PAM type: NRG; PAM sequence: CAG
aggtccgcactgcacagtct

SEQ ID NO: 145395 - DNA, 20 bp, Artificial Sequence
  Description of Artificial Sequence: Synthetic oligonucleotide
  Target: ATXN1; (+) strand; PAM type: NRG; PAM sequence: AAG
ctcagctgtaattctatccc

SEQ ID NO: 145396 - DNA, 20 bp, Artificial Sequence
  Description of Artificial Sequence: Synthetic oligonucleotide
  Target: ATXN1; (+) strand; PAM type: NRG; PAM sequence: CAG
gtaattctatcccaagaaac

SEQ ID NO: 145397 - DNA, 20 bp, Artificial Sequence
  Description of Artificial Sequence: Synthetic oligonucleotide
  Target: ATXN1; (+) strand; PAM type: NRG; PAM sequence: GAG
aattctatcccaagaaacca

SEQ ID NO: 145398 - DNA, 20 bp, Artificial Sequence
  Description of Artificial Sequence: Synthetic oligonucleotide
  Target: ATXN1; (+) strand; PAM type: NRG; PAM sequence: CAG
tatcccaagaaaccagagca

SEQ ID NO: 145399 - DNA, 20 bp, Artificial Sequence
  Description of Artificial Sequence: Synthetic oligonucleotide
  Target: ATXN1; (+) strand; PAM type: NRG; PAM sequence: AGG
atcccaagaaaccagagcac

SEQ ID NO: 145400 - DNA, 20 bp, Artificial Sequence
  Description of Artificial Sequence: Synthetic oligonucleotide
  Target: ATXN1; (+) strand; PAM type: NRG; PAM sequence: CAG
aagaaaccagagcacaggac

SEQ ID NO: 145401 - DNA, 20 bp, Artificial Sequence
  Description of Artificial Sequence: Synthetic oligonucleotide
  Target: ATXN1; (+) strand; PAM type: NRG; PAM sequence: GAG
gaaaccagagcacaggacca

SEQ ID NO: 145402 - DNA, 20 bp, Artificial Sequence
  Description of Artificial Sequence: Synthetic oligonucleotide
  Target: ATXN1; (+) strand; PAM type: NRG; PAM sequence: AAG
acaggaccagagccacactt

SEQ ID NO: 145403 - DNA, 20 bp, Artificial Sequence
  Description of Artificial Sequence: Synthetic oligonucleotide
  Target: ATXN1; (+) strand; PAM type: NRG; PAM sequence: CAG
cagagccacacttaagcctg

SEQ ID NO: 145404 - DNA, 20 bp, Artificial Sequence
  Description of Artificial Sequence: Synthetic oligonucleotide
  Target: ATXN1; (+) strand; PAM type: NRG; PAM sequence: TAG
ccacacttaagcctgcagtg

SEQ ID NO: 145405 - DNA, 20 bp, Artificial Sequence
  Description of Artificial Sequence: Synthetic oligonucleotide
  Target: ATXN1; (+) strand; PAM type: NRG; PAM sequence: AGG
cacacttaagcctgcagtgt

SEQ ID NO: 145406 - DNA, 20 bp, Artificial Sequence
  Description of Artificial Sequence: Synthetic oligonucleotide
  Target: ATXN1; (+) strand; PAM type: NRG; PAM sequence: GGG
acacttaagcctgcagtgta

SEQ ID NO: 145407 - DNA, 20 bp, Artificial Sequence
  Description of Artificial Sequence: Synthetic oligonucleotide
  Target: ATXN1; (+) strand; PAM type: NRG; PAM sequence: TGG
tgcagtgtagggtgacgcca

SEQ ID NO: 145408 - DNA, 20 bp, Artificial Sequence
  Description of Artificial Sequence: Synthetic oligonucleotide
  Target: ATXN1; (+) strand; PAM type: NRG; PAM sequence: GGG
gcagtgtagggtgacgccat

SEQ ID NO: 145409 - DNA, 20 bp, Artificial Sequence
  Description of Artificial Sequence: Synthetic oligonucleotide
  Target: ATXN1; (+) strand; PAM type: NRG; PAM sequence: GGG
cagtgtagggtgacgccatg

SEQ ID NO: 145410 - DNA, 20 bp, Artificial Sequence
  Description of Artificial Sequence: Synthetic oligonucleotide
  Target: ATXN1; (+) strand; PAM type: NRG; PAM sequence: CAG
gacgccatggggccacgtga

SEQ ID NO: 145411 - DNA, 20 bp, Artificial Sequence
  Description of Artificial Sequence: Synthetic oligonucleotide
  Target: ATXN1; (+) strand; PAM type: NRG; PAM sequence: AAG
cgtgacagcctgcctctcca

SEQ ID NO: 145412 - DNA, 20 bp, Artificial Sequence
  Description of Artificial Sequence: Synthetic oligonucleotide
  Target: ATXN1; (+) strand; PAM type: NRG; PAM sequence: CAG
ctctccaaagctgttactgt

SEQ ID NO: 145413 - DNA, 20 bp, Artificial Sequence
  Description of Artificial Sequence: Synthetic oligonucleotide
  Target: ATXN1; (+) strand; PAM type: NRG; PAM sequence: TAG
tccaaagctgttactgtcag

SEQ ID NO: 145414 - DNA, 20 bp, Artificial Sequence
  Description of Artificial Sequence: Synthetic oligonucleotide
  Target: ATXN1; (+) strand; PAM type: NRG; PAM sequence: TAG
ctgttactgtcagtagtatt

SEQ ID NO: 145415 - DNA, 20 bp, Artificial Sequence
  Description of Artificial Sequence: Synthetic oligonucleotide
  Target: ATXN1; (+) strand; PAM type: NRG; PAM sequence: GAG
gttactgtcagtagtattta

SEQ ID NO: 145416 - DNA, 20 bp, Artificial Sequence
  Description of Artificial Sequence: Synthetic oligonucleotide
  Target: ATXN1; (+) strand; PAM type: NRG; PAM sequence: AGG
ttactgtcagtagtatttag

SEQ ID NO: 145417 - DNA, 20 bp, Artificial Sequence
  Description of Artificial Sequence: Synthetic oligonucleotide
  Target: ATXN1; (+) strand; PAM type: NRG; PAM sequence: AAG
tgtcagtagtatttagagga

SEQ ID NO: 145418 - DNA, 20 bp, Artificial Sequence
  Description of Artificial Sequence: Synthetic oligonucleotide
  Target: ATXN1; (+) strand; PAM type: NRG; PAM sequence: AGG
gtcagtagtatttagaggaa

SEQ ID NO: 145419 - DNA, 20 bp, Artificial Sequence
  Description of Artificial Sequence: Synthetic oligonucleotide
  Target: ATXN1; (+) strand; PAM type: NRG; PAM sequence: AAG
gtatttagaggaaaggaaaa

SEQ ID NO: 145420 - DNA, 20 bp, Artificial Sequence
  Description of Artificial Sequence: Synthetic oligonucleotide
  Target: ATXN1; (+) strand; PAM type: NRG; PAM sequence: AAG
gaaaggaaaaaagttgtaac

SEQ ID NO: 145421 - DNA, 20 bp, Artificial Sequence
  Description of Artificial Sequence: Synthetic oligonucleotide
  Target: ATXN1; (+) strand; PAM type: NRG; PAM sequence: AAG
acaagtgtaacacgaacatt

SEQ ID NO: 145422 - DNA, 20 bp, Artificial Sequence
  Description of Artificial Sequence: Synthetic oligonucleotide
  Target: ATXN1; (+) strand; PAM type: NRG; PAM sequence: AGG
caagtgtaacacgaacatta

SEQ ID NO: 145423 - DNA, 20 bp, Artificial Sequence
  Description of Artificial Sequence: Synthetic oligonucleotide
  Target: ATXN1; (+) strand; PAM type: NRG; PAM sequence: AAG
cacgaacattaaggaatacc

SEQ ID NO: 145424 - DNA, 20 bp, Artificial Sequence
  Description of Artificial Sequence: Synthetic oligonucleotide
  Target: ATXN1; (+) strand; PAM type: NRG; PAM sequence: CAG
aacattaaggaataccaagt

SEQ ID NO: 145425 - DNA, 20 bp, Artificial Sequence
  Description of Artificial Sequence: Synthetic oligonucleotide
  Target: ATXN1; (+) strand; PAM type: NRG; PAM sequence: GAG
cattaaggaataccaagtca

SEQ ID NO: 145426 - DNA, 20 bp, Artificial Sequence
  Description of Artificial Sequence: Synthetic oligonucleotide
  Target: ATXN1; (+) strand; PAM type: NRG; PAM sequence: TAG
aataccaagtcagagccaat

SEQ ID NO: 145427 - DNA, 20 bp, Artificial Sequence
  Description of Artificial Sequence: Synthetic oligonucleotide
  Target: ATXN1; (+) strand; PAM type: NRG; PAM sequence: AGG
ataccaagtcagagccaatt

SEQ ID NO: 145428 - DNA, 20 bp, Artificial Sequence
  Description of Artificial Sequence: Synthetic oligonucleotide
  Target: ATXN1; (+) strand; PAM type: NRG; PAM sequence: TGG
agccaattaggacgataatt

SEQ ID NO: 145429 - DNA, 20 bp, Artificial Sequence
  Description of Artificial Sequence: Synthetic oligonucleotide
  Target: ATXN1; (+) strand; PAM type: NRG; PAM sequence: AAG
cctgcctcatgcatatgaaa

SEQ ID NO: 145430 - DNA, 20 bp, Artificial Sequence
  Description of Artificial Sequence: Synthetic oligonucleotide
  Target: ATXN1; (+) strand; PAM type: NRG; PAM sequence: AGG
ctgcctcatgcatatgaaaa

SEQ ID NO: 145431 - DNA, 20 bp, Artificial Sequence
  Description of Artificial Sequence: Synthetic oligonucleotide
  Target: ATXN1; (+) strand; PAM type: NRG; PAM sequence: GAG
aaaaaggatccgccatcaat

SEQ ID NO: 145432 - DNA, 20 bp, Artificial Sequence
  Description of Artificial Sequence: Synthetic oligonucleotide
  Target: ATXN1; (+) strand; PAM type: NRG; PAM sequence: TGG
catcaatgagcaataatgca

SEQ ID NO: 145433 - DNA, 20 bp, Artificial Sequence
  Description of Artificial Sequence: Synthetic oligonucleotide
  Target: ATXN1; (+) strand; PAM type: NRG; PAM sequence: GGG
atcaatgagcaataatgcat

SEQ ID NO: 145434 - DNA, 20 bp, Artificial Sequence
  Description of Artificial Sequence: Synthetic oligonucleotide
  Target: ATXN1; (+) strand; PAM type: NRG; PAM sequence: TGG
gcaataatgcatgggatttg

SEQ ID NO: 145435 - DNA, 20 bp, Artificial Sequence
  Description of Artificial Sequence: Synthetic oligonucleotide
  Target: ATXN1; (+) strand; PAM type: NRG; PAM sequence: GGG
caataatgcatgggatttgt

SEQ ID NO: 145436 - DNA, 20 bp, Artificial Sequence
  Description of Artificial Sequence: Synthetic oligonucleotide
  Target: ATXN1; (+) strand; PAM type: NRG; PAM sequence: AAG
gctctaacttcaatacatca

SEQ ID NO: 145437 - DNA, 20 bp, Artificial Sequence
  Description of Artificial Sequence: Synthetic oligonucleotide
  Target: ATXN1; (+) strand; PAM type: NRG; PAM sequence: TAG
tccgtcttttttattcccat

SEQ ID NO: 145438 - DNA, 20 bp, Artificial Sequence
  Description of Artificial Sequence: Synthetic oligonucleotide
  Target: ATXN1; (+) strand; PAM type: NRG; PAM sequence: TGG
cccattagctcacccttgtc

SEQ ID NO: 145439 - DNA, 20 bp, Artificial Sequence
  Description of Artificial Sequence: Synthetic oligonucleotide
  Target: ATXN1; (+) strand; PAM type: NRG; PAM sequence: AAG
gctcacccttgtctggatga

SEQ ID NO: 145440 - DNA, 20 bp, Artificial Sequence
  Description of Artificial Sequence: Synthetic oligonucleotide
  Target: ATXN1; (+) strand; PAM type: NRG; PAM sequence: GAG
tcacccttgtctggatgaaa

SEQ ID NO: 145441 - DNA, 20 bp, Artificial Sequence
  Description of Artificial Sequence: Synthetic oligonucleotide
  Target: ATXN1; (+) strand; PAM type: NRG; PAM sequence: CAG
cttgtctggatgaaagagct

SEQ ID NO: 145442 - DNA, 20 bp, Artificial Sequence
  Description of Artificial Sequence: Synthetic oligonucleotide
  Target: ATXN1; (+) strand; PAM type: NRG; PAM sequence: AAG
gaactgtttatatatttttc

SEQ ID NO: 145443 - DNA, 20 bp, Artificial Sequence
  Description of Artificial Sequence: Synthetic oligonucleotide
  Target: ATXN1; (+) strand; PAM type: NRG; PAM sequence: TAG
tatatttttcaagtcatgat

SEQ ID NO: 145444 - DNA, 20 bp, Artificial Sequence
  Description of Artificial Sequence: Synthetic oligonucleotide
  Target: ATXN1; (+) strand; PAM type: NRG; PAM sequence: AGG
atatttttcaagtcatgatt

SEQ ID NO: 145445 - DNA, 20 bp, Artificial Sequence
  Description of Artificial Sequence: Synthetic oligonucleotide
  Target: ATXN1; (+) strand; PAM type: NRG; PAM sequence: TAG
tcaagtcatgattaggccat

SEQ ID NO: 145446 - DNA, 20 bp, Artificial Sequence
  Description of Artificial Sequence: Synthetic oligonucleotide
  Target: ATXN1; (+) strand; PAM type: NRG; PAM sequence: GAG
tgattaggccattagtcact

SEQ ID NO: 145447 - DNA, 20 bp, Artificial Sequence
  Description of Artificial Sequence: Synthetic oligonucleotide
  Target: ATXN1; (+) strand; PAM type: NRG; PAM sequence: CAG
tagtcactgagcatattgca

SEQ ID NO: 145448 - DNA, 20 bp, Artificial Sequence
  Description of Artificial Sequence: Synthetic oligonucleotide
  Target: ATXN1; (+) strand; PAM type: NRG; PAM sequence: TAG
gagcatattgcacagtaaac

SEQ ID NO: 145449 - DNA, 20 bp, Artificial Sequence
  Description of Artificial Sequence: Synthetic oligonucleotide
  Target: ATXN1; (+) strand; PAM type: NRG; PAM sequence: GAG
gcatattgcacagtaaacta

SEQ ID NO: 145450 - DNA, 20 bp, Artificial Sequence
  Description of Artificial Sequence: Synthetic oligonucleotide
  Target: ATXN1; (+) strand; PAM type: NRG; PAM sequence: AAG
ctgccattatgcaacttccc

SEQ ID NO: 145451 - DNA, 20 bp, Artificial Sequence
  Description of Artificial Sequence: Synthetic oligonucleotide
  Target: ATXN1; (+) strand; PAM type: NRG; PAM sequence: CAG
tgcaacttcccaagaacata

SEQ ID NO: 145452 - DNA, 20 bp, Artificial Sequence
  Description of Artificial Sequence: Synthetic oligonucleotide
  Target: ATXN1; (+) strand; PAM type: NRG; PAM sequence: GAG
caacttcccaagaacataca

SEQ ID NO: 145453 - DNA, 20 bp, Artificial Sequence
  Description of Artificial Sequence: Synthetic oligonucleotide
  Target: ATXN1; (+) strand; PAM type: NRG; PAM sequence: GAG
acttcccaagaacatacaga

SEQ ID NO: 145454 - DNA, 20 bp, Artificial Sequence
  Description of Artificial Sequence: Synthetic oligonucleotide
  Target: ATXN1; (+) strand; PAM type: NRG; PAM sequence: CAG
gaacatacagagagcattta

SEQ ID NO: 145455 - DNA, 20 bp, Artificial Sequence
  Description of Artificial Sequence: Synthetic oligonucleotide
  Target: ATXN1; (+) strand; PAM type: NRG; PAM sequence: GAG
atacagagagcatttacagt

SEQ ID NO: 145456 - DNA, 20 bp, Artificial Sequence
  Description of Artificial Sequence: Synthetic oligonucleotide
  Target: ATXN1; (+) strand; PAM type: NRG; PAM sequence: AGG
tacagagagcatttacagtg

SEQ ID NO: 145457 - DNA, 20 bp, Artificial Sequence
  Description of Artificial Sequence: Synthetic oligonucleotide
  Target: ATXN1; (+) strand; PAM type: NRG; PAM sequence: CAG
gagcatttacagtgaggcca

SEQ ID NO: 145458 - DNA, 20 bp, Artificial Sequence
  Description of Artificial Sequence: Synthetic oligonucleotide
  Target: ATXN1; (+) strand; PAM type: NRG; PAM sequence: CAG
ttacagtgaggccacagtgc

SEQ ID NO: 145459 - DNA, 20 bp, Artificial Sequence
  Description of Artificial Sequence: Synthetic oligonucleotide
  Target: ATXN1; (+) strand; PAM type: NRG; PAM sequence: TGG
agtgccagcaaaatgtgcaa

SEQ ID NO: 145460 - DNA, 20 bp, Artificial Sequence
  Description of Artificial Sequence: Synthetic oligonucleotide
  Target: ATXN1; (+) strand; PAM type: NRG; PAM sequence: GAG
tgccagcaaaatgtgcaatg

SEQ ID NO: 145461 - DNA, 20 bp, Artificial Sequence
  Description of Artificial Sequence: Synthetic oligonucleotide
  Target: ATXN1; (+) strand; PAM type: NRG; PAM sequence: CAG
gtgcaatggagactatttat

SEQ ID NO: 145462 - DNA, 20 bp, Artificial Sequence
  Description of Artificial Sequence: Synthetic oligonucleotide
  Target: ATXN1; (+) strand; PAM type: NRG; PAM sequence: AAG
gactatttatcagcaattat

SEQ ID NO: 145463 - DNA, 20 bp, Artificial Sequence
  Description of Artificial Sequence: Synthetic oligonucleotide
  Target: ATXN1; (+) strand; PAM type: NRG; PAM sequence: TGG
tgccaaataaaatatacacg

SEQ ID NO: 145464 - DNA, 20 bp, Artificial Sequence
  Description of Artificial Sequence: Synthetic oligonucleotide
  Target: ATXN1; (+) strand; PAM type: NRG; PAM sequence: CAG
caaataaaatatacacgtgg

SEQ ID NO: 145465 - DNA, 20 bp, Artificial Sequence
  Description of Artificial Sequence: Synthetic oligonucleotide
  Target: ATXN1; (+) strand; PAM type: NRG; PAM sequence: CAG
aaatatacacgtggcagata

SEQ ID NO: 145466 - DNA, 20 bp, Artificial Sequence
  Description of Artificial Sequence: Synthetic oligonucleotide
  Target: ATXN1; (+) strand; PAM type: NRG; PAM sequence: GAG
acgtggcagatacagaactt

SEQ ID NO: 145467 - DNA, 20 bp, Artificial Sequence
  Description of Artificial Sequence: Synthetic oligonucleotide
  Target: ATXN1; (+) strand; PAM type: NRG; PAM sequence: AGG
cgtggcagatacagaacttg

SEQ ID NO: 145468 - DNA, 20 bp, Artificial Sequence
  Description of Artificial Sequence: Synthetic oligonucleotide
  Target: ATXN1; (+) strand; PAM type: NRG; PAM sequence: GGG
gtggcagatacagaacttga

SEQ ID NO: 145469 - DNA, 20 bp, Artificial Sequence
  Description of Artificial Sequence: Synthetic oligonucleotide
  Target: ATXN1; (+) strand; PAM type: NRG; PAM sequence: GGG
tggcagatacagaacttgag

SEQ ID NO: 145470 - DNA, 20 bp, Artificial Sequence
  Description of Artificial Sequence: Synthetic oligonucleotide
  Target: ATXN1; (+) strand; PAM type: NRG; PAM sequence: GGG
ggcagatacagaacttgagg

SEQ ID NO: 145471 - DNA, 20 bp, Artificial Sequence
  Description of Artificial Sequence: Synthetic oligonucleotide
  Target: ATXN1; (+) strand; PAM type: NRG; PAM sequence: AAG
atacagaacttgagggggaa

SEQ ID NO: 145472 - DNA, 20 bp, Artificial Sequence
  Description of Artificial Sequence: Synthetic oligonucleotide
  Target: ATXN1; (+) strand; PAM type: NRG; PAM sequence: AAG
ggggaaaagatgcatgatta

SEQ ID NO: 145473 - DNA, 20 bp, Artificial Sequence
  Description of Artificial Sequence: Synthetic oligonucleotide
  Target: ATXN1; (+) strand; PAM type: NRG; PAM sequence: TAG
atttgctcttctgaatgtat

SEQ ID NO: 145474 - DNA, 20 bp, Artificial Sequence
  Description of Artificial Sequence: Synthetic oligonucleotide
  Target: ATXN1; (+) strand; PAM type: NRG; PAM sequence: GAG
ttgctcttctgaatgtatta

SEQ ID NO: 145475 - DNA, 20 bp, Artificial Sequence
  Description of Artificial Sequence: Synthetic oligonucleotide
  Target: ATXN1; (+) strand; PAM type: NRG; PAM sequence: AAG
gtattagagcctgaaaacga

SEQ ID NO: 145476 - DNA, 20 bp, Artificial Sequence
  Description of Artificial Sequence: Synthetic oligonucleotide
  Target: ATXN1; (+) strand; PAM type: NRG; PAM sequence: CAG
aaacgaaagtccccctgaac

SEQ ID NO: 145477 - DNA, 20 bp, Artificial Sequence
  Description of Artificial Sequence: Synthetic oligonucleotide
  Target: ATXN1; (+) strand; PAM type: NRG; PAM sequence: AAG
cgaaagtccccctgaaccag

SEQ ID NO: 145478 - DNA, 20 bp, Artificial Sequence
  Description of Artificial Sequence: Synthetic oligonucleotide
  Target: ATXN1; (+) strand; PAM type: NRG; PAM sequence: CAG
ccagaagcgaatcttgaact

SEQ ID NO: 145479 - DNA, 20 bp, Artificial Sequence
  Description of Artificial Sequence: Synthetic oligonucleotide
  Target: ATXN1; (+) strand; PAM type: NRG; PAM sequence: CAG
gcgaatcttgaactcagtct

SEQ ID NO: 145480 - DNA, 20 bp, Artificial Sequence
  Description of Artificial Sequence: Synthetic oligonucleotide
  Target: ATXN1; (+) strand; PAM type: NRG; PAM sequence: TAG
atcttgaactcagtctcagt

SEQ ID NO: 145481 - DNA, 20 bp, Artificial Sequence
  Description of Artificial Sequence: Synthetic oligonucleotide
  Target: ATXN1; (+) strand; PAM type: NRG; PAM sequence: TGG
gaactcagtctcagttagct

SEQ ID NO: 145482 - DNA, 20 bp, Artificial Sequence
  Description of Artificial Sequence: Synthetic oligonucleotide
  Target: ATXN1; (+) strand; PAM type: NRG; PAM sequence: TAG
tcagtctcagttagcttggt

SEQ ID NO: 145483 - DNA, 20 bp, Artificial Sequence
  Description of Artificial Sequence: Synthetic oligonucleotide
  Target: ATXN1; (+) strand; PAM type: NRG; PAM sequence: TGG
tatctgaacacactcaatgt

SEQ ID NO: 145484 - DNA, 20 bp, Artificial Sequence
  Description of Artificial Sequence: Synthetic oligonucleotide
  Target: ATXN1; (+) strand; PAM type: NRG; PAM sequence: GGG
atctgaacacactcaatgtt

SEQ ID NO: 145485 - DNA, 20 bp, Artificial Sequence
  Description of Artificial Sequence: Synthetic oligonucleotide
  Target: ATXN1; (+) strand; PAM type: NRG; PAM sequence: AAG
ctcaatgttgggtccaacat

SEQ ID NO: 145486 - DNA, 20 bp, Artificial Sequence
  Description of Artificial Sequence: Synthetic oligonucleotide
  Target: ATXN1; (+) strand; PAM type: NRG; PAM sequence: AGG
tcaatgttgggtccaacata

SEQ ID NO: 145487 - DNA, 20 bp, Artificial Sequence
  Description of Artificial Sequence: Synthetic oligonucleotide
  Target: ATXN1; (+) strand; PAM type: NRG; PAM sequence: AAG
tcccttcttctttcttatta

SEQ ID NO: 145488 - DNA, 20 bp, Artificial Sequence
  Description of Artificial Sequence: Synthetic oligonucleotide
  Target: ATXN1; (+) strand; PAM type: NRG; PAM sequence: CAG
tctttcttattaaagattcc

SEQ ID NO: 145489 - DNA, 20 bp, Artificial Sequence
  Description of Artificial Sequence: Synthetic oligonucleotide
  Target: ATXN1; (+) strand; PAM type: NRG; PAM sequence: AGG
ctttcttattaaagattccc

SEQ ID NO: 145490 - DNA, 20 bp, Artificial Sequence
  Description of Artificial Sequence: Synthetic oligonucleotide
  Target: ATXN1; (+) strand; PAM type: NRG; PAM sequence: CAG
tattaaagattcccaggcct

SEQ ID NO: 145491 - DNA, 20 bp, Artificial Sequence
  Description of Artificial Sequence: Synthetic oligonucleotide
  Target: ATXN1; (+) strand; PAM type: NRG; PAM sequence: AAG
ctcagcatcaccccctaccc

SEQ ID NO: 145492 - DNA, 20 bp, Artificial Sequence
  Description of Artificial Sequence: Synthetic oligonucleotide
  Target: ATXN1; (+) strand; PAM type: NRG; PAM sequence: TGG
tcaccccctacccaagcact

SEQ ID NO: 145493 - DNA, 20 bp, Artificial Sequence
  Description of Artificial Sequence: Synthetic oligonucleotide
  Target: ATXN1; (+) strand; PAM type: NRG; PAM sequence: CAG
acccaagcacttggataatt

SEQ ID NO: 145494 - DNA, 20 bp, Artificial Sequence
  Description of Artificial Sequence: Synthetic oligonucleotide
  Target: ATXN1; (+) strand; PAM type: NRG; PAM sequence: TAG
caagcacttggataattcag

SEQ ID NO: 145495 - DNA, 20 bp, Artificial Sequence
  Description of Artificial Sequence: Synthetic oligonucleotide
  Target: ATXN1; (+) strand; PAM type: NRG; PAM sequence: GAG
agcacttggataattcagta

SEQ ID NO: 145496 - DNA, 20 bp, Artificial Sequence
  Description of Artificial Sequence: Synthetic oligonucleotide
  Target: ATXN1; (+) strand; PAM type: NRG; PAM sequence: AGG
gcacttggataattcagtag

SEQ ID NO: 145497 - DNA, 20 bp, Artificial Sequence
  Description of Artificial Sequence: Synthetic oligonucleotide
  Target: ATXN1; (+) strand; PAM type: NRG; PAM sequence: TGG
gataattcagtagaggccac

SEQ ID NO: 145498 - DNA, 20 bp, Artificial Sequence
  Description of Artificial Sequence: Synthetic oligonucleotide
  Target: ATXN1; (+) strand; PAM type: NRG; PAM sequence: GGG
ataattcagtagaggccact

SEQ ID NO: 145499 - DNA, 20 bp, Artificial Sequence
  Description of Artificial Sequence: Synthetic oligonucleotide
  Target: ATXN1; (+) strand; PAM type: NRG; PAM sequence: GGG
taattcagtagaggccactg

SEQ ID NO: 145500 - DNA, 20 bp, Artificial Sequence
  Description of Artificial Sequence: Synthetic oligonucleotide
  Target: ATXN1; (+) strand; PAM type: NRG; PAM sequence: GAG
attcagtagaggccactggg

SEQ ID NO: 145501 - DNA, 20 bp, Artificial Sequence
  Description of Artificial Sequence: Synthetic oligonucleotide
  Target: ATXN1; (+) strand; PAM type: NRG; PAM sequence: GAG
ggggagaacttttttttttt

SEQ ID NO: 145502 - DNA, 20 bp, Artificial Sequence
  Description of Artificial Sequence: Synthetic oligonucleotide
  Target: ATXN1; (+) strand; PAM type: NRG; PAM sequence: TGG
agaactttttttttttgaga

SEQ ID NO: 145503 - DNA, 20 bp, Artificial Sequence
  Description of Artificial Sequence: Synthetic oligonucleotide
  Target: ATXN1; (+) strand; PAM type: NRG; PAM sequence: GAG
aactttttttttttgagatg

SEQ ID NO: 145504 - DNA, 20 bp, Artificial Sequence
  Description of Artificial Sequence: Synthetic oligonucleotide
  Target: ATXN1; (+) strand; PAM type: NRG; PAM sequence: CAG
tggagtctcactctgtcacc

SEQ ID NO: 145505 - DNA, 20 bp, Artificial Sequence
  Description of Artificial Sequence: Synthetic oligonucleotide
  Target: ATXN1; (+) strand; PAM type: NRG; PAM sequence: AGG
ggagtctcactctgtcaccc

SEQ ID NO: 145506 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcacccaggc

SEQ ID NO: 145507 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcacccaggctg

SEQ ID NO: 145508 - DNA, 20 bp, Artificial Sequence
  Description of Artificial Sequence: Synthetic oligonucleotide
  Target: ATXN1; (+) strand; PAM type: NRG; PAM sequence: CAG
ctgtcacccaggctggagtg

SEQ ID NO: 145509 - DNA, 20 bp, Artificial Sequence
  Description of Artificial Sequence: Synthetic oligonucleotide
  Target: ATXN1; (+) strand; PAM type: NRG; PAM sequence: CAG
ggagtgcagtgatgcaatct

SEQ ID NO: 145510 - DNA, 20 bp, Artificial Sequence
  Description of Artificial Sequence: Synthetic oligonucleotide
  Target: ATXN1; (+) strand; PAM type: NRG; PAM sequence: CAG
tcactgcaacctccacctcc

SEQ ID NO: 145511 - DNA, 20 bp, Artificial Sequence
  Description of Artificial Sequence: Synthetic oligonucleotide
  Target: ATXN1; (+) strand; PAM type: NRG; PAM sequence: AGG
cactgcaacctccacctccc

SEQ ID NO: 145512 - DNA, 20 bp, Artificial Sequence
  Description of Artificial Sequence: Synthetic oligonucleotide
  Target: ATXN1; (+) strand; PAM type: NRG; PAM sequence: AAG
aacctccacctcccaggttc

SEQ ID NO: 145513 - DNA, 20 bp, Artificial Sequence
  Description of Artificial Sequence: Synthetic oligonucleotide
  Target: ATXN1; (+) strand; PAM type: NRG; PAM sequence: CAG
ttcaagtgattctcgtgcct

SEQ ID NO: 145514 - DNA, 20 bp, Artificial Sequence
  Description of Artificial Sequence: Synthetic oligonucleotide
  Target: ATXN1; (+) strand; PAM type: NRG; PAM sequence: AAG
ttctcgtgcctcagcctccc

SEQ ID NO: 145515 - DNA, 20 bp, Artificial Sequence
  Description of Artificial Sequence: Synthetic oligonucleotide
  Target: ATXN1; (+) strand; PAM type: NRG; PAM sequence: TAG
tcgtgcctcagcctcccaag

SEQ ID NO: 145516 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtagc

SEQ ID NO: 145517 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagct

SEQ ID NO: 145518 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggatta

SEQ ID NO: 145519 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggattac

SEQ ID NO: 145520 - DNA, 20 bp, Artificial Sequence
  Description of Artificial Sequence: Synthetic oligonucleotide
  Target: ATXN1; (+) strand; PAM type: NRG; PAM sequence: CAG
caggtgtgcaccaccacacc

SEQ ID NO: 145521 - DNA, 20 bp, Artificial Sequence
  Description of Artificial Sequence: Synthetic oligonucleotide
  Target: ATXN1; (+) strand; PAM type: NRG; PAM sequence: TAG
ccagctaatttttgtatttt

SEQ ID NO: 145522 - DNA, 20 bp, Artificial Sequence
  Description of Artificial Sequence: Synthetic oligonucleotide
  Target: ATXN1; (+) strand; PAM type: NRG; PAM sequence: AAG
taatttttgtatttttagta

SEQ ID NO: 145523 - DNA, 20 bp, Artificial Sequence
  Description of Artificial Sequence: Synthetic oligonucleotide
  Target: ATXN1; (+) strand; PAM type: NRG; PAM sequence: CAG
ttgtatttttagtaaagatg

SEQ ID NO: 145524 - DNA, 20 bp, Artificial Sequence
  Description of Artificial Sequence: Synthetic oligonucleotide
  Target: ATXN1; (+) strand; PAM type: NRG; PAM sequence: TGG
aagatgcagtttcaccatga

SEQ ID NO: 145525 - DNA, 20 bp, Artificial Sequence
  Description of Artificial Sequence: Synthetic oligonucleotide
  Target: ATXN1; (+) strand; PAM type: NRG; PAM sequence: CAG
tgcagtttcaccatgatggc

SEQ ID NO: 145526 - DNA, 20 bp, Artificial Sequence
  Description of Artificial Sequence: Synthetic oligonucleotide
  Target: ATXN1; (+) strand; PAM type: NRG; PAM sequence: AGG
gcagtttcaccatgatggcc

SEQ ID NO: 145527 - DNA, 20 bp, Artificial Sequence
  Description of Artificial Sequence: Synthetic oligonucleotide
  Target: ATXN1; (+) strand; PAM type: NRG; PAM sequence: CAG
ttgtctcgaactcctgacct

SEQ ID NO: 145528 - DNA, 20 bp, Artificial Sequence
  Description of Artificial Sequence: Synthetic oligonucleotide
  Target: ATXN1; (+) strand; PAM type: NRG; PAM sequence: AGG
tgtctcgaactcctgacctc

SEQ ID NO: 145529 - DNA, 20 bp, Artificial Sequence
  Description of Artificial Sequence: Synthetic oligonucleotide
  Target: ATXN1; (+) strand; PAM type: NRG; PAM sequence: CGG
ctcaggtgatctgtccgcct

SEQ ID NO: 145530 - DNA, 20 bp, Artificial Sequence
  Description of Artificial Sequence: Synthetic oligonucleotide
  Target: ATXN1; (+) strand; PAM type: NRG; PAM sequence: AAG
ctgtccgcctcggcctccca

SEQ ID NO: 145531 - DNA, 20 bp, Artificial Sequence
  Description of Artificial Sequence: Synthetic oligonucleotide
  Target: ATXN1; (+) strand; PAM type: NRG; PAM sequence: TGG
gcctcggcctcccaaagtgc

SEQ ID NO: 145532 - DNA, 20 bp, Artificial Sequence
  Description of Artificial Sequence: Synthetic oligonucleotide
  Target: ATXN1; (+) strand; PAM type: NRG; PAM sequence: GGG
cctcggcctcccaaagtgct

SEQ ID NO: 145533 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 145534 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 145535 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggtgt

SEQ ID NO: 145536 - DNA, 20 bp, Artificial Sequence
  Description of Artificial Sequence: Synthetic oligonucleotide
  Target: ATXN1; (+) strand; PAM type: NRG; PAM sequence: TGG
caggtgtgagccaccgcgcc

SEQ ID NO: 145537 - DNA, 20 bp, Artificial Sequence
  Description of Artificial Sequence: Synthetic oligonucleotide
  Target: ATXN1; (+) strand; PAM type: NRG; PAM sequence: TGG
gccaccgcgcctggcctctc

SEQ ID NO: 145538 - DNA, 20 bp, Artificial Sequence
  Description of Artificial Sequence: Synthetic oligonucleotide
  Target: ATXN1; (+) strand; PAM type: NRG; PAM sequence: GGG
ccaccgcgcctggcctctct

SEQ ID NO: 145539 - DNA, 20 bp, Artificial Sequence
  Description of Artificial Sequence: Synthetic oligonucleotide
  Target: ATXN1; (+) strand; PAM type: NRG; PAM sequence: GGG
caccgcgcctggcctctctg

SEQ ID NO: 145540 - DNA, 20 bp, Artificial Sequence
  Description of Artificial Sequence: Synthetic oligonucleotide
  Target: ATXN1; (+) strand; PAM type: NRG; PAM sequence: AAG
ggcctctctggggttttctg

SEQ ID NO: 145541 - DNA, 20 bp, Artificial Sequence
  Description of Artificial Sequence: Synthetic oligonucleotide
  Target: ATXN1; (+) strand; PAM type: NRG; PAM sequence: TAG
tggggttttctgaagccaca

SEQ ID NO: 145542 - DNA, 20 bp, Artificial Sequence
  Description of Artificial Sequence: Synthetic oligonucleotide
  Target: ATXN1; (+) strand; PAM type: NRG; PAM sequence: GAG
ccacatagacttacatgttt

SEQ ID NO: 145543 - DNA, 20 bp, Artificial Sequence
  Description of Artificial Sequence: Synthetic oligonucleotide
  Target: ATXN1; (+) strand; PAM type: NRG; PAM sequence: AGG
cacatagacttacatgtttg

SEQ ID NO: 145544 - DNA, 20 bp, Artificial Sequence
  Description of Artificial Sequence: Synthetic oligonucleotide
  Target: ATXN1; (+) strand; PAM type: NRG; PAM sequence: AAG
gtttgaggatttcccattca

SEQ ID NO: 145545 - DNA, 20 bp, Artificial Sequence
  Description of Artificial Sequence: Synthetic oligonucleotide
  Target: ATXN1; (+) strand; PAM type: NRG; PAM sequence: AAG
atttcccattcaaagtccta

SEQ ID NO: 145546 - DNA, 20 bp, Artificial Sequence
  Description of Artificial Sequence: Synthetic oligonucleotide
  Target: ATXN1; (+) strand; PAM type: NRG; PAM sequence: TAG
aaagtcctaaagaacactaa

SEQ ID NO: 145547 - DNA, 20 bp, Artificial Sequence
  Description of Artificial Sequence: Synthetic oligonucleotide
  Target: ATXN1; (+) strand; PAM type: NRG; PAM sequence: AAG
gtcctaaagaacactaatag

SEQ ID NO: 145548 - DNA, 20 bp, Artificial Sequence
  Description of Artificial Sequence: Synthetic oligonucleotide
  Target: ATXN1; (+) strand; PAM type: NRG; PAM sequence: AAG
aagaacactaatagaagaaa

SEQ ID NO: 145549 - DNA, 20 bp, Artificial Sequence
  Description of Artificial Sequence: Synthetic oligonucleotide
  Target: ATXN1; (+) strand; PAM type: NRG; PAM sequence: AAG
acactaatagaagaaaaaga

SEQ ID NO: 145550 - DNA, 20 bp, Artificial Sequence
  Description of Artificial Sequence: Synthetic oligonucleotide
  Target: ATXN1; (+) strand; PAM type: NRG; PAM sequence: AGG
cactaatagaagaaaaagaa

SEQ ID NO: 145551 - DNA, 20 bp, Artificial Sequence
  Description of Artificial Sequence: Synthetic oligonucleotide
  Target: ATXN1; (+) strand; PAM type: NRG; PAM sequence: AAG
aaaaagaaaggaacatgtaa

SEQ ID NO: 145552 - DNA, 20 bp, Artificial Sequence
  Description of Artificial Sequence: Synthetic oligonucleotide
  Target: ATXN1; (+) strand; PAM type: NRG; PAM sequence: TGG
aagaaaggaacatgtaaaag

SEQ ID NO: 145553 - DNA, 20 bp, Artificial Sequence
  Description of Artificial Sequence: Synthetic oligonucleotide
  Target: ATXN1; (+) strand; PAM type: NRG; PAM sequence: CAG
aaaagtggcatttaatttat

SEQ ID NO: 145554 - DNA, 20 bp, Artificial Sequence
  Description of Artificial Sequence: Synthetic oligonucleotide
  Target: ATXN1; (+) strand; PAM type: NRG; PAM sequence: AGG
aaagtggcatttaatttatc

SEQ ID NO: 145555 - DNA, 20 bp, Artificial Sequence
  Description of Artificial Sequence: Synthetic oligonucleotide
  Target: ATXN1; (+) strand; PAM type: NRG; PAM sequence: TAG
atttaatttatcaggaccct

SEQ ID NO: 145556 - DNA, 20 bp, Artificial Sequence
  Description of Artificial Sequence: Synthetic oligonucleotide
  Target: ATXN1; (+) strand; PAM type: NRG; PAM sequence: AAG
tcacatacattgcccatgat

SEQ ID NO: 145557 - DNA, 20 bp, Artificial Sequence
  Description of Artificial Sequence: Synthetic oligonucleotide
  Target: ATXN1; (+) strand; PAM type: NRG; PAM sequence: CAG
atacattgcccatgataagc

SEQ ID NO: 145558 - DNA, 20 bp, Artificial Sequence
  Description of Artificial Sequence: Synthetic oligonucleotide
  Target: ATXN1; (+) strand; PAM type: NRG; PAM sequence: AAG
gccagtgacaaatataattg

SEQ ID NO: 145559 - DNA, 20 bp, Artificial Sequence
  Description of Artificial Sequence: Synthetic oligonucleotide
  Target: ATXN1; (+) strand; PAM type: NRG; PAM sequence: AAG
caaatataattgaagtttta

SEQ ID NO: 145560 - DNA, 20 bp, Artificial Sequence
  Description of Artificial Sequence: Synthetic oligonucleotide
  Target: ATXN1; (+) strand; PAM type: NRG; PAM sequence: AAG
aagttttaaagtacatgtgc

SEQ ID NO: 145561 - DNA, 20 bp, Artificial Sequence
  Description of Artificial Sequence: Synthetic oligonucleotide
  Target: ATXN1; (+) strand; PAM type: NRG; PAM sequence: AGG
agttttaaagtacatgtgca

SEQ ID NO: 145562 - DNA, 20 bp, Artificial Sequence
  Description of Artificial Sequence: Synthetic oligonucleotide
  Target: ATXN1; (+) strand; PAM type: NRG; PAM sequence: GGG
gttttaaagtacatgtgcaa

SEQ ID NO: 145563 - DNA, 20 bp, Artificial Sequence
  Description of Artificial Sequence: Synthetic oligonucleotide
  Target: ATXN1; (+) strand; PAM type: NRG; PAM sequence: CAG
aaagtacatgtgcaagggat

SEQ ID NO: 145564 - DNA, 20 bp, Artificial Sequence
  Description of Artificial Sequence: Synthetic oligonucleotide
  Target: ATXN1; (+) strand; PAM type: NRG; PAM sequence: CAG
atcagctacttgaaacctcc

SEQ ID NO: 145565 - DNA, 20 bp, Artificial Sequence
  Description of Artificial Sequence: Synthetic oligonucleotide
  Target: ATXN1; (+) strand; PAM type: NRG; PAM sequence: CAG
agctacttgaaacctcccag

SEQ ID NO: 145566 - DNA, 20 bp, Artificial Sequence
  Description of Artificial Sequence: Synthetic oligonucleotide
  Target: ATXN1; (+) strand; PAM type: NRG; PAM sequence: AGG
gctacttgaaacctcccagc

SEQ ID NO: 145567 - DNA, 20 bp, Artificial Sequence
  Description of Artificial Sequence: Synthetic oligonucleotide
  Target: ATXN1; (+) strand; PAM type: NRG; PAM sequence: AAG
aaacctcccagcaggaaaac

SEQ ID NO: 145568 - DNA, 20 bp, Artificial Sequence
  Description of Artificial Sequence: Synthetic oligonucleotide
  Target: ATXN1; (+) strand; PAM type: NRG; PAM sequence: AAG
ccagcaggaaaacaagaaat

SEQ ID NO: 145569 - DNA, 20 bp, Artificial Sequence
  Description of Artificial Sequence: Synthetic oligonucleotide
  Target: ATXN1; (+) strand; PAM type: NRG; PAM sequence: AGG
cagcaggaaaacaagaaata

SEQ ID NO: 145570 - DNA, 20 bp, Artificial Sequence
  Description of Artificial Sequence: Synthetic oligonucleotide
  Target: ATXN1; (+) strand; PAM type: NRG; PAM sequence: GGG
agcaggaaaacaagaaataa

SEQ ID NO: 145571 - DNA, 20 bp, Artificial Sequence
  Description of Artificial Sequence: Synthetic oligonucleotide
  Target: ATXN1; (+) strand; PAM type: NRG; PAM sequence: GAG
aacaagaaataagggaccat

SEQ ID NO: 145572 - DNA, 20 bp, Artificial Sequence
  Description of Artificial Sequence: Synthetic oligonucleotide
  Target: ATXN1; (+) strand; PAM type: NRG; PAM sequence: AGG
acaagaaataagggaccatg

SEQ ID NO: 145573 - DNA, 20 bp, Artificial Sequence
  Description of Artificial Sequence: Synthetic oligonucleotide
  Target: ATXN1; (+) strand; PAM type: NRG; PAM sequence: AAG
agaaataagggaccatgagg

SEQ ID NO: 145574 - DNA, 20 bp, Artificial Sequence
  Description of Artificial Sequence: Synthetic oligonucleotide
  Target: ATXN1; (+) strand; PAM type: NRG; PAM sequence: GAG
aaataagggaccatgaggaa

SEQ ID NO: 145575 - DNA, 20 bp, Artificial Sequence
  Description of Artificial Sequence: Synthetic oligonucleotide
  Target: ATXN1; (+) strand; PAM type: NRG; PAM sequence: CAG
gggaccatgaggaagagatc

SEQ ID NO: 145576 - DNA, 20 bp, Artificial Sequence
  Description of Artificial Sequence: Synthetic oligonucleotide
  Target: ATXN1; (+) strand; PAM type: NRG; PAM sequence: AGG
ggaccatgaggaagagatcc

SEQ ID NO: 145577 - DNA, 20 bp, Artificial Sequence
  Description of Artificial Sequence: Synthetic oligonucleotide
  Target: ATXN1; (+) strand; PAM type: NRG; PAM sequence: AAG
ggtctccacatttactgtac

SEQ ID NO: 145578 - DNA, 20 bp, Artificial Sequence
  Description of Artificial Sequence: Synthetic oligonucleotide
  Target: ATXN1; (+) strand; PAM type: NRG; PAM sequence: AAG
tactgtacaagtaataacat

SEQ ID NO: 145579 - DNA, 20 bp, Artificial Sequence
  Description of Artificial Sequence: Synthetic oligonucleotide
  Target: ATXN1; (+) strand; PAM type: NRG; PAM sequence: AAG
gtacaagtaataacataagc

SEQ ID NO: 145580 - DNA, 20 bp, Artificial Sequence
  Description of Artificial Sequence: Synthetic oligonucleotide
  Target: ATXN1; (+) strand; PAM type: NRG; PAM sequence: GAG
acaagtaataacataagcaa

SEQ ID NO: 145581 - DNA, 20 bp, Artificial Sequence
  Description of Artificial Sequence: Synthetic oligonucleotide
  Target: ATXN1; (+) strand; PAM type: NRG; PAM sequence: AAG
acataagcaagagacttcct

SEQ ID NO: 145582 - DNA, 20 bp, Artificial Sequence
  Description of Artificial Sequence: Synthetic oligonucleotide
  Target: ATXN1; (+) strand; PAM type: NRG; PAM sequence: GAG
ataagcaagagacttcctaa

SEQ ID NO: 145583 - DNA, 20 bp, Artificial Sequence
  Description of Artificial Sequence: Synthetic oligonucleotide
  Target: ATXN1; (+) strand; PAM type: NRG; PAM sequence: TAG
gacttcctaagagtgtttta

SEQ ID NO: 145584 - DNA, 20 bp, Artificial Sequence
  Description of Artificial Sequence: Synthetic oligonucleotide
  Target: ATXN1; (+) strand; PAM type: NRG; PAM sequence: TGG
gtgttttatagtattttaca

SEQ ID NO: 145585 - DNA, 20 bp, Artificial Sequence
  Description of Artificial Sequence: Synthetic oligonucleotide
  Target: ATXN1; (+) strand; PAM type: NRG; PAM sequence: AAG
tttatagtattttacatggc

SEQ ID NO: 145586 - DNA, 20 bp, Artificial Sequence
  Description of Artificial Sequence: Synthetic oligonucleotide
  Target: ATXN1; (+) strand; PAM type: NRG; PAM sequence: CAG
atggcaagactcttactctc

SEQ ID NO: 145587 - DNA, 20 bp, Artificial Sequence
  Description of Artificial Sequence: Synthetic oligonucleotide
  Target: ATXN1; (+) strand; PAM type: NRG; PAM sequence: GAG
tttatatgtatttatttgtt

SEQ ID NO: 145588 - DNA, 20 bp, Artificial Sequence
  Description of Artificial Sequence: Synthetic oligonucleotide
  Target: ATXN1; (+) strand; PAM type: NRG; PAM sequence: TAG
atttgttgagttatatattt

SEQ ID NO: 145589 - DNA, 20 bp, Artificial Sequence
  Description of Artificial Sequence: Synthetic oligonucleotide
  Target: ATXN1; (+) strand; PAM type: NRG; PAM sequence: TGG
ttatatattttagctgaact

SEQ ID NO: 145590 - DNA, 20 bp, Artificial Sequence
  Description of Artificial Sequence: Synthetic oligonucleotide
  Target: ATXN1; (+) strand; PAM type: NRG; PAM sequence: CAG
tttagctgaacttggaatga

SEQ ID NO: 145591 - DNA, 20 bp, Artificial Sequence
  Description of Artificial Sequence: Synthetic oligonucleotide
  Target: ATXN1; (+) strand; PAM type: NRG; PAM sequence: AAG
ttggaatgacagttattttt

SEQ ID NO: 145592 - DNA, 20 bp, Artificial Sequence
  Description of Artificial Sequence: Synthetic oligonucleotide
  Target: ATXN1; (+) strand; PAM type: NRG; PAM sequence: GAG
ggaatgacagttatttttaa

SEQ ID NO: 145593 - DNA, 20 bp, Artificial Sequence
  Description of Artificial Sequence: Synthetic oligonucleotide
  Target: ATXN1; (+) strand; PAM type: NRG; PAM sequence: AGG
gaatgacagttatttttaag

SEQ ID NO: 145594 - DNA, 20 bp, Artificial Sequence
  Description of Artificial Sequence: Synthetic oligonucleotide
  Target: ATXN1; (+) strand; PAM type: NRG; PAM sequence: TGG
tttttaagaggctaccaaca

SEQ ID NO: 145595 - DNA, 20 bp, Artificial Sequence
  Description of Artificial Sequence: Synthetic oligonucleotide
  Target: ATXN1; (+) strand; PAM type: NRG; PAM sequence: GGG
ttttaagaggctaccaacat

SEQ ID NO: 145596 - DNA, 20 bp, Artificial Sequence
  Description of Artificial Sequence: Synthetic oligonucleotide
  Target: ATXN1; (+) strand; PAM type: NRG; PAM sequence: CAG
aagaggctaccaacatgggt

SEQ ID NO: 145597 - DNA, 20 bp, Artificial Sequence
  Description of Artificial Sequence: Synthetic oligonucleotide
  Target: ATXN1; (+) strand; PAM type: NRG; PAM sequence: AGG
agaggctaccaacatgggtc

SEQ ID NO: 145598 - DNA, 20 bp, Artificial Sequence
  Description of Artificial Sequence: Synthetic oligonucleotide
  Target: ATXN1; (+) strand; PAM type: NRG; PAM sequence: AAG
ggctaccaacatgggtcagg

SEQ ID NO: 145599 - DNA, 20 bp, Artificial Sequence
  Description of Artificial Sequence: Synthetic oligonucleotide
  Target: ATXN1; (+) strand; PAM type: NRG; PAM sequence: CAG
acatgggtcaggaagaacct

SEQ ID NO: 145600 - DNA, 20 bp, Artificial Sequence
  Description of Artificial Sequence: Synthetic oligonucleotide
  Target: ATXN1; (+) strand; PAM type: NRG; PAM sequence: TGG
caggaagaacctcagaaacc

SEQ ID NO: 145601 - DNA, 20 bp, Artificial Sequence
  Description of Artificial Sequence: Synthetic oligonucleotide
  Target: ATXN1; (+) strand; PAM type: NRG; PAM sequence: CAG
aacctcagaaacctggctca

SEQ ID NO: 145602 - DNA, 20 bp, Artificial Sequence
  Description of Artificial Sequence: Synthetic oligonucleotide
  Target: ATXN1; (+) strand; PAM type: NRG; PAM sequence: TGG
aacctggctcacagttgctc

SEQ ID NO: 145603 - DNA, 20 bp, Artificial Sequence
  Description of Artificial Sequence: Synthetic oligonucleotide
  Target: ATXN1; (+) strand; PAM type: NRG; PAM sequence: AAG
cacagttgctctggcataaa

SEQ ID NO: 145604 - DNA, 20 bp, Artificial Sequence
  Description of Artificial Sequence: Synthetic oligonucleotide
  Target: ATXN1; (+) strand; PAM type: NRG; PAM sequence: CAG
ccttgaccgccaaaaccaac

SEQ ID NO: 145605 - DNA, 20 bp, Artificial Sequence
  Description of Artificial Sequence: Synthetic oligonucleotide
  Target: ATXN1; (+) strand; PAM type: NRG; PAM sequence: AGG
cttgaccgccaaaaccaacc

SEQ ID NO: 145606 - DNA, 20 bp, Artificial Sequence
  Description of Artificial Sequence: Synthetic oligonucleotide
  Target: ATXN1; (+) strand; PAM type: NRG; PAM sequence: GGG
ttgaccgccaaaaccaacca

SEQ ID NO: 145607 - DNA, 20 bp, Artificial Sequence
  Description of Artificial Sequence: Synthetic oligonucleotide
  Target: ATXN1; (+) strand; PAM type: NRG; PAM sequence: GAG
gaccgccaaaaccaaccagg

SEQ ID NO: 145608 - DNA, 20 bp, Artificial Sequence
  Description of Artificial Sequence: Synthetic oligonucleotide
  Target: ATXN1; (+) strand; PAM type: NRG; PAM sequence: GAG
aaaccaaccagggagttgat

SEQ ID NO: 145609 - DNA, 20 bp, Artificial Sequence
  Description of Artificial Sequence: Synthetic oligonucleotide
  Target: ATXN1; (+) strand; PAM type: NRG; PAM sequence: TAG
accagggagttgatgagatc

SEQ ID NO: 145610 - DNA, 20 bp, Artificial Sequence
  Description of Artificial Sequence: Synthetic oligonucleotide
  Target: ATXN1; (+) strand; PAM type: NRG; PAM sequence: AGG
ccagggagttgatgagatct

SEQ ID NO: 145611 - DNA, 20 bp, Artificial Sequence
  Description of Artificial Sequence: Synthetic oligonucleotide
  Target: ATXN1; (+) strand; PAM type: NRG; PAM sequence: AAG
ggtttccaaaacaccacgaa

SEQ ID NO: 145612 - DNA, 20 bp, Artificial Sequence
  Description of Artificial Sequence: Synthetic oligonucleotide
  Target: ATXN1; (+) strand; PAM type: NRG; PAM sequence: AGG
gtttccaaaacaccacgaaa

SEQ ID NO: 145613 - DNA, 20 bp, Artificial Sequence
  Description of Artificial Sequence: Synthetic oligonucleotide
  Target: ATXN1; (+) strand; PAM type: NRG; PAM sequence: TGG
atcttttgctttctcccatc

SEQ ID NO: 145614 - DNA, 20 bp, Artificial Sequence
  Description of Artificial Sequence: Synthetic oligonucleotide
  Target: ATXN1; (+) strand; PAM type: NRG; PAM sequence: TAG
ctggccattaaaaaaaaaaa

SEQ ID NO: 145615 - DNA, 20 bp, Artificial Sequence
  Description of Artificial Sequence: Synthetic oligonucleotide
  Target: ATXN1; (+) strand; PAM type: NRG; PAM sequence: AAG
aaaaaaatagttatttacca

SEQ ID NO: 145616 - DNA, 20 bp, Artificial Sequence
  Description of Artificial Sequence: Synthetic oligonucleotide
  Target: ATXN1; (+) strand; PAM type: NRG; PAM sequence: AAG
aaaatagttatttaccaaag

SEQ ID NO: 145617 - DNA, 20 bp, Artificial Sequence
  Description of Artificial Sequence: Synthetic oligonucleotide
  Target: ATXN1; (+) strand; PAM type: NRG; PAM sequence: TAG
caatcacttcctcctgtgtt

SEQ ID NO: 145618 - DNA, 20 bp, Artificial Sequence
  Description of Artificial Sequence: Synthetic oligonucleotide
  Target: ATXN1; (+) strand; PAM type: NRG; PAM sequence: AGG
aatcacttcctcctgtgttt

SEQ ID NO: 145619 - DNA, 20 bp, Artificial Sequence
  Description of Artificial Sequence: Synthetic oligonucleotide
  Target: ATXN1; (+) strand; PAM type: NRG; PAM sequence: GGG
atcacttcctcctgtgttta

SEQ ID NO: 145620 - DNA, 20 bp, Artificial Sequence
  Description of Artificial Sequence: Synthetic oligonucleotide
  Target: ATXN1; (+) strand; PAM type: NRG; PAM sequence: TAG
ctgtgtttagggttcaaatc

SEQ ID NO: 145621 - DNA, 20 bp, Artificial Sequence
  Description of Artificial Sequence: Synthetic oligonucleotide
  Target: ATXN1; (+) strand; PAM type: NRG; PAM sequence: AAG
tgtttagggttcaaatctag

SEQ ID NO: 145622 - DNA, 20 bp, Artificial Sequence
  Description of Artificial Sequence: Synthetic oligonucleotide
  Target: ATXN1; (+) strand; PAM type: NRG; PAM sequence: CAG
aaatctagaagtccatatgt

SEQ ID NO: 145623 - DNA, 20 bp, Artificial Sequence
  Description of Artificial Sequence: Synthetic oligonucleotide
  Target: ATXN1; (+) strand; PAM type: NRG; PAM sequence: TAG
tagaagtccatatgtcagtc

SEQ ID NO: 145624 - DNA, 20 bp, Artificial Sequence
  Description of Artificial Sequence: Synthetic oligonucleotide
  Target: ATXN1; (+) strand; PAM type: NRG; PAM sequence: TAG
gtccatatgtcagtctagct

SEQ ID NO: 145625 - DNA, 20 bp, Artificial Sequence
  Description of Artificial Sequence: Synthetic oligonucleotide
  Target: ATXN1; (+) strand; PAM type: NRG; PAM sequence: GAG
ccatatgtcagtctagctta

SEQ ID NO: 145626 - DNA, 20 bp, Artificial Sequence
  Description of Artificial Sequence: Synthetic oligonucleotide
  Target: ATXN1; (+) strand; PAM type: NRG; PAM sequence: TAG
gtctagcttagagcaaaatg

SEQ ID NO: 145627 - DNA, 20 bp, Artificial Sequence
  Description of Artificial Sequence: Synthetic oligonucleotide
  Target: ATXN1; (+) strand; PAM type: NRG; PAM sequence: TGG
aaatgtagctttcttcacct

SEQ ID NO: 145628 - DNA, 20 bp, Artificial Sequence
  Description of Artificial Sequence: Synthetic oligonucleotide
  Target: ATXN1; (+) strand; PAM type: NRG; PAM sequence: TAG
tagctttcttcaccttggac

SEQ ID NO: 145629 - DNA, 20 bp, Artificial Sequence
  Description of Artificial Sequence: Synthetic oligonucleotide
  Target: ATXN1; (+) strand; PAM type: NRG; PAM sequence: GAG
cttggactagaacaacctat

SEQ ID NO: 145630 - DNA, 20 bp, Artificial Sequence
  Description of Artificial Sequence: Synthetic oligonucleotide
  Target: ATXN1; (+) strand; PAM type: NRG; PAM sequence: GAG
tggactagaacaacctatga

SEQ ID NO: 145631 - DNA, 20 bp, Artificial Sequence
  Description of Artificial Sequence: Synthetic oligonucleotide
  Target: ATXN1; (+) strand; PAM type: NRG; PAM sequence: AAG
ctagaacaacctatgagaga

SEQ ID NO: 145632 - DNA, 20 bp, Artificial Sequence
  Description of Artificial Sequence: Synthetic oligonucleotide
  Target: ATXN1; (+) strand; PAM type: NRG; PAM sequence: TGG
aacaacctatgagagaaaga

SEQ ID NO: 145633 - DNA, 20 bp, Artificial Sequence
  Description of Artificial Sequence: Synthetic oligonucleotide
  Target: ATXN1; (+) strand; PAM type: NRG; PAM sequence: TGG
gagagaaagatggtgcccaa

SEQ ID NO: 145634 - DNA, 20 bp, Artificial Sequence
  Description of Artificial Sequence: Synthetic oligonucleotide
  Target: ATXN1; (+) strand; PAM type: NRG; PAM sequence: GGG
agagaaagatggtgcccaat

SEQ ID NO: 145635 - DNA, 20 bp, Artificial Sequence
  Description of Artificial Sequence: Synthetic oligonucleotide
  Target: ATXN1; (+) strand; PAM type: NRG; PAM sequence: CAG
aaagatggtgcccaatgggc

SEQ ID NO: 145636 - DNA, 20 bp, Artificial Sequence
  Description of Artificial Sequence: Synthetic oligonucleotide
  Target: ATXN1; (+) strand; PAM type: NRG; PAM sequence: CAG
gtgcccaatgggccagcaca

SEQ ID NO: 145637 - DNA, 20 bp, Artificial Sequence
  Description of Artificial Sequence: Synthetic oligonucleotide
  Target: ATXN1; (+) strand; PAM type: NRG; PAM sequence: CAG
acagctgctttctaaattga

SEQ ID NO: 145638 - DNA, 20 bp, Artificial Sequence
  Description of Artificial Sequence: Synthetic oligonucleotide
  Target: ATXN1; (+) strand; PAM type: NRG; PAM sequence: GAG
ctttctaaattgacagccct

SEQ ID NO: 145639 - DNA, 20 bp, Artificial Sequence
  Description of Artificial Sequence: Synthetic oligonucleotide
  Target: ATXN1; (+) strand; PAM type: NRG; PAM sequence: TGG
gacagccctgagcttctcca

SEQ ID NO: 145640 - DNA, 20 bp, Artificial Sequence
  Description of Artificial Sequence: Synthetic oligonucleotide
  Target: ATXN1; (+) strand; PAM type: NRG; PAM sequence: CAG
gccctgagcttctccatgga

SEQ ID NO: 145641 - DNA, 20 bp, Artificial Sequence
  Description of Artificial Sequence: Synthetic oligonucleotide
  Target: ATXN1; (+) strand; PAM type: NRG; PAM sequence: TGG
cagtgttccaaaactaactg

SEQ ID NO: 145642 - DNA, 20 bp, Artificial Sequence
  Description of Artificial Sequence: Synthetic oligonucleotide
  Target: ATXN1; (+) strand; PAM type: NRG; PAM sequence: TAG
ccaaaactaactgtggctgt

SEQ ID NO: 145643 - DNA, 20 bp, Artificial Sequence
  Description of Artificial Sequence: Synthetic oligonucleotide
  Target: ATXN1; (+) strand; PAM type: NRG; PAM sequence: AGG
caaaactaactgtggctgtt

SEQ ID NO: 145644 - DNA, 20 bp, Artificial Sequence
  Description of Artificial Sequence: Synthetic oligonucleotide
  Target: ATXN1; (+) strand; PAM type: NRG; PAM sequence: AAG
taactgtggctgttaggata

SEQ ID NO: 145645 - DNA, 20 bp, Artificial Sequence
  Description of Artificial Sequence: Synthetic oligonucleotide
  Target: ATXN1; (+) strand; PAM type: NRG; PAM sequence: GAG
actgtggctgttaggataaa

SEQ ID NO: 145646 - DNA, 20 bp, Artificial Sequence
  Description of Artificial Sequence: Synthetic oligonucleotide
  Target: ATXN1; (+) strand; PAM type: NRG; PAM sequence: AGG
ctgtggctgttaggataaag

SEQ ID NO: 145647 - DNA, 20 bp, Artificial Sequence
  Description of Artificial Sequence: Synthetic oligonucleotide
  Target: ATXN1; (+) strand; PAM type: NRG; PAM sequence: GGG
tgtggctgttaggataaaga

SEQ ID NO: 145648 - DNA, 20 bp, Artificial Sequence
  Description of Artificial Sequence: Synthetic oligonucleotide
  Target: ATXN1; (+) strand; PAM type: NRG; PAM sequence: CAG
ggctgttaggataaagaggg

SEQ ID NO: 145649 - DNA, 20 bp, Artificial Sequence
  Description of Artificial Sequence: Synthetic oligonucleotide
  Target: ATXN1; (+) strand; PAM type: NRG; PAM sequence: CAG
ggataaagagggcagtttct

SEQ ID NO: 145650 - DNA, 20 bp, Artificial Sequence
  Description of Artificial Sequence: Synthetic oligonucleotide
  Target: ATXN1; (+) strand; PAM type: NRG; PAM sequence: CAG
agagggcagtttctcagctt

SEQ ID NO: 145651 - DNA, 20 bp, Artificial Sequence
  Description of Artificial Sequence: Synthetic oligonucleotide
  Target: ATXN1; (+) strand; PAM type: NRG; PAM sequence: AAG
ttctcagcttcagtgccttt

SEQ ID NO: 145652 - DNA, 20 bp, Artificial Sequence
  Description of Artificial Sequence: Synthetic oligonucleotide
  Target: ATXN1; (+) strand; PAM type: NRG; PAM sequence: AGG
tctcagcttcagtgccttta

SEQ ID NO: 145653 - DNA, 20 bp, Artificial Sequence
  Description of Artificial Sequence: Synthetic oligonucleotide
  Target: ATXN1; (+) strand; PAM type: NRG; PAM sequence: CAG
cacctctgttaactacgctg

SEQ ID NO: 145654 - DNA, 20 bp, Artificial Sequence
  Description of Artificial Sequence: Synthetic oligonucleotide
  Target: ATXN1; (+) strand; PAM type: NRG; PAM sequence: AAG
gaactctccttaatatccat

SEQ ID NO: 145655 - DNA, 20 bp, Artificial Sequence
  Description of Artificial Sequence: Synthetic oligonucleotide
  Target: ATXN1; (+) strand; PAM type: NRG; PAM sequence: CAG
tctccttaatatccataagc

SEQ ID NO: 145656 - DNA, 20 bp, Artificial Sequence
  Description of Artificial Sequence: Synthetic oligonucleotide
  Target: ATXN1; (+) strand; PAM type: NRG; PAM sequence: GAG
tccttaatatccataagcca

SEQ ID NO: 145657 - DNA, 20 bp, Artificial Sequence
  Description of Artificial Sequence: Synthetic oligonucleotide
  Target: ATXN1; (+) strand; PAM type: NRG; PAM sequence: TAG
cataagccagagatgttcat

SEQ ID NO: 145658 - DNA, 20 bp, Artificial Sequence
  Description of Artificial Sequence: Synthetic oligonucleotide
  Target: ATXN1; (+) strand; PAM type: NRG; PAM sequence: CAG
aaaaatttctcactcctcat

SEQ ID NO: 145659 - DNA, 20 bp, Artificial Sequence
  Description of Artificial Sequence: Synthetic oligonucleotide
  Target: ATXN1; (+) strand; PAM type: NRG; PAM sequence: CAG
atttctcactcctcatcaga

SEQ ID NO: 145660 - DNA, 20 bp, Artificial Sequence
  Description of Artificial Sequence: Synthetic oligonucleotide
  Target: ATXN1; (+) strand; PAM type: NRG; PAM sequence: AAG
cactcctcatcagacagctg

SEQ ID NO: 145661 - DNA, 20 bp, Artificial Sequence
  Description of Artificial Sequence: Synthetic oligonucleotide
  Target: ATXN1; (+) strand; PAM type: NRG; PAM sequence: GAG
catcagacagctgaagacct

SEQ ID NO: 145662 - DNA, 20 bp, Artificial Sequence
  Description of Artificial Sequence: Synthetic oligonucleotide
  Target: ATXN1; (+) strand; PAM type: NRG; PAM sequence: TGG
tcctttgtcttcccctattc

SEQ ID NO: 145663 - DNA, 20 bp, Artificial Sequence
  Description of Artificial Sequence: Synthetic oligonucleotide
  Target: ATXN1; (+) strand; PAM type: NRG; PAM sequence: GAG
ctttgtcttcccctattctg

SEQ ID NO: 145664 - DNA, 20 bp, Artificial Sequence
  Description of Artificial Sequence: Synthetic oligonucleotide
  Target: ATXN1; (+) strand; PAM type: NRG; PAM sequence: AAG
ctattctggagatcacattg

SEQ ID NO: 145665 - DNA, 20 bp, Artificial Sequence
  Description of Artificial Sequence: Synthetic oligonucleotide
  Target: ATXN1; (+) strand; PAM type: NRG; PAM sequence: AGG
tattctggagatcacattga

SEQ ID NO: 145666 - DNA, 20 bp, Artificial Sequence
  Description of Artificial Sequence: Synthetic oligonucleotide
  Target: ATXN1; (+) strand; PAM type: NRG; PAM sequence: GGG
attctggagatcacattgaa

SEQ ID NO: 145667 - DNA, 20 bp, Artificial Sequence
  Description of Artificial Sequence: Synthetic oligonucleotide
  Target: ATXN1; (+) strand; PAM type: NRG; PAM sequence: TGG
gatcacattgaagggatttt

SEQ ID NO: 145668 - DNA, 20 bp, Artificial Sequence
  Description of Artificial Sequence: Synthetic oligonucleotide
  Target: ATXN1; (+) strand; PAM type: NRG; PAM sequence: GGG
atcacattgaagggattttt

SEQ ID NO: 145669 - DNA, 20 bp, Artificial Sequence
  Description of Artificial Sequence: Synthetic oligonucleotide
  Target: ATXN1; (+) strand; PAM type: NRG; PAM sequence: AAG
gggatttttgggctacctga

SEQ ID NO: 145670 - DNA, 20 bp, Artificial Sequence
  Description of Artificial Sequence: Synthetic oligonucleotide
  Target: ATXN1; (+) strand; PAM type: NRG; PAM sequence: CAG
ctacctgaaagtgtttatga

SEQ ID NO: 145671 - DNA, 20 bp, Artificial Sequence
  Description of Artificial Sequence: Synthetic oligonucleotide
  Target: ATXN1; (+) strand; PAM type: NRG; PAM sequence: CAG
ctgaaagtgtttatgacaga

SEQ ID NO: 145672 - DNA, 20 bp, Artificial Sequence
  Description of Artificial Sequence: Synthetic oligonucleotide
  Target: ATXN1; (+) strand; PAM type: NRG; PAM sequence: TGG
gtttatgacagacagactct

SEQ ID NO: 145673 - DNA, 20 bp, Artificial Sequence
  Description of Artificial Sequence: Synthetic oligonucleotide
  Target: ATXN1; (+) strand; PAM type: NRG; PAM sequence: CAG
gacagacagactcttggatt

SEQ ID NO: 145674 - DNA, 20 bp, Artificial Sequence
  Description of Artificial Sequence: Synthetic oligonucleotide
  Target: ATXN1; (+) strand; PAM type: NRG; PAM sequence: AGG
acagacagactcttggattc

SEQ ID NO: 145675 - DNA, 20 bp, Artificial Sequence
  Description of Artificial Sequence: Synthetic oligonucleotide
  Target: ATXN1; (+) strand; PAM type: NRG; PAM sequence: TAG
cagactcttggattcaggct

SEQ ID NO: 145676 - DNA, 20 bp, Artificial Sequence
  Description of Artificial Sequence: Synthetic oligonucleotide
  Target: ATXN1; (+) strand; PAM type: NRG; PAM sequence: AGG
agactcttggattcaggctt

SEQ ID NO: 145677 - DNA, 20 bp, Artificial Sequence
  Description of Artificial Sequence: Synthetic oligonucleotide
  Target: ATXN1; (+) strand; PAM type: NRG; PAM sequence: AAG
cttggattcaggcttaggac

SEQ ID NO: 145678 - DNA, 20 bp, Artificial Sequence
  Description of Artificial Sequence: Synthetic oligonucleotide
  Target: ATXN1; (+) strand; PAM type: NRG; PAM sequence: GAG
gacaagcaaacctttcatat

SEQ ID NO: 145679 - DNA, 20 bp, Artificial Sequence
  Description of Artificial Sequence: Synthetic oligonucleotide
  Target: ATXN1; (+) strand; PAM type: NRG; PAM sequence: CAG
ttcatatgagtccttaaaaa

SEQ ID NO: 145680 - DNA, 20 bp, Artificial Sequence
  Description of Artificial Sequence: Synthetic oligonucleotide
  Target: ATXN1; (+) strand; PAM type: NRG; PAM sequence: CAG
tatgagtccttaaaaacaga

SEQ ID NO: 145681 - DNA, 20 bp, Artificial Sequence
  Description of Artificial Sequence: Synthetic oligonucleotide
  Target: ATXN1; (+) strand; PAM type: NRG; PAM sequence: TAG
tgtaactttgaactccattc

SEQ ID NO: 145682 - DNA, 20 bp, Artificial Sequence
  Description of Artificial Sequence: Synthetic oligonucleotide
  Target: ATXN1; (+) strand; PAM type: NRG; PAM sequence: TGG
cattctagtacaaacatgct

SEQ ID NO: 145683 - DNA, 20 bp, Artificial Sequence
  Description of Artificial Sequence: Synthetic oligonucleotide
  Target: ATXN1; (+) strand; PAM type: NRG; PAM sequence: TAG
gtacaaacatgcttggcaac

SEQ ID NO: 145684 - DNA, 20 bp, Artificial Sequence
  Description of Artificial Sequence: Synthetic oligonucleotide
  Target: ATXN1; (+) strand; PAM type: NRG; PAM sequence: CGG
acatgcttggcaactagtgc

SEQ ID NO: 145685 - DNA, 20 bp, Artificial Sequence
  Description of Artificial Sequence: Synthetic oligonucleotide
  Target: ATXN1; (+) strand; PAM type: NRG; PAM sequence: GAG
atgcttggcaactagtgccg

SEQ ID NO: 145686 - DNA, 20 bp, Artificial Sequence
  Description of Artificial Sequence: Synthetic oligonucleotide
  Target: ATXN1; (+) strand; PAM type: NRG; PAM sequence: AGG
tgcttggcaactagtgccgg

SEQ ID NO: 145687 - DNA, 20 bp, Artificial Sequence
  Description of Artificial Sequence: Synthetic oligonucleotide
  Target: ATXN1; (+) strand; PAM type: NRG; PAM sequence: GGG
gcttggcaactagtgccgga

SEQ ID NO: 145688 - DNA, 20 bp, Artificial Sequence
  Description of Artificial Sequence: Synthetic oligonucleotide
  Target: ATXN1; (+) strand; PAM type: NRG; PAM sequence: CAG
actagtgccggagggttaac

SEQ ID NO: 145689 - DNA, 20 bp, Artificial Sequence
  Description of Artificial Sequence: Synthetic oligonucleotide
  Target: ATXN1; (+) strand; PAM type: NRG; PAM sequence: GAG
tagtgccggagggttaacca

SEQ ID NO: 145690 - DNA, 20 bp, Artificial Sequence
  Description of Artificial Sequence: Synthetic oligonucleotide
  Target: ATXN1; (+) strand; PAM type: NRG; PAM sequence: GAG
gtgccggagggttaaccaga

SEQ ID NO: 145691 - DNA, 20 bp, Artificial Sequence
  Description of Artificial Sequence: Synthetic oligonucleotide
  Target: ATXN1; (+) strand; PAM type: NRG; PAM sequence: TGG
taaccagagagttttcttcc

SEQ ID NO: 145692 - DNA, 20 bp, Artificial Sequence
  Description of Artificial Sequence: Synthetic oligonucleotide
  Target: ATXN1; (+) strand; PAM type: NRG; PAM sequence: TGG
aaattgctctgccgccacca

SEQ ID NO: 145693 - DNA, 20 bp, Artificial Sequence
  Description of Artificial Sequence: Synthetic oligonucleotide
  Target: ATXN1; (+) strand; PAM type: NRG; PAM sequence: GGG
aattgctctgccgccaccat

SEQ ID NO: 145694 - DNA, 20 bp, Artificial Sequence
  Description of Artificial Sequence: Synthetic oligonucleotide
  Target: ATXN1; (+) strand; PAM type: NRG; PAM sequence: CAG
caccatgggtattaacactc

SEQ ID NO: 145695 - DNA, 20 bp, Artificial Sequence
  Description of Artificial Sequence: Synthetic oligonucleotide
  Target: ATXN1; (+) strand; PAM type: NRG; PAM sequence: AGG
accatgggtattaacactcc

SEQ ID NO: 145696 - DNA, 20 bp, Artificial Sequence
  Description of Artificial Sequence: Synthetic oligonucleotide
  Target: ATXN1; (+) strand; PAM type: NRG; PAM sequence: GAG
tattcctcatcccctgccct

SEQ ID NO: 145697 - DNA, 20 bp, Artificial Sequence
  Description of Artificial Sequence: Synthetic oligonucleotide
  Target: ATXN1; (+) strand; PAM type: NRG; PAM sequence: AAG
ctgagatattatctgtgccc

SEQ ID NO: 145698 - DNA, 20 bp, Artificial Sequence
  Description of Artificial Sequence: Synthetic oligonucleotide
  Target: ATXN1; (+) strand; PAM type: NRG; PAM sequence: CAG
tattatctgtgcccaagctg

SEQ ID NO: 145699 - DNA, 20 bp, Artificial Sequence
  Description of Artificial Sequence: Synthetic oligonucleotide
  Target: ATXN1; (+) strand; PAM type: NRG; PAM sequence: AGG
attatctgtgcccaagctgc

SEQ ID NO: 145700 - DNA, 20 bp, Artificial Sequence
  Description of Artificial Sequence: Synthetic oligonucleotide
  Target: ATXN1; (+) strand; PAM type: NRG; PAM sequence: GGG
ttatctgtgcccaagctgca

SEQ ID NO: 145701 - DNA, 20 bp, Artificial Sequence
  Description of Artificial Sequence: Synthetic oligonucleotide
  Target: ATXN1; (+) strand; PAM type: NRG; PAM sequence: GGG
tatctgtgcccaagctgcag

SEQ ID NO: 145702 - DNA, 20 bp, Artificial Sequence
  Description of Artificial Sequence: Synthetic oligonucleotide
  Target: ATXN1; (+) strand; PAM type: NRG; PAM sequence: GAG
gtgcccaagctgcaggggtt

SEQ ID NO: 145703 - DNA, 20 bp, Artificial Sequence
  Description of Artificial Sequence: Synthetic oligonucleotide
  Target: ATXN1; (+) strand; PAM type: NRG; PAM sequence: AGG
tgcccaagctgcaggggttg

SEQ ID NO: 145704 - DNA, 20 bp, Artificial Sequence
  Description of Artificial Sequence: Synthetic oligonucleotide
  Target: ATXN1; (+) strand; PAM type: NRG; PAM sequence: TGG
aggggttgaggtcacacatc

SEQ ID NO: 145705 - DNA, 20 bp, Artificial Sequence
  Description of Artificial Sequence: Synthetic oligonucleotide
  Target: ATXN1; (+) strand; PAM type: NRG; PAM sequence: AAG
gaggtcacacatctggtgcc

SEQ ID NO: 145706 - DNA, 20 bp, Artificial Sequence
  Description of Artificial Sequence: Synthetic oligonucleotide
  Target: ATXN1; (+) strand; PAM type: NRG; PAM sequence: AGG
aggtcacacatctggtgcca

SEQ ID NO: 145707 - DNA, 20 bp, Artificial Sequence
  Description of Artificial Sequence: Synthetic oligonucleotide
  Target: ATXN1; (+) strand; PAM type: NRG; PAM sequence: GAG
gtcacacatctggtgccaag

SEQ ID NO: 145708 - DNA, 20 bp, Artificial Sequence
  Description of Artificial Sequence: Synthetic oligonucleotide
  Target: ATXN1; (+) strand; PAM type: NRG; PAM sequence: CAG
atctggtgccaaggagctgt

SEQ ID NO: 145709 - DNA, 20 bp, Artificial Sequence
  Description of Artificial Sequence: Synthetic oligonucleotide
  Target: ATXN1; (+) strand; PAM type: NRG; PAM sequence: CAG
caaggagctgtcagtgcctc

SEQ ID NO: 145710 - DNA, 20 bp, Artificial Sequence
  Description of Artificial Sequence: Synthetic oligonucleotide
  Target: ATXN1; (+) strand; PAM type: NRG; PAM sequence: CAG
ggagctgtcagtgcctccag

SEQ ID NO: 145711 - DNA, 20 bp, Artificial Sequence
  Description of Artificial Sequence: Synthetic oligonucleotide
  Target: ATXN1; (+) strand; PAM type: NRG; PAM sequence: TGG
gctgtcagtgcctccagcag

SEQ ID NO: 145712 - DNA, 20 bp, Artificial Sequence
  Description of Artificial Sequence: Synthetic oligonucleotide
  Target: ATXN1; (+) strand; PAM type: NRG; PAM sequence: CAG
cagtgcctccagcagtggca

SEQ ID NO: 145713 - DNA, 20 bp, Artificial Sequence
  Description of Artificial Sequence: Synthetic oligonucleotide
  Target: ATXN1; (+) strand; PAM type: NRG; PAM sequence: TGG
tccagcagtggcacagttca

SEQ ID NO: 145714 - DNA, 20 bp, Artificial Sequence
  Description of Artificial Sequence: Synthetic oligonucleotide
  Target: ATXN1; (+) strand; PAM type: NRG; PAM sequence: CGG
gtggcacagttcatggttca

SEQ ID NO: 145715 - DNA, 20 bp, Artificial Sequence
  Description of Artificial Sequence: Synthetic oligonucleotide
  Target: ATXN1; (+) strand; PAM type: NRG; PAM sequence: TGG
atggttcacggttcttctcc

SEQ ID NO: 145716 - DNA, 20 bp, Artificial Sequence
  Description of Artificial Sequence: Synthetic oligonucleotide
  Target: ATXN1; (+) strand; PAM type: NRG; PAM sequence: TGG
tcttctcctggcccctccct

SEQ ID NO: 145717 - DNA, 20 bp, Artificial Sequence
  Description of Artificial Sequence: Synthetic oligonucleotide
  Target: ATXN1; (+) strand; PAM type: NRG; PAM sequence: TGG
tcctggcccctcccttggtc

SEQ ID NO: 145718 - DNA, 20 bp, Artificial Sequence
  Description of Artificial Sequence: Synthetic oligonucleotide
  Target: ATXN1; (+) strand; PAM type: NRG; PAM sequence: CAG
cccttggtctggcatgctga

SEQ ID NO: 145719 - DNA, 20 bp, Artificial Sequence
  Description of Artificial Sequence: Synthetic oligonucleotide
  Target: ATXN1; (+) strand; PAM type: NRG; PAM sequence: CAG
ttcatcatttgtctgtgact

SEQ ID NO: 145720 - DNA, 20 bp, Artificial Sequence
  Description of Artificial Sequence: Synthetic oligonucleotide
  Target: ATXN1; (+) strand; PAM type: NRG; PAM sequence: GAG
catcatttgtctgtgactca

SEQ ID NO: 145721 - DNA, 20 bp, Artificial Sequence
  Description of Artificial Sequence: Synthetic oligonucleotide
  Target: ATXN1; (+) strand; PAM type: NRG; PAM sequence: AGG
atcatttgtctgtgactcag

SEQ ID NO: 145722 - DNA, 20 bp, Artificial Sequence
  Description of Artificial Sequence: Synthetic oligonucleotide
  Target: ATXN1; (+) strand; PAM type: NRG; PAM sequence: CAG
atttgtctgtgactcagagg

SEQ ID NO: 145723 - DNA, 20 bp, Artificial Sequence
  Description of Artificial Sequence: Synthetic oligonucleotide
  Target: ATXN1; (+) strand; PAM type: NRG; PAM sequence: TGG
tgtgactcagaggcagacca

SEQ ID NO: 145724 - DNA, 20 bp, Artificial Sequence
  Description of Artificial Sequence: Synthetic oligonucleotide
  Target: ATXN1; (+) strand; PAM type: NRG; PAM sequence: GGG
gtgactcagaggcagaccat

SEQ ID NO: 145725 - DNA, 20 bp, Artificial Sequence
  Description of Artificial Sequence: Synthetic oligonucleotide
  Target: ATXN1; (+) strand; PAM type: NRG; PAM sequence: GGG
tgactcagaggcagaccatg

SEQ ID NO: 145726 - DNA, 20 bp, Artificial Sequence
  Description of Artificial Sequence: Synthetic oligonucleotide
  Target: ATXN1; (+) strand; PAM type: NRG; PAM sequence: CAG
gaccatggggccaacaaatc

SEQ ID NO: 145727 - DNA, 20 bp, Artificial Sequence
  Description of Artificial Sequence: Synthetic oligonucleotide
  Target: ATXN1; (+) strand; PAM type: NRG; PAM sequence: AAG
ccagcccatgatcacgcttg

SEQ ID NO: 145728 - DNA, 20 bp, Artificial Sequence
  Description of Artificial Sequence: Synthetic oligonucleotide
  Target: ATXN1; (+) strand; PAM type: NRG; PAM sequence: AGG
cagcccatgatcacgcttga

SEQ ID NO: 145729 - DNA, 20 bp, Artificial Sequence
  Description of Artificial Sequence: Synthetic oligonucleotide
  Target: ATXN1; (+) strand; PAM type: NRG; PAM sequence: CAG
catgatcacgcttgaaggca

SEQ ID NO: 145730 - DNA, 20 bp, Artificial Sequence
  Description of Artificial Sequence: Synthetic oligonucleotide
  Target: ATXN1; (+) strand; PAM type: NRG; PAM sequence: AGG
atgatcacgcttgaaggcac

SEQ ID NO: 145731 - DNA, 20 bp, Artificial Sequence
  Description of Artificial Sequence: Synthetic oligonucleotide
  Target: ATXN1; (+) strand; PAM type: NRG; PAM sequence: GGG
tgatcacgcttgaaggcaca

SEQ ID NO: 145732 - DNA, 20 bp, Artificial Sequence
  Description of Artificial Sequence: Synthetic oligonucleotide
  Target: ATXN1; (+) strand; PAM type: NRG; PAM sequence: TAG
cttgaaggcacagggatatc

SEQ ID NO: 145733 - DNA, 20 bp, Artificial Sequence
  Description of Artificial Sequence: Synthetic oligonucleotide
  Target: ATXN1; (+) strand; PAM type: NRG; PAM sequence: AAG
gaaggcacagggatatctag

SEQ ID NO: 145734 - DNA, 20 bp, Artificial Sequence
  Description of Artificial Sequence: Synthetic oligonucleotide
  Target: ATXN1; (+) strand; PAM type: NRG; PAM sequence: CAG
agaagtcatcccccaaactt

SEQ ID NO: 145735 - DNA, 20 bp, Artificial Sequence
  Description of Artificial Sequence: Synthetic oligonucleotide
  Target: ATXN1; (+) strand; PAM type: NRG; PAM sequence: AGG
gaagtcatcccccaaacttc

SEQ ID NO: 145736 - DNA, 20 bp, Artificial Sequence
  Description of Artificial Sequence: Synthetic oligonucleotide
  Target: ATXN1; (+) strand; PAM type: NRG; PAM sequence: GGG
aagtcatcccccaaacttca

SEQ ID NO: 145737 - DNA, 20 bp, Artificial Sequence
  Description of Artificial Sequence: Synthetic oligonucleotide
  Target: ATXN1; (+) strand; PAM type: NRG; PAM sequence: TGG
ggactattgtcaaaccttct

SEQ ID NO: 145738 - DNA, 20 bp, Artificial Sequence
  Description of Artificial Sequence: Synthetic oligonucleotide
  Target: ATXN1; (+) strand; PAM type: NRG; PAM sequence: GGG
gactattgtcaaaccttctt

SEQ ID NO: 145739 - DNA, 20 bp, Artificial Sequence
  Description of Artificial Sequence: Synthetic oligonucleotide
  Target: ATXN1; (+) strand; PAM type: NRG; PAM sequence: CAG
tgtcaaaccttcttgggata

SEQ ID NO: 145740 - DNA, 20 bp, Artificial Sequence
  Description of Artificial Sequence: Synthetic oligonucleotide
  Target: ATXN1; (+) strand; PAM type: NRG; PAM sequence: CAG
tgggatacagacatatttct

SEQ ID NO: 145741 - DNA, 20 bp, Artificial Sequence
  Description of Artificial Sequence: Synthetic oligonucleotide
  Target: ATXN1; (+) strand; PAM type: NRG; PAM sequence: TGG
catatttctcagatctcctt

SEQ ID NO: 145742 - DNA, 20 bp, Artificial Sequence
  Description of Artificial Sequence: Synthetic oligonucleotide
  Target: ATXN1; (+) strand; PAM type: NRG; PAM sequence: AAG
tttctcagatctcctttgga

SEQ ID NO: 145743 - DNA, 20 bp, Artificial Sequence
  Description of Artificial Sequence: Synthetic oligonucleotide
  Target: ATXN1; (+) strand; PAM type: NRG; PAM sequence: TAG
gatctcctttggaaagatct

SEQ ID NO: 145744 - DNA, 20 bp, Artificial Sequence
  Description of Artificial Sequence: Synthetic oligonucleotide
  Target: ATXN1; (+) strand; PAM type: NRG; PAM sequence: CAG
aagatcttagacttgcttga

SEQ ID NO: 145745 - DNA, 20 bp, Artificial Sequence
  Description of Artificial Sequence: Synthetic oligonucleotide
  Target: ATXN1; (+) strand; PAM type: NRG; PAM sequence: AGG
agatcttagacttgcttgac

SEQ ID NO: 145746 - DNA, 20 bp, Artificial Sequence
  Description of Artificial Sequence: Synthetic oligonucleotide
  Target: ATXN1; (+) strand; PAM type: NRG; PAM sequence: GGG
gatcttagacttgcttgaca

SEQ ID NO: 145747 - DNA, 20 bp, Artificial Sequence
  Description of Artificial Sequence: Synthetic oligonucleotide
  Target: ATXN1; (+) strand; PAM type: NRG; PAM sequence: GGG
atcttagacttgcttgacag

SEQ ID NO: 145748 - DNA, 20 bp, Artificial Sequence
  Description of Artificial Sequence: Synthetic oligonucleotide
  Target: ATXN1; (+) strand; PAM type: NRG; PAM sequence: TGG
acttgcttgacaggggtcct

SEQ ID NO: 145749 - DNA, 20 bp, Artificial Sequence
  Description of Artificial Sequence: Synthetic oligonucleotide
  Target: ATXN1; (+) strand; PAM type: NRG; PAM sequence: GAG
ttgcttgacaggggtccttg

SEQ ID NO: 145750 - DNA, 20 bp, Artificial Sequence
  Description of Artificial Sequence: Synthetic oligonucleotide
  Target: ATXN1; (+) strand; PAM type: NRG; PAM sequence: AAG
ataaccctcctctcatttta

SEQ ID NO: 145751 - DNA, 20 bp, Artificial Sequence
  Description of Artificial Sequence: Synthetic oligonucleotide
  Target: ATXN1; (+) strand; PAM type: NRG; PAM sequence: TGG
cattttaaagttttctttat

SEQ ID NO: 145752 - DNA, 20 bp, Artificial Sequence
  Description of Artificial Sequence: Synthetic oligonucleotide
  Target: ATXN1; (+) strand; PAM type: NRG; PAM sequence: TGG
tttctttattggattcttta

SEQ ID NO: 145753 - DNA, 20 bp, Artificial Sequence
  Description of Artificial Sequence: Synthetic oligonucleotide
  Target: ATXN1; (+) strand; PAM type: NRG; PAM sequence: GGG
ttctttattggattctttat

SEQ ID NO: 145754 - DNA, 20 bp, Artificial Sequence
  Description of Artificial Sequence: Synthetic oligonucleotide
  Target: ATXN1; (+) strand; PAM type: NRG; PAM sequence: GAG
ctttattggattctttatgg

SEQ ID NO: 145755 - DNA, 20 bp, Artificial Sequence
  Description of Artificial Sequence: Synthetic oligonucleotide
  Target: ATXN1; (+) strand; PAM type: NRG; PAM sequence: AAG
tggattctttatgggagacc

SEQ ID NO: 145756 - DNA, 20 bp, Artificial Sequence
  Description of Artificial Sequence: Synthetic oligonucleotide
  Target: ATXN1; (+) strand; PAM type: NRG; PAM sequence: TGG
tgggagaccaagttccttat

SEQ ID NO: 145757 - DNA, 20 bp, Artificial Sequence
  Description of Artificial Sequence: Synthetic oligonucleotide
  Target: ATXN1; (+) strand; PAM type: NRG; PAM sequence: TGG
ccttattggattgcttcctg

SEQ ID NO: 145758 - DNA, 20 bp, Artificial Sequence
  Description of Artificial Sequence: Synthetic oligonucleotide
  Target: ATXN1; (+) strand; PAM type: NRG; PAM sequence: AAG
tggattgcttcctgtggacc

SEQ ID NO: 145759 - DNA, 20 bp, Artificial Sequence
  Description of Artificial Sequence: Synthetic oligonucleotide
  Target: ATXN1; (+) strand; PAM type: NRG; PAM sequence: AGG
ggattgcttcctgtggacca

SEQ ID NO: 145760 - DNA, 20 bp, Artificial Sequence
  Description of Artificial Sequence: Synthetic oligonucleotide
  Target: ATXN1; (+) strand; PAM type: NRG; PAM sequence: TAG
ggaccaaggatgatgttttc

SEQ ID NO: 145761 - DNA, 20 bp, Artificial Sequence
  Description of Artificial Sequence: Synthetic oligonucleotide
  Target: ATXN1; (+) strand; PAM type: NRG; PAM sequence: AGG
gaccaaggatgatgttttct

SEQ ID NO: 145762 - DNA, 20 bp, Artificial Sequence
  Description of Artificial Sequence: Synthetic oligonucleotide
  Target: ATXN1; (+) strand; PAM type: NRG; PAM sequence: GGG
accaaggatgatgttttcta

SEQ ID NO: 145763 - DNA, 20 bp, Artificial Sequence
  Description of Artificial Sequence: Synthetic oligonucleotide
  Target: ATXN1; (+) strand; PAM type: NRG; PAM sequence: GAG
ctagggacttattgaaactt

SEQ ID NO: 145764 - DNA, 20 bp, Artificial Sequence
  Description of Artificial Sequence: Synthetic oligonucleotide
  Target: ATXN1; (+) strand; PAM type: NRG; PAM sequence: GAG
agggacttattgaaacttga

SEQ ID NO: 145765 - DNA, 20 bp, Artificial Sequence
  Description of Artificial Sequence: Synthetic oligonucleotide
  Target: ATXN1; (+) strand; PAM type: NRG; PAM sequence: CGG
acttattgaaacttgagagt

SEQ ID NO: 145766 - DNA, 20 bp, Artificial Sequence
  Description of Artificial Sequence: Synthetic oligonucleotide
  Target: ATXN1; (+) strand; PAM type: NRG; PAM sequence: AAG
tattgaaacttgagagtcgg

SEQ ID NO: 145767 - DNA, 20 bp, Artificial Sequence
  Description of Artificial Sequence: Synthetic oligonucleotide
  Target: ATXN1; (+) strand; PAM type: NRG; PAM sequence: TGG
tgaaacttgagagtcggaag

SEQ ID NO: 145768 - DNA, 20 bp, Artificial Sequence
  Description of Artificial Sequence: Synthetic oligonucleotide
  Target: ATXN1; (+) strand; PAM type: NRG; PAM sequence: AAG
tgagagtcggaagtggtctg

SEQ ID NO: 145769 - DNA, 20 bp, Artificial Sequence
  Description of Artificial Sequence: Synthetic oligonucleotide
  Target: ATXN1; (+) strand; PAM type: NRG; PAM sequence: AGG
gagagtcggaagtggtctga

SEQ ID NO: 145770 - DNA, 20 bp, Artificial Sequence
  Description of Artificial Sequence: Synthetic oligonucleotide
  Target: ATXN1; (+) strand; PAM type: NRG; PAM sequence: TAG
gtctgaaggattgtttgatt

SEQ ID NO: 145771 - DNA, 20 bp, Artificial Sequence
  Description of Artificial Sequence: Synthetic oligonucleotide
  Target: ATXN1; (+) strand; PAM type: NRG; PAM sequence: TGG
tgaaggattgtttgatttag

SEQ ID NO: 145772 - DNA, 20 bp, Artificial Sequence
  Description of Artificial Sequence: Synthetic oligonucleotide
  Target: ATXN1; (+) strand; PAM type: NRG; PAM sequence: TAG
tgtgaactgacattgcctaa

SEQ ID NO: 145773 - DNA, 20 bp, Artificial Sequence
  Description of Artificial Sequence: Synthetic oligonucleotide
  Target: ATXN1; (+) strand; PAM type: NRG; PAM sequence: AAG
ctaatagctgttgtaacata

SEQ ID NO: 145774 - DNA, 20 bp, Artificial Sequence
  Description of Artificial Sequence: Synthetic oligonucleotide
  Target: ATXN1; (+) strand; PAM type: NRG; PAM sequence: CAG
tgttgtaacataaagattct

SEQ ID NO: 145775 - DNA, 20 bp, Artificial Sequence
  Description of Artificial Sequence: Synthetic oligonucleotide
  Target: ATXN1; (+) strand; PAM type: NRG; PAM sequence: AGG
gttgtaacataaagattctc

SEQ ID NO: 145776 - DNA, 20 bp, Artificial Sequence
  Description of Artificial Sequence: Synthetic oligonucleotide
  Target: ATXN1; (+) strand; PAM type: NRG; PAM sequence: CAG
acataaagattctcaggtct

SEQ ID NO: 145777 - DNA, 20 bp, Artificial Sequence
  Description of Artificial Sequence: Synthetic oligonucleotide
  Target: ATXN1; (+) strand; PAM type: NRG; PAM sequence: TGG
ccaccccttacccaaaccct

SEQ ID NO: 145778 - DNA, 20 bp, Artificial Sequence
  Description of Artificial Sequence: Synthetic oligonucleotide
  Target: ATXN1; (+) strand; PAM type: NRG; PAM sequence: CAG
caaacccttggctaattcca

SEQ ID NO: 145779 - DNA, 20 bp, Artificial Sequence
  Description of Artificial Sequence: Synthetic oligonucleotide
  Target: ATXN1; (+) strand; PAM type: NRG; PAM sequence: GAG
aacccttggctaattccaca

SEQ ID NO: 145780 - DNA, 20 bp, Artificial Sequence
  Description of Artificial Sequence: Synthetic oligonucleotide
  Target: ATXN1; (+) strand; PAM type: NRG; PAM sequence: AGG
acccttggctaattccacag

SEQ ID NO: 145781 - DNA, 20 bp, Artificial Sequence
  Description of Artificial Sequence: Synthetic oligonucleotide
  Target: ATXN1; (+) strand; PAM type: NRG; PAM sequence: CAG
gcctgtctcactctgtcgcc

SEQ ID NO: 145782 - DNA, 20 bp, Artificial Sequence
  Description of Artificial Sequence: Synthetic oligonucleotide
  Target: ATXN1; (+) strand; PAM type: NRG; PAM sequence: AGG
cctgtctcactctgtcgccc

SEQ ID NO: 145783 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcgcccaggc

SEQ ID NO: 145784 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcgcccaggctg

SEQ ID NO: 145785 - DNA, 20 bp, Artificial Sequence
  Description of Artificial Sequence: Synthetic oligonucleotide
  Target: ATXN1; (+) strand; PAM type: NRG; PAM sequence: CAG
ctgtcgcccaggctggagtg

SEQ ID NO: 145786 - DNA, 20 bp, Artificial Sequence
  Description of Artificial Sequence: Synthetic oligonucleotide
  Target: ATXN1; (+) strand; PAM type: NRG; PAM sequence: TGG
tcgcccaggctggagtgcag

SEQ ID NO: 145787 - DNA, 20 bp, Artificial Sequence
  Description of Artificial Sequence: Synthetic oligonucleotide
  Target: ATXN1; (+) strand; PAM type: NRG; PAM sequence: CAG
gctggagtgcagtggctctc

SEQ ID NO: 145788 - DNA, 20 bp, Artificial Sequence
  Description of Artificial Sequence: Synthetic oligonucleotide
  Target: ATXN1; (+) strand; PAM type: NRG; PAM sequence: AGG
ctggagtgcagtggctctcc

SEQ ID NO: 145789 - DNA, 20 bp, Artificial Sequence
  Description of Artificial Sequence: Synthetic oligonucleotide
  Target: ATXN1; (+) strand; PAM type: NRG; PAM sequence: GGG
tggagtgcagtggctctcca

SEQ ID NO: 145790 - DNA, 20 bp, Artificial Sequence
  Description of Artificial Sequence: Synthetic oligonucleotide
  Target: ATXN1; (+) strand; PAM type: NRG; PAM sequence: AAG
tggctctccagggttttctg

SEQ ID NO: 145791 - DNA, 20 bp, Artificial Sequence
  Description of Artificial Sequence: Synthetic oligonucleotide
  Target: ATXN1; (+) strand; PAM type: NRG; PAM sequence: AAG
cccaacttcctcattttcct

SEQ ID NO: 145792 - DNA, 20 bp, Artificial Sequence
  Description of Artificial Sequence: Synthetic oligonucleotide
  Target: ATXN1; (+) strand; PAM type: NRG; PAM sequence: AGG
ccaacttcctcattttccta

SEQ ID NO: 145793 - DNA, 20 bp, Artificial Sequence
  Description of Artificial Sequence: Synthetic oligonucleotide
  Target: ATXN1; (+) strand; PAM type: NRG; PAM sequence: CAG
ttcctcattttcctaaggct

SEQ ID NO: 145794 - DNA, 20 bp, Artificial Sequence
  Description of Artificial Sequence: Synthetic oligonucleotide
  Target: ATXN1; (+) strand; PAM type: NRG; PAM sequence: GAG
cctcattttcctaaggctca

SEQ ID NO: 145795 - DNA, 20 bp, Artificial Sequence
  Description of Artificial Sequence: Synthetic oligonucleotide
  Target: ATXN1; (+) strand; PAM type: NRG; PAM sequence: CGG
tcctaaggctcagagaactt

SEQ ID NO: 145796 - DNA, 20 bp, Artificial Sequence
  Description of Artificial Sequence: Synthetic oligonucleotide
  Target: ATXN1; (+) strand; PAM type: NRG; PAM sequence: AAG
agaacttcggttatttgcca

SEQ ID NO: 145797 - DNA, 20 bp, Artificial Sequence
  Description of Artificial Sequence: Synthetic oligonucleotide
  Target: ATXN1; (+) strand; PAM type: NRG; PAM sequence: AGG
gaacttcggttatttgccaa

SEQ ID NO: 145798 - DNA, 20 bp, Artificial Sequence
  Description of Artificial Sequence: Synthetic oligonucleotide
  Target: ATXN1; (+) strand; PAM type: NRG; PAM sequence: CAG
atttgccaaaggccgcacaa

SEQ ID NO: 145799 - DNA, 20 bp, Artificial Sequence
  Description of Artificial Sequence: Synthetic oligonucleotide
  Target: ATXN1; (+) strand; PAM type: NRG; PAM sequence: CAG
ggccgcacaacagttaatga

SEQ ID NO: 145800 - DNA, 20 bp, Artificial Sequence
  Description of Artificial Sequence: Synthetic oligonucleotide
  Target: ATXN1; (+) strand; PAM type: NRG; PAM sequence: AGG
gccgcacaacagttaatgac

SEQ ID NO: 145801 - DNA, 20 bp, Artificial Sequence
  Description of Artificial Sequence: Synthetic oligonucleotide
  Target: ATXN1; (+) strand; PAM type: NRG; PAM sequence: AAG
caacagttaatgacaggcct

SEQ ID NO: 145802 - DNA, 20 bp, Artificial Sequence
  Description of Artificial Sequence: Synthetic oligonucleotide
  Target: ATXN1; (+) strand; PAM type: NRG; PAM sequence: CAG
acaggcctaagacttccacc

SEQ ID NO: 145803 - DNA, 20 bp, Artificial Sequence
  Description of Artificial Sequence: Synthetic oligonucleotide
  Target: ATXN1; (+) strand; PAM type: NRG; PAM sequence: CAG
taagacttccacccagttcc

SEQ ID NO: 145804 - DNA, 20 bp, Artificial Sequence
  Description of Artificial Sequence: Synthetic oligonucleotide
  Target: ATXN1; (+) strand; PAM type: NRG; PAM sequence: CAG
cagttcccagcgtgctcaac

SEQ ID NO: 145805 - DNA, 20 bp, Artificial Sequence
  Description of Artificial Sequence: Synthetic oligonucleotide
  Target: ATXN1; (+) strand; PAM type: NRG; PAM sequence: TGG
ccagcgtgctcaaccagtga

SEQ ID NO: 145806 - DNA, 20 bp, Artificial Sequence
  Description of Artificial Sequence: Synthetic oligonucleotide
  Target: ATXN1; (+) strand; PAM type: NRG; PAM sequence: GAG
ggtctttgcatttactttct

SEQ ID NO: 145807 - DNA, 20 bp, Artificial Sequence
  Description of Artificial Sequence: Synthetic oligonucleotide
  Target: ATXN1; (+) strand; PAM type: NRG; PAM sequence: TAG
gcatttactttctgagcatt

SEQ ID NO: 145808 - DNA, 20 bp, Artificial Sequence
  Description of Artificial Sequence: Synthetic oligonucleotide
  Target: ATXN1; (+) strand; PAM type: NRG; PAM sequence: CAG
ctttctgagcatttagcgtt

SEQ ID NO: 145809 - DNA, 20 bp, Artificial Sequence
  Description of Artificial Sequence: Synthetic oligonucleotide
  Target: ATXN1; (+) strand; PAM type: NRG; PAM sequence: TAG
aatcatttactctctgctaa

SEQ ID NO: 145810 - DNA, 20 bp, Artificial Sequence
  Description of Artificial Sequence: Synthetic oligonucleotide
  Target: ATXN1; (+) strand; PAM type: NRG; PAM sequence: GAG
tcatttactctctgctaata

SEQ ID NO: 145811 - DNA, 20 bp, Artificial Sequence
  Description of Artificial Sequence: Synthetic oligonucleotide
  Target: ATXN1; (+) strand; PAM type: NRG; PAM sequence: TAG
ttatataacctataaaattt

SEQ ID NO: 145812 - DNA, 20 bp, Artificial Sequence
  Description of Artificial Sequence: Synthetic oligonucleotide
  Target: ATXN1; (+) strand; PAM type: NRG; PAM sequence: AGG
tatataacctataaaatttt

SEQ ID NO: 145813 - DNA, 20 bp, Artificial Sequence
  Description of Artificial Sequence: Synthetic oligonucleotide
  Target: ATXN1; (+) strand; PAM type: NRG; PAM sequence: TAG
ataaaattttaggatcttat

SEQ ID NO: 145814 - DNA, 20 bp, Artificial Sequence
  Description of Artificial Sequence: Synthetic oligonucleotide
  Target: ATXN1; (+) strand; PAM type: NRG; PAM sequence: AAG
aattttaggatcttattagc

SEQ ID NO: 145815 - DNA, 20 bp, Artificial Sequence
  Description of Artificial Sequence: Synthetic oligonucleotide
  Target: ATXN1; (+) strand; PAM type: NRG; PAM sequence: TAG
aaatgtctcctttcttaaat

SEQ ID NO: 145816 - DNA, 20 bp, Artificial Sequence
  Description of Artificial Sequence: Synthetic oligonucleotide
  Target: ATXN1; (+) strand; PAM type: NRG; PAM sequence: AGG
aatgtctcctttcttaaatt

SEQ ID NO: 145817 - DNA, 20 bp, Artificial Sequence
  Description of Artificial Sequence: Synthetic oligonucleotide
  Target: ATXN1; (+) strand; PAM type: NRG; PAM sequence: GGG
atgtctcctttcttaaatta

SEQ ID NO: 145818 - DNA, 20 bp, Artificial Sequence
  Description of Artificial Sequence: Synthetic oligonucleotide
  Target: ATXN1; (+) strand; PAM type: NRG; PAM sequence: TGG
ctcctttcttaaattagggc

SEQ ID NO: 145819 - DNA, 20 bp, Artificial Sequence
  Description of Artificial Sequence: Synthetic oligonucleotide
  Target: ATXN1; (+) strand; PAM type: NRG; PAM sequence: AAG
gggctggttttttttttttg

SEQ ID NO: 145820 - DNA, 20 bp, Artificial Sequence
  Description of Artificial Sequence: Synthetic oligonucleotide
  Target: ATXN1; (+) strand; PAM type: NRG; PAM sequence: AAG
ttttttttttttgaagaatt

SEQ ID NO: 145821 - DNA, 20 bp, Artificial Sequence
  Description of Artificial Sequence: Synthetic oligonucleotide
  Target: ATXN1; (+) strand; PAM type: NRG; PAM sequence: AGG
tttttttttttgaagaatta

SEQ ID NO: 145822 - DNA, 20 bp, Artificial Sequence
  Description of Artificial Sequence: Synthetic oligonucleotide
  Target: ATXN1; (+) strand; PAM type: NRG; PAM sequence: AAG
ttaattcgccttcatgttct

SEQ ID NO: 145823 - DNA, 20 bp, Artificial Sequence
  Description of Artificial Sequence: Synthetic oligonucleotide
  Target: ATXN1; (+) strand; PAM type: NRG; PAM sequence: GAG
aattcgccttcatgttctaa

SEQ ID NO: 145824 - DNA, 20 bp, Artificial Sequence
  Description of Artificial Sequence: Synthetic oligonucleotide
  Target: ATXN1; (+) strand; PAM type: NRG; PAM sequence: AAG
cttcatgttctaagagtgat

SEQ ID NO: 145825 - DNA, 20 bp, Artificial Sequence
  Description of Artificial Sequence: Synthetic oligonucleotide
  Target: ATXN1; (+) strand; PAM type: NRG; PAM sequence: GAG
tcatgttctaagagtgataa

SEQ ID NO: 145826 - DNA, 20 bp, Artificial Sequence
  Description of Artificial Sequence: Synthetic oligonucleotide
  Target: ATXN1; (+) strand; PAM type: NRG; PAM sequence: CGG
aagagtgataagagacttca

SEQ ID NO: 145827 - DNA, 20 bp, Artificial Sequence
  Description of Artificial Sequence: Synthetic oligonucleotide
  Target: ATXN1; (+) strand; PAM type: NRG; PAM sequence: GGG
agagtgataagagacttcac

SEQ ID NO: 145828 - DNA, 20 bp, Artificial Sequence
  Description of Artificial Sequence: Synthetic oligonucleotide
  Target: ATXN1; (+) strand; PAM type: NRG; PAM sequence: CAG
agacttcacgggaaacaaat

SEQ ID NO: 145829 - DNA, 20 bp, Artificial Sequence
  Description of Artificial Sequence: Synthetic oligonucleotide
  Target: ATXN1; (+) strand; PAM type: NRG; PAM sequence: AAG
cttcacgggaaacaaatcag

SEQ ID NO: 145830 - DNA, 20 bp, Artificial Sequence
  Description of Artificial Sequence: Synthetic oligonucleotide
  Target: ATXN1; (+) strand; PAM type: NRG; PAM sequence: AAG
gggaaacaaatcagaagcac

SEQ ID NO: 145831 - DNA, 20 bp, Artificial Sequence
  Description of Artificial Sequence: Synthetic oligonucleotide
  Target: ATXN1; (+) strand; PAM type: NRG; PAM sequence: GAG
aacaaatcagaagcacaagt

SEQ ID NO: 145832 - DNA, 20 bp, Artificial Sequence
  Description of Artificial Sequence: Synthetic oligonucleotide
  Target: ATXN1; (+) strand; PAM type: NRG; PAM sequence: TAG
caagtgagtgaaattttctt

SEQ ID NO: 145833 - DNA, 20 bp, Artificial Sequence
  Description of Artificial Sequence: Synthetic oligonucleotide
  Target: ATXN1; (+) strand; PAM type: NRG; PAM sequence: AGG
aagtgagtgaaattttcttt

SEQ ID NO: 145834 - DNA, 20 bp, Artificial Sequence
  Description of Artificial Sequence: Synthetic oligonucleotide
  Target: ATXN1; (+) strand; PAM type: NRG; PAM sequence: AAG
aattttctttaggacaacga

SEQ ID NO: 145835 - DNA, 20 bp, Artificial Sequence
  Description of Artificial Sequence: Synthetic oligonucleotide
  Target: ATXN1; (+) strand; PAM type: NRG; PAM sequence: TGG
ctttaggacaacgaaagaaa

SEQ ID NO: 145836 - DNA, 20 bp, Artificial Sequence
  Description of Artificial Sequence: Synthetic oligonucleotide
  Target: ATXN1; (+) strand; PAM type: NRG; PAM sequence: CAG
aacatatttgttaacttcta

SEQ ID NO: 145837 - DNA, 20 bp, Artificial Sequence
  Description of Artificial Sequence: Synthetic oligonucleotide
  Target: ATXN1; (+) strand; PAM type: NRG; PAM sequence: TGG
cacacacaccctcccacttc

SEQ ID NO: 145838 - DNA, 20 bp, Artificial Sequence
  Description of Artificial Sequence: Synthetic oligonucleotide
  Target: ATXN1; (+) strand; PAM type: NRG; PAM sequence: CAG
caccctcccacttctggctc

SEQ ID NO: 145839 - DNA, 20 bp, Artificial Sequence
  Description of Artificial Sequence: Synthetic oligonucleotide
  Target: ATXN1; (+) strand; PAM type: NRG; PAM sequence: TGG
attacttgttacttactatg

SEQ ID NO: 145840 - DNA, 20 bp, Artificial Sequence
  Description of Artificial Sequence: Synthetic oligonucleotide
  Target: ATXN1; (+) strand; PAM type: NRG; PAM sequence: GGG
ttacttgttacttactatgt

SEQ ID NO: 145841 - DNA, 20 bp, Artificial Sequence
  Description of Artificial Sequence: Synthetic oligonucleotide
  Target: ATXN1; (+) strand; PAM type: NRG; PAM sequence: AAG
cttgttacttactatgtggg

SEQ ID NO: 145842 - DNA, 20 bp, Artificial Sequence
  Description of Artificial Sequence: Synthetic oligonucleotide
  Target: ATXN1; (+) strand; PAM type: NRG; PAM sequence: AGG
ttgttacttactatgtggga

SEQ ID NO: 145843 - DNA, 20 bp, Artificial Sequence
  Description of Artificial Sequence: Synthetic oligonucleotide
  Target: ATXN1; (+) strand; PAM type: NRG; PAM sequence: CAG
aaatgctttcactgttatgt

SEQ ID NO: 145844 - DNA, 20 bp, Artificial Sequence
  Description of Artificial Sequence: Synthetic oligonucleotide
  Target: ATXN1; (+) strand; PAM type: NRG; PAM sequence: AGG
aatgctttcactgttatgtc

SEQ ID NO: 145845 - DNA, 20 bp, Artificial Sequence
  Description of Artificial Sequence: Synthetic oligonucleotide
  Target: ATXN1; (+) strand; PAM type: NRG; PAM sequence: AAG
ttatgtcaggtcaatctgtt

SEQ ID NO: 145846 - DNA, 20 bp, Artificial Sequence
  Description of Artificial Sequence: Synthetic oligonucleotide
  Target: ATXN1; (+) strand; PAM type: NRG; PAM sequence: CAG
attgtaaatttttgccacat

SEQ ID NO: 145847 - DNA, 20 bp, Artificial Sequence
  Description of Artificial Sequence: Synthetic oligonucleotide
  Target: ATXN1; (+) strand; PAM type: NRG; PAM sequence: TAG
cactaatgccatttgtatat

SEQ ID NO: 145848 - DNA, 20 bp, Artificial Sequence
  Description of Artificial Sequence: Synthetic oligonucleotide
  Target: ATXN1; (+) strand; PAM type: NRG; PAM sequence: AAG
tgtaatacacactgatcata

SEQ ID NO: 145849 - DNA, 20 bp, Artificial Sequence
  Description of Artificial Sequence: Synthetic oligonucleotide
  Target: ATXN1; (+) strand; PAM type: NRG; PAM sequence: AAG
tttgctaaactttaaaaatg

SEQ ID NO: 145850 - DNA, 20 bp, Artificial Sequence
  Description of Artificial Sequence: Synthetic oligonucleotide
  Target: ATXN1; (+) strand; PAM type: NRG; PAM sequence: AGG
ttgctaaactttaaaaatga

SEQ ID NO: 145851 - DNA, 20 bp, Artificial Sequence
  Description of Artificial Sequence: Synthetic oligonucleotide
  Target: ATXN1; (+) strand; PAM type: NRG; PAM sequence: CAG
acctccccgcccccattatt

SEQ ID NO: 145852 - DNA, 20 bp, Artificial Sequence
  Description of Artificial Sequence: Synthetic oligonucleotide
  Target: ATXN1; (+) strand; PAM type: NRG; PAM sequence: AAG
ccgcccccattattcagaat

SEQ ID NO: 145853 - DNA, 20 bp, Artificial Sequence
  Description of Artificial Sequence: Synthetic oligonucleotide
  Target: ATXN1; (+) strand; PAM type: NRG; PAM sequence: TGG
cccccattattcagaataag

SEQ ID NO: 145854 - DNA, 20 bp, Artificial Sequence
  Description of Artificial Sequence: Synthetic oligonucleotide
  Target: ATXN1; (+) strand; PAM type: NRG; PAM sequence: GAG
cccattattcagaataagtg

SEQ ID NO: 145855 - DNA, 20 bp, Artificial Sequence
  Description of Artificial Sequence: Synthetic oligonucleotide
  Target: ATXN1; (+) strand; PAM type: NRG; PAM sequence: TGG
tattcagaataagtggagtg

SEQ ID NO: 145856 - DNA, 20 bp, Artificial Sequence
  Description of Artificial Sequence: Synthetic oligonucleotide
  Target: ATXN1; (+) strand; PAM type: NRG; PAM sequence: GAG
ttcagaataagtggagtgtg

SEQ ID NO: 145857 - DNA, 20 bp, Artificial Sequence
  Description of Artificial Sequence: Synthetic oligonucleotide
  Target: ATXN1; (+) strand; PAM type: NRG; PAM sequence: TGG
ataagtggagtgtggagcat

SEQ ID NO: 145858 - DNA, 20 bp, Artificial Sequence
  Description of Artificial Sequence: Synthetic oligonucleotide
  Target: ATXN1; (+) strand; PAM type: NRG; PAM sequence: GGG
taagtggagtgtggagcatt

SEQ ID NO: 145859 - DNA, 20 bp, Artificial Sequence
  Description of Artificial Sequence: Synthetic oligonucleotide
  Target: ATXN1; (+) strand; PAM type: NRG; PAM sequence: TGG
agcattgggttttccctttc

SEQ ID NO: 145860 - DNA, 20 bp, Artificial Sequence
  Description of Artificial Sequence: Synthetic oligonucleotide
  Target: ATXN1; (+) strand; PAM type: NRG; PAM sequence: GGG
gcattgggttttccctttct

SEQ ID NO: 145861 - DNA, 20 bp, Artificial Sequence
  Description of Artificial Sequence: Synthetic oligonucleotide
  Target: ATXN1; (+) strand; PAM type: NRG; PAM sequence: GGG
cattgggttttccctttctg

SEQ ID NO: 145862 - DNA, 20 bp, Artificial Sequence
  Description of Artificial Sequence: Synthetic oligonucleotide
  Target: ATXN1; (+) strand; PAM type: NRG; PAM sequence: GAG
ttgggttttccctttctggg

SEQ ID NO: 145863 - DNA, 20 bp, Artificial Sequence
  Description of Artificial Sequence: Synthetic oligonucleotide
  Target: ATXN1; (+) strand; PAM type: NRG; PAM sequence: AGG
tgggttttccctttctgggg

SEQ ID NO: 145864 - DNA, 20 bp, Artificial Sequence
  Description of Artificial Sequence: Synthetic oligonucleotide
  Target: ATXN1; (+) strand; PAM type: NRG; PAM sequence: GAG
ctggggaggaacaaatgaat

SEQ ID NO: 145865 - DNA, 20 bp, Artificial Sequence
  Description of Artificial Sequence: Synthetic oligonucleotide
  Target: ATXN1; (+) strand; PAM type: NRG; PAM sequence: TAG
ggaacaaatgaatgagtaac

SEQ ID NO: 145866 - DNA, 20 bp, Artificial Sequence
  Description of Artificial Sequence: Synthetic oligonucleotide
  Target: ATXN1; (+) strand; PAM type: NRG; PAM sequence: GAG
caaatgaatgagtaactagt

SEQ ID NO: 145867 - DNA, 20 bp, Artificial Sequence
  Description of Artificial Sequence: Synthetic oligonucleotide
  Target: ATXN1; (+) strand; PAM type: NRG; PAM sequence: AGG
aaatgaatgagtaactagtg

SEQ ID NO: 145868 - DNA, 20 bp, Artificial Sequence
  Description of Artificial Sequence: Synthetic oligonucleotide
  Target: ATXN1; (+) strand; PAM type: NRG; PAM sequence: GGG
aatgaatgagtaactagtga

SEQ ID NO: 145869 - DNA, 20 bp, Artificial Sequence
  Description of Artificial Sequence: Synthetic oligonucleotide
  Target: ATXN1; (+) strand; PAM type: NRG; PAM sequence: TAG
agtaactagtgagggcatct

SEQ ID NO: 145870 - DNA, 20 bp, Artificial Sequence
  Description of Artificial Sequence: Synthetic oligonucleotide
  Target: ATXN1; (+) strand; PAM type: NRG; PAM sequence: AGG
gtaactagtgagggcatctt

SEQ ID NO: 145871 - DNA, 20 bp, Artificial Sequence
  Description of Artificial Sequence: Synthetic oligonucleotide
  Target: ATXN1; (+) strand; PAM type: NRG; PAM sequence: GGG
taactagtgagggcatctta

SEQ ID NO: 145872 - DNA, 20 bp, Artificial Sequence
  Description of Artificial Sequence: Synthetic oligonucleotide
  Target: ATXN1; (+) strand; PAM type: NRG; PAM sequence: GAG
actagtgagggcatcttagg

SEQ ID NO: 145873 - DNA, 20 bp, Artificial Sequence
  Description of Artificial Sequence: Synthetic oligonucleotide
  Target: ATXN1; (+) strand; PAM type: NRG; PAM sequence: CAG
ttagggagttcccccgccca

SEQ ID NO: 145874 - DNA, 20 bp, Artificial Sequence
  Description of Artificial Sequence: Synthetic oligonucleotide
  Target: ATXN1; (+) strand; PAM type: NRG; PAM sequence: GAG
ttcccccgcccacagactat

SEQ ID NO: 145875 - DNA, 20 bp, Artificial Sequence
  Description of Artificial Sequence: Synthetic oligonucleotide
  Target: ATXN1; (+) strand; PAM type: NRG; PAM sequence: AGG
tcccccgcccacagactatg

SEQ ID NO: 145876 - DNA, 20 bp, Artificial Sequence
  Description of Artificial Sequence: Synthetic oligonucleotide
  Target: ATXN1; (+) strand; PAM type: NRG; PAM sequence: AAG
tatgaggcatcttgatttga

SEQ ID NO: 145877 - DNA, 20 bp, Artificial Sequence
  Description of Artificial Sequence: Synthetic oligonucleotide
  Target: ATXN1; (+) strand; PAM type: NRG; PAM sequence: AGG
atgaggcatcttgatttgaa

SEQ ID NO: 145878 - DNA, 20 bp, Artificial Sequence
  Description of Artificial Sequence: Synthetic oligonucleotide
  Target: ATXN1; (+) strand; PAM type: NRG; PAM sequence: AAG
cgcacacaaaaacactttta

SEQ ID NO: 145879 - DNA, 20 bp, Artificial Sequence
  Description of Artificial Sequence: Synthetic oligonucleotide
  Target: ATXN1; (+) strand; PAM type: NRG; PAM sequence: AAG
aaagttgacttcttacataa

SEQ ID NO: 145880 - DNA, 20 bp, Artificial Sequence
  Description of Artificial Sequence: Synthetic oligonucleotide
  Target: ATXN1; (+) strand; PAM type: NRG; PAM sequence: CAG
ttgacttcttacataaaagc

SEQ ID NO: 145881 - DNA, 20 bp, Artificial Sequence
  Description of Artificial Sequence: Synthetic oligonucleotide
  Target: ATXN1; (+) strand; PAM type: NRG; PAM sequence: CAG
acttcttacataaaagccag

SEQ ID NO: 145882 - DNA, 20 bp, Artificial Sequence
  Description of Artificial Sequence: Synthetic oligonucleotide
  Target: ATXN1; (+) strand; PAM type: NRG; PAM sequence: TAG
aagccagcagtactccctgc

SEQ ID NO: 145883 - DNA, 20 bp, Artificial Sequence
  Description of Artificial Sequence: Synthetic oligonucleotide
  Target: ATXN1; (+) strand; PAM type: NRG; PAM sequence: AAG
gtactccctgctagaatctg

SEQ ID NO: 145884 - DNA, 20 bp, Artificial Sequence
  Description of Artificial Sequence: Synthetic oligonucleotide
  Target: ATXN1; (+) strand; PAM type: NRG; PAM sequence: AAG
ccctgctagaatctgaagaa

SEQ ID NO: 145885 - DNA, 20 bp, Artificial Sequence
  Description of Artificial Sequence: Synthetic oligonucleotide
  Target: ATXN1; (+) strand; PAM type: NRG; PAM sequence: TGG
tattactattattattttac

SEQ ID NO: 145886 - DNA, 20 bp, Artificial Sequence
  Description of Artificial Sequence: Synthetic oligonucleotide
  Target: ATXN1; (+) strand; PAM type: NRG; PAM sequence: AAG
actattattattttactggc

SEQ ID NO: 145887 - DNA, 20 bp, Artificial Sequence
  Description of Artificial Sequence: Synthetic oligonucleotide
  Target: ATXN1; (+) strand; PAM type: NRG; PAM sequence: AGG
ctattattattttactggca

SEQ ID NO: 145888 - DNA, 20 bp, Artificial Sequence
  Description of Artificial Sequence: Synthetic oligonucleotide
  Target: ATXN1; (+) strand; PAM type: NRG; PAM sequence: CAG
attttactggcaaggccttt

SEQ ID NO: 145889 - DNA, 20 bp, Artificial Sequence
  Description of Artificial Sequence: Synthetic oligonucleotide
  Target: ATXN1; (+) strand; PAM type: NRG; PAM sequence: AGG
ttttactggcaaggcctttc

SEQ ID NO: 145890 - DNA, 20 bp, Artificial Sequence
  Description of Artificial Sequence: Synthetic oligonucleotide
  Target: ATXN1; (+) strand; PAM type: NRG; PAM sequence: GGG
tttactggcaaggcctttca

SEQ ID NO: 145891 - DNA, 20 bp, Artificial Sequence
  Description of Artificial Sequence: Synthetic oligonucleotide
  Target: ATXN1; (+) strand; PAM type: NRG; PAM sequence: GGG
ttactggcaaggcctttcag

SEQ ID NO: 145892 - DNA, 20 bp, Artificial Sequence
  Description of Artificial Sequence: Synthetic oligonucleotide
  Target: ATXN1; (+) strand; PAM type: NRG; PAM sequence: GGG
tactggcaaggcctttcagg

SEQ ID NO: 145893 - DNA, 20 bp, Artificial Sequence
  Description of Artificial Sequence: Synthetic oligonucleotide
  Target: ATXN1; (+) strand; PAM type: NRG; PAM sequence: GAG
gggttatgcttcattcaatt

SEQ ID NO: 145894 - DNA, 20 bp, Artificial Sequence
  Description of Artificial Sequence: Synthetic oligonucleotide
  Target: ATXN1; (+) strand; PAM type: NRG; PAM sequence: AAG
tcaattgagcctaattgata

SEQ ID NO: 145895 - DNA, 20 bp, Artificial Sequence
  Description of Artificial Sequence: Synthetic oligonucleotide
  Target: ATXN1; (+) strand; PAM type: NRG; PAM sequence: CAG
ataaagctaacacatgttta

SEQ ID NO: 145896 - DNA, 20 bp, Artificial Sequence
  Description of Artificial Sequence: Synthetic oligonucleotide
  Target: ATXN1; (+) strand; PAM type: NRG; PAM sequence: AGG
taaagctaacacatgtttac

SEQ ID NO: 145897 - DNA, 20 bp, Artificial Sequence
  Description of Artificial Sequence: Synthetic oligonucleotide
  Target: ATXN1; (+) strand; PAM type: NRG; PAM sequence: AAG
gtttacaggtaataaaaatg

SEQ ID NO: 145898 - DNA, 20 bp, Artificial Sequence
  Description of Artificial Sequence: Synthetic oligonucleotide
  Target: ATXN1; (+) strand; PAM type: NRG; PAM sequence: TGG
aaaatgaagtactatctaca

SEQ ID NO: 145899 - DNA, 20 bp, Artificial Sequence
  Description of Artificial Sequence: Synthetic oligonucleotide
  Target: ATXN1; (+) strand; PAM type: NRG; PAM sequence: CAG
ctatctacatggaaacaaat

SEQ ID NO: 145900 - DNA, 20 bp, Artificial Sequence
  Description of Artificial Sequence: Synthetic oligonucleotide
  Target: ATXN1; (+) strand; PAM type: NRG; PAM sequence: AGG
tatctacatggaaacaaatc

SEQ ID NO: 145901 - DNA, 20 bp, Artificial Sequence
  Description of Artificial Sequence: Synthetic oligonucleotide
  Target: ATXN1; (+) strand; PAM type: NRG; PAM sequence: GGG
atctacatggaaacaaatca

SEQ ID NO: 145902 - DNA, 20 bp, Artificial Sequence
  Description of Artificial Sequence: Synthetic oligonucleotide
  Target: ATXN1; (+) strand; PAM type: NRG; PAM sequence: GAG
ctacatggaaacaaatcagg

SEQ ID NO: 145903 - DNA, 20 bp, Artificial Sequence
  Description of Artificial Sequence: Synthetic oligonucleotide
  Target: ATXN1; (+) strand; PAM type: NRG; PAM sequence: CAG
catggaaacaaatcagggag

SEQ ID NO: 145904 - DNA, 20 bp, Artificial Sequence
  Description of Artificial Sequence: Synthetic oligonucleotide
  Target: ATXN1; (+) strand; PAM type: NRG; PAM sequence: GAG
tggaaacaaatcagggagca

SEQ ID NO: 145905 - DNA, 20 bp, Artificial Sequence
  Description of Artificial Sequence: Synthetic oligonucleotide
  Target: ATXN1; (+) strand; PAM type: NRG; PAM sequence: AGG
ggaaacaaatcagggagcag

SEQ ID NO: 145906 - DNA, 20 bp, Artificial Sequence
  Description of Artificial Sequence: Synthetic oligonucleotide
  Target: ATXN1; (+) strand; PAM type: NRG; PAM sequence: CAG
aaatcagggagcagaggaac

SEQ ID NO: 145907 - DNA, 20 bp, Artificial Sequence
  Description of Artificial Sequence: Synthetic oligonucleotide
  Target: ATXN1; (+) strand; PAM type: NRG; PAM sequence: AAG
taaaaactaaaatgttctct

SEQ ID NO: 145908 - DNA, 20 bp, Artificial Sequence
  Description of Artificial Sequence: Synthetic oligonucleotide
  Target: ATXN1; (+) strand; PAM type: NRG; PAM sequence: AAG
aatgttctctaagcattatc

SEQ ID NO: 145909 - DNA, 20 bp, Artificial Sequence
  Description of Artificial Sequence: Synthetic oligonucleotide
  Target: ATXN1; (+) strand; PAM type: NRG; PAM sequence: AAG
aacaaaaatataatttcaca

SEQ ID NO: 145910 - DNA, 20 bp, Artificial Sequence
  Description of Artificial Sequence: Synthetic oligonucleotide
  Target: ATXN1; (+) strand; PAM type: NRG; PAM sequence: AAG
aaatataatttcacaaagca

SEQ ID NO: 145911 - DNA, 20 bp, Artificial Sequence
  Description of Artificial Sequence: Synthetic oligonucleotide
  Target: ATXN1; (+) strand; PAM type: NRG; PAM sequence: AAG
atcgttcaataaattatttt

SEQ ID NO: 145912 - DNA, 20 bp, Artificial Sequence
  Description of Artificial Sequence: Synthetic oligonucleotide
  Target: ATXN1; (+) strand; PAM type: NRG; PAM sequence: GAG
cgttcaataaattattttaa

SEQ ID NO: 145913 - DNA, 20 bp, Artificial Sequence
  Description of Artificial Sequence: Synthetic oligonucleotide
  Target: ATXN1; (+) strand; PAM type: NRG; PAM sequence: CAG
tcaataaattattttaagag

SEQ ID NO: 145914 - DNA, 20 bp, Artificial Sequence
  Description of Artificial Sequence: Synthetic oligonucleotide
  Target: ATXN1; (+) strand; PAM type: NRG; PAM sequence: AAG
taaattattttaagagcaga

SEQ ID NO: 145915 - DNA, 20 bp, Artificial Sequence
  Description of Artificial Sequence: Synthetic oligonucleotide
  Target: ATXN1; (+) strand; PAM type: NRG; PAM sequence: TAG
agagcagaaagcactgactt

SEQ ID NO: 145916 - DNA, 20 bp, Artificial Sequence
  Description of Artificial Sequence: Synthetic oligonucleotide
  Target: ATXN1; (+) strand; PAM type: NRG; PAM sequence: TGG
agcactgactttagctttac

SEQ ID NO: 145917 - DNA, 20 bp, Artificial Sequence
  Description of Artificial Sequence: Synthetic oligonucleotide
  Target: ATXN1; (+) strand; PAM type: NRG; PAM sequence: TGG
gttatctctgttcttaaaaa

SEQ ID NO: 145918 - DNA, 20 bp, Artificial Sequence
  Description of Artificial Sequence: Synthetic oligonucleotide
  Target: ATXN1; (+) strand; PAM type: NRG; PAM sequence: CAG
tcttaaaaatggaatatttc

SEQ ID NO: 145919 - DNA, 20 bp, Artificial Sequence
  Description of Artificial Sequence: Synthetic oligonucleotide
  Target: ATXN1; (+) strand; PAM type: NRG; PAM sequence: AGG
cttaaaaatggaatatttcc

SEQ ID NO: 145920 - DNA, 20 bp, Artificial Sequence
  Description of Artificial Sequence: Synthetic oligonucleotide
  Target: ATXN1; (+) strand; PAM type: NRG; PAM sequence: GGG
ttaaaaatggaatatttcca

SEQ ID NO: 145921 - DNA, 20 bp, Artificial Sequence
  Description of Artificial Sequence: Synthetic oligonucleotide
  Target: ATXN1; (+) strand; PAM type: NRG; PAM sequence: AAG
ggaatatttccagggacaaa

SEQ ID NO: 145922 - DNA, 20 bp, Artificial Sequence
  Description of Artificial Sequence: Synthetic oligonucleotide
  Target: ATXN1; (+) strand; PAM type: NRG; PAM sequence: AAG
tttccagggacaaaaagtat

SEQ ID NO: 145923 - DNA, 20 bp, Artificial Sequence
  Description of Artificial Sequence: Synthetic oligonucleotide
  Target: ATXN1; (+) strand; PAM type: NRG; PAM sequence: TGG
taagtaatacgtgattaata

SEQ ID NO: 145924 - DNA, 20 bp, Artificial Sequence
  Description of Artificial Sequence: Synthetic oligonucleotide
  Target: ATXN1; (+) strand; PAM type: NRG; PAM sequence: AAG
taccgaatattcttaatgaa

SEQ ID NO: 145925 - DNA, 20 bp, Artificial Sequence
  Description of Artificial Sequence: Synthetic oligonucleotide
  Target: ATXN1; (+) strand; PAM type: NRG; PAM sequence: AAG
aaagttctgttttttttgaa

SEQ ID NO: 145926 - DNA, 20 bp, Artificial Sequence
  Description of Artificial Sequence: Synthetic oligonucleotide
  Target: ATXN1; (+) strand; PAM type: NRG; PAM sequence: CAG
cttcctgatactatattttg

SEQ ID NO: 145927 - DNA, 20 bp, Artificial Sequence
  Description of Artificial Sequence: Synthetic oligonucleotide
  Target: ATXN1; (+) strand; PAM type: NRG; PAM sequence: TGG
atactatattttgcagtgca

SEQ ID NO: 145928 - DNA, 20 bp, Artificial Sequence
  Description of Artificial Sequence: Synthetic oligonucleotide
  Target: ATXN1; (+) strand; PAM type: NRG; PAM sequence: TGG
ctatattttgcagtgcatgg

SEQ ID NO: 145929 - DNA, 20 bp, Artificial Sequence
  Description of Artificial Sequence: Synthetic oligonucleotide
  Target: ATXN1; (+) strand; PAM type: NRG; PAM sequence: AAG
ttttgcagtgcatggtggca

SEQ ID NO: 145930 - DNA, 20 bp, Artificial Sequence
  Description of Artificial Sequence: Synthetic oligonucleotide
  Target: ATXN1; (+) strand; PAM type: NRG; PAM sequence: AGG
tttgcagtgcatggtggcaa

SEQ ID NO: 145931 - DNA, 20 bp, Artificial Sequence
  Description of Artificial Sequence: Synthetic oligonucleotide
  Target: ATXN1; (+) strand; PAM type: NRG; PAM sequence: AAG
tgcatggtggcaaaggcaat

SEQ ID NO: 145932 - DNA, 20 bp, Artificial Sequence
  Description of Artificial Sequence: Synthetic oligonucleotide
  Target: ATXN1; (+) strand; PAM type: NRG; PAM sequence: AGG
gcatggtggcaaaggcaata

SEQ ID NO: 145933 - DNA, 20 bp, Artificial Sequence
  Description of Artificial Sequence: Synthetic oligonucleotide
  Target: ATXN1; (+) strand; PAM type: NRG; PAM sequence: TGG
ggcaaaggcaataaggtttt

SEQ ID NO: 145934 - DNA, 20 bp, Artificial Sequence
  Description of Artificial Sequence: Synthetic oligonucleotide
  Target: ATXN1; (+) strand; PAM type: NRG; PAM sequence: CAG
tttggtaataccttgttaca

SEQ ID NO: 145935 - DNA, 20 bp, Artificial Sequence
  Description of Artificial Sequence: Synthetic oligonucleotide
  Target: ATXN1; (+) strand; PAM type: NRG; PAM sequence: TAG
cttgttacacagattattta

SEQ ID NO: 145936 - DNA, 20 bp, Artificial Sequence
  Description of Artificial Sequence: Synthetic oligonucleotide
  Target: ATXN1; (+) strand; PAM type: NRG; PAM sequence: CAG
atcccaaaacatacataaca

SEQ ID NO: 145937 - DNA, 20 bp, Artificial Sequence
  Description of Artificial Sequence: Synthetic oligonucleotide
  Target: ATXN1; (+) strand; PAM type: NRG; PAM sequence: GAG
cccaaaacatacataacaca

SEQ ID NO: 145938 - DNA, 20 bp, Artificial Sequence
  Description of Artificial Sequence: Synthetic oligonucleotide
  Target: ATXN1; (+) strand; PAM type: NRG; PAM sequence: CAG
cttaaattttaaaaccatat

SEQ ID NO: 145939 - DNA, 20 bp, Artificial Sequence
  Description of Artificial Sequence: Synthetic oligonucleotide
  Target: ATXN1; (+) strand; PAM type: NRG; PAM sequence: CAG
aaatatacaacttatccttc

SEQ ID NO: 145940 - DNA, 20 bp, Artificial Sequence
  Description of Artificial Sequence: Synthetic oligonucleotide
  Target: ATXN1; (+) strand; PAM type: NRG; PAM sequence: AGG
aatatacaacttatccttcc

SEQ ID NO: 145941 - DNA, 20 bp, Artificial Sequence
  Description of Artificial Sequence: Synthetic oligonucleotide
  Target: ATXN1; (+) strand; PAM type: NRG; PAM sequence: AAG
tccttccaggtctttcctaa

SEQ ID NO: 145942 - DNA, 20 bp, Artificial Sequence
  Description of Artificial Sequence: Synthetic oligonucleotide
  Target: ATXN1; (+) strand; PAM type: NRG; PAM sequence: AGG
ccttccaggtctttcctaaa

SEQ ID NO: 145943 - DNA, 20 bp, Artificial Sequence
  Description of Artificial Sequence: Synthetic oligonucleotide
  Target: ATXN1; (+) strand; PAM type: NRG; PAM sequence: AAG
aaggtatacatacacttccg

SEQ ID NO: 145944 - DNA, 20 bp, Artificial Sequence
  Description of Artificial Sequence: Synthetic oligonucleotide
  Target: ATXN1; (+) strand; PAM type: NRG; PAM sequence: TAG
gtatacatacacttccgaag

SEQ ID NO: 145945 - DNA, 20 bp, Artificial Sequence
  Description of Artificial Sequence: Synthetic oligonucleotide
  Target: ATXN1; (+) strand; PAM type: NRG; PAM sequence: AAG
ttccgaagtagtataaaaaa

SEQ ID NO: 145946 - DNA, 20 bp, Artificial Sequence
  Description of Artificial Sequence: Synthetic oligonucleotide
  Target: ATXN1; (+) strand; PAM type: NRG; PAM sequence: GAG
ccgaagtagtataaaaaaaa

SEQ ID NO: 145947 - DNA, 20 bp, Artificial Sequence
  Description of Artificial Sequence: Synthetic oligonucleotide
  Target: ATXN1; (+) strand; PAM type: NRG; PAM sequence: AGG
cgaagtagtataaaaaaaag

SEQ ID NO: 145948 - DNA, 20 bp, Artificial Sequence
  Description of Artificial Sequence: Synthetic oligonucleotide
  Target: ATXN1; (+) strand; PAM type: NRG; PAM sequence: TAG
tctgataacgcactgtgaat

SEQ ID NO: 145949 - DNA, 20 bp, Artificial Sequence
  Description of Artificial Sequence: Synthetic oligonucleotide
  Target: ATXN1; (+) strand; PAM type: NRG; PAM sequence: AAG
ttaacaacactgtcctaatt

SEQ ID NO: 145950 - DNA, 20 bp, Artificial Sequence
  Description of Artificial Sequence: Synthetic oligonucleotide
  Target: ATXN1; (+) strand; PAM type: NRG; PAM sequence: AAG
ctgtcctaattaagaccaat

SEQ ID NO: 145951 - DNA, 20 bp, Artificial Sequence
  Description of Artificial Sequence: Synthetic oligonucleotide
  Target: ATXN1; (+) strand; PAM type: NRG; PAM sequence: AAG
cctaattaagaccaataaga

SEQ ID NO: 145952 - DNA, 20 bp, Artificial Sequence
  Description of Artificial Sequence: Synthetic oligonucleotide
  Target: ATXN1; (+) strand; PAM type: NRG; PAM sequence: GAG
ccatccatccaatattccac

SEQ ID NO: 145953 - DNA, 20 bp, Artificial Sequence
  Description of Artificial Sequence: Synthetic oligonucleotide
  Target: ATXN1; (+) strand; PAM type: NRG; PAM sequence: CAG
ccatccaatattccacgaga

SEQ ID NO: 145954 - DNA, 20 bp, Artificial Sequence
  Description of Artificial Sequence: Synthetic oligonucleotide
  Target: ATXN1; (+) strand; PAM type: NRG; PAM sequence: CAG
ccaatattccacgagacagc

SEQ ID NO: 145955 - DNA, 20 bp, Artificial Sequence
  Description of Artificial Sequence: Synthetic oligonucleotide
  Target: ATXN1; (+) strand; PAM type: NRG; PAM sequence: AGG
caatattccacgagacagcc

SEQ ID NO: 145956 - DNA, 20 bp, Artificial Sequence
  Description of Artificial Sequence: Synthetic oligonucleotide
  Target: ATXN1; (+) strand; PAM type: NRG; PAM sequence: TAG
ttgtgtaattattcacctca

SEQ ID NO: 145957 - DNA, 20 bp, Artificial Sequence
  Description of Artificial Sequence: Synthetic oligonucleotide
  Target: ATXN1; (+) strand; PAM type: NRG; PAM sequence: TGG
tgtaattattcacctcatag

SEQ ID NO: 145958 - DNA, 20 bp, Artificial Sequence
  Description of Artificial Sequence: Synthetic oligonucleotide
  Target: ATXN1; (+) strand; PAM type: NRG; PAM sequence: AAG
cctcatagtggtccaccttg

SEQ ID NO: 145959 - DNA, 20 bp, Artificial Sequence
  Description of Artificial Sequence: Synthetic oligonucleotide
  Target: ATXN1; (+) strand; PAM type: NRG; PAM sequence: AGG
ctcatagtggtccaccttga

SEQ ID NO: 145960 - DNA, 20 bp, Artificial Sequence
  Description of Artificial Sequence: Synthetic oligonucleotide
  Target: ATXN1; (+) strand; PAM type: NRG; PAM sequence: AAG
atgcaacacattatgccgaa

SEQ ID NO: 145961 - DNA, 20 bp, Artificial Sequence
  Description of Artificial Sequence: Synthetic oligonucleotide
  Target: ATXN1; (+) strand; PAM type: NRG; PAM sequence: GAG
gcaacacattatgccgaaaa

SEQ ID NO: 145962 - DNA, 20 bp, Artificial Sequence
  Description of Artificial Sequence: Synthetic oligonucleotide
  Target: ATXN1; (+) strand; PAM type: NRG; PAM sequence: TAG
gccgaaaagagatatttata

SEQ ID NO: 145963 - DNA, 20 bp, Artificial Sequence
  Description of Artificial Sequence: Synthetic oligonucleotide
  Target: ATXN1; (+) strand; PAM type: NRG; PAM sequence: AAG
gaaaagagatatttatatag

SEQ ID NO: 145964 - DNA, 20 bp, Artificial Sequence
  Description of Artificial Sequence: Synthetic oligonucleotide
  Target: ATXN1; (+) strand; PAM type: NRG; PAM sequence: AGG
aaaagagatatttatataga

SEQ ID NO: 145965 - DNA, 20 bp, Artificial Sequence
  Description of Artificial Sequence: Synthetic oligonucleotide
  Target: ATXN1; (+) strand; PAM type: NRG; PAM sequence: GGG
aaagagatatttatatagaa

SEQ ID NO: 145966 - DNA, 20 bp, Artificial Sequence
  Description of Artificial Sequence: Synthetic oligonucleotide
  Target: ATXN1; (+) strand; PAM type: NRG; PAM sequence: TAG
ttatatagaagggaattact

SEQ ID NO: 145967 - DNA, 20 bp, Artificial Sequence
  Description of Artificial Sequence: Synthetic oligonucleotide
  Target: ATXN1; (+) strand; PAM type: NRG; PAM sequence: AGG
tatatagaagggaattactt

SEQ ID NO: 145968 - DNA, 20 bp, Artificial Sequence
  Description of Artificial Sequence: Synthetic oligonucleotide
  Target: ATXN1; (+) strand; PAM type: NRG; PAM sequence: CGG
agggaattacttaggacatg

SEQ ID NO: 145969 - DNA, 20 bp, Artificial Sequence
  Description of Artificial Sequence: Synthetic oligonucleotide
  Target: ATXN1; (+) strand; PAM type: NRG; PAM sequence: AAG
atgcggatgtccctaaaata

SEQ ID NO: 145970 - DNA, 20 bp, Artificial Sequence
  Description of Artificial Sequence: Synthetic oligonucleotide
  Target: ATXN1; (+) strand; PAM type: NRG; PAM sequence: GAG
ataaagattcttgaccactc

SEQ ID NO: 145971 - DNA, 20 bp, Artificial Sequence
  Description of Artificial Sequence: Synthetic oligonucleotide
  Target: ATXN1; (+) strand; PAM type: NRG; PAM sequence: CAG
tcttgaccactcgagctact

SEQ ID NO: 145972 - DNA, 20 bp, Artificial Sequence
  Description of Artificial Sequence: Synthetic oligonucleotide
  Target: ATXN1; (+) strand; PAM type: NRG; PAM sequence: TAG
agctactcagtatttctctc

SEQ ID NO: 145973 - DNA, 20 bp, Artificial Sequence
  Description of Artificial Sequence: Synthetic oligonucleotide
  Target: ATXN1; (+) strand; PAM type: NRG; PAM sequence: AGG
gctactcagtatttctctct

SEQ ID NO: 145974 - DNA, 20 bp, Artificial Sequence
  Description of Artificial Sequence: Synthetic oligonucleotide
  Target: ATXN1; (+) strand; PAM type: NRG; PAM sequence: TAG
ctcagtatttctctctaggc

SEQ ID NO: 145975 - DNA, 20 bp, Artificial Sequence
  Description of Artificial Sequence: Synthetic oligonucleotide
  Target: ATXN1; (+) strand; PAM type: NRG; PAM sequence: CAG
atttctctctaggctagaaa

SEQ ID NO: 145976 - DNA, 20 bp, Artificial Sequence
  Description of Artificial Sequence: Synthetic oligonucleotide
  Target: ATXN1; (+) strand; PAM type: NRG; PAM sequence: AAG
tctctaggctagaaacagaa

SEQ ID NO: 145977 - DNA, 20 bp, Artificial Sequence
  Description of Artificial Sequence: Synthetic oligonucleotide
  Target: ATXN1; (+) strand; PAM type: NRG; PAM sequence: TGG
gattaaataacatattcata

SEQ ID NO: 145978 - DNA, 20 bp, Artificial Sequence
  Description of Artificial Sequence: Synthetic oligonucleotide
  Target: ATXN1; (+) strand; PAM type: NRG; PAM sequence: GGG
attaaataacatattcatat

SEQ ID NO: 145979 - DNA, 20 bp, Artificial Sequence
  Description of Artificial Sequence: Synthetic oligonucleotide
  Target: ATXN1; (+) strand; PAM type: NRG; PAM sequence: AAG
aaataacatattcatatggg

SEQ ID NO: 145980 - DNA, 20 bp, Artificial Sequence
  Description of Artificial Sequence: Synthetic oligonucleotide
  Target: ATXN1; (+) strand; PAM type: NRG; PAM sequence: AAG
tcaatttttccatcaatgaa

SEQ ID NO: 145981 - DNA, 20 bp, Artificial Sequence
  Description of Artificial Sequence: Synthetic oligonucleotide
  Target: ATXN1; (+) strand; PAM type: NRG; PAM sequence: AAG
tttttccatcaatgaaaagc

SEQ ID NO: 145982 - DNA, 20 bp, Artificial Sequence
  Description of Artificial Sequence: Synthetic oligonucleotide
  Target: ATXN1; (+) strand; PAM type: NRG; PAM sequence: AAG
aatgaaaagcaagaaaccgt

SEQ ID NO: 145983 - DNA, 20 bp, Artificial Sequence
  Description of Artificial Sequence: Synthetic oligonucleotide
  Target: ATXN1; (+) strand; PAM type: NRG; PAM sequence: GAG
tgaaaagcaagaaaccgtaa

SEQ ID NO: 145984 - DNA, 20 bp, Artificial Sequence
  Description of Artificial Sequence: Synthetic oligonucleotide
  Target: ATXN1; (+) strand; PAM type: NRG; PAM sequence: AAG
agaaaccgtaagagcatttc

SEQ ID NO: 145985 - DNA, 20 bp, Artificial Sequence
  Description of Artificial Sequence: Synthetic oligonucleotide
  Target: ATXN1; (+) strand; PAM type: NRG; PAM sequence: AGG
gaaaccgtaagagcatttca

SEQ ID NO: 145986 - DNA, 20 bp, Artificial Sequence
  Description of Artificial Sequence: Synthetic oligonucleotide
  Target: ATXN1; (+) strand; PAM type: NRG; PAM sequence: AAG
ccgtaagagcatttcaaggc

SEQ ID NO: 145987 - DNA, 20 bp, Artificial Sequence
  Description of Artificial Sequence: Synthetic oligonucleotide
  Target: ATXN1; (+) strand; PAM type: NRG; PAM sequence: AAG
tttcaaggcaagatctttta

SEQ ID NO: 145988 - DNA, 20 bp, Artificial Sequence
  Description of Artificial Sequence: Synthetic oligonucleotide
  Target: ATXN1; (+) strand; PAM type: NRG; PAM sequence: AAG
ttaaagtcctacaaatattt

SEQ ID NO: 145989 - DNA, 20 bp, Artificial Sequence
  Description of Artificial Sequence: Synthetic oligonucleotide
  Target: ATXN1; (+) strand; PAM type: NRG; PAM sequence: CAG
ctctacactttttaaaaata

SEQ ID NO: 145990 - DNA, 20 bp, Artificial Sequence
  Description of Artificial Sequence: Synthetic oligonucleotide
  Target: ATXN1; (+) strand; PAM type: NRG; PAM sequence: AAG
ttaaaaatacagtttattta

SEQ ID NO: 145991 - DNA, 20 bp, Artificial Sequence
  Description of Artificial Sequence: Synthetic oligonucleotide
  Target: ATXN1; (+) strand; PAM type: NRG; PAM sequence: AAG
tacagtttatttaaagatat

SEQ ID NO: 145992 - DNA, 20 bp, Artificial Sequence
  Description of Artificial Sequence: Synthetic oligonucleotide
  Target: ATXN1; (+) strand; PAM type: NRG; PAM sequence: AGG
acagtttatttaaagatata

SEQ ID NO: 145993 - DNA, 20 bp, Artificial Sequence
  Description of Artificial Sequence: Synthetic oligonucleotide
  Target: ATXN1; (+) strand; PAM type: NRG; PAM sequence: AAG
tttatttaaagatataagga

SEQ ID NO: 145994 - DNA, 20 bp, Artificial Sequence
  Description of Artificial Sequence: Synthetic oligonucleotide
  Target: ATXN1; (+) strand; PAM type: NRG; PAM sequence: AAG
ggaaagtccatcaaataaac

SEQ ID NO: 145995 - DNA, 20 bp, Artificial Sequence
  Description of Artificial Sequence: Synthetic oligonucleotide
  Target: ATXN1; (+) strand; PAM type: NRG; PAM sequence: GAG
ataaacaagaaatatttact

SEQ ID NO: 145996 - DNA, 20 bp, Artificial Sequence
  Description of Artificial Sequence: Synthetic oligonucleotide
  Target: ATXN1; (+) strand; PAM type: NRG; PAM sequence: TGG
tttactgagaacctcctttg

SEQ ID NO: 145997 - DNA, 20 bp, Artificial Sequence
  Description of Artificial Sequence: Synthetic oligonucleotide
  Target: ATXN1; (+) strand; PAM type: NRG; PAM sequence: CAG
ctgagaacctcctttgtggc

SEQ ID NO: 145998 - DNA, 20 bp, Artificial Sequence
  Description of Artificial Sequence: Synthetic oligonucleotide
  Target: ATXN1; (+) strand; PAM type: NRG; PAM sequence: AGG
tgagaacctcctttgtggcc

SEQ ID NO: 145999 - DNA, 20 bp, Artificial Sequence
  Description of Artificial Sequence: Synthetic oligonucleotide
  Target: ATXN1; (+) strand; PAM type: NRG; PAM sequence: AAG
ccaggattatgtttctatct

SEQ ID NO: 146000 - DNA, 20 bp, Artificial Sequence
  Description of Artificial Sequence: Synthetic oligonucleotide
  Target: ATXN1; (+) strand; PAM type: NRG; PAM sequence: TGG
ctatctaagtcccatgaact

SEQ ID NO: 146001 - DNA, 20 bp, Artificial Sequence
  Description of Artificial Sequence: Synthetic oligonucleotide
  Target: ATXN1; (+) strand; PAM type: NRG; PAM sequence: GAG
atctaagtcccatgaacttg

SEQ ID NO: 146002 - DNA, 20 bp, Artificial Sequence
  Description of Artificial Sequence: Synthetic oligonucleotide
  Target: ATXN1; (+) strand; PAM type: NRG; PAM sequence: AAG
caaaattatttaactttata

SEQ ID NO: 146003 - DNA, 20 bp, Artificial Sequence
  Description of Artificial Sequence: Synthetic oligonucleotide
  Target: ATXN1; (+) strand; PAM type: NRG; PAM sequence: CAG
aagtatttcaatgaataatg

SEQ ID NO: 146004 - DNA, 20 bp, Artificial Sequence
  Description of Artificial Sequence: Synthetic oligonucleotide
  Target: ATXN1; (+) strand; PAM type: NRG; PAM sequence: TGG
gcagtcttccaaaatgtgca

SEQ ID NO: 146005 - DNA, 20 bp, Artificial Sequence
  Description of Artificial Sequence: Synthetic oligonucleotide
  Target: ATXN1; (+) strand; PAM type: NRG; PAM sequence: GGG
cagtcttccaaaatgtgcat

SEQ ID NO: 146006 - DNA, 20 bp, Artificial Sequence
  Description of Artificial Sequence: Synthetic oligonucleotide
  Target: ATXN1; (+) strand; PAM type: NRG; PAM sequence: GGG
agtcttccaaaatgtgcatg

SEQ ID NO: 146007 - DNA, 20 bp, Artificial Sequence
  Description of Artificial Sequence: Synthetic oligonucleotide
  Target: ATXN1; (+) strand; PAM type: NRG; PAM sequence: TAG
catggggctgtaattccatc

SEQ ID NO: 146008 - DNA, 20 bp, Artificial Sequence
  Description of Artificial Sequence: Synthetic oligonucleotide
  Target: ATXN1; (+) strand; PAM type: NRG; PAM sequence: AAG
agtgtttacaatgacactat

SEQ ID NO: 146009 - DNA, 20 bp, Artificial Sequence
  Description of Artificial Sequence: Synthetic oligonucleotide
  Target: ATXN1; (+) strand; PAM type: NRG; PAM sequence: TGG
tacaatgacactataagcct

SEQ ID NO: 146010 - DNA, 20 bp, Artificial Sequence
  Description of Artificial Sequence: Synthetic oligonucleotide
  Target: ATXN1; (+) strand; PAM type: NRG; PAM sequence: TGG
atgacactataagccttgga

SEQ ID NO: 146011 - DNA, 20 bp, Artificial Sequence
  Description of Artificial Sequence: Synthetic oligonucleotide
  Target: ATXN1; (+) strand; PAM type: NRG; PAM sequence: TGG
ggatggaattacaatcttaa

SEQ ID NO: 146012 - DNA, 20 bp, Artificial Sequence
  Description of Artificial Sequence: Synthetic oligonucleotide
  Target: ATXN1; (+) strand; PAM type: NRG; PAM sequence: GGG
gatggaattacaatcttaat

SEQ ID NO: 146013 - DNA, 20 bp, Artificial Sequence
  Description of Artificial Sequence: Synthetic oligonucleotide
  Target: ATXN1; (+) strand; PAM type: NRG; PAM sequence: CAG
acaatcttaatgggaacaat

SEQ ID NO: 146014 - DNA, 20 bp, Artificial Sequence
  Description of Artificial Sequence: Synthetic oligonucleotide
  Target: ATXN1; (+) strand; PAM type: NRG; PAM sequence: GAG
aatcttaatgggaacaatca

SEQ ID NO: 146015 - DNA, 20 bp, Artificial Sequence
  Description of Artificial Sequence: Synthetic oligonucleotide
  Target: ATXN1; (+) strand; PAM type: NRG; PAM sequence: CAG
agtgcactactccatatgct

SEQ ID NO: 146016 - DNA, 20 bp, Artificial Sequence
  Description of Artificial Sequence: Synthetic oligonucleotide
  Target: ATXN1; (+) strand; PAM type: NRG; PAM sequence: GAG
tgcactactccatatgctca

SEQ ID NO: 146017 - DNA, 20 bp, Artificial Sequence
  Description of Artificial Sequence: Synthetic oligonucleotide
  Target: ATXN1; (+) strand; PAM type: NRG; PAM sequence: CAG
ctccatatgctcagagaatt

SEQ ID NO: 146018 - DNA, 20 bp, Artificial Sequence
  Description of Artificial Sequence: Synthetic oligonucleotide
  Target: ATXN1; (+) strand; PAM type: NRG; PAM sequence: AGG
tccatatgctcagagaattc

SEQ ID NO: 146019 - DNA, 20 bp, Artificial Sequence
  Description of Artificial Sequence: Synthetic oligonucleotide
  Target: ATXN1; (+) strand; PAM type: NRG; PAM sequence: AAG
aactcaacttctaaaataaa

SEQ ID NO: 146020 - DNA, 20 bp, Artificial Sequence
  Description of Artificial Sequence: Synthetic oligonucleotide
  Target: ATXN1; (+) strand; PAM type: NRG; PAM sequence: AAG
cttctaaaataaaaagcacc

SEQ ID NO: 146021 - DNA, 20 bp, Artificial Sequence
  Description of Artificial Sequence: Synthetic oligonucleotide
  Target: ATXN1; (+) strand; PAM type: NRG; PAM sequence: TGG
aataaaaagcaccaagccat

SEQ ID NO: 146022 - DNA, 20 bp, Artificial Sequence
  Description of Artificial Sequence: Synthetic oligonucleotide
  Target: ATXN1; (+) strand; PAM type: NRG; PAM sequence: CAG
cattggcatgtaattacaac

SEQ ID NO: 146023 - DNA, 20 bp, Artificial Sequence
  Description of Artificial Sequence: Synthetic oligonucleotide
  Target: ATXN1; (+) strand; PAM type: NRG; PAM sequence: AGG
attggcatgtaattacaacc

SEQ ID NO: 146024 - DNA, 20 bp, Artificial Sequence
  Description of Artificial Sequence: Synthetic oligonucleotide
  Target: ATXN1; (+) strand; PAM type: NRG; PAM sequence: GAG
tggcatgtaattacaaccag

SEQ ID NO: 146025 - DNA, 20 bp, Artificial Sequence
  Description of Artificial Sequence: Synthetic oligonucleotide
  Target: ATXN1; (+) strand; PAM type: NRG; PAM sequence: AGG
ggcatgtaattacaaccagg

SEQ ID NO: 146026 - DNA, 20 bp, Artificial Sequence
  Description of Artificial Sequence: Synthetic oligonucleotide
  Target: ATXN1; (+) strand; PAM type: NRG; PAM sequence: AAG
gtaattacaaccaggaggcc

SEQ ID NO: 146027 - DNA, 20 bp, Artificial Sequence
  Description of Artificial Sequence: Synthetic oligonucleotide
  Target: ATXN1; (+) strand; PAM type: NRG; PAM sequence: TAG
aggccaagctgtctgcttgc

SEQ ID NO: 146028 - DNA, 20 bp, Artificial Sequence
  Description of Artificial Sequence: Synthetic oligonucleotide
  Target: ATXN1; (+) strand; PAM type: NRG; PAM sequence: GAG
ctgtctgcttgctagtatat

SEQ ID NO: 146029 - DNA, 20 bp, Artificial Sequence
  Description of Artificial Sequence: Synthetic oligonucleotide
  Target: ATXN1; (+) strand; PAM type: NRG; PAM sequence: AAG
tatgagaaatgctcaattga

SEQ ID NO: 146030 - DNA, 20 bp, Artificial Sequence
  Description of Artificial Sequence: Synthetic oligonucleotide
  Target: ATXN1; (+) strand; PAM type: NRG; PAM sequence: TAG
agtaccatctcaccttattg

SEQ ID NO: 146031 - DNA, 20 bp, Artificial Sequence
  Description of Artificial Sequence: Synthetic oligonucleotide
  Target: ATXN1; (+) strand; PAM type: NRG; PAM sequence: GAG
aaactttcgactttcgtgat

SEQ ID NO: 146032 - DNA, 20 bp, Artificial Sequence
  Description of Artificial Sequence: Synthetic oligonucleotide
  Target: ATXN1; (+) strand; PAM type: NRG; PAM sequence: AAG
cgtgatgagaaaatttccac

SEQ ID NO: 146033 - DNA, 20 bp, Artificial Sequence
  Description of Artificial Sequence: Synthetic oligonucleotide
  Target: ATXN1; (+) strand; PAM type: NRG; PAM sequence: AGG
gtgatgagaaaatttccaca

SEQ ID NO: 146034 - DNA, 20 bp, Artificial Sequence
  Description of Artificial Sequence: Synthetic oligonucleotide
  Target: ATXN1; (+) strand; PAM type: NRG; PAM sequence: GGG
tgatgagaaaatttccacaa

SEQ ID NO: 146035 - DNA, 20 bp, Artificial Sequence
  Description of Artificial Sequence: Synthetic oligonucleotide
  Target: ATXN1; (+) strand; PAM type: NRG; PAM sequence: TAG
ttccacaagggtctaccaca

SEQ ID NO: 146036 - DNA, 20 bp, Artificial Sequence
  Description of Artificial Sequence: Synthetic oligonucleotide
  Target: ATXN1; (+) strand; PAM type: NRG; PAM sequence: GAG
ccacaagggtctaccacata

SEQ ID NO: 146037 - DNA, 20 bp, Artificial Sequence
  Description of Artificial Sequence: Synthetic oligonucleotide
  Target: ATXN1; (+) strand; PAM type: NRG; PAM sequence: AGG
cacaagggtctaccacatag

SEQ ID NO: 146038 - DNA, 20 bp, Artificial Sequence
  Description of Artificial Sequence: Synthetic oligonucleotide
  Target: ATXN1; (+) strand; PAM type: NRG; PAM sequence: CGG
cacatagaggtgatatatat

SEQ ID NO: 146039 - DNA, 20 bp, Artificial Sequence
  Description of Artificial Sequence: Synthetic oligonucleotide
  Target: ATXN1; (+) strand; PAM type: NRG; PAM sequence: GGG
acatagaggtgatatatatc

SEQ ID NO: 146040 - DNA, 20 bp, Artificial Sequence
  Description of Artificial Sequence: Synthetic oligonucleotide
  Target: ATXN1; (+) strand; PAM type: NRG; PAM sequence: AAG
gatatatatcgggtgatgac

SEQ ID NO: 146041 - DNA, 20 bp, Artificial Sequence
  Description of Artificial Sequence: Synthetic oligonucleotide
  Target: ATXN1; (+) strand; PAM type: NRG; PAM sequence: TGG
cgggtgatgacaagattgtc

SEQ ID NO: 146042 - DNA, 20 bp, Artificial Sequence
  Description of Artificial Sequence: Synthetic oligonucleotide
  Target: ATXN1; (+) strand; PAM type: NRG; PAM sequence: AAG
ggatgctaccaataaaatct

SEQ ID NO: 146043 - DNA, 20 bp, Artificial Sequence
  Description of Artificial Sequence: Synthetic oligonucleotide
  Target: ATXN1; (+) strand; PAM type: NRG; PAM sequence: AAG
acctaaacttaaactctgaa

SEQ ID NO: 146044 - DNA, 20 bp, Artificial Sequence
  Description of Artificial Sequence: Synthetic oligonucleotide
  Target: ATXN1; (+) strand; PAM type: NRG; PAM sequence: AAG
tctgaaaagtacaatgtatt

SEQ ID NO: 146045 - DNA, 20 bp, Artificial Sequence
  Description of Artificial Sequence: Synthetic oligonucleotide
  Target: ATXN1; (+) strand; PAM type: NRG; PAM sequence: CAG
aagtacaatgtattaagaaa

SEQ ID NO: 146046 - DNA, 20 bp, Artificial Sequence
  Description of Artificial Sequence: Synthetic oligonucleotide
  Target: ATXN1; (+) strand; PAM type: NRG; PAM sequence: AGG
agtacaatgtattaagaaac

SEQ ID NO: 146047 - DNA, 20 bp, Artificial Sequence
  Description of Artificial Sequence: Synthetic oligonucleotide
  Target: ATXN1; (+) strand; PAM type: NRG; PAM sequence: AAG
caggaaaaaaaatcatgctc

SEQ ID NO: 146048 - DNA, 20 bp, Artificial Sequence
  Description of Artificial Sequence: Synthetic oligonucleotide
  Target: ATXN1; (+) strand; PAM type: NRG; PAM sequence: GAG
ggaaaaaaaatcatgctcaa

SEQ ID NO: 146049 - DNA, 20 bp, Artificial Sequence
  Description of Artificial Sequence: Synthetic oligonucleotide
  Target: ATXN1; (+) strand; PAM type: NRG; PAM sequence: TGG
caagagccctttgaaattac

SEQ ID NO: 146050 - DNA, 20 bp, Artificial Sequence
  Description of Artificial Sequence: Synthetic oligonucleotide
  Target: ATXN1; (+) strand; PAM type: NRG; PAM sequence: TGG
ctggcatttcttctaatttt

SEQ ID NO: 146051 - DNA, 20 bp, Artificial Sequence
  Description of Artificial Sequence: Synthetic oligonucleotide
  Target: ATXN1; (+) strand; PAM type: NRG; PAM sequence: GGG
tggcatttcttctaattttt

SEQ ID NO: 146052 - DNA, 20 bp, Artificial Sequence
  Description of Artificial Sequence: Synthetic oligonucleotide
  Target: ATXN1; (+) strand; PAM type: NRG; PAM sequence: GGG
ggcatttcttctaatttttg

SEQ ID NO: 146053 - DNA, 20 bp, Artificial Sequence
  Description of Artificial Sequence: Synthetic oligonucleotide
  Target: ATXN1; (+) strand; PAM type: NRG; PAM sequence: GGG
gcatttcttctaatttttgg

SEQ ID NO: 146054 - DNA, 20 bp, Artificial Sequence
  Description of Artificial Sequence: Synthetic oligonucleotide
  Target: ATXN1; (+) strand; PAM type: NRG; PAM sequence: TAG
ttcttctaatttttgggggc

SEQ ID NO: 146055 - DNA, 20 bp, Artificial Sequence
  Description of Artificial Sequence: Synthetic oligonucleotide
  Target: ATXN1; (+) strand; PAM type: NRG; PAM sequence: TAG
ggggctagtctgacatttat

SEQ ID NO: 146056 - DNA, 20 bp, Artificial Sequence
  Description of Artificial Sequence: Synthetic oligonucleotide
  Target: ATXN1; (+) strand; PAM type: NRG; PAM sequence: AAG
gacatttattagcataaaca

SEQ ID NO: 146057 - DNA, 20 bp, Artificial Sequence
  Description of Artificial Sequence: Synthetic oligonucleotide
  Target: ATXN1; (+) strand; PAM type: NRG; PAM sequence: AAG
ttattagcataaacaaagca

SEQ ID NO: 146058 - DNA, 20 bp, Artificial Sequence
  Description of Artificial Sequence: Synthetic oligonucleotide
  Target: ATXN1; (+) strand; PAM type: NRG; PAM sequence: AAG
gcaaagtgccttgtgtccgc

SEQ ID NO: 146059 - DNA, 20 bp, Artificial Sequence
  Description of Artificial Sequence: Synthetic oligonucleotide
  Target: ATXN1; (+) strand; PAM type: NRG; PAM sequence: GAG
aaagtgccttgtgtccgcaa

SEQ ID NO: 146060 - DNA, 20 bp, Artificial Sequence
  Description of Artificial Sequence: Synthetic oligonucleotide
  Target: ATXN1; (+) strand; PAM type: NRG; PAM sequence: AGG
aagtgccttgtgtccgcaag

SEQ ID NO: 146061 - DNA, 20 bp, Artificial Sequence
  Description of Artificial Sequence: Synthetic oligonucleotide
  Target: ATXN1; (+) strand; PAM type: NRG; PAM sequence: GGG
agtgccttgtgtccgcaaga

SEQ ID NO: 146062 - DNA, 20 bp, Artificial Sequence
  Description of Artificial Sequence: Synthetic oligonucleotide
  Target: ATXN1; (+) strand; PAM type: NRG; PAM sequence: TAG
agagggaaaaaaaaaaactt

SEQ ID NO: 146063 - DNA, 20 bp, Artificial Sequence
  Description of Artificial Sequence: Synthetic oligonucleotide
  Target: ATXN1; (+) strand; PAM type: NRG; PAM sequence: GAG
agggaaaaaaaaaaacttta

SEQ ID NO: 146064 - DNA, 20 bp, Artificial Sequence
  Description of Artificial Sequence: Synthetic oligonucleotide
  Target: ATXN1; (+) strand; PAM type: NRG; PAM sequence: GAG
ggaaaaaaaaaaactttaga

SEQ ID NO: 146065 - DNA, 20 bp, Artificial Sequence
  Description of Artificial Sequence: Synthetic oligonucleotide
  Target: ATXN1; (+) strand; PAM type: NRG; PAM sequence: CAG
aactttagagagattaaact

SEQ ID NO: 146066 - DNA, 20 bp, Artificial Sequence
  Description of Artificial Sequence: Synthetic oligonucleotide
  Target: ATXN1; (+) strand; PAM type: NRG; PAM sequence: GAG
ctttagagagattaaactca

SEQ ID NO: 146067 - DNA, 20 bp, Artificial Sequence
  Description of Artificial Sequence: Synthetic oligonucleotide
  Target: ATXN1; (+) strand; PAM type: NRG; PAM sequence: TAG
agagattaaactcagagttg

SEQ ID NO: 146068 - DNA, 20 bp, Artificial Sequence
  Description of Artificial Sequence: Synthetic oligonucleotide
  Target: ATXN1; (+) strand; PAM type: NRG; PAM sequence: AAG
taaactcagagttgtagaaa

SEQ ID NO: 146069 - DNA, 20 bp, Artificial Sequence
  Description of Artificial Sequence: Synthetic oligonucleotide
  Target: ATXN1; (+) strand; PAM type: NRG; PAM sequence: TAG
tcagagttgtagaaaaagtt

SEQ ID NO: 146070 - DNA, 20 bp, Artificial Sequence
  Description of Artificial Sequence: Synthetic oligonucleotide
  Target: ATXN1; (+) strand; PAM type: NRG; PAM sequence: CGG
ttgtagaaaaagtttagaaa

SEQ ID NO: 146071 - DNA, 20 bp, Artificial Sequence
  Description of Artificial Sequence: Synthetic oligonucleotide
  Target: ATXN1; (+) strand; PAM type: NRG; PAM sequence: TAG
aaaaagtttagaaacggatt

SEQ ID NO: 146072 - DNA, 20 bp, Artificial Sequence
  Description of Artificial Sequence: Synthetic oligonucleotide
  Target: ATXN1; (+) strand; PAM type: NRG; PAM sequence: CAG
gaaacggatttagaatttcg

SEQ ID NO: 146073 - DNA, 20 bp, Artificial Sequence
  Description of Artificial Sequence: Synthetic oligonucleotide
  Target: ATXN1; (+) strand; PAM type: NRG; PAM sequence: AGG
aaacggatttagaatttcgc

SEQ ID NO: 146074 - DNA, 20 bp, Artificial Sequence
  Description of Artificial Sequence: Synthetic oligonucleotide
  Target: ATXN1; (+) strand; PAM type: NRG; PAM sequence: AAG
atttagaatttcgcaggaaa

SEQ ID NO: 146075 - DNA, 20 bp, Artificial Sequence
  Description of Artificial Sequence: Synthetic oligonucleotide
  Target: ATXN1; (+) strand; PAM type: NRG; PAM sequence: AAG
gaatttcgcaggaaaaagaa

SEQ ID NO: 146076 - DNA, 20 bp, Artificial Sequence
  Description of Artificial Sequence: Synthetic oligonucleotide
  Target: ATXN1; (+) strand; PAM type: NRG; PAM sequence: CAG
ttcgcaggaaaaagaaaaga

SEQ ID NO: 146077 - DNA, 20 bp, Artificial Sequence
  Description of Artificial Sequence: Synthetic oligonucleotide
  Target: ATXN1; (+) strand; PAM type: NRG; PAM sequence: CAG
aagacagtgacactatgaat

SEQ ID NO: 146078 - DNA, 20 bp, Artificial Sequence
  Description of Artificial Sequence: Synthetic oligonucleotide
  Target: ATXN1; (+) strand; PAM type: NRG; PAM sequence: AAG
atgaatcagcattttcgtat

SEQ ID NO: 146079 - DNA, 20 bp, Artificial Sequence
  Description of Artificial Sequence: Synthetic oligonucleotide
  Target: ATXN1; (+) strand; PAM type: NRG; PAM sequence: CAG
aatcagcattttcgtataag

SEQ ID NO: 146080 - DNA, 20 bp, Artificial Sequence
  Description of Artificial Sequence: Synthetic oligonucleotide
  Target: ATXN1; (+) strand; PAM type: NRG; PAM sequence: TGG
gcattttcgtataagcagcc

SEQ ID NO: 146081 - DNA, 20 bp, Artificial Sequence
  Description of Artificial Sequence: Synthetic oligonucleotide
  Target: ATXN1; (+) strand; PAM type: NRG; PAM sequence: AAG
gtataagcagcctggaatca

SEQ ID NO: 146082 - DNA, 20 bp, Artificial Sequence
  Description of Artificial Sequence: Synthetic oligonucleotide
  Target: ATXN1; (+) strand; PAM type: NRG; PAM sequence: AAG
taagcagcctggaatcaaag

SEQ ID NO: 146083 - DNA, 20 bp, Artificial Sequence
  Description of Artificial Sequence: Synthetic oligonucleotide
  Target: ATXN1; (+) strand; PAM type: NRG; PAM sequence: CGG
cacacacacacacacacaca

SEQ ID NO: 146084 - DNA, 20 bp, Artificial Sequence
  Description of Artificial Sequence: Synthetic oligonucleotide
  Target: ATXN1; (+) strand; PAM type: NRG; PAM sequence: GAG
cacacacacacacacacacg

SEQ ID NO: 146085 - DNA, 20 bp, Artificial Sequence
  Description of Artificial Sequence: Synthetic oligonucleotide
  Target: ATXN1; (+) strand; PAM type: NRG; PAM sequence: AGG
acacacacacacacacacgg

SEQ ID NO: 146086 - DNA, 20 bp, Artificial Sequence
  Description of Artificial Sequence: Synthetic oligonucleotide
  Target: ATXN1; (+) strand; PAM type: NRG; PAM sequence: CAG
acacacacacacggaggata

SEQ ID NO: 146087 - DNA, 20 bp, Artificial Sequence
  Description of Artificial Sequence: Synthetic oligonucleotide
  Target: ATXN1; (+) strand; PAM type: NRG; PAM sequence: AAG
acggaggatacagcaccgtg

SEQ ID NO: 146088 - DNA, 20 bp, Artificial Sequence
  Description of Artificial Sequence: Synthetic oligonucleotide
  Target: ATXN1; (+) strand; PAM type: NRG; PAM sequence: AAG
atacagcaccgtgaagaatg

SEQ ID NO: 146089 - DNA, 20 bp, Artificial Sequence
  Description of Artificial Sequence: Synthetic oligonucleotide
  Target: ATXN1; (+) strand; PAM type: NRG; PAM sequence: TAG
gacacaaatgcatacaaatt

SEQ ID NO: 146090 - DNA, 20 bp, Artificial Sequence
  Description of Artificial Sequence: Synthetic oligonucleotide
  Target: ATXN1; (+) strand; PAM type: NRG; PAM sequence: TAG
ttagtctgtatatttatatt

SEQ ID NO: 146091 - DNA, 20 bp, Artificial Sequence
  Description of Artificial Sequence: Synthetic oligonucleotide
  Target: ATXN1; (+) strand; PAM type: NRG; PAM sequence: TGG
atttatatttagaatacaaa

SEQ ID NO: 146092 - DNA, 20 bp, Artificial Sequence
  Description of Artificial Sequence: Synthetic oligonucleotide
  Target: ATXN1; (+) strand; PAM type: NRG; PAM sequence: CGG
tagaatacaaatggcttcta

SEQ ID NO: 146093 - DNA, 20 bp, Artificial Sequence
  Description of Artificial Sequence: Synthetic oligonucleotide
  Target: ATXN1; (+) strand; PAM type: NRG; PAM sequence: TGG
ttatcatacctaactttatc

SEQ ID NO: 146094 - DNA, 20 bp, Artificial Sequence
  Description of Artificial Sequence: Synthetic oligonucleotide
  Target: ATXN1; (+) strand; PAM type: NRG; PAM sequence: TAG
ctaactttatctggtactca

SEQ ID NO: 146095 - DNA, 20 bp, Artificial Sequence
  Description of Artificial Sequence: Synthetic oligonucleotide
  Target: ATXN1; (+) strand; PAM type: NRG; PAM sequence: GAG
aactttatctggtactcata

SEQ ID NO: 146096 - DNA, 20 bp, Artificial Sequence
  Description of Artificial Sequence: Synthetic oligonucleotide
  Target: ATXN1; (+) strand; PAM type: NRG; PAM sequence: AGG
actttatctggtactcatag

SEQ ID NO: 146097 - DNA, 20 bp, Artificial Sequence
  Description of Artificial Sequence: Synthetic oligonucleotide
  Target: ATXN1; (+) strand; PAM type: NRG; PAM sequence: AAG
ggtactcatagaggtcacca

SEQ ID NO: 146098 - DNA, 20 bp, Artificial Sequence
  Description of Artificial Sequence: Synthetic oligonucleotide
  Target: ATXN1; (+) strand; PAM type: NRG; PAM sequence: TAG
accaaagctgtataaaatca

SEQ ID NO: 146099 - DNA, 20 bp, Artificial Sequence
  Description of Artificial Sequence: Synthetic oligonucleotide
  Target: ATXN1; (+) strand; PAM type: NRG; PAM sequence: CAG
ctgtataaaatcatagcaac

SEQ ID NO: 146100 - DNA, 20 bp, Artificial Sequence
  Description of Artificial Sequence: Synthetic oligonucleotide
  Target: ATXN1; (+) strand; PAM type: NRG; PAM sequence: AAG
tcatagcaaccagaaaacta

SEQ ID NO: 146101 - DNA, 20 bp, Artificial Sequence
  Description of Artificial Sequence: Synthetic oligonucleotide
  Target: ATXN1; (+) strand; PAM type: NRG; PAM sequence: AGG
catagcaaccagaaaactaa

SEQ ID NO: 146102 - DNA, 20 bp, Artificial Sequence
  Description of Artificial Sequence: Synthetic oligonucleotide
  Target: ATXN1; (+) strand; PAM type: NRG; PAM sequence: TGG
ctaaaggaaacaaacacctc

SEQ ID NO: 146103 - DNA, 20 bp, Artificial Sequence
  Description of Artificial Sequence: Synthetic oligonucleotide
  Target: ATXN1; (+) strand; PAM type: NRG; PAM sequence: CAG
aaggaaacaaacacctctgg

SEQ ID NO: 146104 - DNA, 20 bp, Artificial Sequence
  Description of Artificial Sequence: Synthetic oligonucleotide
  Target: ATXN1; (+) strand; PAM type: NRG; PAM sequence: AAG
gcagaaatcctcaccaaaca

SEQ ID NO: 146105 - DNA, 20 bp, Artificial Sequence
  Description of Artificial Sequence: Synthetic oligonucleotide
  Target: ATXN1; (+) strand; PAM type: NRG; PAM sequence: AAG
atcctcaccaaacaaagtat

SEQ ID NO: 146106 - DNA, 20 bp, Artificial Sequence
  Description of Artificial Sequence: Synthetic oligonucleotide
  Target: ATXN1; (+) strand; PAM type: NRG; PAM sequence: AGG
tcctcaccaaacaaagtata

SEQ ID NO: 146107 - DNA, 20 bp, Artificial Sequence
  Description of Artificial Sequence: Synthetic oligonucleotide
  Target: ATXN1; (+) strand; PAM type: NRG; PAM sequence: AAG
caaacaaagtataaggcata

SEQ ID NO: 146108 - DNA, 20 bp, Artificial Sequence
  Description of Artificial Sequence: Synthetic oligonucleotide
  Target: ATXN1; (+) strand; PAM type: NRG; PAM sequence: TGG
taaagaaactatactttcat

SEQ ID NO: 146109 - DNA, 20 bp, Artificial Sequence
  Description of Artificial Sequence: Synthetic oligonucleotide
  Target: ATXN1; (+) strand; PAM type: NRG; PAM sequence: TAG
ttcattggccacttttaaca

SEQ ID NO: 146110 - DNA, 20 bp, Artificial Sequence
  Description of Artificial Sequence: Synthetic oligonucleotide
  Target: ATXN1; (+) strand; PAM type: NRG; PAM sequence: AAG
tagccatgcttctacctgtg

SEQ ID NO: 146111 - DNA, 20 bp, Artificial Sequence
  Description of Artificial Sequence: Synthetic oligonucleotide
  Target: ATXN1; (+) strand; PAM type: NRG; PAM sequence: AGG
agccatgcttctacctgtga

SEQ ID NO: 146112 - DNA, 20 bp, Artificial Sequence
  Description of Artificial Sequence: Synthetic oligonucleotide
  Target: ATXN1; (+) strand; PAM type: NRG; PAM sequence: TGG
tgcttctacctgtgaaggta

SEQ ID NO: 146113 - DNA, 20 bp, Artificial Sequence
  Description of Artificial Sequence: Synthetic oligonucleotide
  Target: ATXN1; (+) strand; PAM type: NRG; PAM sequence: GGG
gcttctacctgtgaaggtat

SEQ ID NO: 146114 - DNA, 20 bp, Artificial Sequence
  Description of Artificial Sequence: Synthetic oligonucleotide
  Target: ATXN1; (+) strand; PAM type: NRG; PAM sequence: GAG
gggacaattccatgaaaact

SEQ ID NO: 146115 - DNA, 20 bp, Artificial Sequence
  Description of Artificial Sequence: Synthetic oligonucleotide
  Target: ATXN1; (+) strand; PAM type: NRG; PAM sequence: CGG
ttccatgaaaactgagttca

SEQ ID NO: 146116 - DNA, 20 bp, Artificial Sequence
  Description of Artificial Sequence: Synthetic oligonucleotide
  Target: ATXN1; (+) strand; PAM type: NRG; PAM sequence: GAG
ccatgaaaactgagttcacg

SEQ ID NO: 146117 - DNA, 20 bp, Artificial Sequence
  Description of Artificial Sequence: Synthetic oligonucleotide
  Target: ATXN1; (+) strand; PAM type: NRG; PAM sequence: AGG
catgaaaactgagttcacgg

SEQ ID NO: 146118 - DNA, 20 bp, Artificial Sequence
  Description of Artificial Sequence: Synthetic oligonucleotide
  Target: ATXN1; (+) strand; PAM type: NRG; PAM sequence: GGG
atgaaaactgagttcacgga

SEQ ID NO: 146119 - DNA, 20 bp, Artificial Sequence
  Description of Artificial Sequence: Synthetic oligonucleotide
  Target: ATXN1; (+) strand; PAM type: NRG; PAM sequence: TGG
gttcacggagggccctcctg

SEQ ID NO: 146120 - DNA, 20 bp, Artificial Sequence
  Description of Artificial Sequence: Synthetic oligonucleotide
  Target: ATXN1; (+) strand; PAM type: NRG; PAM sequence: GGG
ttcacggagggccctcctgt

SEQ ID NO: 146121 - DNA, 20 bp, Artificial Sequence
  Description of Artificial Sequence: Synthetic oligonucleotide
  Target: ATXN1; (+) strand; PAM type: NRG; PAM sequence: TGG
ctcctgtgggttatgtatcc

SEQ ID NO: 146122 - DNA, 20 bp, Artificial Sequence
  Description of Artificial Sequence: Synthetic oligonucleotide
  Target: ATXN1; (+) strand; PAM type: NRG; PAM sequence: GGG
tcctgtgggttatgtatcct

SEQ ID NO: 146123 - DNA, 20 bp, Artificial Sequence
  Description of Artificial Sequence: Synthetic oligonucleotide
  Target: ATXN1; (+) strand; PAM type: NRG; PAM sequence: CAG
gggttatgtatcctgggttc

SEQ ID NO: 146124 - DNA, 20 bp, Artificial Sequence
  Description of Artificial Sequence: Synthetic oligonucleotide
  Target: ATXN1; (+) strand; PAM type: NRG; PAM sequence: TGG
ctgggttccagcataacccc

SEQ ID NO: 146125 - DNA, 20 bp, Artificial Sequence
  Description of Artificial Sequence: Synthetic oligonucleotide
  Target: ATXN1; (+) strand; PAM type: NRG; PAM sequence: GAG
ttccagcataacccctggtt

SEQ ID NO: 146126 - DNA, 20 bp, Artificial Sequence
  Description of Artificial Sequence: Synthetic oligonucleotide
  Target: ATXN1; (+) strand; PAM type: NRG; PAM sequence: TAG
tgagaacttactattaacat

SEQ ID NO: 146127 - DNA, 20 bp, Artificial Sequence
  Description of Artificial Sequence: Synthetic oligonucleotide
  Target: ATXN1; (+) strand; PAM type: NRG; PAM sequence: CAG
ttcaatttattttcatgatc

SEQ ID NO: 146128 - DNA, 20 bp, Artificial Sequence
  Description of Artificial Sequence: Synthetic oligonucleotide
  Target: ATXN1; (+) strand; PAM type: NRG; PAM sequence: AGG
tcaatttattttcatgatcc

SEQ ID NO: 146129 - DNA, 20 bp, Artificial Sequence
  Description of Artificial Sequence: Synthetic oligonucleotide
  Target: ATXN1; (+) strand; PAM type: NRG; PAM sequence: GGG
caatttattttcatgatcca

SEQ ID NO: 146130 - DNA, 20 bp, Artificial Sequence
  Description of Artificial Sequence: Synthetic oligonucleotide
  Target: ATXN1; (+) strand; PAM type: NRG; PAM sequence: CAG
gacttgtgtatattgtatca

SEQ ID NO: 146131 - DNA, 20 bp, Artificial Sequence
  Description of Artificial Sequence: Synthetic oligonucleotide
  Target: ATXN1; (+) strand; PAM type: NRG; PAM sequence: TGG
ttgtgtatattgtatcacag

SEQ ID NO: 146132 - DNA, 20 bp, Artificial Sequence
  Description of Artificial Sequence: Synthetic oligonucleotide
  Target: ATXN1; (+) strand; PAM type: NRG; PAM sequence: AAG
cagtggttacctaaaataaa

SEQ ID NO: 146133 - DNA, 20 bp, Artificial Sequence
  Description of Artificial Sequence: Synthetic oligonucleotide
  Target: ATXN1; (+) strand; PAM type: NRG; PAM sequence: CAG
tacctaaaataaaaagtaac

SEQ ID NO: 146134 - DNA, 20 bp, Artificial Sequence
  Description of Artificial Sequence: Synthetic oligonucleotide
  Target: ATXN1; (+) strand; PAM type: NRG; PAM sequence: TAG
taaaataaaaagtaaccaga

SEQ ID NO: 146135 - DNA, 20 bp, Artificial Sequence
  Description of Artificial Sequence: Synthetic oligonucleotide
  Target: ATXN1; (+) strand; PAM type: NRG; PAM sequence: AGG
aaaataaaaagtaaccagat

SEQ ID NO: 146136 - DNA, 20 bp, Artificial Sequence
  Description of Artificial Sequence: Synthetic oligonucleotide
  Target: ATXN1; (+) strand; PAM type: NRG; PAM sequence: GAG
aataaaaagtaaccagatag

SEQ ID NO: 146137 - DNA, 20 bp, Artificial Sequence
  Description of Artificial Sequence: Synthetic oligonucleotide
  Target: ATXN1; (+) strand; PAM type: NRG; PAM sequence: CAG
aaaagtaaccagataggaga

SEQ ID NO: 146138 - DNA, 20 bp, Artificial Sequence
  Description of Artificial Sequence: Synthetic oligonucleotide
  Target: ATXN1; (+) strand; PAM type: NRG; PAM sequence: GAG
caatattgatgaatttccat

SEQ ID NO: 146139 - DNA, 20 bp, Artificial Sequence
  Description of Artificial Sequence: Synthetic oligonucleotide
  Target: ATXN1; (+) strand; PAM type: NRG; PAM sequence: GAG
tgatgaatttccatgagaat

SEQ ID NO: 146140 - DNA, 20 bp, Artificial Sequence
  Description of Artificial Sequence: Synthetic oligonucleotide
  Target: ATXN1; (+) strand; PAM type: NRG; PAM sequence: TAG
tgagaatgagacatatcatt

SEQ ID NO: 146141 - DNA, 20 bp, Artificial Sequence
  Description of Artificial Sequence: Synthetic oligonucleotide
  Target: ATXN1; (+) strand; PAM type: NRG; PAM sequence: AGG
gagaatgagacatatcattt

SEQ ID NO: 146142 - DNA, 20 bp, Artificial Sequence
  Description of Artificial Sequence: Synthetic oligonucleotide
  Target: ATXN1; (+) strand; PAM type: NRG; PAM sequence: GAG
gaatgagacatatcatttag

SEQ ID NO: 146143 - DNA, 20 bp, Artificial Sequence
  Description of Artificial Sequence: Synthetic oligonucleotide
  Target: ATXN1; (+) strand; PAM type: NRG; PAM sequence: AAG
ttcctgctaaacaaacaaaa

SEQ ID NO: 146144 - DNA, 20 bp, Artificial Sequence
  Description of Artificial Sequence: Synthetic oligonucleotide
  Target: ATXN1; (+) strand; PAM type: NRG; PAM sequence: AGG
tcctgctaaacaaacaaaaa

SEQ ID NO: 146145 - DNA, 20 bp, Artificial Sequence
  Description of Artificial Sequence: Synthetic oligonucleotide
  Target: ATXN1; (+) strand; PAM type: NRG; PAM sequence: TGG
ctaatgcgatatctgtctct

SEQ ID NO: 146146 - DNA, 20 bp, Artificial Sequence
  Description of Artificial Sequence: Synthetic oligonucleotide
  Target: ATXN1; (+) strand; PAM type: NRG; PAM sequence: GGG
taatgcgatatctgtctctt

SEQ ID NO: 146147 - DNA, 20 bp, Artificial Sequence
  Description of Artificial Sequence: Synthetic oligonucleotide
  Target: ATXN1; (+) strand; PAM type: NRG; PAM sequence: GGG
aatgcgatatctgtctcttg

SEQ ID NO: 146148 - DNA, 20 bp, Artificial Sequence
  Description of Artificial Sequence: Synthetic oligonucleotide
  Target: ATXN1; (+) strand; PAM type: NRG; PAM sequence: GAG
gtctcccatgcttatgaatt

SEQ ID NO: 146149 - DNA, 20 bp, Artificial Sequence
  Description of Artificial Sequence: Synthetic oligonucleotide
  Target: ATXN1; (+) strand; PAM type: NRG; PAM sequence: AAG
tgagaaaacacacttgatat

SEQ ID NO: 146150 - DNA, 20 bp, Artificial Sequence
  Description of Artificial Sequence: Synthetic oligonucleotide
  Target: ATXN1; (+) strand; PAM type: NRG; PAM sequence: AAG
acacttgatataagtaaatg

SEQ ID NO: 146151 - DNA, 20 bp, Artificial Sequence
  Description of Artificial Sequence: Synthetic oligonucleotide
  Target: ATXN1; (+) strand; PAM type: NRG; PAM sequence: TAG
ataagtaaatgaagaaacaa

SEQ ID NO: 146152 - DNA, 20 bp, Artificial Sequence
  Description of Artificial Sequence: Synthetic oligonucleotide
  Target: ATXN1; (+) strand; PAM type: NRG; PAM sequence: CAG
tgaagaaacaatagttgaaa

SEQ ID NO: 146153 - DNA, 20 bp, Artificial Sequence
  Description of Artificial Sequence: Synthetic oligonucleotide
  Target: ATXN1; (+) strand; PAM type: NRG; PAM sequence: AAG
caatagttgaaacagccctg

SEQ ID NO: 146154 - DNA, 20 bp, Artificial Sequence
  Description of Artificial Sequence: Synthetic oligonucleotide
  Target: ATXN1; (+) strand; PAM type: NRG; PAM sequence: CAG
ttgaaacagccctgaagtga

SEQ ID NO: 146155 - DNA, 20 bp, Artificial Sequence
  Description of Artificial Sequence: Synthetic oligonucleotide
  Target: ATXN1; (+) strand; PAM type: NRG; PAM sequence: TGG
ccctgaagtgacagaaaaaa

SEQ ID NO: 146156 - DNA, 20 bp, Artificial Sequence
  Description of Artificial Sequence: Synthetic oligonucleotide
  Target: ATXN1; (+) strand; PAM type: NRG; PAM sequence: AAG
tgaagtgacagaaaaaatgg

SEQ ID NO: 146157 - DNA, 20 bp, Artificial Sequence
  Description of Artificial Sequence: Synthetic oligonucleotide
  Target: ATXN1; (+) strand; PAM type: NRG; PAM sequence: TAG
agtgacagaaaaaatggaag

SEQ ID NO: 146158 - DNA, 20 bp, Artificial Sequence
  Description of Artificial Sequence: Synthetic oligonucleotide
  Target: ATXN1; (+) strand; PAM type: NRG; PAM sequence: AGG
gtgacagaaaaaatggaagt

SEQ ID NO: 146159 - DNA, 20 bp, Artificial Sequence
  Description of Artificial Sequence: Synthetic oligonucleotide
  Target: ATXN1; (+) strand; PAM type: NRG; PAM sequence: GGG
tgacagaaaaaatggaagta

SEQ ID NO: 146160 - DNA, 20 bp, Artificial Sequence
  Description of Artificial Sequence: Synthetic oligonucleotide
  Target: ATXN1; (+) strand; PAM type: NRG; PAM sequence: AAG
aaaaatggaagtagggttct

SEQ ID NO: 146161 - DNA, 20 bp, Artificial Sequence
  Description of Artificial Sequence: Synthetic oligonucleotide
  Target: ATXN1; (+) strand; PAM type: NRG; PAM sequence: CAG
tagggttctaagctcaactc

SEQ ID NO: 146162 - DNA, 20 bp, Artificial Sequence
  Description of Artificial Sequence: Synthetic oligonucleotide
  Target: ATXN1; (+) strand; PAM type: NRG; PAM sequence: GAG
gggttctaagctcaactcca

SEQ ID NO: 146163 - DNA, 20 bp, Artificial Sequence
  Description of Artificial Sequence: Synthetic oligonucleotide
  Target: ATXN1; (+) strand; PAM type: NRG; PAM sequence: AGG
ggttctaagctcaactccag

SEQ ID NO: 146164 - DNA, 20 bp, Artificial Sequence
  Description of Artificial Sequence: Synthetic oligonucleotide
  Target: ATXN1; (+) strand; PAM type: NRG; PAM sequence: AAG
ctaagctcaactccagaggc

SEQ ID NO: 146165 - DNA, 20 bp, Artificial Sequence
  Description of Artificial Sequence: Synthetic oligonucleotide
  Target: ATXN1; (+) strand; PAM type: NRG; PAM sequence: AGG
taagctcaactccagaggca

SEQ ID NO: 146166 - DNA, 20 bp, Artificial Sequence
  Description of Artificial Sequence: Synthetic oligonucleotide
  Target: ATXN1; (+) strand; PAM type: NRG; PAM sequence: TGG
gctcaactccagaggcaagg

SEQ ID NO: 146167 - DNA, 20 bp, Artificial Sequence
  Description of Artificial Sequence: Synthetic oligonucleotide
  Target: ATXN1; (+) strand; PAM type: NRG; PAM sequence: CAG
actccagaggcaaggtggta

SEQ ID NO: 146168 - DNA, 20 bp, Artificial Sequence
  Description of Artificial Sequence: Synthetic oligonucleotide
  Target: ATXN1; (+) strand; PAM type: NRG; PAM sequence: CAG
ggcaaggtggtacagaatac

SEQ ID NO: 146169 - DNA, 20 bp, Artificial Sequence
  Description of Artificial Sequence: Synthetic oligonucleotide
  Target: ATXN1; (+) strand; PAM type: NRG; PAM sequence: TGG
aggtggtacagaataccagc

SEQ ID NO: 146170 - DNA, 20 bp, Artificial Sequence
  Description of Artificial Sequence: Synthetic oligonucleotide
  Target: ATXN1; (+) strand; PAM type: NRG; PAM sequence: CAG
cagaataccagctggatgaa

SEQ ID NO: 146171 - DNA, 20 bp, Artificial Sequence
  Description of Artificial Sequence: Synthetic oligonucleotide
  Target: ATXN1; (+) strand; PAM type: NRG; PAM sequence: AAG
ccagctggatgaacagttca

SEQ ID NO: 146172 - DNA, 20 bp, Artificial Sequence
  Description of Artificial Sequence: Synthetic oligonucleotide
  Target: ATXN1; (+) strand; PAM type: NRG; PAM sequence: TAG
tgaacagttcaaagcttccc

SEQ ID NO: 146173 - DNA, 20 bp, Artificial Sequence
  Description of Artificial Sequence: Synthetic oligonucleotide
  Target: ATXN1; (+) strand; PAM type: NRG; PAM sequence: GAG
agttcaaagcttccctagtt

SEQ ID NO: 146174 - DNA, 20 bp, Artificial Sequence
  Description of Artificial Sequence: Synthetic oligonucleotide
  Target: ATXN1; (+) strand; PAM type: NRG; PAM sequence: AGG
gttcaaagcttccctagttg

SEQ ID NO: 146175 - DNA, 20 bp, Artificial Sequence
  Description of Artificial Sequence: Synthetic oligonucleotide
  Target: ATXN1; (+) strand; PAM type: NRG; PAM sequence: GGG
ttcaaagcttccctagttga

SEQ ID NO: 146176 - DNA, 20 bp, Artificial Sequence
  Description of Artificial Sequence: Synthetic oligonucleotide
  Target: ATXN1; (+) strand; PAM type: NRG; PAM sequence: CAG
gagggtctctacctcaatga

SEQ ID NO: 146177 - DNA, 20 bp, Artificial Sequence
  Description of Artificial Sequence: Synthetic oligonucleotide
  Target: ATXN1; (+) strand; PAM type: NRG; PAM sequence: TGG
acagacaaaactcctaactt

SEQ ID NO: 146178 - DNA, 20 bp, Artificial Sequence
  Description of Artificial Sequence: Synthetic oligonucleotide
  Target: ATXN1; (+) strand; PAM type: NRG; PAM sequence: TAG
cctaactttggctttctcca

SEQ ID NO: 146179 - DNA, 20 bp, Artificial Sequence
  Description of Artificial Sequence: Synthetic oligonucleotide
  Target: ATXN1; (+) strand; PAM type: NRG; PAM sequence: GAG
taactttggctttctccata

SEQ ID NO: 146180 - DNA, 20 bp, Artificial Sequence
  Description of Artificial Sequence: Synthetic oligonucleotide
  Target: ATXN1; (+) strand; PAM type: NRG; PAM sequence: CAG
catagagcatcaaccaaatt

SEQ ID NO: 146181 - DNA, 20 bp, Artificial Sequence
  Description of Artificial Sequence: Synthetic oligonucleotide
  Target: ATXN1; (+) strand; PAM type: NRG; PAM sequence: AAG
aaccaaattcagtaatgatg

SEQ ID NO: 146182 - DNA, 20 bp, Artificial Sequence
  Description of Artificial Sequence: Synthetic oligonucleotide
  Target: ATXN1; (+) strand; PAM type: NRG; PAM sequence: TAG
gaagtacctgcttaacacta

SEQ ID NO: 146183 - DNA, 20 bp, Artificial Sequence
  Description of Artificial Sequence: Synthetic oligonucleotide
  Target: ATXN1; (+) strand; PAM type: NRG; PAM sequence: AGG
aagtacctgcttaacactat

SEQ ID NO: 146184 - DNA, 20 bp, Artificial Sequence
  Description of Artificial Sequence: Synthetic oligonucleotide
  Target: ATXN1; (+) strand; PAM type: NRG; PAM sequence: AAG
taggttgaataacttttgac

SEQ ID NO: 146185 - DNA, 20 bp, Artificial Sequence
  Description of Artificial Sequence: Synthetic oligonucleotide
  Target: ATXN1; (+) strand; PAM type: NRG; PAM sequence: TGG
gacaagctgtaacatcctgt

SEQ ID NO: 146186 - DNA, 20 bp, Artificial Sequence
  Description of Artificial Sequence: Synthetic oligonucleotide
  Target: ATXN1; (+) strand; PAM type: NRG; PAM sequence: TGG
aagctgtaacatcctgttgg

SEQ ID NO: 146187 - DNA, 20 bp, Artificial Sequence
  Description of Artificial Sequence: Synthetic oligonucleotide
  Target: ATXN1; (+) strand; PAM type: NRG; PAM sequence: TAG
aacatcctgttggtggaaaa

SEQ ID NO: 146188 - DNA, 20 bp, Artificial Sequence
  Description of Artificial Sequence: Synthetic oligonucleotide
  Target: ATXN1; (+) strand; PAM type: NRG; PAM sequence: CAG
tcctgttggtggaaaatagc

SEQ ID NO: 146189 - DNA, 20 bp, Artificial Sequence
  Description of Artificial Sequence: Synthetic oligonucleotide
  Target: ATXN1; (+) strand; PAM type: NRG; PAM sequence: CAG
ataatattgcaaacccaaaa

SEQ ID NO: 146190 - DNA, 20 bp, Artificial Sequence
  Description of Artificial Sequence: Synthetic oligonucleotide
  Target: ATXN1; (+) strand; PAM type: NRG; PAM sequence: AGG
taatattgcaaacccaaaac

SEQ ID NO: 146191 - DNA, 20 bp, Artificial Sequence
  Description of Artificial Sequence: Synthetic oligonucleotide
  Target: ATXN1; (+) strand; PAM type: NRG; PAM sequence: GGG
aatattgcaaacccaaaaca

SEQ ID NO: 146192 - DNA, 20 bp, Artificial Sequence
  Description of Artificial Sequence: Synthetic oligonucleotide
  Target: ATXN1; (+) strand; PAM type: NRG; PAM sequence: AAG
caaaacagggtaattgtgca

SEQ ID NO: 146193 - DNA, 20 bp, Artificial Sequence
  Description of Artificial Sequence: Synthetic oligonucleotide
  Target: ATXN1; (+) strand; PAM type: NRG; PAM sequence: GAG
aaacagggtaattgtgcaaa

SEQ ID NO: 146194 - DNA, 20 bp, Artificial Sequence
  Description of Artificial Sequence: Synthetic oligonucleotide
  Target: ATXN1; (+) strand; PAM type: NRG; PAM sequence: GAG
acagggtaattgtgcaaaga

SEQ ID NO: 146195 - DNA, 20 bp, Artificial Sequence
  Description of Artificial Sequence: Synthetic oligonucleotide
  Target: ATXN1; (+) strand; PAM type: NRG; PAM sequence: CAG
ttttgtgtatgtcccctttc

SEQ ID NO: 146196 - DNA, 20 bp, Artificial Sequence
  Description of Artificial Sequence: Synthetic oligonucleotide
  Target: ATXN1; (+) strand; PAM type: NRG; PAM sequence: TGG
cccctttccagaaaatattc

SEQ ID NO: 146197 - DNA, 20 bp, Artificial Sequence
  Description of Artificial Sequence: Synthetic oligonucleotide
  Target: ATXN1; (+) strand; PAM type: NRG; PAM sequence: GGG
ccctttccagaaaatattct

SEQ ID NO: 146198 - DNA, 20 bp, Artificial Sequence
  Description of Artificial Sequence: Synthetic oligonucleotide
  Target: ATXN1; (+) strand; PAM type: NRG; PAM sequence: CGG
acatccaatctgcttttacc

SEQ ID NO: 146199 - DNA, 20 bp, Artificial Sequence
  Description of Artificial Sequence: Synthetic oligonucleotide
  Target: ATXN1; (+) strand; PAM type: NRG; PAM sequence: TGG
ccggctcacttatttacaat

SEQ ID NO: 146200 - DNA, 20 bp, Artificial Sequence
  Description of Artificial Sequence: Synthetic oligonucleotide
  Target: ATXN1; (+) strand; PAM type: NRG; PAM sequence: GGG
cggctcacttatttacaatt

SEQ ID NO: 146201 - DNA, 20 bp, Artificial Sequence
  Description of Artificial Sequence: Synthetic oligonucleotide
  Target: ATXN1; (+) strand; PAM type: NRG; PAM sequence: GGG
ggctcacttatttacaattg

SEQ ID NO: 146202 - DNA, 20 bp, Artificial Sequence
  Description of Artificial Sequence: Synthetic oligonucleotide
  Target: ATXN1; (+) strand; PAM type: NRG; PAM sequence: AAG
ataaactattttgtgaaatc

SEQ ID NO: 146203 - DNA, 20 bp, Artificial Sequence
  Description of Artificial Sequence: Synthetic oligonucleotide
  Target: ATXN1; (+) strand; PAM type: NRG; PAM sequence: TAG
ctattttgtgaaatcaagtt

SEQ ID NO: 146204 - DNA, 20 bp, Artificial Sequence
  Description of Artificial Sequence: Synthetic oligonucleotide
  Target: ATXN1; (+) strand; PAM type: NRG; PAM sequence: GAG
gaaatcaagtttagtaactt

SEQ ID NO: 146205 - DNA, 20 bp, Artificial Sequence
  Description of Artificial Sequence: Synthetic oligonucleotide
  Target: ATXN1; (+) strand; PAM type: NRG; PAM sequence: TAG
gacaaccaccaaaacctgat

SEQ ID NO: 146206 - DNA, 20 bp, Artificial Sequence
  Description of Artificial Sequence: Synthetic oligonucleotide
  Target: ATXN1; (+) strand; PAM type: NRG; PAM sequence: TAG
agacatctctctcctttgtc

SEQ ID NO: 146207 - DNA, 20 bp, Artificial Sequence
  Description of Artificial Sequence: Synthetic oligonucleotide
  Target: ATXN1; (+) strand; PAM type: NRG; PAM sequence: AGG
gacatctctctcctttgtct

SEQ ID NO: 146208 - DNA, 20 bp, Artificial Sequence
  Description of Artificial Sequence: Synthetic oligonucleotide
  Target: ATXN1; (+) strand; PAM type: NRG; PAM sequence: AAG
ctaggtgctttactgaaaaa

SEQ ID NO: 146209 - DNA, 20 bp, Artificial Sequence
  Description of Artificial Sequence: Synthetic oligonucleotide
  Target: ATXN1; (+) strand; PAM type: NRG; PAM sequence: TGG
tgctttactgaaaaaaagca

SEQ ID NO: 146210 - DNA, 20 bp, Artificial Sequence
  Description of Artificial Sequence: Synthetic oligonucleotide
  Target: ATXN1; (+) strand; PAM type: NRG; PAM sequence: TAG
actgaaaaaaagcatggaaa

SEQ ID NO: 146211 - DNA, 20 bp, Artificial Sequence
  Description of Artificial Sequence: Synthetic oligonucleotide
  Target: ATXN1; (+) strand; PAM type: NRG; PAM sequence: TGG
aaaaagcatggaaatagact

SEQ ID NO: 146212 - DNA, 20 bp, Artificial Sequence
  Description of Artificial Sequence: Synthetic oligonucleotide
  Target: ATXN1; (+) strand; PAM type: NRG; PAM sequence: GAG
aaagcatggaaatagacttg

SEQ ID NO: 146213 - DNA, 20 bp, Artificial Sequence
  Description of Artificial Sequence: Synthetic oligonucleotide
  Target: ATXN1; (+) strand; PAM type: NRG; PAM sequence: TGG
tgtgtgtgtatgtgtgtgtg

SEQ ID NO: 146214 - DNA, 20 bp, Artificial Sequence
  Description of Artificial Sequence: Synthetic oligonucleotide
  Target: ATXN1; (+) strand; PAM type: NRG; PAM sequence: TAG
tgcatgtgtatgtacatata

SEQ ID NO: 146215 - DNA, 20 bp, Artificial Sequence
  Description of Artificial Sequence: Synthetic oligonucleotide
  Target: ATXN1; (+) strand; PAM type: NRG; PAM sequence: CAG
catatgtgtacgtgtatatg

SEQ ID NO: 146216 - DNA, 20 bp, Artificial Sequence
  Description of Artificial Sequence: Synthetic oligonucleotide
  Target: ATXN1; (+) strand; PAM type: NRG; PAM sequence: CAG
cacactgcttttcctatatg

SEQ ID NO: 146217 - DNA, 20 bp, Artificial Sequence
  Description of Artificial Sequence: Synthetic oligonucleotide
  Target: ATXN1; (+) strand; PAM type: NRG; PAM sequence: CAG
actgcttttcctatatgcag

SEQ ID NO: 146218 - DNA, 20 bp, Artificial Sequence
  Description of Artificial Sequence: Synthetic oligonucleotide
  Target: ATXN1; (+) strand; PAM type: NRG; PAM sequence: AGG
ctgcttttcctatatgcagc

SEQ ID NO: 146219 - DNA, 20 bp, Artificial Sequence
  Description of Artificial Sequence: Synthetic oligonucleotide
  Target: ATXN1; (+) strand; PAM type: NRG; PAM sequence: TGG
tgcagcaggaatttcctatc

SEQ ID NO: 146220 - DNA, 20 bp, Artificial Sequence
  Description of Artificial Sequence: Synthetic oligonucleotide
  Target: ATXN1; (+) strand; PAM type: NRG; PAM sequence: AAG
aatttcctatctggcatatg

SEQ ID NO: 146221 - DNA, 20 bp, Artificial Sequence
  Description of Artificial Sequence: Synthetic oligonucleotide
  Target: ATXN1; (+) strand; PAM type: NRG; PAM sequence: TGG
gaagacaatacatactcttt

SEQ ID NO: 146222 - DNA, 20 bp, Artificial Sequence
  Description of Artificial Sequence: Synthetic oligonucleotide
  Target: ATXN1; (+) strand; PAM type: NRG; PAM sequence: TGG
acaatacatactcttttgga

SEQ ID NO: 146223 - DNA, 20 bp, Artificial Sequence
  Description of Artificial Sequence: Synthetic oligonucleotide
  Target: ATXN1; (+) strand; PAM type: NRG; PAM sequence: GAG
aatacatactcttttggatg

SEQ ID NO: 146224 - DNA, 20 bp, Artificial Sequence
  Description of Artificial Sequence: Synthetic oligonucleotide
  Target: ATXN1; (+) strand; PAM type: NRG; PAM sequence: TGG
catactcttttggatggagc

SEQ ID NO: 146225 - DNA, 20 bp, Artificial Sequence
  Description of Artificial Sequence: Synthetic oligonucleotide
  Target: ATXN1; (+) strand; PAM type: NRG; PAM sequence: GAG
ctcttttggatggagctggt

SEQ ID NO: 146226 - DNA, 20 bp, Artificial Sequence
  Description of Artificial Sequence: Synthetic oligonucleotide
  Target: ATXN1; (+) strand; PAM type: NRG; PAM sequence: CAG
tttggatggagctggtgagt

SEQ ID NO: 146227 - DNA, 20 bp, Artificial Sequence
  Description of Artificial Sequence: Synthetic oligonucleotide
  Target: ATXN1; (+) strand; PAM type: NRG; PAM sequence: AGG
ttggatggagctggtgagtc

SEQ ID NO: 146228 - DNA, 20 bp, Artificial Sequence
  Description of Artificial Sequence: Synthetic oligonucleotide
  Target: ATXN1; (+) strand; PAM type: NRG; PAM sequence: CAG
gatggagctggtgagtcagg

SEQ ID NO: 146229 - DNA, 20 bp, Artificial Sequence
  Description of Artificial Sequence: Synthetic oligonucleotide
  Target: ATXN1; (+) strand; PAM type: NRG; PAM sequence: TGG
tggtgagtcaggcagtgttt

SEQ ID NO: 146230 - DNA, 20 bp, Artificial Sequence
  Description of Artificial Sequence: Synthetic oligonucleotide
  Target: ATXN1; (+) strand; PAM type: NRG; PAM sequence: GAG
gttttggaactgcaatactt

SEQ ID NO: 146231 - DNA, 20 bp, Artificial Sequence
  Description of Artificial Sequence: Synthetic oligonucleotide
  Target: ATXN1; (+) strand; PAM type: NRG; PAM sequence: GAG
cttgagtctgcatgactcat

SEQ ID NO: 146232 - DNA, 20 bp, Artificial Sequence
  Description of Artificial Sequence: Synthetic oligonucleotide
  Target: ATXN1; (+) strand; PAM type: NRG; PAM sequence: AGG
ttgagtctgcatgactcatg

SEQ ID NO: 146233 - DNA, 20 bp, Artificial Sequence
  Description of Artificial Sequence: Synthetic oligonucleotide
  Target: ATXN1; (+) strand; PAM type: NRG; PAM sequence: AAG
gtctgcatgactcatgagga

SEQ ID NO: 146234 - DNA, 20 bp, Artificial Sequence
  Description of Artificial Sequence: Synthetic oligonucleotide
  Target: ATXN1; (+) strand; PAM type: NRG; PAM sequence: AAG
gcatgactcatgaggaaagc

SEQ ID NO: 146235 - DNA, 20 bp, Artificial Sequence
  Description of Artificial Sequence: Synthetic oligonucleotide
  Target: ATXN1; (+) strand; PAM type: NRG; PAM sequence: TGG
actcatgaggaaagcaagtc

SEQ ID NO: 146236 - DNA, 20 bp, Artificial Sequence
  Description of Artificial Sequence: Synthetic oligonucleotide
  Target: ATXN1; (+) strand; PAM type: NRG; PAM sequence: GGG
ctcatgaggaaagcaagtct

SEQ ID NO: 146237 - DNA, 20 bp, Artificial Sequence
  Description of Artificial Sequence: Synthetic oligonucleotide
  Target: ATXN1; (+) strand; PAM type: NRG; PAM sequence: GGG
tcatgaggaaagcaagtctg

SEQ ID NO: 146238 - DNA, 20 bp, Artificial Sequence
  Description of Artificial Sequence: Synthetic oligonucleotide
  Target: ATXN1; (+) strand; PAM type: NRG; PAM sequence: TGG
aggaaagcaagtctggggtc

SEQ ID NO: 146239 - DNA, 20 bp, Artificial Sequence
  Description of Artificial Sequence: Synthetic oligonucleotide
  Target: ATXN1; (+) strand; PAM type: NRG; PAM sequence: GGG
ggaaagcaagtctggggtct

SEQ ID NO: 146240 - DNA, 20 bp, Artificial Sequence
  Description of Artificial Sequence: Synthetic oligonucleotide
  Target: ATXN1; (+) strand; PAM type: NRG; PAM sequence: TGG
ctgggactgttgtatcaaaa

SEQ ID NO: 146241 - DNA, 20 bp, Artificial Sequence
  Description of Artificial Sequence: Synthetic oligonucleotide
  Target: ATXN1; (+) strand; PAM type: NRG; PAM sequence: GGG
tgggactgttgtatcaaaat

SEQ ID NO: 146242 - DNA, 20 bp, Artificial Sequence
  Description of Artificial Sequence: Synthetic oligonucleotide
  Target: ATXN1; (+) strand; PAM type: NRG; PAM sequence: AAG
gactgttgtatcaaaatggg

SEQ ID NO: 146243 - DNA, 20 bp, Artificial Sequence
  Description of Artificial Sequence: Synthetic oligonucleotide
  Target: ATXN1; (+) strand; PAM type: NRG; PAM sequence: AGG
actgttgtatcaaaatggga

SEQ ID NO: 146244 - DNA, 20 bp, Artificial Sequence
  Description of Artificial Sequence: Synthetic oligonucleotide
  Target: ATXN1; (+) strand; PAM type: NRG; PAM sequence: GAG
tgttgtatcaaaatgggaag

SEQ ID NO: 146245 - DNA, 20 bp, Artificial Sequence
  Description of Artificial Sequence: Synthetic oligonucleotide
  Target: ATXN1; (+) strand; PAM type: NRG; PAM sequence: TGG
tgtatcaaaatgggaaggag

SEQ ID NO: 146246 - DNA, 20 bp, Artificial Sequence
  Description of Artificial Sequence: Synthetic oligonucleotide
  Target: ATXN1; (+) strand; PAM type: NRG; PAM sequence: GGG
gtatcaaaatgggaaggagt

SEQ ID NO: 146247 - DNA, 20 bp, Artificial Sequence
  Description of Artificial Sequence: Synthetic oligonucleotide
  Target: ATXN1; (+) strand; PAM type: NRG; PAM sequence: AAG
caaaatgggaaggagtggga

SEQ ID NO: 146248 - DNA, 20 bp, Artificial Sequence
  Description of Artificial Sequence: Synthetic oligonucleotide
  Target: ATXN1; (+) strand; PAM type: NRG; PAM sequence: AAG
aatgggaaggagtgggaaag

SEQ ID NO: 146249 - DNA, 20 bp, Artificial Sequence
  Description of Artificial Sequence: Synthetic oligonucleotide
  Target: ATXN1; (+) strand; PAM type: NRG; PAM sequence: TGG
ggaaggagtgggaaagaaga

SEQ ID NO: 146250 - DNA, 20 bp, Artificial Sequence
  Description of Artificial Sequence: Synthetic oligonucleotide
  Target: ATXN1; (+) strand; PAM type: NRG; PAM sequence: AAG
tttattttttatattgttgt

SEQ ID NO: 146251 - DNA, 20 bp, Artificial Sequence
  Description of Artificial Sequence: Synthetic oligonucleotide
  Target: ATXN1; (+) strand; PAM type: NRG; PAM sequence: GAG
tgttgtaagtttttactttt

SEQ ID NO: 146252 - DNA, 20 bp, Artificial Sequence
  Description of Artificial Sequence: Synthetic oligonucleotide
  Target: ATXN1; (+) strand; PAM type: NRG; PAM sequence: CAG
gtaagtttttacttttgaga

SEQ ID NO: 146253 - DNA, 20 bp, Artificial Sequence
  Description of Artificial Sequence: Synthetic oligonucleotide
  Target: ATXN1; (+) strand; PAM type: NRG; PAM sequence: AGG
taagtttttacttttgagac

SEQ ID NO: 146254 - DNA, 20 bp, Artificial Sequence
  Description of Artificial Sequence: Synthetic oligonucleotide
  Target: ATXN1; (+) strand; PAM type: NRG; PAM sequence: GGG
aagtttttacttttgagaca

SEQ ID NO: 146255 - DNA, 20 bp, Artificial Sequence
  Description of Artificial Sequence: Synthetic oligonucleotide
  Target: ATXN1; (+) strand; PAM type: NRG; PAM sequence: CAG
cagggtatcactctcttgct

SEQ ID NO: 146256 - DNA, 20 bp, Artificial Sequence
  Description of Artificial Sequence: Synthetic oligonucleotide
  Target: ATXN1; (+) strand; PAM type: NRG; PAM sequence: AGG
agggtatcactctcttgctc

SEQ ID NO: 146257 - DNA, 20 bp, Artificial Sequence
  Description of Artificial Sequence: Synthetic oligonucleotide
  Target: ATXN1; (+) strand; PAM type: NRG; PAM sequence: TAG
tatcactctcttgctcaggc

SEQ ID NO: 146258 - DNA, 20 bp, Artificial Sequence
  Description of Artificial Sequence: Synthetic oligonucleotide
  Target: ATXN1; (+) strand; PAM type: NRG; PAM sequence: GAG
tcactctcttgctcaggcta

SEQ ID NO: 146259 - DNA, 20 bp, Artificial Sequence
  Description of Artificial Sequence: Synthetic oligonucleotide
  Target: ATXN1; (+) strand; PAM type: NRG; PAM sequence: CAG
ctcttgctcaggctagagcg

SEQ ID NO: 146260 - DNA, 20 bp, Artificial Sequence
  Description of Artificial Sequence: Synthetic oligonucleotide
  Target: ATXN1; (+) strand; PAM type: NRG; PAM sequence: TGG
ttgctcaggctagagcgcag

SEQ ID NO: 146261 - DNA, 20 bp, Artificial Sequence
  Description of Artificial Sequence: Synthetic oligonucleotide
  Target: ATXN1; (+) strand; PAM type: NRG; PAM sequence: TAG
agagcgcagtggcatgatca

SEQ ID NO: 146262 - DNA, 20 bp, Artificial Sequence
  Description of Artificial Sequence: Synthetic oligonucleotide
  Target: ATXN1; (+) strand; PAM type: NRG; PAM sequence: CAG
ggcatgatcatagctcacta

SEQ ID NO: 146263 - DNA, 20 bp, Artificial Sequence
  Description of Artificial Sequence: Synthetic oligonucleotide
  Target: ATXN1; (+) strand; PAM type: NRG; PAM sequence: TGG
tcactacagccacaaactcc

SEQ ID NO: 146264 - DNA, 20 bp, Artificial Sequence
  Description of Artificial Sequence: Synthetic oligonucleotide
  Target: ATXN1; (+) strand; PAM type: NRG; PAM sequence: GGG
cactacagccacaaactcct

SEQ ID NO: 146265 - DNA, 20 bp, Artificial Sequence
  Description of Artificial Sequence: Synthetic oligonucleotide
  Target: ATXN1; (+) strand; PAM type: NRG; PAM sequence: TGG
gccacaaactcctgggccca

SEQ ID NO: 146266 - DNA, 20 bp, Artificial Sequence
  Description of Artificial Sequence: Synthetic oligonucleotide
  Target: ATXN1; (+) strand; PAM type: NRG; PAM sequence: GGG
ccacaaactcctgggcccat

SEQ ID NO: 146267 - DNA, 20 bp, Artificial Sequence
  Description of Artificial Sequence: Synthetic oligonucleotide
  Target: ATXN1; (+) strand; PAM type: NRG; PAM sequence: CAG
cccatgggatcctcccacct

SEQ ID NO: 146268 - DNA, 20 bp, Artificial Sequence
  Description of Artificial Sequence: Synthetic oligonucleotide
  Target: ATXN1; (+) strand; PAM type: NRG; PAM sequence: GAG
atcctcccacctcagctccc

SEQ ID NO: 146269 - DNA, 20 bp, Artificial Sequence
  Description of Artificial Sequence: Synthetic oligonucleotide
  Target: ATXN1; (+) strand; PAM type: NRG; PAM sequence: CAG
ctcccacctcagctcccgag

SEQ ID NO: 146270 - DNA, 20 bp, Artificial Sequence
  Description of Artificial Sequence: Synthetic oligonucleotide
  Target: ATXN1; (+) strand; PAM type: NRG; PAM sequence: GAG
acctcagctcccgagcagct

SEQ ID NO: 146271 - DNA, 20 bp, Artificial Sequence
  Description of Artificial Sequence: Synthetic oligonucleotide
  Target: ATXN1; (+) strand; PAM type: NRG; PAM sequence: CAG
ctcccgagcagctgagacta

SEQ ID NO: 146272 - DNA, 20 bp, Artificial Sequence
  Description of Artificial Sequence: Synthetic oligonucleotide
  Target: ATXN1; (+) strand; PAM type: NRG; PAM sequence: AGG
tcccgagcagctgagactac

SEQ ID NO: 146273 - DNA, 20 bp, Artificial Sequence
  Description of Artificial Sequence: Synthetic oligonucleotide
  Target: ATXN1; (+) strand; PAM type: NRG; PAM sequence: AAG
gagcagctgagactacaggc

SEQ ID NO: 146274 - DNA, 20 bp, Artificial Sequence
  Description of Artificial Sequence: Synthetic oligonucleotide
  Target: ATXN1; (+) strand; PAM type: NRG; PAM sequence: GAG
gcagctgagactacaggcaa

SEQ ID NO: 146275 - DNA, 20 bp, Artificial Sequence
  Description of Artificial Sequence: Synthetic oligonucleotide
  Target: ATXN1; (+) strand; PAM type: NRG; PAM sequence: CAG
caggcaagagccaccacacc

SEQ ID NO: 146276 - DNA, 20 bp, Artificial Sequence
  Description of Artificial Sequence: Synthetic oligonucleotide
  Target: ATXN1; (+) strand; PAM type: NRG; PAM sequence: TAG
ttttcttttttttttttttg

SEQ ID NO: 146277 - DNA, 20 bp, Artificial Sequence
  Description of Artificial Sequence: Synthetic oligonucleotide
  Target: ATXN1; (+) strand; PAM type: NRG; PAM sequence: GAG
ttcttttttttttttttgta

SEQ ID NO: 146278 - DNA, 20 bp, Artificial Sequence
  Description of Artificial Sequence: Synthetic oligonucleotide
  Target: ATXN1; (+) strand; PAM type: NRG; PAM sequence: TGG
tttttttttttttgtagaga

SEQ ID NO: 146279 - DNA, 20 bp, Artificial Sequence
  Description of Artificial Sequence: Synthetic oligonucleotide
  Target: ATXN1; (+) strand; PAM type: NRG; PAM sequence: GAG
tttttttttttgtagagatg

SEQ ID NO: 146280 - DNA, 20 bp, Artificial Sequence
  Description of Artificial Sequence: Synthetic oligonucleotide
  Target: ATXN1; (+) strand; PAM type: NRG; PAM sequence: AAG
ggagtctccctatgttgccc

SEQ ID NO: 146281 - DNA, 20 bp, Artificial Sequence
  Description of Artificial Sequence: Synthetic oligonucleotide
  Target: ATXN1; (+) strand; PAM type: NRG; PAM sequence: TGG
ccaagctgctgtcaaactcc

SEQ ID NO: 146282 - DNA, 20 bp, Artificial Sequence
  Description of Artificial Sequence: Synthetic oligonucleotide
  Target: ATXN1; (+) strand; PAM type: NRG; PAM sequence: GGG
caagctgctgtcaaactcct

SEQ ID NO: 146283 - DNA, 20 bp, Artificial Sequence
  Description of Artificial Sequence: Synthetic oligonucleotide
  Target: ATXN1; (+) strand; PAM type: NRG; PAM sequence: AAG
gctgtcaaactcctgggctc

SEQ ID NO: 146284 - DNA, 20 bp, Artificial Sequence
  Description of Artificial Sequence: Synthetic oligonucleotide
  Target: ATXN1; (+) strand; PAM type: NRG; PAM sequence: AGG
ctgtcaaactcctgggctca

SEQ ID NO: 146285 - DNA, 20 bp, Artificial Sequence
  Description of Artificial Sequence: Synthetic oligonucleotide
  Target: ATXN1; (+) strand; PAM type: NRG; PAM sequence: GGG
tgtcaaactcctgggctcaa

SEQ ID NO: 146286 - DNA, 20 bp, Artificial Sequence
  Description of Artificial Sequence: Synthetic oligonucleotide
  Target: ATXN1; (+) strand; PAM type: NRG; PAM sequence: TGG
ctcaagggatcctcccacct

SEQ ID NO: 146287 - DNA, 20 bp, Artificial Sequence
  Description of Artificial Sequence: Synthetic oligonucleotide
  Target: ATXN1; (+) strand; PAM type: NRG; PAM sequence: TAG
gggatcctcccaccttggcc

SEQ ID NO: 146288 - DNA, 20 bp, Artificial Sequence
  Description of Artificial Sequence: Synthetic oligonucleotide
  Target: ATXN1; (+) strand; PAM type: NRG; PAM sequence: TAG
tgacaaataataattgcatg

SEQ ID NO: 146289 - DNA, 20 bp, Artificial Sequence
  Description of Artificial Sequence: Synthetic oligonucleotide
  Target: ATXN1; (+) strand; PAM type: NRG; PAM sequence: TGG
ataataattgcatgtagtta

SEQ ID NO: 146290 - DNA, 20 bp, Artificial Sequence
  Description of Artificial Sequence: Synthetic oligonucleotide
  Target: ATXN1; (+) strand; PAM type: NRG; PAM sequence: GGG
taataattgcatgtagttat

SEQ ID NO: 146291 - DNA, 20 bp, Artificial Sequence
  Description of Artificial Sequence: Synthetic oligonucleotide
  Target: ATXN1; (+) strand; PAM type: NRG; PAM sequence: TAG
tataatgtgatgttttgata

SEQ ID NO: 146292 - DNA, 20 bp, Artificial Sequence
  Description of Artificial Sequence: Synthetic oligonucleotide
  Target: ATXN1; (+) strand; PAM type: NRG; PAM sequence: AAG
tactataaaatgattatatt

SEQ ID NO: 146293 - DNA, 20 bp, Artificial Sequence
  Description of Artificial Sequence: Synthetic oligonucleotide
  Target: ATXN1; (+) strand; PAM type: NRG; PAM sequence: AAG
catacttattttttataatg

SEQ ID NO: 146294 - DNA, 20 bp, Artificial Sequence
  Description of Artificial Sequence: Synthetic oligonucleotide
  Target: ATXN1; (+) strand; PAM type: NRG; PAM sequence: TAG
catttaaaaacgtattcttt

SEQ ID NO: 146295 - DNA, 20 bp, Artificial Sequence
  Description of Artificial Sequence: Synthetic oligonucleotide
  Target: ATXN1; (+) strand; PAM type: NRG; PAM sequence: GAG
catttataataccttattat

SEQ ID NO: 146296 - DNA, 20 bp, Artificial Sequence
  Description of Artificial Sequence: Synthetic oligonucleotide
  Target: ATXN1; (+) strand; PAM type: NRG; PAM sequence: AGG
atttataataccttattatg

SEQ ID NO: 146297 - DNA, 20 bp, Artificial Sequence
  Description of Artificial Sequence: Synthetic oligonucleotide
  Target: ATXN1; (+) strand; PAM type: NRG; PAM sequence: GGG
tttataataccttattatga

SEQ ID NO: 146298 - DNA, 20 bp, Artificial Sequence
  Description of Artificial Sequence: Synthetic oligonucleotide
  Target: ATXN1; (+) strand; PAM type: NRG; PAM sequence: TGG
atattaataatcctgtacaa

SEQ ID NO: 146299 - DNA, 20 bp, Artificial Sequence
  Description of Artificial Sequence: Synthetic oligonucleotide
  Target: ATXN1; (+) strand; PAM type: NRG; PAM sequence: GGG
tattaataatcctgtacaat

SEQ ID NO: 146300 - DNA, 20 bp, Artificial Sequence
  Description of Artificial Sequence: Synthetic oligonucleotide
  Target: ATXN1; (+) strand; PAM type: NRG; PAM sequence: CAG
taatcctgtacaatgggtct

SEQ ID NO: 146301 - DNA, 20 bp, Artificial Sequence
  Description of Artificial Sequence: Synthetic oligonucleotide
  Target: ATXN1; (+) strand; PAM type: NRG; PAM sequence: TAG
tacaatgggtctcagaaact

SEQ ID NO: 146302 - DNA, 20 bp, Artificial Sequence
  Description of Artificial Sequence: Synthetic oligonucleotide
  Target: ATXN1; (+) strand; PAM type: NRG; PAM sequence: AAG
ctgtaccgtttgatcaacca

SEQ ID NO: 146303 - DNA, 20 bp, Artificial Sequence
  Description of Artificial Sequence: Synthetic oligonucleotide
  Target: ATXN1; (+) strand; PAM type: NRG; PAM sequence: TGG
accgtttgatcaaccaaaga

SEQ ID NO: 146304 - DNA, 20 bp, Artificial Sequence
  Description of Artificial Sequence: Synthetic oligonucleotide
  Target: ATXN1; (+) strand; PAM type: NRG; PAM sequence: TGG
caaccaaagatggcttttgt

SEQ ID NO: 146305 - DNA, 20 bp, Artificial Sequence
  Description of Artificial Sequence: Synthetic oligonucleotide
  Target: ATXN1; (+) strand; PAM type: NRG; PAM sequence: TGG
tcctcatttttgtcttcatt

SEQ ID NO: 146306 - DNA, 20 bp, Artificial Sequence
  Description of Artificial Sequence: Synthetic oligonucleotide
  Target: ATXN1; (+) strand; PAM type: NRG; PAM sequence: GAG
ctcatttttgtcttcatttg

SEQ ID NO: 146307 - DNA, 20 bp, Artificial Sequence
  Description of Artificial Sequence: Synthetic oligonucleotide
  Target: ATXN1; (+) strand; PAM type: NRG; PAM sequence: AAG
ttggagtttttatccattac

SEQ ID NO: 146308 - DNA, 20 bp, Artificial Sequence
  Description of Artificial Sequence: Synthetic oligonucleotide
  Target: ATXN1; (+) strand; PAM type: NRG; PAM sequence: GAG
ggagtttttatccattacaa

SEQ ID NO: 146309 - DNA, 20 bp, Artificial Sequence
  Description of Artificial Sequence: Synthetic oligonucleotide
  Target: ATXN1; (+) strand; PAM type: NRG; PAM sequence: GAG
agtttttatccattacaaga

SEQ ID NO: 146310 - DNA, 20 bp, Artificial Sequence
  Description of Artificial Sequence: Synthetic oligonucleotide
  Target: ATXN1; (+) strand; PAM type: NRG; PAM sequence: AGG
gtttttatccattacaagag

SEQ ID NO: 146311 - DNA, 20 bp, Artificial Sequence
  Description of Artificial Sequence: Synthetic oligonucleotide
  Target: ATXN1; (+) strand; PAM type: NRG; PAM sequence: AAG
tttatccattacaagagagg

SEQ ID NO: 146312 - DNA, 20 bp, Artificial Sequence
  Description of Artificial Sequence: Synthetic oligonucleotide
  Target: ATXN1; (+) strand; PAM type: NRG; PAM sequence: AAG
acaagagaggaagatgacac

SEQ ID NO: 146313 - DNA, 20 bp, Artificial Sequence
  Description of Artificial Sequence: Synthetic oligonucleotide
  Target: ATXN1; (+) strand; PAM type: NRG; PAM sequence: CAG
gagaggaagatgacacaagc

SEQ ID NO: 146314 - DNA, 20 bp, Artificial Sequence
  Description of Artificial Sequence: Synthetic oligonucleotide
  Target: ATXN1; (+) strand; PAM type: NRG; PAM sequence: TAG
gaagatgacacaagccagaa

SEQ ID NO: 146315 - DNA, 20 bp, Artificial Sequence
  Description of Artificial Sequence: Synthetic oligonucleotide
  Target: ATXN1; (+) strand; PAM type: NRG; PAM sequence: GAG
agatgacacaagccagaata

SEQ ID NO: 146316 - DNA, 20 bp, Artificial Sequence
  Description of Artificial Sequence: Synthetic oligonucleotide
  Target: ATXN1; (+) strand; PAM type: NRG; PAM sequence: AGG
gatgacacaagccagaatag

SEQ ID NO: 146317 - DNA, 20 bp, Artificial Sequence
  Description of Artificial Sequence: Synthetic oligonucleotide
  Target: ATXN1; (+) strand; PAM type: NRG; PAM sequence: AAG
gacacaagccagaatagagg

SEQ ID NO: 146318 - DNA, 20 bp, Artificial Sequence
  Description of Artificial Sequence: Synthetic oligonucleotide
  Target: ATXN1; (+) strand; PAM type: NRG; PAM sequence: CAG
ggaagatgaaacaaaccact

SEQ ID NO: 146319 - DNA, 20 bp, Artificial Sequence
  Description of Artificial Sequence: Synthetic oligonucleotide
  Target: ATXN1; (+) strand; PAM type: NRG; PAM sequence: AGG
gaagatgaaacaaaccactc

SEQ ID NO: 146320 - DNA, 20 bp, Artificial Sequence
  Description of Artificial Sequence: Synthetic oligonucleotide
  Target: ATXN1; (+) strand; PAM type: NRG; PAM sequence: AAG
acaaaccactcaggattctg

SEQ ID NO: 146321 - DNA, 20 bp, Artificial Sequence
  Description of Artificial Sequence: Synthetic oligonucleotide
  Target: ATXN1; (+) strand; PAM type: NRG; PAM sequence: AGG
caaaccactcaggattctga

SEQ ID NO: 146322 - DNA, 20 bp, Artificial Sequence
  Description of Artificial Sequence: Synthetic oligonucleotide
  Target: ATXN1; (+) strand; PAM type: NRG; PAM sequence: GGG
aaaccactcaggattctgaa

SEQ ID NO: 146323 - DNA, 20 bp, Artificial Sequence
  Description of Artificial Sequence: Synthetic oligonucleotide
  Target: ATXN1; (+) strand; PAM type: NRG; PAM sequence: TGG
caggattctgaagggaacac

SEQ ID NO: 146324 - DNA, 20 bp, Artificial Sequence
  Description of Artificial Sequence: Synthetic oligonucleotide
  Target: ATXN1; (+) strand; PAM type: NRG; PAM sequence: GGG
aggattctgaagggaacact

SEQ ID NO: 146325 - DNA, 20 bp, Artificial Sequence
  Description of Artificial Sequence: Synthetic oligonucleotide
  Target: ATXN1; (+) strand; PAM type: NRG; PAM sequence: TGG
ttctgaagggaacactgggt

SEQ ID NO: 146326 - DNA, 20 bp, Artificial Sequence
  Description of Artificial Sequence: Synthetic oligonucleotide
  Target: ATXN1; (+) strand; PAM type: NRG; PAM sequence: GGG
tctgaagggaacactgggtt

SEQ ID NO: 146327 - DNA, 20 bp, Artificial Sequence
  Description of Artificial Sequence: Synthetic oligonucleotide
  Target: ATXN1; (+) strand; PAM type: NRG; PAM sequence: TAG
ttgatgtttattatttgtct

SEQ ID NO: 146328 - DNA, 20 bp, Artificial Sequence
  Description of Artificial Sequence: Synthetic oligonucleotide
  Target: ATXN1; (+) strand; PAM type: NRG; PAM sequence: GAG
gatgtttattatttgtctta

SEQ ID NO: 146329 - DNA, 20 bp, Artificial Sequence
  Description of Artificial Sequence: Synthetic oligonucleotide
  Target: ATXN1; (+) strand; PAM type: NRG; PAM sequence: CGG
tttattatttgtcttagaga

SEQ ID NO: 146330 - DNA, 20 bp, Artificial Sequence
  Description of Artificial Sequence: Synthetic oligonucleotide
  Target: ATXN1; (+) strand; PAM type: NRG; PAM sequence: GGG
ttattatttgtcttagagac

SEQ ID NO: 146331 - DNA, 20 bp, Artificial Sequence
  Description of Artificial Sequence: Synthetic oligonucleotide
  Target: ATXN1; (+) strand; PAM type: NRG; PAM sequence: GGG
tattatttgtcttagagacg

SEQ ID NO: 146332 - DNA, 20 bp, Artificial Sequence
  Description of Artificial Sequence: Synthetic oligonucleotide
  Target: ATXN1; (+) strand; PAM type: NRG; PAM sequence: AAG
ggggtctcactatgttgccc

SEQ ID NO: 146333 - DNA, 20 bp, Artificial Sequence
  Description of Artificial Sequence: Synthetic oligonucleotide
  Target: ATXN1; (+) strand; PAM type: NRG; PAM sequence: TGG
tctcactatgttgcccaagt

SEQ ID NO: 146334 - DNA, 20 bp, Artificial Sequence
  Description of Artificial Sequence: Synthetic oligonucleotide
  Target: ATXN1; (+) strand; PAM type: NRG; PAM sequence: AAG
ggccttgaactcctctgctc

SEQ ID NO: 146335 - DNA, 20 bp, Artificial Sequence
  Description of Artificial Sequence: Synthetic oligonucleotide
  Target: ATXN1; (+) strand; PAM type: NRG; PAM sequence: TGG
cctctgctcaagtgaccctt

SEQ ID NO: 146336 - DNA, 20 bp, Artificial Sequence
  Description of Artificial Sequence: Synthetic oligonucleotide
  Target: ATXN1; (+) strand; PAM type: NRG; PAM sequence: TGG
tgctcaagtgaccctttggc

SEQ ID NO: 146337 - DNA, 20 bp, Artificial Sequence
  Description of Artificial Sequence: Synthetic oligonucleotide
  Target: ATXN1; (+) strand; PAM type: NRG; PAM sequence: GGG
gctcaagtgaccctttggct

SEQ ID NO: 146338 - DNA, 20 bp, Artificial Sequence
  Description of Artificial Sequence: Synthetic oligonucleotide
  Target: ATXN1; (+) strand; PAM type: NRG; PAM sequence: GAG
ccctttggctgggactgcat

SEQ ID NO: 146339 - DNA, 20 bp, Artificial Sequence
  Description of Artificial Sequence: Synthetic oligonucleotide
  Target: ATXN1; (+) strand; PAM type: NRG; PAM sequence: CAG
gcatgagcacaccactgcat

SEQ ID NO: 146340 - DNA, 20 bp, Artificial Sequence
  Description of Artificial Sequence: Synthetic oligonucleotide
  Target: ATXN1; (+) strand; PAM type: NRG; PAM sequence: AGG
catgagcacaccactgcatc

SEQ ID NO: 146341 - DNA, 20 bp, Artificial Sequence
  Description of Artificial Sequence: Synthetic oligonucleotide
  Target: ATXN1; (+) strand; PAM type: NRG; PAM sequence: CAG
accactgcatcaggctcatc

SEQ ID NO: 146342 - DNA, 20 bp, Artificial Sequence
  Description of Artificial Sequence: Synthetic oligonucleotide
  Target: ATXN1; (+) strand; PAM type: NRG; PAM sequence: GAG
tgcatcaggctcatccagtt

SEQ ID NO: 146343 - DNA, 20 bp, Artificial Sequence
  Description of Artificial Sequence: Synthetic oligonucleotide
  Target: ATXN1; (+) strand; PAM type: NRG; PAM sequence: AGG
gcatcaggctcatccagttg

SEQ ID NO: 146344 - DNA, 20 bp, Artificial Sequence
  Description of Artificial Sequence: Synthetic oligonucleotide
  Target: ATXN1; (+) strand; PAM type: NRG; PAM sequence: TGG
aatactgtttttgctctgat

SEQ ID NO: 146345 - DNA, 20 bp, Artificial Sequence
  Description of Artificial Sequence: Synthetic oligonucleotide
  Target: ATXN1; (+) strand; PAM type: NRG; PAM sequence: GGG
atactgtttttgctctgatt

SEQ ID NO: 146346 - DNA, 20 bp, Artificial Sequence
  Description of Artificial Sequence: Synthetic oligonucleotide
  Target: ATXN1; (+) strand; PAM type: NRG; PAM sequence: TAG
ctgtttttgctctgattggg

SEQ ID NO: 146347 - DNA, 20 bp, Artificial Sequence
  Description of Artificial Sequence: Synthetic oligonucleotide
  Target: ATXN1; (+) strand; PAM type: NRG; PAM sequence: AAG
gctctgattgggtagcctca

SEQ ID NO: 146348 - DNA, 20 bp, Artificial Sequence
  Description of Artificial Sequence: Synthetic oligonucleotide
  Target: ATXN1; (+) strand; PAM type: NRG; PAM sequence: GAG
tctgattgggtagcctcaaa

SEQ ID NO: 146349 - DNA, 20 bp, Artificial Sequence
  Description of Artificial Sequence: Synthetic oligonucleotide
  Target: ATXN1; (+) strand; PAM type: NRG; PAM sequence: AGG
ctgattgggtagcctcaaag

SEQ ID NO: 146350 - DNA, 20 bp, Artificial Sequence
  Description of Artificial Sequence: Synthetic oligonucleotide
  Target: ATXN1; (+) strand; PAM type: NRG; PAM sequence: GAG
gattgggtagcctcaaagag

SEQ ID NO: 146351 - DNA, 20 bp, Artificial Sequence
  Description of Artificial Sequence: Synthetic oligonucleotide
  Target: ATXN1; (+) strand; PAM type: NRG; PAM sequence: AGG
attgggtagcctcaaagagg

SEQ ID NO: 146352 - DNA, 20 bp, Artificial Sequence
  Description of Artificial Sequence: Synthetic oligonucleotide
  Target: ATXN1; (+) strand; PAM type: NRG; PAM sequence: AAG
gggtagcctcaaagaggagg

SEQ ID NO: 146353 - DNA, 20 bp, Artificial Sequence
  Description of Artificial Sequence: Synthetic oligonucleotide
  Target: ATXN1; (+) strand; PAM type: NRG; PAM sequence: GAG
gtagcctcaaagaggaggaa

SEQ ID NO: 146354 - DNA, 20 bp, Artificial Sequence
  Description of Artificial Sequence: Synthetic oligonucleotide
  Target: ATXN1; (+) strand; PAM type: NRG; PAM sequence: GAG
agcctcaaagaggaggaaga

SEQ ID NO: 146355 - DNA, 20 bp, Artificial Sequence
  Description of Artificial Sequence: Synthetic oligonucleotide
  Target: ATXN1; (+) strand; PAM type: NRG; PAM sequence: GAG
aggaggaagagagtcatgat

SEQ ID NO: 146356 - DNA, 20 bp, Artificial Sequence
  Description of Artificial Sequence: Synthetic oligonucleotide
  Target: ATXN1; (+) strand; PAM type: NRG; PAM sequence: CAG
gagtcatgatgagcttgatt

SEQ ID NO: 146357 - DNA, 20 bp, Artificial Sequence
  Description of Artificial Sequence: Synthetic oligonucleotide
  Target: ATXN1; (+) strand; PAM type: NRG; PAM sequence: CAG
tgagcttgattcagaatctt

SEQ ID NO: 146358 - DNA, 20 bp, Artificial Sequence
  Description of Artificial Sequence: Synthetic oligonucleotide
  Target: ATXN1; (+) strand; PAM type: NRG; PAM sequence: CAG
tcttcagctctccactctat

SEQ ID NO: 146359 - DNA, 20 bp, Artificial Sequence
  Description of Artificial Sequence: Synthetic oligonucleotide
  Target: ATXN1; (+) strand; PAM type: NRG; PAM sequence: AAG
tcagcaacctgccttccttc

SEQ ID NO: 146360 - DNA, 20 bp, Artificial Sequence
  Description of Artificial Sequence: Synthetic oligonucleotide
  Target: ATXN1; (+) strand; PAM type: NRG; PAM sequence: TGG
tgccttccttcaagtctact

SEQ ID NO: 146361 - DNA, 20 bp, Artificial Sequence
  Description of Artificial Sequence: Synthetic oligonucleotide
  Target: ATXN1; (+) strand; PAM type: NRG; PAM sequence: CAG
tccttcaagtctacttggcc

SEQ ID NO: 146362 - DNA, 20 bp, Artificial Sequence
  Description of Artificial Sequence: Synthetic oligonucleotide
  Target: ATXN1; (+) strand; PAM type: NRG; PAM sequence: TGG
tgctgttattcctcctccac

SEQ ID NO: 146363 - DNA, 20 bp, Artificial Sequence
  Description of Artificial Sequence: Synthetic oligonucleotide
  Target: ATXN1; (+) strand; PAM type: NRG; PAM sequence: TAG
attcctcctccactggcaac

SEQ ID NO: 146364 - DNA, 20 bp, Artificial Sequence
  Description of Artificial Sequence: Synthetic oligonucleotide
  Target: ATXN1; (+) strand; PAM type: NRG; PAM sequence: GAG
ccactggcaactagatgtgt

SEQ ID NO: 146365 - DNA, 20 bp, Artificial Sequence
  Description of Artificial Sequence: Synthetic oligonucleotide
  Target: ATXN1; (+) strand; PAM type: NRG; PAM sequence: CAG
gtgacattgattcctattac

SEQ ID NO: 146366 - DNA, 20 bp, Artificial Sequence
  Description of Artificial Sequence: Synthetic oligonucleotide
  Target: ATXN1; (+) strand; PAM type: NRG; PAM sequence: GAG
gacattgattcctattacca

SEQ ID NO: 146367 - DNA, 20 bp, Artificial Sequence
  Description of Artificial Sequence: Synthetic oligonucleotide
  Target: ATXN1; (+) strand; PAM type: NRG; PAM sequence: AGG
acattgattcctattaccag

SEQ ID NO: 146368 - DNA, 20 bp, Artificial Sequence
  Description of Artificial Sequence: Synthetic oligonucleotide
  Target: ATXN1; (+) strand; PAM type: NRG; PAM sequence: GGG
cattgattcctattaccaga

SEQ ID NO: 146369 - DNA, 20 bp, Artificial Sequence
  Description of Artificial Sequence: Synthetic oligonucleotide
  Target: ATXN1; (+) strand; PAM type: NRG; PAM sequence: AAG
taccagagggattaactcca

SEQ ID NO: 146370 - DNA, 20 bp, Artificial Sequence
  Description of Artificial Sequence: Synthetic oligonucleotide
  Target: ATXN1; (+) strand; PAM type: NRG; PAM sequence: AAG
ttaactccaaagttctcttg

SEQ ID NO: 146371 - DNA, 20 bp, Artificial Sequence
  Description of Artificial Sequence: Synthetic oligonucleotide
  Target: ATXN1; (+) strand; PAM type: NRG; PAM sequence: AGG
taactccaaagttctcttga

SEQ ID NO: 146372 - DNA, 20 bp, Artificial Sequence
  Description of Artificial Sequence: Synthetic oligonucleotide
  Target: ATXN1; (+) strand; PAM type: NRG; PAM sequence: CAG
aagttctcttgaaggtttta

SEQ ID NO: 146373 - DNA, 20 bp, Artificial Sequence
  Description of Artificial Sequence: Synthetic oligonucleotide
  Target: ATXN1; (+) strand; PAM type: NRG; PAM sequence: CAG
aaggttttacagttcttttc

SEQ ID NO: 146374 - DNA, 20 bp, Artificial Sequence
  Description of Artificial Sequence: Synthetic oligonucleotide
  Target: ATXN1; (+) strand; PAM type: NRG; PAM sequence: CAG
gttttacagttcttttccag

SEQ ID NO: 146375 - DNA, 20 bp, Artificial Sequence
  Description of Artificial Sequence: Synthetic oligonucleotide
  Target: ATXN1; (+) strand; PAM type: NRG; PAM sequence: AAG
cagcagttcctcattcttca

SEQ ID NO: 146376 - DNA, 20 bp, Artificial Sequence
  Description of Artificial Sequence: Synthetic oligonucleotide
  Target: ATXN1; (+) strand; PAM type: NRG; PAM sequence: AGG
agcagttcctcattcttcaa

SEQ ID NO: 146377 - DNA, 20 bp, Artificial Sequence
  Description of Artificial Sequence: Synthetic oligonucleotide
  Target: ATXN1; (+) strand; PAM type: NRG; PAM sequence: TGG
aaaggtaattaacctcttga

SEQ ID NO: 146378 - DNA, 20 bp, Artificial Sequence
  Description of Artificial Sequence: Synthetic oligonucleotide
  Target: ATXN1; (+) strand; PAM type: NRG; PAM sequence: GGG
aaggtaattaacctcttgat

SEQ ID NO: 146379 - DNA, 20 bp, Artificial Sequence
  Description of Artificial Sequence: Synthetic oligonucleotide
  Target: ATXN1; (+) strand; PAM type: NRG; PAM sequence: CAG
ttaacctcttgatgggctta

SEQ ID NO: 146380 - DNA, 20 bp, Artificial Sequence
  Description of Artificial Sequence: Synthetic oligonucleotide
  Target: ATXN1; (+) strand; PAM type: NRG; PAM sequence: CAG
acctcttgatgggcttacag

SEQ ID NO: 146381 - DNA, 20 bp, Artificial Sequence
  Description of Artificial Sequence: Synthetic oligonucleotide
  Target: ATXN1; (+) strand; PAM type: NRG; PAM sequence: AAG
tcttgatgggcttacagcag

SEQ ID NO: 146382 - DNA, 20 bp, Artificial Sequence
  Description of Artificial Sequence: Synthetic oligonucleotide
  Target: ATXN1; (+) strand; PAM type: NRG; PAM sequence: CAG
tgatgggcttacagcagaag

SEQ ID NO: 146383 - DNA, 20 bp, Artificial Sequence
  Description of Artificial Sequence: Synthetic oligonucleotide
  Target: ATXN1; (+) strand; PAM type: NRG; PAM sequence: TAG
gcttacagcagaagcagtgt

SEQ ID NO: 146384 - DNA, 20 bp, Artificial Sequence
  Description of Artificial Sequence: Synthetic oligonucleotide
  Target: ATXN1; (+) strand; PAM type: NRG; PAM sequence: AAG
tacagcagaagcagtgttag

SEQ ID NO: 146385 - DNA, 20 bp, Artificial Sequence
  Description of Artificial Sequence: Synthetic oligonucleotide
  Target: ATXN1; (+) strand; PAM type: NRG; PAM sequence: CAG
attgatgatatgttataaac

SEQ ID NO: 146386 - DNA, 20 bp, Artificial Sequence
  Description of Artificial Sequence: Synthetic oligonucleotide
  Target: ATXN1; (+) strand; PAM type: NRG; PAM sequence: AGG
ttgatgatatgttataaacc

SEQ ID NO: 146387 - DNA, 20 bp, Artificial Sequence
  Description of Artificial Sequence: Synthetic oligonucleotide
  Target: ATXN1; (+) strand; PAM type: NRG; PAM sequence: GGG
tgatgatatgttataaacca

SEQ ID NO: 146388 - DNA, 20 bp, Artificial Sequence
  Description of Artificial Sequence: Synthetic oligonucleotide
  Target: ATXN1; (+) strand; PAM type: NRG; PAM sequence: GGG
gatgatatgttataaaccag

SEQ ID NO: 146389 - DNA, 20 bp, Artificial Sequence
  Description of Artificial Sequence: Synthetic oligonucleotide
  Target: ATXN1; (+) strand; PAM type: NRG; PAM sequence: GAG
tgatatgttataaaccaggg

SEQ ID NO: 146390 - DNA, 20 bp, Artificial Sequence
  Description of Artificial Sequence: Synthetic oligonucleotide
  Target: ATXN1; (+) strand; PAM type: NRG; PAM sequence: GAG
atatgttataaaccagggga

SEQ ID NO: 146391 - DNA, 20 bp, Artificial Sequence
  Description of Artificial Sequence: Synthetic oligonucleotide
  Target: ATXN1; (+) strand; PAM type: NRG; PAM sequence: AGG
tatgttataaaccaggggag

SEQ ID NO: 146392 - DNA, 20 bp, Artificial Sequence
  Description of Artificial Sequence: Synthetic oligonucleotide
  Target: ATXN1; (+) strand; PAM type: NRG; PAM sequence: TGG
aaaccaggggagaggataat

SEQ ID NO: 146393 - DNA, 20 bp, Artificial Sequence
  Description of Artificial Sequence: Synthetic oligonucleotide
  Target: ATXN1; (+) strand; PAM type: NRG; PAM sequence: CAG
ataattggaaaatgtatttc

SEQ ID NO: 146394 - DNA, 20 bp, Artificial Sequence
  Description of Artificial Sequence: Synthetic oligonucleotide
  Target: ATXN1; (+) strand; PAM type: NRG; PAM sequence: TGG
aaatgtatttccagcctcat

SEQ ID NO: 146395 - DNA, 20 bp, Artificial Sequence
  Description of Artificial Sequence: Synthetic oligonucleotide
  Target: ATXN1; (+) strand; PAM type: NRG; PAM sequence: GAG
aaaatatatttccatttatt

SEQ ID NO: 146396 - DNA, 20 bp, Artificial Sequence
  Description of Artificial Sequence: Synthetic oligonucleotide
  Target: ATXN1; (+) strand; PAM type: NRG; PAM sequence: AAG
tatttccatttattgagaaa

SEQ ID NO: 146397 - DNA, 20 bp, Artificial Sequence
  Description of Artificial Sequence: Synthetic oligonucleotide
  Target: ATXN1; (+) strand; PAM type: NRG; PAM sequence: AAG
ttattgagaaaaagtaactc

SEQ ID NO: 146398 - DNA, 20 bp, Artificial Sequence
  Description of Artificial Sequence: Synthetic oligonucleotide
  Target: ATXN1; (+) strand; PAM type: NRG; PAM sequence: TAG
gaaaaagtaactcaagtgtt

SEQ ID NO: 146399 - DNA, 20 bp, Artificial Sequence
  Description of Artificial Sequence: Synthetic oligonucleotide
  Target: ATXN1; (+) strand; PAM type: NRG; PAM sequence: AGG
aaaaagtaactcaagtgttt

SEQ ID NO: 146400 - DNA, 20 bp, Artificial Sequence
  Description of Artificial Sequence: Synthetic oligonucleotide
  Target: ATXN1; (+) strand; PAM type: NRG; PAM sequence: CAG
gtttaggaacatatgaatca

SEQ ID NO: 146401 - DNA, 20 bp, Artificial Sequence
  Description of Artificial Sequence: Synthetic oligonucleotide
  Target: ATXN1; (+) strand; PAM type: NRG; PAM sequence: TAG
acatatgaatcacagaattg

SEQ ID NO: 146402 - DNA, 20 bp, Artificial Sequence
  Description of Artificial Sequence: Synthetic oligonucleotide
  Target: ATXN1; (+) strand; PAM type: NRG; PAM sequence: TGG
tgaatcacagaattgtagat

SEQ ID NO: 146403 - DNA, 20 bp, Artificial Sequence
  Description of Artificial Sequence: Synthetic oligonucleotide
  Target: ATXN1; (+) strand; PAM type: NRG; PAM sequence: CAG
atcacagaattgtagattgg

SEQ ID NO: 146404 - DNA, 20 bp, Artificial Sequence
  Description of Artificial Sequence: Synthetic oligonucleotide
  Target: ATXN1; (+) strand; PAM type: NRG; PAM sequence: GAG
cacagaattgtagattggca

SEQ ID NO: 146405 - DNA, 20 bp, Artificial Sequence
  Description of Artificial Sequence: Synthetic oligonucleotide
  Target: ATXN1; (+) strand; PAM type: NRG; PAM sequence: AGG
acagaattgtagattggcag

SEQ ID NO: 146406 - DNA, 20 bp, Artificial Sequence
  Description of Artificial Sequence: Synthetic oligonucleotide
  Target: ATXN1; (+) strand; PAM type: NRG; PAM sequence: TAG
ttgtagattggcagaggcct

SEQ ID NO: 146407 - DNA, 20 bp, Artificial Sequence
  Description of Artificial Sequence: Synthetic oligonucleotide
  Target: ATXN1; (+) strand; PAM type: NRG; PAM sequence: GAG
tttcgacttctactaataat

SEQ ID NO: 146408 - DNA, 20 bp, Artificial Sequence
  Description of Artificial Sequence: Synthetic oligonucleotide
  Target: ATXN1; (+) strand; PAM type: NRG; PAM sequence: CGG
ttctactaataatgagaaaa

SEQ ID NO: 146409 - DNA, 20 bp, Artificial Sequence
  Description of Artificial Sequence: Synthetic oligonucleotide
  Target: ATXN1; (+) strand; PAM type: NRG; PAM sequence: GAG
ctactaataatgagaaaacg

SEQ ID NO: 146410 - DNA, 20 bp, Artificial Sequence
  Description of Artificial Sequence: Synthetic oligonucleotide
  Target: ATXN1; (+) strand; PAM type: NRG; PAM sequence: AGG
tactaataatgagaaaacgg

SEQ ID NO: 146411 - DNA, 20 bp, Artificial Sequence
  Description of Artificial Sequence: Synthetic oligonucleotide
  Target: ATXN1; (+) strand; PAM type: NRG; PAM sequence: TGG
taataatgagaaaacggagg

SEQ ID NO: 146412 - DNA, 20 bp, Artificial Sequence
  Description of Artificial Sequence: Synthetic oligonucleotide
  Target: ATXN1; (+) strand; PAM type: NRG; PAM sequence: AAG
aatgagaaaacggaggtgga

SEQ ID NO: 146413 - DNA, 20 bp, Artificial Sequence
  Description of Artificial Sequence: Synthetic oligonucleotide
  Target: ATXN1; (+) strand; PAM type: NRG; PAM sequence: GAG
tgagaaaacggaggtggaaa

SEQ ID NO: 146414 - DNA, 20 bp, Artificial Sequence
  Description of Artificial Sequence: Synthetic oligonucleotide
  Target: ATXN1; (+) strand; PAM type: NRG; PAM sequence: AGG
gagaaaacggaggtggaaag

SEQ ID NO: 146415 - DNA, 20 bp, Artificial Sequence
  Description of Artificial Sequence: Synthetic oligonucleotide
  Target: ATXN1; (+) strand; PAM type: NRG; PAM sequence: GGG
agaaaacggaggtggaaaga

SEQ ID NO: 146416 - DNA, 20 bp, Artificial Sequence
  Description of Artificial Sequence: Synthetic oligonucleotide
  Target: ATXN1; (+) strand; PAM type: NRG; PAM sequence: GAG
aaaacggaggtggaaagagg

SEQ ID NO: 146417 - DNA, 20 bp, Artificial Sequence
  Description of Artificial Sequence: Synthetic oligonucleotide
  Target: ATXN1; (+) strand; PAM type: NRG; PAM sequence: GAG
aacggaggtggaaagaggga

SEQ ID NO: 146418 - DNA, 20 bp, Artificial Sequence
  Description of Artificial Sequence: Synthetic oligonucleotide
  Target: ATXN1; (+) strand; PAM type: NRG; PAM sequence: GAG
aagagggagagtgacctgcc

SEQ ID NO: 146419 - DNA, 20 bp, Artificial Sequence
  Description of Artificial Sequence: Synthetic oligonucleotide
  Target: ATXN1; (+) strand; PAM type: NRG; PAM sequence: CAG
gagagtgacctgccgagcca

SEQ ID NO: 146420 - DNA, 20 bp, Artificial Sequence
  Description of Artificial Sequence: Synthetic oligonucleotide
  Target: ATXN1; (+) strand; PAM type: NRG; PAM sequence: CAG
ccgagccacagttacccaac

SEQ ID NO: 146421 - DNA, 20 bp, Artificial Sequence
  Description of Artificial Sequence: Synthetic oligonucleotide
  Target: ATXN1; (+) strand; PAM type: NRG; PAM sequence: TAG
ttacccaaccagcaccaatg

SEQ ID NO: 146422 - DNA, 20 bp, Artificial Sequence
  Description of Artificial Sequence: Synthetic oligonucleotide
  Target: ATXN1; (+) strand; PAM type: NRG; PAM sequence: CAG
ccaaccagcaccaatgtagt

SEQ ID NO: 146423 - DNA, 20 bp, Artificial Sequence
  Description of Artificial Sequence: Synthetic oligonucleotide
  Target: ATXN1; (+) strand; PAM type: NRG; PAM sequence: TGG
ccaatgtagtcagtgctgcc

SEQ ID NO: 146424 - DNA, 20 bp, Artificial Sequence
  Description of Artificial Sequence: Synthetic oligonucleotide
  Target: ATXN1; (+) strand; PAM type: NRG; PAM sequence: GAG
aatgtagtcagtgctgcctg

SEQ ID NO: 146425 - DNA, 20 bp, Artificial Sequence
  Description of Artificial Sequence: Synthetic oligonucleotide
  Target: ATXN1; (+) strand; PAM type: NRG; PAM sequence: GAG
tagtcagtgctgcctggagc

SEQ ID NO: 146426 - DNA, 20 bp, Artificial Sequence
  Description of Artificial Sequence: Synthetic oligonucleotide
  Target: ATXN1; (+) strand; PAM type: NRG; PAM sequence: TGG
agcgagacctgaccatactg

SEQ ID NO: 146427 - DNA, 20 bp, Artificial Sequence
  Description of Artificial Sequence: Synthetic oligonucleotide
  Target: ATXN1; (+) strand; PAM type: NRG; PAM sequence: GGG
gcgagacctgaccatactgt

SEQ ID NO: 146428 - DNA, 20 bp, Artificial Sequence
  Description of Artificial Sequence: Synthetic oligonucleotide
  Target: ATXN1; (+) strand; PAM type: NRG; PAM sequence: GGG
cgagacctgaccatactgtg

SEQ ID NO: 146429 - DNA, 20 bp, Artificial Sequence
  Description of Artificial Sequence: Synthetic oligonucleotide
  Target: ATXN1; (+) strand; PAM type: NRG; PAM sequence: CAG
gacctgaccatactgtgggg

SEQ ID NO: 146430 - DNA, 20 bp, Artificial Sequence
  Description of Artificial Sequence: Synthetic oligonucleotide
  Target: ATXN1; (+) strand; PAM type: NRG; PAM sequence: AAG
cccctccaatccccttcata

SEQ ID NO: 146431 - DNA, 20 bp, Artificial Sequence
  Description of Artificial Sequence: Synthetic oligonucleotide
  Target: ATXN1; (+) strand; PAM type: NRG; PAM sequence: TAG
caacctgtgcctcctgtcct

SEQ ID NO: 146432 - DNA, 20 bp, Artificial Sequence
  Description of Artificial Sequence: Synthetic oligonucleotide
  Target: ATXN1; (+) strand; PAM type: NRG; PAM sequence: GAG
acctgtgcctcctgtcctta

SEQ ID NO: 146433 - DNA, 20 bp, Artificial Sequence
  Description of Artificial Sequence: Synthetic oligonucleotide
  Target: ATXN1; (+) strand; PAM type: NRG; PAM sequence: CAG
gcctcctgtccttagagccc

SEQ ID NO: 146434 - DNA, 20 bp, Artificial Sequence
  Description of Artificial Sequence: Synthetic oligonucleotide
  Target: ATXN1; (+) strand; PAM type: NRG; PAM sequence: TAG
tagagccccagatttcattt

SEQ ID NO: 146435 - DNA, 20 bp, Artificial Sequence
  Description of Artificial Sequence: Synthetic oligonucleotide
  Target: ATXN1; (+) strand; PAM type: NRG; PAM sequence: AGG
agagccccagatttcatttt

SEQ ID NO: 146436 - DNA, 20 bp, Artificial Sequence
  Description of Artificial Sequence: Synthetic oligonucleotide
  Target: ATXN1; (+) strand; PAM type: NRG; PAM sequence: GAG
agccccagatttcattttag

SEQ ID NO: 146437 - DNA, 20 bp, Artificial Sequence
  Description of Artificial Sequence: Synthetic oligonucleotide
  Target: ATXN1; (+) strand; PAM type: NRG; PAM sequence: GAG
ccccagatttcattttagga

SEQ ID NO: 146438 - DNA, 20 bp, Artificial Sequence
  Description of Artificial Sequence: Synthetic oligonucleotide
  Target: ATXN1; (+) strand; PAM type: NRG; PAM sequence: AGG
cccagatttcattttaggag

SEQ ID NO: 146439 - DNA, 20 bp, Artificial Sequence
  Description of Artificial Sequence: Synthetic oligonucleotide
  Target: ATXN1; (+) strand; PAM type: NRG; PAM sequence: AAG
aggattacgaaataatgact

SEQ ID NO: 146440 - DNA, 20 bp, Artificial Sequence
  Description of Artificial Sequence: Synthetic oligonucleotide
  Target: ATXN1; (+) strand; PAM type: NRG; PAM sequence: GAG
atgactaagctctgaaaact

SEQ ID NO: 146441 - DNA, 20 bp, Artificial Sequence
  Description of Artificial Sequence: Synthetic oligonucleotide
  Target: ATXN1; (+) strand; PAM type: NRG; PAM sequence: GAG
aagctctgaaaactgagaat

SEQ ID NO: 146442 - DNA, 20 bp, Artificial Sequence
  Description of Artificial Sequence: Synthetic oligonucleotide
  Target: ATXN1; (+) strand; PAM type: NRG; PAM sequence: AAG
tgaaaactgagaatgagaca

SEQ ID NO: 146443 - DNA, 20 bp, Artificial Sequence
  Description of Artificial Sequence: Synthetic oligonucleotide
  Target: ATXN1; (+) strand; PAM type: NRG; PAM sequence: AGG
gaaaactgagaatgagacaa

SEQ ID NO: 146444 - DNA, 20 bp, Artificial Sequence
  Description of Artificial Sequence: Synthetic oligonucleotide
  Target: ATXN1; (+) strand; PAM type: NRG; PAM sequence: AAG
aactgagaatgagacaaagg

SEQ ID NO: 146445 - DNA, 20 bp, Artificial Sequence
  Description of Artificial Sequence: Synthetic oligonucleotide
  Target: ATXN1; (+) strand; PAM type: NRG; PAM sequence: AAG
gagaatgagacaaaggaaga

SEQ ID NO: 146446 - DNA, 20 bp, Artificial Sequence
  Description of Artificial Sequence: Synthetic oligonucleotide
  Target: ATXN1; (+) strand; PAM type: NRG; PAM sequence: AGG
agaatgagacaaaggaagaa

SEQ ID NO: 146447 - DNA, 20 bp, Artificial Sequence
  Description of Artificial Sequence: Synthetic oligonucleotide
  Target: ATXN1; (+) strand; PAM type: NRG; PAM sequence: GGG
gaatgagacaaaggaagaaa

SEQ ID NO: 146448 - DNA, 20 bp, Artificial Sequence
  Description of Artificial Sequence: Synthetic oligonucleotide
  Target: ATXN1; (+) strand; PAM type: NRG; PAM sequence: GAG
atgagacaaaggaagaaagg

SEQ ID NO: 146449 - DNA, 20 bp, Artificial Sequence
  Description of Artificial Sequence: Synthetic oligonucleotide
  Target: ATXN1; (+) strand; PAM type: NRG; PAM sequence: AAG
acaaaggaagaaagggagat

SEQ ID NO: 146450 - DNA, 20 bp, Artificial Sequence
  Description of Artificial Sequence: Synthetic oligonucleotide
  Target: ATXN1; (+) strand; PAM type: NRG; PAM sequence: AAG
aaggaagaaagggagataag

SEQ ID NO: 146451 - DNA, 20 bp, Artificial Sequence
  Description of Artificial Sequence: Synthetic oligonucleotide
  Target: ATXN1; (+) strand; PAM type: NRG; PAM sequence: AGG
aggaagaaagggagataaga

SEQ ID NO: 146452 - DNA, 20 bp, Artificial Sequence
  Description of Artificial Sequence: Synthetic oligonucleotide
  Target: ATXN1; (+) strand; PAM type: NRG; PAM sequence: AAG
aagaaagggagataagaagg

SEQ ID NO: 146453 - DNA, 20 bp, Artificial Sequence
  Description of Artificial Sequence: Synthetic oligonucleotide
  Target: ATXN1; (+) strand; PAM type: NRG; PAM sequence: CAG
aagggagataagaaggaaga

SEQ ID NO: 146454 - DNA, 20 bp, Artificial Sequence
  Description of Artificial Sequence: Synthetic oligonucleotide
  Target: ATXN1; (+) strand; PAM type: NRG; PAM sequence: AAG
gagataagaaggaagacagt

SEQ ID NO: 146455 - DNA, 20 bp, Artificial Sequence
  Description of Artificial Sequence: Synthetic oligonucleotide
  Target: ATXN1; (+) strand; PAM type: NRG; PAM sequence: GAG
gataagaaggaagacagtaa

SEQ ID NO: 146456 - DNA, 20 bp, Artificial Sequence
  Description of Artificial Sequence: Synthetic oligonucleotide
  Target: ATXN1; (+) strand; PAM type: NRG; PAM sequence: GAG
taagaaggaagacagtaaga

SEQ ID NO: 146457 - DNA, 20 bp, Artificial Sequence
  Description of Artificial Sequence: Synthetic oligonucleotide
  Target: ATXN1; (+) strand; PAM type: NRG; PAM sequence: AAG
aagacagtaagagagtcaac

SEQ ID NO: 146458 - DNA, 20 bp, Artificial Sequence
  Description of Artificial Sequence: Synthetic oligonucleotide
  Target: ATXN1; (+) strand; PAM type: NRG; PAM sequence: TAG
agtcaacaagcaacttattg

SEQ ID NO: 146459 - DNA, 20 bp, Artificial Sequence
  Description of Artificial Sequence: Synthetic oligonucleotide
  Target: ATXN1; (+) strand; PAM type: NRG; PAM sequence: CAG
aaccaccttcatgcattctg

SEQ ID NO: 146460 - DNA, 20 bp, Artificial Sequence
  Description of Artificial Sequence: Synthetic oligonucleotide
  Target: ATXN1; (+) strand; PAM type: NRG; PAM sequence: AAG
tcatgcattctgcagtgaaa

SEQ ID NO: 146461 - DNA, 20 bp, Artificial Sequence
  Description of Artificial Sequence: Synthetic oligonucleotide
  Target: ATXN1; (+) strand; PAM type: NRG; PAM sequence: TGG
gcattctgcagtgaaaaaga

SEQ ID NO: 146462 - DNA, 20 bp, Artificial Sequence
  Description of Artificial Sequence: Synthetic oligonucleotide
  Target: ATXN1; (+) strand; PAM type: NRG; PAM sequence: CAG
tgcagtgaaaaagatggtgc

SEQ ID NO: 146463 - DNA, 20 bp, Artificial Sequence
  Description of Artificial Sequence: Synthetic oligonucleotide
  Target: ATXN1; (+) strand; PAM type: NRG; PAM sequence: AGG
gcagtgaaaaagatggtgcc

SEQ ID NO: 146464 - DNA, 20 bp, Artificial Sequence
  Description of Artificial Sequence: Synthetic oligonucleotide
  Target: ATXN1; (+) strand; PAM type: NRG; PAM sequence: TGG
tgaaaaagatggtgccaggt

SEQ ID NO: 146465 - DNA, 20 bp, Artificial Sequence
  Description of Artificial Sequence: Synthetic oligonucleotide
  Target: ATXN1; (+) strand; PAM type: NRG; PAM sequence: AAG
ccaggttggaatttcattgt

SEQ ID NO: 146466 - DNA, 20 bp, Artificial Sequence
  Description of Artificial Sequence: Synthetic oligonucleotide
  Target: ATXN1; (+) strand; PAM type: NRG; PAM sequence: CAG
gaatttcattgtaagtgtcg

SEQ ID NO: 146467 - DNA, 20 bp, Artificial Sequence
  Description of Artificial Sequence: Synthetic oligonucleotide
  Target: ATXN1; (+) strand; PAM type: NRG; PAM sequence: TGG
gtgtcgcagaaatatccctt

SEQ ID NO: 146468 - DNA, 20 bp, Artificial Sequence
  Description of Artificial Sequence: Synthetic oligonucleotide
  Target: ATXN1; (+) strand; PAM type: NRG; PAM sequence: CAG
cagaaatatccctttggaat

SEQ ID NO: 146469 - DNA, 20 bp, Artificial Sequence
  Description of Artificial Sequence: Synthetic oligonucleotide
  Target: ATXN1; (+) strand; PAM type: NRG; PAM sequence: AGG
agaaatatccctttggaatc

SEQ ID NO: 146470 - DNA, 20 bp, Artificial Sequence
  Description of Artificial Sequence: Synthetic oligonucleotide
  Target: ATXN1; (+) strand; PAM type: NRG; PAM sequence: TGG
attgtcatcatcgtgtatca

SEQ ID NO: 146471 - DNA, 20 bp, Artificial Sequence
  Description of Artificial Sequence: Synthetic oligonucleotide
  Target: ATXN1; (+) strand; PAM type: NRG; PAM sequence: AAG
catcatcgtgtatcatggca

SEQ ID NO: 146472 - DNA, 20 bp, Artificial Sequence
  Description of Artificial Sequence: Synthetic oligonucleotide
  Target: ATXN1; (+) strand; PAM type: NRG; PAM sequence: GAG
gtatcatggcaaagctccct

SEQ ID NO: 146473 - DNA, 20 bp, Artificial Sequence
  Description of Artificial Sequence: Synthetic oligonucleotide
  Target: ATXN1; (+) strand; PAM type: NRG; PAM sequence: AGG
tatcatggcaaagctccctg

SEQ ID NO: 146474 - DNA, 20 bp, Artificial Sequence
  Description of Artificial Sequence: Synthetic oligonucleotide
  Target: ATXN1; (+) strand; PAM type: NRG; PAM sequence: GGG
atcatggcaaagctccctga

SEQ ID NO: 146475 - DNA, 20 bp, Artificial Sequence
  Description of Artificial Sequence: Synthetic oligonucleotide
  Target: ATXN1; (+) strand; PAM type: NRG; PAM sequence: GGG
tcatggcaaagctccctgag

SEQ ID NO: 146476 - DNA, 20 bp, Artificial Sequence
  Description of Artificial Sequence: Synthetic oligonucleotide
  Target: ATXN1; (+) strand; PAM type: NRG; PAM sequence: GAG
atggcaaagctccctgaggg

SEQ ID NO: 146477 - DNA, 20 bp, Artificial Sequence
  Description of Artificial Sequence: Synthetic oligonucleotide
  Target: ATXN1; (+) strand; PAM type: NRG; PAM sequence: AGG
tggcaaagctccctgagggg

SEQ ID NO: 146478 - DNA, 20 bp, Artificial Sequence
  Description of Artificial Sequence: Synthetic oligonucleotide
  Target: ATXN1; (+) strand; PAM type: NRG; PAM sequence: GAG
gcaaagctccctgaggggag

SEQ ID NO: 146479 - DNA, 20 bp, Artificial Sequence
  Description of Artificial Sequence: Synthetic oligonucleotide
  Target: ATXN1; (+) strand; PAM type: NRG; PAM sequence: CGG
tatcatattccttacaccta

SEQ ID NO: 146480 - DNA, 20 bp, Artificial Sequence
  Description of Artificial Sequence: Synthetic oligonucleotide
  Target: ATXN1; (+) strand; PAM type: NRG; PAM sequence: TGG
ccttacacctacggcatcca

SEQ ID NO: 146481 - DNA, 20 bp, Artificial Sequence
  Description of Artificial Sequence: Synthetic oligonucleotide
  Target: ATXN1; (+) strand; PAM type: NRG; PAM sequence: GGG
cttacacctacggcatccat

SEQ ID NO: 146482 - DNA, 20 bp, Artificial Sequence
  Description of Artificial Sequence: Synthetic oligonucleotide
  Target: ATXN1; (+) strand; PAM type: NRG; PAM sequence: AAG
acctacggcatccatgggac

SEQ ID NO: 146483 - DNA, 20 bp, Artificial Sequence
  Description of Artificial Sequence: Synthetic oligonucleotide
  Target: ATXN1; (+) strand; PAM type: NRG; PAM sequence: AAG
cggcatccatgggacaagct

SEQ ID NO: 146484 - DNA, 20 bp, Artificial Sequence
  Description of Artificial Sequence: Synthetic oligonucleotide
  Target: ATXN1; (+) strand; PAM type: NRG; PAM sequence: AAG
agctaagtaaaatttactga

SEQ ID NO: 146485 - DNA, 20 bp, Artificial Sequence
  Description of Artificial Sequence: Synthetic oligonucleotide
  Target: ATXN1; (+) strand; PAM type: NRG; PAM sequence: AGG
gctaagtaaaatttactgaa

SEQ ID NO: 146486 - DNA, 20 bp, Artificial Sequence
  Description of Artificial Sequence: Synthetic oligonucleotide
  Target: ATXN1; (+) strand; PAM type: NRG; PAM sequence: TGG
gctgaataaaaacttccaca

SEQ ID NO: 146487 - DNA, 20 bp, Artificial Sequence
  Description of Artificial Sequence: Synthetic oligonucleotide
  Target: ATXN1; (+) strand; PAM type: NRG; PAM sequence: AAG
aaaaacttccacatggaatg

SEQ ID NO: 146488 - DNA, 20 bp, Artificial Sequence
  Description of Artificial Sequence: Synthetic oligonucleotide
  Target: ATXN1; (+) strand; PAM type: NRG; PAM sequence: AAG
aacttccacatggaatgaag

SEQ ID NO: 146489 - DNA, 20 bp, Artificial Sequence
  Description of Artificial Sequence: Synthetic oligonucleotide
  Target: ATXN1; (+) strand; PAM type: NRG; PAM sequence: TAG
gaatgaagaagaaatatgca

SEQ ID NO: 146490 - DNA, 20 bp, Artificial Sequence
  Description of Artificial Sequence: Synthetic oligonucleotide
  Target: ATXN1; (+) strand; PAM type: NRG; PAM sequence: CAG
atagtttgaaaatgcatatg

SEQ ID NO: 146491 - DNA, 20 bp, Artificial Sequence
  Description of Artificial Sequence: Synthetic oligonucleotide
  Target: ATXN1; (+) strand; PAM type: NRG; PAM sequence: CAG
aaaatgcatatgcagtatta

SEQ ID NO: 146492 - DNA, 20 bp, Artificial Sequence
  Description of Artificial Sequence: Synthetic oligonucleotide
  Target: ATXN1; (+) strand; PAM type: NRG; PAM sequence: AAG
cagtattacagttttctgta

SEQ ID NO: 146493 - DNA, 20 bp, Artificial Sequence
  Description of Artificial Sequence: Synthetic oligonucleotide
  Target: ATXN1; (+) strand; PAM type: NRG; PAM sequence: AGG
agtattacagttttctgtaa

SEQ ID NO: 146494 - DNA, 20 bp, Artificial Sequence
  Description of Artificial Sequence: Synthetic oligonucleotide
  Target: ATXN1; (+) strand; PAM type: NRG; PAM sequence: AAG
ttttctgtaaaggaaaatga

SEQ ID NO: 146495 - DNA, 20 bp, Artificial Sequence
  Description of Artificial Sequence: Synthetic oligonucleotide
  Target: ATXN1; (+) strand; PAM type: NRG; PAM sequence: AAG
tctgtaaaggaaaatgaaag

SEQ ID NO: 146496 - DNA, 20 bp, Artificial Sequence
  Description of Artificial Sequence: Synthetic oligonucleotide
  Target: ATXN1; (+) strand; PAM type: NRG; PAM sequence: AAG
aaaatttaaaaccacattaa

SEQ ID NO: 146497 - DNA, 20 bp, Artificial Sequence
  Description of Artificial Sequence: Synthetic oligonucleotide
  Target: ATXN1; (+) strand; PAM type: NRG; PAM sequence: GAG
taaaaccacattaaaagatt

SEQ ID NO: 146498 - DNA, 20 bp, Artificial Sequence
  Description of Artificial Sequence: Synthetic oligonucleotide
  Target: ATXN1; (+) strand; PAM type: NRG; PAM sequence: GAG
aaaccacattaaaagattga

SEQ ID NO: 146499 - DNA, 20 bp, Artificial Sequence
  Description of Artificial Sequence: Synthetic oligonucleotide
  Target: ATXN1; (+) strand; PAM type: NRG; PAM sequence: AAG
gagttttttgtatttataaa

SEQ ID NO: 146500 - DNA, 20 bp, Artificial Sequence
  Description of Artificial Sequence: Synthetic oligonucleotide
  Target: ATXN1; (+) strand; PAM type: NRG; PAM sequence: GAG
ttttgtatttataaaaagct

SEQ ID NO: 146501 - DNA, 20 bp, Artificial Sequence
  Description of Artificial Sequence: Synthetic oligonucleotide
  Target: ATXN1; (+) strand; PAM type: NRG; PAM sequence: AGG
tttgtatttataaaaagctg

SEQ ID NO: 146502 - DNA, 20 bp, Artificial Sequence
  Description of Artificial Sequence: Synthetic oligonucleotide
  Target: ATXN1; (+) strand; PAM type: NRG; PAM sequence: TGG
aagctgaggtatgttaaaaa

SEQ ID NO: 146503 - DNA, 20 bp, Artificial Sequence
  Description of Artificial Sequence: Synthetic oligonucleotide
  Target: ATXN1; (+) strand; PAM type: NRG; PAM sequence: AAG
tgaggtatgttaaaaatgga

SEQ ID NO: 146504 - DNA, 20 bp, Artificial Sequence
  Description of Artificial Sequence: Synthetic oligonucleotide
  Target: ATXN1; (+) strand; PAM type: NRG; PAM sequence: AAG
aaaaatggaaagcacctatt

SEQ ID NO: 146505 - DNA, 20 bp, Artificial Sequence
  Description of Artificial Sequence: Synthetic oligonucleotide
  Target: ATXN1; (+) strand; PAM type: NRG; PAM sequence: CAG
acctattaagctgttactgt

SEQ ID NO: 146506 - DNA, 20 bp, Artificial Sequence
  Description of Artificial Sequence: Synthetic oligonucleotide
  Target: ATXN1; (+) strand; PAM type: NRG; PAM sequence: AAG
tactgtcagtttcacctgtt

SEQ ID NO: 146507 - DNA, 20 bp, Artificial Sequence
  Description of Artificial Sequence: Synthetic oligonucleotide
  Target: ATXN1; (+) strand; PAM type: NRG; PAM sequence: TAG
tgtcagtttcacctgttaag

SEQ ID NO: 146508 - DNA, 20 bp, Artificial Sequence
  Description of Artificial Sequence: Synthetic oligonucleotide
  Target: ATXN1; (+) strand; PAM type: NRG; PAM sequence: AGG
gtcagtttcacctgttaagt

SEQ ID NO: 146509 - DNA, 20 bp, Artificial Sequence
  Description of Artificial Sequence: Synthetic oligonucleotide
  Target: ATXN1; (+) strand; PAM type: NRG; PAM sequence: TAG
acctgttaagtaggtactat

SEQ ID NO: 146510 - DNA, 20 bp, Artificial Sequence
  Description of Artificial Sequence: Synthetic oligonucleotide
  Target: ATXN1; (+) strand; PAM type: NRG; PAM sequence: AAG
ttaagtaggtactattagtt

SEQ ID NO: 146511 - DNA, 20 bp, Artificial Sequence
  Description of Artificial Sequence: Synthetic oligonucleotide
  Target: ATXN1; (+) strand; PAM type: NRG; PAM sequence: CAG
gtaggtactattagttaagc

SEQ ID NO: 146512 - DNA, 20 bp, Artificial Sequence
  Description of Artificial Sequence: Synthetic oligonucleotide
  Target: ATXN1; (+) strand; PAM type: NRG; PAM sequence: TAG
tactattagttaagccagca

SEQ ID NO: 146513 - DNA, 20 bp, Artificial Sequence
  Description of Artificial Sequence: Synthetic oligonucleotide
  Target: ATXN1; (+) strand; PAM type: NRG; PAM sequence: GAG
gttaagccagcatagttcct

SEQ ID NO: 146514 - DNA, 20 bp, Artificial Sequence
  Description of Artificial Sequence: Synthetic oligonucleotide
  Target: ATXN1; (+) strand; PAM type: NRG; PAM sequence: AAG
agcatagttcctgagttgca

SEQ ID NO: 146515 - DNA, 20 bp, Artificial Sequence
  Description of Artificial Sequence: Synthetic oligonucleotide
  Target: ATXN1; (+) strand; PAM type: NRG; PAM sequence: CAG
cctgagttgcaaagcatata

SEQ ID NO: 146516 - DNA, 20 bp, Artificial Sequence
  Description of Artificial Sequence: Synthetic oligonucleotide
  Target: ATXN1; (+) strand; PAM type: NRG; PAM sequence: AGG
ctgagttgcaaagcatatac

SEQ ID NO: 146517 - DNA, 20 bp, Artificial Sequence
  Description of Artificial Sequence: Synthetic oligonucleotide
  Target: ATXN1; (+) strand; PAM type: NRG; PAM sequence: AAG
tgcaaagcatatacaggctg

SEQ ID NO: 146518 - DNA, 20 bp, Artificial Sequence
  Description of Artificial Sequence: Synthetic oligonucleotide
  Target: ATXN1; (+) strand; PAM type: NRG; PAM sequence: AAG
acaggctgaagtacaatgtc

SEQ ID NO: 146519 - DNA, 20 bp, Artificial Sequence
  Description of Artificial Sequence: Synthetic oligonucleotide
  Target: ATXN1; (+) strand; PAM type: NRG; PAM sequence: AAG
aatgtcaagaaaacatgtta

SEQ ID NO: 146520 - DNA, 20 bp, Artificial Sequence
  Description of Artificial Sequence: Synthetic oligonucleotide
  Target: ATXN1; (+) strand; PAM type: NRG; PAM sequence: AGG
atgtcaagaaaacatgttaa

SEQ ID NO: 146521 - DNA, 20 bp, Artificial Sequence
  Description of Artificial Sequence: Synthetic oligonucleotide
  Target: ATXN1; (+) strand; PAM type: NRG; PAM sequence: GGG
tgtcaagaaaacatgttaaa

SEQ ID NO: 146522 - DNA, 20 bp, Artificial Sequence
  Description of Artificial Sequence: Synthetic oligonucleotide
  Target: ATXN1; (+) strand; PAM type: NRG; PAM sequence: TGG
caagaaaacatgttaaaggg

SEQ ID NO: 146523 - DNA, 20 bp, Artificial Sequence
  Description of Artificial Sequence: Synthetic oligonucleotide
  Target: ATXN1; (+) strand; PAM type: NRG; PAM sequence: TAG
gttaaagggtggtaaataaa

SEQ ID NO: 146524 - DNA, 20 bp, Artificial Sequence
  Description of Artificial Sequence: Synthetic oligonucleotide
  Target: ATXN1; (+) strand; PAM type: NRG; PAM sequence: GAG
gtggtaaataaatagccact

SEQ ID NO: 146525 - DNA, 20 bp, Artificial Sequence
  Description of Artificial Sequence: Synthetic oligonucleotide
  Target: ATXN1; (+) strand; PAM type: NRG; PAM sequence: AAG
gtaaataaatagccactgag

SEQ ID NO: 146526 - DNA, 20 bp, Artificial Sequence
  Description of Artificial Sequence: Synthetic oligonucleotide
  Target: ATXN1; (+) strand; PAM type: NRG; PAM sequence: CAG
cactgagaagatactctgaa

SEQ ID NO: 146527 - DNA, 20 bp, Artificial Sequence
  Description of Artificial Sequence: Synthetic oligonucleotide
  Target: ATXN1; (+) strand; PAM type: NRG; PAM sequence: AAG
gatactctgaacagataaat

SEQ ID NO: 146528 - DNA, 20 bp, Artificial Sequence
  Description of Artificial Sequence: Synthetic oligonucleotide
  Target: ATXN1; (+) strand; PAM type: NRG; PAM sequence: AAG
tgaacagataaataagaaaa

SEQ ID NO: 146529 - DNA, 20 bp, Artificial Sequence
  Description of Artificial Sequence: Synthetic oligonucleotide
  Target: ATXN1; (+) strand; PAM type: NRG; PAM sequence: TAG
aaataagaaaaaagcaaatg

SEQ ID NO: 146530 - DNA, 20 bp, Artificial Sequence
  Description of Artificial Sequence: Synthetic oligonucleotide
  Target: ATXN1; (+) strand; PAM type: NRG; PAM sequence: TGG
gcaaatgtagttgaaataaa

SEQ ID NO: 146531 - DNA, 20 bp, Artificial Sequence
  Description of Artificial Sequence: Synthetic oligonucleotide
  Target: ATXN1; (+) strand; PAM type: NRG; PAM sequence: AAG
aatgtagttgaaataaatgg

SEQ ID NO: 146532 - DNA, 20 bp, Artificial Sequence
  Description of Artificial Sequence: Synthetic oligonucleotide
  Target: ATXN1; (+) strand; PAM type: NRG; PAM sequence: TAG
gttgaaataaatggaagctc

SEQ ID NO: 146533 - DNA, 20 bp, Artificial Sequence
  Description of Artificial Sequence: Synthetic oligonucleotide
  Target: ATXN1; (+) strand; PAM type: NRG; PAM sequence: AGG
ttgaaataaatggaagctct

SEQ ID NO: 146534 - DNA, 20 bp, Artificial Sequence
  Description of Artificial Sequence: Synthetic oligonucleotide
  Target: ATXN1; (+) strand; PAM type: NRG; PAM sequence: CAG
aaataaatggaagctctagg

SEQ ID NO: 146535 - DNA, 20 bp, Artificial Sequence
  Description of Artificial Sequence: Synthetic oligonucleotide
  Target: ATXN1; (+) strand; PAM type: NRG; PAM sequence: TGG
tggaagctctaggcagtgtg

SEQ ID NO: 146536 - DNA, 20 bp, Artificial Sequence
  Description of Artificial Sequence: Synthetic oligonucleotide
  Target: ATXN1; (+) strand; PAM type: NRG; PAM sequence: CAG
agctctaggcagtgtgtgga

SEQ ID NO: 146537 - DNA, 20 bp, Artificial Sequence
  Description of Artificial Sequence: Synthetic oligonucleotide
  Target: ATXN1; (+) strand; PAM type: NRG; PAM sequence: CAG
ctaggcagtgtgtggacaga

SEQ ID NO: 146538 - DNA, 20 bp, Artificial Sequence
  Description of Artificial Sequence: Synthetic oligonucleotide
  Target: ATXN1; (+) strand; PAM type: NRG; PAM sequence: AAG
tgtgtggacagacagaacaa

SEQ ID NO: 146539 - DNA, 20 bp, Artificial Sequence
  Description of Artificial Sequence: Synthetic oligonucleotide
  Target: ATXN1; (+) strand; PAM type: NRG; PAM sequence: TGG
gtggacagacagaacaaaag

SEQ ID NO: 146540 - DNA, 20 bp, Artificial Sequence
  Description of Artificial Sequence: Synthetic oligonucleotide
  Target: ATXN1; (+) strand; PAM type: NRG; PAM sequence: TGG
agtggtcactgtttatgcct

SEQ ID NO: 146541 - DNA, 20 bp, Artificial Sequence
  Description of Artificial Sequence: Synthetic oligonucleotide
  Target: ATXN1; (+) strand; PAM type: NRG; PAM sequence: TAG
aatcctaactccccacgtga

SEQ ID NO: 146542 - DNA, 20 bp, Artificial Sequence
  Description of Artificial Sequence: Synthetic oligonucleotide
  Target: ATXN1; (+) strand; PAM type: NRG; PAM sequence: TAG
aactccccacgtgatagtat

SEQ ID NO: 146543 - DNA, 20 bp, Artificial Sequence
  Description of Artificial Sequence: Synthetic oligonucleotide
  Target: ATXN1; (+) strand; PAM type: NRG; PAM sequence: AGG
actccccacgtgatagtatt

SEQ ID NO: 146544 - DNA, 20 bp, Artificial Sequence
  Description of Artificial Sequence: Synthetic oligonucleotide
  Target: ATXN1; (+) strand; PAM type: NRG; PAM sequence: GGG
ctccccacgtgatagtatta

SEQ ID NO: 146545 - DNA, 20 bp, Artificial Sequence
  Description of Artificial Sequence: Synthetic oligonucleotide
  Target: ATXN1; (+) strand; PAM type: NRG; PAM sequence: GAG
ccccacgtgatagtattagg

SEQ ID NO: 146546 - DNA, 20 bp, Artificial Sequence
  Description of Artificial Sequence: Synthetic oligonucleotide
  Target: ATXN1; (+) strand; PAM type: NRG; PAM sequence: TGG
cacgtgatagtattagggag

SEQ ID NO: 146547 - DNA, 20 bp, Artificial Sequence
  Description of Artificial Sequence: Synthetic oligonucleotide
  Target: ATXN1; (+) strand; PAM type: NRG; PAM sequence: GAG
cgtgatagtattagggagtg

SEQ ID NO: 146548 - DNA, 20 bp, Artificial Sequence
  Description of Artificial Sequence: Synthetic oligonucleotide
  Target: ATXN1; (+) strand; PAM type: NRG; PAM sequence: TGG
gtattagggagtggagccct

SEQ ID NO: 146549 - DNA, 20 bp, Artificial Sequence
  Description of Artificial Sequence: Synthetic oligonucleotide
  Target: ATXN1; (+) strand; PAM type: NRG; PAM sequence: GGG
tattagggagtggagccctt

SEQ ID NO: 146550 - DNA, 20 bp, Artificial Sequence
  Description of Artificial Sequence: Synthetic oligonucleotide
  Target: ATXN1; (+) strand; PAM type: NRG; PAM sequence: GAG
ttagggagtggagcccttgg

SEQ ID NO: 146551 - DNA, 20 bp, Artificial Sequence
  Description of Artificial Sequence: Synthetic oligonucleotide
  Target: ATXN1; (+) strand; PAM type: NRG; PAM sequence: AGG
tagggagtggagcccttggg

SEQ ID NO: 146552 - DNA, 20 bp, Artificial Sequence
  Description of Artificial Sequence: Synthetic oligonucleotide
  Target: ATXN1; (+) strand; PAM type: NRG; PAM sequence: TGG
ttgggaggtgccctcttgaa

SEQ ID NO: 146553 - DNA, 20 bp, Artificial Sequence
  Description of Artificial Sequence: Synthetic oligonucleotide
  Target: ATXN1; (+) strand; PAM type: NRG; PAM sequence: TAG
ggtgccctcttgaatggaat

SEQ ID NO: 146554 - DNA, 20 bp, Artificial Sequence
  Description of Artificial Sequence: Synthetic oligonucleotide
  Target: ATXN1; (+) strand; PAM type: NRG; PAM sequence: AAG
tggaattagcacctttatca

SEQ ID NO: 146555 - DNA, 20 bp, Artificial Sequence
  Description of Artificial Sequence: Synthetic oligonucleotide
  Target: ATXN1; (+) strand; PAM type: NRG; PAM sequence: CAG
cctttatcaaagaactcccc

SEQ ID NO: 146556 - DNA, 20 bp, Artificial Sequence
  Description of Artificial Sequence: Synthetic oligonucleotide
  Target: ATXN1; (+) strand; PAM type: NRG; PAM sequence: AGG
ctttatcaaagaactccccc

SEQ ID NO: 146557 - DNA, 20 bp, Artificial Sequence
  Description of Artificial Sequence: Synthetic oligonucleotide
  Target: ATXN1; (+) strand; PAM type: NRG; PAM sequence: GAG
ctttgcctcttccaccatgt

SEQ ID NO: 146558 - DNA, 20 bp, Artificial Sequence
  Description of Artificial Sequence: Synthetic oligonucleotide
  Target: ATXN1; (+) strand; PAM type: NRG; PAM sequence: AGG
tttgcctcttccaccatgtg

SEQ ID NO: 146559 - DNA, 20 bp, Artificial Sequence
  Description of Artificial Sequence: Synthetic oligonucleotide
  Target: ATXN1; (+) strand; PAM type: NRG; PAM sequence: CAG
ttccaccatgtgaggataca

SEQ ID NO: 146560 - DNA, 20 bp, Artificial Sequence
  Description of Artificial Sequence: Synthetic oligonucleotide
  Target: ATXN1; (+) strand; PAM type: NRG; PAM sequence: GAG
ccaccatgtgaggatacaca

SEQ ID NO: 146561 - DNA, 20 bp, Artificial Sequence
  Description of Artificial Sequence: Synthetic oligonucleotide
  Target: ATXN1; (+) strand; PAM type: NRG; PAM sequence: AAG
ccatgtgaggatacacagag

SEQ ID NO: 146562 - DNA, 20 bp, Artificial Sequence
  Description of Artificial Sequence: Synthetic oligonucleotide
  Target: ATXN1; (+) strand; PAM type: NRG; PAM sequence: AGG
catgtgaggatacacagaga

SEQ ID NO: 146563 - DNA, 20 bp, Artificial Sequence
  Description of Artificial Sequence: Synthetic oligonucleotide
  Target: ATXN1; (+) strand; PAM type: NRG; PAM sequence: GAG
acagagaaggtgccatctgt

SEQ ID NO: 146564 - DNA, 20 bp, Artificial Sequence
  Description of Artificial Sequence: Synthetic oligonucleotide
  Target: ATXN1; (+) strand; PAM type: NRG; PAM sequence: TAG
aaggtgccatctgtgagcct

SEQ ID NO: 146565 - DNA, 20 bp, Artificial Sequence
  Description of Artificial Sequence: Synthetic oligonucleotide
  Target: ATXN1; (+) strand; PAM type: NRG; PAM sequence: AAG
ccatctgtgagccttagaac

SEQ ID NO: 146566 - DNA, 20 bp, Artificial Sequence
  Description of Artificial Sequence: Synthetic oligonucleotide
  Target: ATXN1; (+) strand; PAM type: NRG; PAM sequence: TAG
gtgagccttagaacaagcct

SEQ ID NO: 146567 - DNA, 20 bp, Artificial Sequence
  Description of Artificial Sequence: Synthetic oligonucleotide
  Target: ATXN1; (+) strand; PAM type: NRG; PAM sequence: TAG
ccttagaacaagccttagaa

SEQ ID NO: 146568 - DNA, 20 bp, Artificial Sequence
  Description of Artificial Sequence: Synthetic oligonucleotide
  Target: ATXN1; (+) strand; PAM type: NRG; PAM sequence: AGG
cttagaacaagccttagaat

SEQ ID NO: 146569 - DNA, 20 bp, Artificial Sequence
  Description of Artificial Sequence: Synthetic oligonucleotide
  Target: ATXN1; (+) strand; PAM type: NRG; PAM sequence: CGG
gaacaagccttagaataggc

SEQ ID NO: 146570 - DNA, 20 bp, Artificial Sequence
  Description of Artificial Sequence: Synthetic oligonucleotide
  Target: ATXN1; (+) strand; PAM type: NRG; PAM sequence: GGG
aacaagccttagaataggcc

SEQ ID NO: 146571 - DNA, 20 bp, Artificial Sequence
  Description of Artificial Sequence: Synthetic oligonucleotide
  Target: ATXN1; (+) strand; PAM type: NRG; PAM sequence: TGG
gccttagaataggccgggtg

SEQ ID NO: 146572 - DNA, 20 bp, Artificial Sequence
  Description of Artificial Sequence: Synthetic oligonucleotide
  Target: ATXN1; (+) strand; PAM type: NRG; PAM sequence: TGG
ttagaataggccgggtgtgg

SEQ ID NO: 146573 - DNA, 20 bp, Artificial Sequence
  Description of Artificial Sequence: Synthetic oligonucleotide
  Target: ATXN1; (+) strand; PAM type: NRG; PAM sequence: AAG
taggccgggtgtggtggctc

SEQ ID NO: 146574 - DNA, 20 bp, Artificial Sequence
  Description of Artificial Sequence: Synthetic oligonucleotide
  Target: ATXN1; (+) strand; PAM type: NRG; PAM sequence: CAG
gtggctcaagcctgtaatcc

SEQ ID NO: 146575 - DNA, 20 bp, Artificial Sequence
  Description of Artificial Sequence: Synthetic oligonucleotide
  Target: ATXN1; (+) strand; PAM type: NRG; PAM sequence: TGG
agcctgtaatcccagcactt

SEQ ID NO: 146576 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 146577 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 146578 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 146579 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 146580 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 146581 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggccgagg

SEQ ID NO: 146582 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccgaggc

SEQ ID NO: 146583 - DNA, 20 bp, Artificial Sequence
  Description of Artificial Sequence: Synthetic oligonucleotide
  Target: ATXN1; (+) strand; PAM type: NRG; PAM sequence: CAG
ctttgggaggccgaggcggg

SEQ ID NO: 146584 - DNA, 20 bp, Artificial Sequence
  Description of Artificial Sequence: Synthetic oligonucleotide
  Target: ATXN1; (+) strand; PAM type: NRG; PAM sequence: CAG
gcgggcagatcacctgacat

SEQ ID NO: 146585 - DNA, 20 bp, Artificial Sequence
  Description of Artificial Sequence: Synthetic oligonucleotide
  Target: ATXN1; (+) strand; PAM type: NRG; PAM sequence: AGG
cgggcagatcacctgacatc

SEQ ID NO: 146586 - DNA, 20 bp, Artificial Sequence
  Description of Artificial Sequence: Synthetic oligonucleotide
  Target: ATXN1; (+) strand; PAM type: NRG; PAM sequence: GAG
ggcagatcacctgacatcag

SEQ ID NO: 146587 - DNA, 20 bp, Artificial Sequence
  Description of Artificial Sequence: Synthetic oligonucleotide
  Target: ATXN1; (+) strand; PAM type: NRG; PAM sequence: GAG
tcacctgacatcaggagttc

SEQ ID NO: 146588 - DNA, 20 bp, Artificial Sequence
  Description of Artificial Sequence: Synthetic oligonucleotide
  Target: ATXN1; (+) strand; PAM type: NRG; PAM sequence: CAG
tgacatcaggagttcgagac

SEQ ID NO: 146589 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcgagaccagcc

SEQ ID NO: 146590 - DNA, 20 bp, Artificial Sequence
  Description of Artificial Sequence: Synthetic oligonucleotide
  Target: ATXN1; (+) strand; PAM type: NRG; PAM sequence: TGG
cgagaccagcctggccaata

SEQ ID NO: 146591 - DNA, 20 bp, Artificial Sequence
  Description of Artificial Sequence: Synthetic oligonucleotide
  Target: ATXN1; (+) strand; PAM type: NRG; PAM sequence: CGG
catctctactaaaaatacac

SEQ ID NO: 146592 - DNA, 20 bp, Artificial Sequence
  Description of Artificial Sequence: Synthetic oligonucleotide
  Target: ATXN1; (+) strand; PAM type: NRG; PAM sequence: GGG
atctctactaaaaatacacc

SEQ ID NO: 146593 - DNA, 20 bp, Artificial Sequence
  Description of Artificial Sequence: Synthetic oligonucleotide
  Target: ATXN1; (+) strand; PAM type: NRG; PAM sequence: TGG
tactaaaaatacaccgggcg

SEQ ID NO: 146594 - DNA, 20 bp, Artificial Sequence
  Description of Artificial Sequence: Synthetic oligonucleotide
  Target: ATXN1; (+) strand; PAM type: NRG; PAM sequence: TGG
taaaaatacaccgggcgtgg

SEQ ID NO: 146595 - DNA, 20 bp, Artificial Sequence
  Description of Artificial Sequence: Synthetic oligonucleotide
  Target: ATXN1; (+) strand; PAM type: NRG; PAM sequence: TAG
ggcgtggtggcacgcacctg

SEQ ID NO: 146596 - DNA, 20 bp, Artificial Sequence
  Description of Artificial Sequence: Synthetic oligonucleotide
  Target: ATXN1; (+) strand; PAM type: NRG; PAM sequence: CAG
gtggcacgcacctgtagtcc

SEQ ID NO: 146597 - DNA, 20 bp, Artificial Sequence
  Description of Artificial Sequence: Synthetic oligonucleotide
  Target: ATXN1; (+) strand; PAM type: NRG; PAM sequence: CAG
cacctgtagtcccagctact

SEQ ID NO: 146598 - DNA, 20 bp, Artificial Sequence
  Description of Artificial Sequence: Synthetic oligonucleotide
  Target: ATXN1; (+) strand; PAM type: NRG; PAM sequence: AGG
acctgtagtcccagctactc

SEQ ID NO: 146599 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctactcag

SEQ ID NO: 146600 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctactcagg

SEQ ID NO: 146601 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcaggaggct

SEQ ID NO: 146602 - DNA, 20 bp, Artificial Sequence
  Description of Artificial Sequence: Synthetic oligonucleotide
  Target: ATXN1; (+) strand; PAM type: NRG; PAM sequence: CAG
agctactcaggaggctgaga

SEQ ID NO: 146603 - DNA, 20 bp, Artificial Sequence
  Description of Artificial Sequence: Synthetic oligonucleotide
  Target: ATXN1; (+) strand; PAM type: NRG; PAM sequence: TAG
tactcaggaggctgagacag

SEQ ID NO: 146604 - DNA, 20 bp, Artificial Sequence
  Description of Artificial Sequence: Synthetic oligonucleotide
  Target: ATXN1; (+) strand; PAM type: NRG; PAM sequence: TGG
acagtagaattgcttgaacc

SEQ ID NO: 146605 - DNA, 20 bp, Artificial Sequence
  Description of Artificial Sequence: Synthetic oligonucleotide
  Target: ATXN1; (+) strand; PAM type: NRG; PAM sequence: GGG
cagtagaattgcttgaacct

SEQ ID NO: 146606 - DNA, 20 bp, Artificial Sequence
  Description of Artificial Sequence: Synthetic oligonucleotide
  Target: ATXN1; (+) strand; PAM type: NRG; PAM sequence: GAG
gtagaattgcttgaacctgg

SEQ ID NO: 146607 - DNA, 20 bp, Artificial Sequence
  Description of Artificial Sequence: Synthetic oligonucleotide
  Target: ATXN1; (+) strand; PAM type: NRG; PAM sequence: AGG
tagaattgcttgaacctggg

SEQ ID NO: 146608 - DNA, 20 bp, Artificial Sequence
  Description of Artificial Sequence: Synthetic oligonucleotide
  Target: ATXN1; (+) strand; PAM type: NRG; PAM sequence: CGG
aattgcttgaacctgggagg

SEQ ID NO: 146609 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaacctgggaggcg

SEQ ID NO: 146610 - DNA, 20 bp, Artificial Sequence
  Description of Artificial Sequence: Synthetic oligonucleotide
  Target: ATXN1; (+) strand; PAM type: NRG; PAM sequence: AGG
tgcttgaacctgggaggcgg

SEQ ID NO: 146611 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggcggaggttg

SEQ ID NO: 146612 - DNA, 20 bp, Artificial Sequence
  Description of Artificial Sequence: Synthetic oligonucleotide
  Target: ATXN1; (+) strand; PAM type: NRG; PAM sequence: GAG
tgggaggcggaggttgcagt

SEQ ID NO: 146613 - DNA, 20 bp, Artificial Sequence
  Description of Artificial Sequence: Synthetic oligonucleotide
  Target: ATXN1; (+) strand; PAM type: NRG; PAM sequence: GAG
ggcggaggttgcagtgagcc

SEQ ID NO: 146614 - DNA, 20 bp, Artificial Sequence
  Description of Artificial Sequence: Synthetic oligonucleotide
  Target: ATXN1; (+) strand; PAM type: NRG; PAM sequence: CAG
gagatcatgccactgcactc

SEQ ID NO: 146615 - DNA, 20 bp, Artificial Sequence
  Description of Artificial Sequence: Synthetic oligonucleotide
  Target: ATXN1; (+) strand; PAM type: NRG; PAM sequence: TGG
catgccactgcactccagcc

SEQ ID NO: 146616 - DNA, 20 bp, Artificial Sequence
  Description of Artificial Sequence: Synthetic oligonucleotide
  Target: ATXN1; (+) strand; PAM type: NRG; PAM sequence: GGG
atgccactgcactccagcct

SEQ ID NO: 146617 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggcgact

SEQ ID NO: 146618 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggcgactgagc

SEQ ID NO: 146619 - DNA, 20 bp, Artificial Sequence
  Description of Artificial Sequence: Synthetic oligonucleotide
  Target: ATXN1; (+) strand; PAM type: NRG; PAM sequence: AAG
taatctatttgtaaccattg

SEQ ID NO: 146620 - DNA, 20 bp, Artificial Sequence
  Description of Artificial Sequence: Synthetic oligonucleotide
  Target: ATXN1; (+) strand; PAM type: NRG; PAM sequence: TAG
ttaaattcaaacctctacct

SEQ ID NO: 146621 - DNA, 20 bp, Artificial Sequence
  Description of Artificial Sequence: Synthetic oligonucleotide
  Target: ATXN1; (+) strand; PAM type: NRG; PAM sequence: CAG
aattcaaacctctaccttag

SEQ ID NO: 146622 - DNA, 20 bp, Artificial Sequence
  Description of Artificial Sequence: Synthetic oligonucleotide
  Target: ATXN1; (+) strand; PAM type: NRG; PAM sequence: CAG
ctaccttagcagccatatca

SEQ ID NO: 146623 - DNA, 20 bp, Artificial Sequence
  Description of Artificial Sequence: Synthetic oligonucleotide
  Target: ATXN1; (+) strand; PAM type: NRG; PAM sequence: TGG
acagtcacaaattaactata

SEQ ID NO: 146624 - DNA, 20 bp, Artificial Sequence
  Description of Artificial Sequence: Synthetic oligonucleotide
  Target: ATXN1; (+) strand; PAM type: NRG; PAM sequence: AAG
tcacaaattaactatatggc

SEQ ID NO: 146625 - DNA, 20 bp, Artificial Sequence
  Description of Artificial Sequence: Synthetic oligonucleotide
  Target: ATXN1; (+) strand; PAM type: NRG; PAM sequence: TGG
agtaatctgtatgattactt

SEQ ID NO: 146626 - DNA, 20 bp, Artificial Sequence
  Description of Artificial Sequence: Synthetic oligonucleotide
  Target: ATXN1; (+) strand; PAM type: NRG; PAM sequence: GGG
gtaatctgtatgattacttt

SEQ ID NO: 146627 - DNA, 20 bp, Artificial Sequence
  Description of Artificial Sequence: Synthetic oligonucleotide
  Target: ATXN1; (+) strand; PAM type: NRG; PAM sequence: CAG
gtatgattactttgggttct

SEQ ID NO: 146628 - DNA, 20 bp, Artificial Sequence
  Description of Artificial Sequence: Synthetic oligonucleotide
  Target: ATXN1; (+) strand; PAM type: NRG; PAM sequence: AAG
gacttgctatgtatttaatg

SEQ ID NO: 146629 - DNA, 20 bp, Artificial Sequence
  Description of Artificial Sequence: Synthetic oligonucleotide
  Target: ATXN1; (+) strand; PAM type: NRG; PAM sequence: AAG
atttaatgaagtaaaattgt

SEQ ID NO: 146630 - DNA, 20 bp, Artificial Sequence
  Description of Artificial Sequence: Synthetic oligonucleotide
  Target: ATXN1; (+) strand; PAM type: NRG; PAM sequence: AAG
atgaagtaaaattgtaagtc

SEQ ID NO: 146631 - DNA, 20 bp, Artificial Sequence
  Description of Artificial Sequence: Synthetic oligonucleotide
  Target: ATXN1; (+) strand; PAM type: NRG; PAM sequence: CAG
agtaaaattgtaagtcaagt

SEQ ID NO: 146632 - DNA, 20 bp, Artificial Sequence
  Description of Artificial Sequence: Synthetic oligonucleotide
  Target: ATXN1; (+) strand; PAM type: NRG; PAM sequence: TAG
attgtaagtcaagtcagata

SEQ ID NO: 146633 - DNA, 20 bp, Artificial Sequence
  Description of Artificial Sequence: Synthetic oligonucleotide
  Target: ATXN1; (+) strand; PAM type: NRG; PAM sequence: AGG
ttgtaagtcaagtcagatat

SEQ ID NO: 146634 - DNA, 20 bp, Artificial Sequence
  Description of Artificial Sequence: Synthetic oligonucleotide
  Target: ATXN1; (+) strand; PAM type: NRG; PAM sequence: TAG
taagtcaagtcagatatagg

SEQ ID NO: 146635 - DNA, 20 bp, Artificial Sequence
  Description of Artificial Sequence: Synthetic oligonucleotide
  Target: ATXN1; (+) strand; PAM type: NRG; PAM sequence: AGG
aagtcaagtcagatataggt

SEQ ID NO: 146636 - DNA, 20 bp, Artificial Sequence
  Description of Artificial Sequence: Synthetic oligonucleotide
  Target: ATXN1; (+) strand; PAM type: NRG; PAM sequence: AAG
atattaacaaatgtaatcaa

SEQ ID NO: 146637 - DNA, 20 bp, Artificial Sequence
  Description of Artificial Sequence: Synthetic oligonucleotide
  Target: ATXN1; (+) strand; PAM type: NRG; PAM sequence: AAG
caaaagatttgtctatttta

SEQ ID NO: 146638 - DNA, 20 bp, Artificial Sequence
  Description of Artificial Sequence: Synthetic oligonucleotide
  Target: ATXN1; (+) strand; PAM type: NRG; PAM sequence: AAG
tttgtctattttaaagactc

SEQ ID NO: 146639 - DNA, 20 bp, Artificial Sequence
  Description of Artificial Sequence: Synthetic oligonucleotide
  Target: ATXN1; (+) strand; PAM type: NRG; PAM sequence: AAG
tctattttaaagactcaaga

SEQ ID NO: 146640 - DNA, 20 bp, Artificial Sequence
  Description of Artificial Sequence: Synthetic oligonucleotide
  Target: ATXN1; (+) strand; PAM type: NRG; PAM sequence: AAG
ttaacacacacattcatatg

SEQ ID NO: 146641 - DNA, 20 bp, Artificial Sequence
  Description of Artificial Sequence: Synthetic oligonucleotide
  Target: ATXN1; (+) strand; PAM type: NRG; PAM sequence: AGG
taacacacacattcatatga

SEQ ID NO: 146642 - DNA, 20 bp, Artificial Sequence
  Description of Artificial Sequence: Synthetic oligonucleotide
  Target: ATXN1; (+) strand; PAM type: NRG; PAM sequence: GGG
aacacacacattcatatgaa

SEQ ID NO: 146643 - DNA, 20 bp, Artificial Sequence
  Description of Artificial Sequence: Synthetic oligonucleotide
  Target: ATXN1; (+) strand; PAM type: NRG; PAM sequence: TGG
gggtacaaatacctaatttt

SEQ ID NO: 146644 - DNA, 20 bp, Artificial Sequence
  Description of Artificial Sequence: Synthetic oligonucleotide
  Target: ATXN1; (+) strand; PAM type: NRG; PAM sequence: TGG
gaaaacatttcatataattt

SEQ ID NO: 146645 - DNA, 20 bp, Artificial Sequence
  Description of Artificial Sequence: Synthetic oligonucleotide
  Target: ATXN1; (+) strand; PAM type: NRG; PAM sequence: AAG
gtaaatatataaataataat

SEQ ID NO: 146646 - DNA, 20 bp, Artificial Sequence
  Description of Artificial Sequence: Synthetic oligonucleotide
  Target: ATXN1; (+) strand; PAM type: NRG; PAM sequence: AAG
aatatataaataataataag

SEQ ID NO: 146647 - DNA, 20 bp, Artificial Sequence
  Description of Artificial Sequence: Synthetic oligonucleotide
  Target: ATXN1; (+) strand; PAM type: NRG; PAM sequence: AAG
atataaataataataagaag

SEQ ID NO: 146648 - DNA, 20 bp, Artificial Sequence
  Description of Artificial Sequence: Synthetic oligonucleotide
  Target: ATXN1; (+) strand; PAM type: NRG; PAM sequence: TAG
accaccaacaacaaaaacaa

SEQ ID NO: 146649 - DNA, 20 bp, Artificial Sequence
  Description of Artificial Sequence: Synthetic oligonucleotide
  Target: ATXN1; (+) strand; PAM type: NRG; PAM sequence: AAG
caaccactttctaaaacatg

SEQ ID NO: 146650 - DNA, 20 bp, Artificial Sequence
  Description of Artificial Sequence: Synthetic oligonucleotide
  Target: ATXN1; (+) strand; PAM type: NRG; PAM sequence: AGG
aaccactttctaaaacatga

SEQ ID NO: 146651 - DNA, 20 bp, Artificial Sequence
  Description of Artificial Sequence: Synthetic oligonucleotide
  Target: ATXN1; (+) strand; PAM type: NRG; PAM sequence: AAG
ctttctaaaacatgaaggct

SEQ ID NO: 146652 - DNA, 20 bp, Artificial Sequence
  Description of Artificial Sequence: Synthetic oligonucleotide
  Target: ATXN1; (+) strand; PAM type: NRG; PAM sequence: AGG
tttctaaaacatgaaggcta

SEQ ID NO: 146653 - DNA, 20 bp, Artificial Sequence
  Description of Artificial Sequence: Synthetic oligonucleotide
  Target: ATXN1; (+) strand; PAM type: NRG; PAM sequence: AAG
aaacatgaaggctaaggaat

SEQ ID NO: 146654 - DNA, 20 bp, Artificial Sequence
  Description of Artificial Sequence: Synthetic oligonucleotide
  Target: ATXN1; (+) strand; PAM type: NRG; PAM sequence: CAG
catgaaggctaaggaataag

SEQ ID NO: 146655 - DNA, 20 bp, Artificial Sequence
  Description of Artificial Sequence: Synthetic oligonucleotide
  Target: ATXN1; (+) strand; PAM type: NRG; PAM sequence: TGG
ctaaggaataagcagtgtgc

SEQ ID NO: 146656 - DNA, 20 bp, Artificial Sequence
  Description of Artificial Sequence: Synthetic oligonucleotide
  Target: ATXN1; (+) strand; PAM type: NRG; PAM sequence: GGG
taaggaataagcagtgtgct

SEQ ID NO: 146657 - DNA, 20 bp, Artificial Sequence
  Description of Artificial Sequence: Synthetic oligonucleotide
  Target: ATXN1; (+) strand; PAM type: NRG; PAM sequence: CAG
tgtattccattgtgttctta

SEQ ID NO: 146658 - DNA, 20 bp, Artificial Sequence
  Description of Artificial Sequence: Synthetic oligonucleotide
  Target: ATXN1; (+) strand; PAM type: NRG; PAM sequence: AGG
gtattccattgtgttcttac

SEQ ID NO: 146659 - DNA, 20 bp, Artificial Sequence
  Description of Artificial Sequence: Synthetic oligonucleotide
  Target: ATXN1; (+) strand; PAM type: NRG; PAM sequence: TAG
catgttctatattttcactt

SEQ ID NO: 146660 - DNA, 20 bp, Artificial Sequence
  Description of Artificial Sequence: Synthetic oligonucleotide
  Target: ATXN1; (+) strand; PAM type: NRG; PAM sequence: GAG
tgttctatattttcacttta

SEQ ID NO: 146661 - DNA, 20 bp, Artificial Sequence
  Description of Artificial Sequence: Synthetic oligonucleotide
  Target: ATXN1; (+) strand; PAM type: NRG; PAM sequence: TGG
atattttcactttagagatg

SEQ ID NO: 146662 - DNA, 20 bp, Artificial Sequence
  Description of Artificial Sequence: Synthetic oligonucleotide
  Target: ATXN1; (+) strand; PAM type: NRG; PAM sequence: AAG
ctttagagatgtggaaactg

SEQ ID NO: 146663 - DNA, 20 bp, Artificial Sequence
  Description of Artificial Sequence: Synthetic oligonucleotide
  Target: ATXN1; (+) strand; PAM type: NRG; PAM sequence: CAG
gagatgtggaaactgaagct

SEQ ID NO: 146664 - DNA, 20 bp, Artificial Sequence
  Description of Artificial Sequence: Synthetic oligonucleotide
  Target: ATXN1; (+) strand; PAM type: NRG; PAM sequence: AGG
agatgtggaaactgaagctc

SEQ ID NO: 146665 - DNA, 20 bp, Artificial Sequence
  Description of Artificial Sequence: Synthetic oligonucleotide
  Target: ATXN1; (+) strand; PAM type: NRG; PAM sequence: AAG
tggaaactgaagctcaggct

SEQ ID NO: 146666 - DNA, 20 bp, Artificial Sequence
  Description of Artificial Sequence: Synthetic oligonucleotide
  Target: ATXN1; (+) strand; PAM type: NRG; PAM sequence: TGG
ctgaagctcaggctaagtaa

SEQ ID NO: 146667 - DNA, 20 bp, Artificial Sequence
  Description of Artificial Sequence: Synthetic oligonucleotide
  Target: ATXN1; (+) strand; PAM type: NRG; PAM sequence: GGG
tgaagctcaggctaagtaat

SEQ ID NO: 146668 - DNA, 20 bp, Artificial Sequence
  Description of Artificial Sequence: Synthetic oligonucleotide
  Target: ATXN1; (+) strand; PAM type: NRG; PAM sequence: AAG
tcaggctaagtaatgggccc

SEQ ID NO: 146669 - DNA, 20 bp, Artificial Sequence
  Description of Artificial Sequence: Synthetic oligonucleotide
  Target: ATXN1; (+) strand; PAM type: NRG; PAM sequence: TGG
atgggcccaagatctcaaat

SEQ ID NO: 146670 - DNA, 20 bp, Artificial Sequence
  Description of Artificial Sequence: Synthetic oligonucleotide
  Target: ATXN1; (+) strand; PAM type: NRG; PAM sequence: CAG
ggcccaagatctcaaattgg

SEQ ID NO: 146671 - DNA, 20 bp, Artificial Sequence
  Description of Artificial Sequence: Synthetic oligonucleotide
  Target: ATXN1; (+) strand; PAM type: NRG; PAM sequence: TGG
agatctcaaattggcagatc

SEQ ID NO: 146672 - DNA, 20 bp, Artificial Sequence
  Description of Artificial Sequence: Synthetic oligonucleotide
  Target: ATXN1; (+) strand; PAM type: NRG; PAM sequence: GGG
gatctcaaattggcagatct

SEQ ID NO: 146673 - DNA, 20 bp, Artificial Sequence
  Description of Artificial Sequence: Synthetic oligonucleotide
  Target: ATXN1; (+) strand; PAM type: NRG; PAM sequence: TAG
cagatctgggttcaaaacct

SEQ ID NO: 146674 - DNA, 20 bp, Artificial Sequence
  Description of Artificial Sequence: Synthetic oligonucleotide
  Target: ATXN1; (+) strand; PAM type: NRG; PAM sequence: CAG
tctgggttcaaaaccttagt

SEQ ID NO: 146675 - DNA, 20 bp, Artificial Sequence
  Description of Artificial Sequence: Synthetic oligonucleotide
  Target: ATXN1; (+) strand; PAM type: NRG; PAM sequence: GAG
ttcaaaaccttagtcagaac

SEQ ID NO: 146676 - DNA, 20 bp, Artificial Sequence
  Description of Artificial Sequence: Synthetic oligonucleotide
  Target: ATXN1; (+) strand; PAM type: NRG; PAM sequence: CAG
aaccttagtcagaacgagcc

SEQ ID NO: 146677 - DNA, 20 bp, Artificial Sequence
  Description of Artificial Sequence: Synthetic oligonucleotide
  Target: ATXN1; (+) strand; PAM type: NRG; PAM sequence: CAG
acgagcccagacctcccata

SEQ ID NO: 146678 - DNA, 20 bp, Artificial Sequence
  Description of Artificial Sequence: Synthetic oligonucleotide
  Target: ATXN1; (+) strand; PAM type: NRG; PAM sequence: AGG
cgagcccagacctcccatac

SEQ ID NO: 146679 - DNA, 20 bp, Artificial Sequence
  Description of Artificial Sequence: Synthetic oligonucleotide
  Target: ATXN1; (+) strand; PAM type: NRG; PAM sequence: CAG
gcccagacctcccatacagg

SEQ ID NO: 146680 - DNA, 20 bp, Artificial Sequence
  Description of Artificial Sequence: Synthetic oligonucleotide
  Target: ATXN1; (+) strand; PAM type: NRG; PAM sequence: GAG
ccagacctcccatacaggca

SEQ ID NO: 146681 - DNA, 20 bp, Artificial Sequence
  Description of Artificial Sequence: Synthetic oligonucleotide
  Target: ATXN1; (+) strand; PAM type: NRG; PAM sequence: AGG
cagacctcccatacaggcag

SEQ ID NO: 146682 - DNA, 20 bp, Artificial Sequence
  Description of Artificial Sequence: Synthetic oligonucleotide
  Target: ATXN1; (+) strand; PAM type: NRG; PAM sequence: CAG
catacaggcagaggtctttg

SEQ ID NO: 146683 - DNA, 20 bp, Artificial Sequence
  Description of Artificial Sequence: Synthetic oligonucleotide
  Target: ATXN1; (+) strand; PAM type: NRG; PAM sequence: TGG
caggcagaggtctttgcaga

SEQ ID NO: 146684 - DNA, 20 bp, Artificial Sequence
  Description of Artificial Sequence: Synthetic oligonucleotide
  Target: ATXN1; (+) strand; PAM type: NRG; PAM sequence: GGG
aggcagaggtctttgcagat

SEQ ID NO: 146685 - DNA, 20 bp, Artificial Sequence
  Description of Artificial Sequence: Synthetic oligonucleotide
  Target: ATXN1; (+) strand; PAM type: NRG; PAM sequence: AAG
cagaggtctttgcagatggg

SEQ ID NO: 146686 - DNA, 20 bp, Artificial Sequence
  Description of Artificial Sequence: Synthetic oligonucleotide
  Target: ATXN1; (+) strand; PAM type: NRG; PAM sequence: TGG
tctttgcagatgggaagata

SEQ ID NO: 146687 - DNA, 20 bp, Artificial Sequence
  Description of Artificial Sequence: Synthetic oligonucleotide
  Target: ATXN1; (+) strand; PAM type: NRG; PAM sequence: TAG
tgcagatgggaagatatgga

SEQ ID NO: 146688 - DNA, 20 bp, Artificial Sequence
  Description of Artificial Sequence: Synthetic oligonucleotide
  Target: ATXN1; (+) strand; PAM type: NRG; PAM sequence: AAG
atgggaagatatggatagat

SEQ ID NO: 146689 - DNA, 20 bp, Artificial Sequence
  Description of Artificial Sequence: Synthetic oligonucleotide
  Target: ATXN1; (+) strand; PAM type: NRG; PAM sequence: AAG
ataagctttctcctctactt

SEQ ID NO: 146690 - DNA, 20 bp, Artificial Sequence
  Description of Artificial Sequence: Synthetic oligonucleotide
  Target: ATXN1; (+) strand; PAM type: NRG; PAM sequence: CAG
ctttctcctctacttaagct

SEQ ID NO: 146691 - DNA, 20 bp, Artificial Sequence
  Description of Artificial Sequence: Synthetic oligonucleotide
  Target: ATXN1; (+) strand; PAM type: NRG; PAM sequence: GAG
gctcagtgtatctgtacact

SEQ ID NO: 146692 - DNA, 20 bp, Artificial Sequence
  Description of Artificial Sequence: Synthetic oligonucleotide
  Target: ATXN1; (+) strand; PAM type: NRG; PAM sequence: TAG
cagtgtatctgtacactgag

SEQ ID NO: 146693 - DNA, 20 bp, Artificial Sequence
  Description of Artificial Sequence: Synthetic oligonucleotide
  Target: ATXN1; (+) strand; PAM type: NRG; PAM sequence: TAG
ctgtacactgagtagccatg

SEQ ID NO: 146694 - DNA, 20 bp, Artificial Sequence
  Description of Artificial Sequence: Synthetic oligonucleotide
  Target: ATXN1; (+) strand; PAM type: NRG; PAM sequence: TGG
tgagtagccatgtagcataa

SEQ ID NO: 146695 - DNA, 20 bp, Artificial Sequence
  Description of Artificial Sequence: Synthetic oligonucleotide
  Target: ATXN1; (+) strand; PAM type: NRG; PAM sequence: TGG
gtagccatgtagcataatgg

SEQ ID NO: 146696 - DNA, 20 bp, Artificial Sequence
  Description of Artificial Sequence: Synthetic oligonucleotide
  Target: ATXN1; (+) strand; PAM type: NRG; PAM sequence: GAG
agccatgtagcataatggtg

SEQ ID NO: 146697 - DNA, 20 bp, Artificial Sequence
  Description of Artificial Sequence: Synthetic oligonucleotide
  Target: ATXN1; (+) strand; PAM type: NRG; PAM sequence: TGG
tagcataatggtggagtgca

SEQ ID NO: 146698 - DNA, 20 bp, Artificial Sequence
  Description of Artificial Sequence: Synthetic oligonucleotide
  Target: ATXN1; (+) strand; PAM type: NRG; PAM sequence: GGG
agcataatggtggagtgcat

SEQ ID NO: 146699 - DNA, 20 bp, Artificial Sequence
  Description of Artificial Sequence: Synthetic oligonucleotide
  Target: ATXN1; (+) strand; PAM type: NRG; PAM sequence: TGG
atggtggagtgcatgggctc

SEQ ID NO: 146700 - DNA, 20 bp, Artificial Sequence
  Description of Artificial Sequence: Synthetic oligonucleotide
  Target: ATXN1; (+) strand; PAM type: NRG; PAM sequence: GAG
ggtggagtgcatgggctctg

SEQ ID NO: 146701 - DNA, 20 bp, Artificial Sequence
  Description of Artificial Sequence: Synthetic oligonucleotide
  Target: ATXN1; (+) strand; PAM type: NRG; PAM sequence: AAG
gtgcatgggctctggagcca

SEQ ID NO: 146702 - DNA, 20 bp, Artificial Sequence
  Description of Artificial Sequence: Synthetic oligonucleotide
  Target: ATXN1; (+) strand; PAM type: NRG; PAM sequence: AAG
ggctctggagccaaagctct

SEQ ID NO: 146703 - DNA, 20 bp, Artificial Sequence
  Description of Artificial Sequence: Synthetic oligonucleotide
  Target: ATXN1; (+) strand; PAM type: NRG; PAM sequence: CAG
tggagccaaagctctaagtt

SEQ ID NO: 146704 - DNA, 20 bp, Artificial Sequence
  Description of Artificial Sequence: Synthetic oligonucleotide
  Target: ATXN1; (+) strand; PAM type: NRG; PAM sequence: CAG
aaagctctaagttcagattt

SEQ ID NO: 146705 - DNA, 20 bp, Artificial Sequence
  Description of Artificial Sequence: Synthetic oligonucleotide
  Target: ATXN1; (+) strand; PAM type: NRG; PAM sequence: TAG
atttcagctccgccactcac

SEQ ID NO: 146706 - DNA, 20 bp, Artificial Sequence
  Description of Artificial Sequence: Synthetic oligonucleotide
  Target: ATXN1; (+) strand; PAM type: NRG; PAM sequence: CAG
cctaacttctctgtgcctct

SEQ ID NO: 146707 - DNA, 20 bp, Artificial Sequence
  Description of Artificial Sequence: Synthetic oligonucleotide
  Target: ATXN1; (+) strand; PAM type: NRG; PAM sequence: TGG
aacttctctgtgcctctcag

SEQ ID NO: 146708 - DNA, 20 bp, Artificial Sequence
  Description of Artificial Sequence: Synthetic oligonucleotide
  Target: ATXN1; (+) strand; PAM type: NRG; PAM sequence: CAG
tctgtgcctctcagtggcct

SEQ ID NO: 146709 - DNA, 20 bp, Artificial Sequence
  Description of Artificial Sequence: Synthetic oligonucleotide
  Target: ATXN1; (+) strand; PAM type: NRG; PAM sequence: AAG
tctcagtggcctcagctctg

SEQ ID NO: 146710 - DNA, 20 bp, Artificial Sequence
  Description of Artificial Sequence: Synthetic oligonucleotide
  Target: ATXN1; (+) strand; PAM type: NRG; PAM sequence: GAG
gtggcctcagctctgaagat

SEQ ID NO: 146711 - DNA, 20 bp, Artificial Sequence
  Description of Artificial Sequence: Synthetic oligonucleotide
  Target: ATXN1; (+) strand; PAM type: NRG; PAM sequence: TAG
tctgaagatgagaatcgtaa

SEQ ID NO: 146712 - DNA, 20 bp, Artificial Sequence
  Description of Artificial Sequence: Synthetic oligonucleotide
  Target: ATXN1; (+) strand; PAM type: NRG; PAM sequence: CAG
gatgagaatcgtaatagtac

SEQ ID NO: 146713 - DNA, 20 bp, Artificial Sequence
  Description of Artificial Sequence: Synthetic oligonucleotide
  Target: ATXN1; (+) strand; PAM type: NRG; PAM sequence: AAG
gagaatcgtaatagtaccag

SEQ ID NO: 146714 - DNA, 20 bp, Artificial Sequence
  Description of Artificial Sequence: Synthetic oligonucleotide
  Target: ATXN1; (+) strand; PAM type: NRG; PAM sequence: CAG
aactgatatctacctactaa

SEQ ID NO: 146715 - DNA, 20 bp, Artificial Sequence
  Description of Artificial Sequence: Synthetic oligonucleotide
  Target: ATXN1; (+) strand; PAM type: NRG; PAM sequence: AGG
actgatatctacctactaac

SEQ ID NO: 146716 - DNA, 20 bp, Artificial Sequence
  Description of Artificial Sequence: Synthetic oligonucleotide
  Target: ATXN1; (+) strand; PAM type: NRG; PAM sequence: GGG
ctgatatctacctactaaca

SEQ ID NO: 146717 - DNA, 20 bp, Artificial Sequence
  Description of Artificial Sequence: Synthetic oligonucleotide
  Target: ATXN1; (+) strand; PAM type: NRG; PAM sequence: GAG
cctactaacagggccactgt

SEQ ID NO: 146718 - DNA, 20 bp, Artificial Sequence
  Description of Artificial Sequence: Synthetic oligonucleotide
  Target: ATXN1; (+) strand; PAM type: NRG; PAM sequence: AGG
ctactaacagggccactgtg

SEQ ID NO: 146719 - DNA, 20 bp, Artificial Sequence
  Description of Artificial Sequence: Synthetic oligonucleotide
  Target: ATXN1; (+) strand; PAM type: NRG; PAM sequence: GAG
ggccactgtgaggattaaat

SEQ ID NO: 146720 - DNA, 20 bp, Artificial Sequence
  Description of Artificial Sequence: Synthetic oligonucleotide
  Target: ATXN1; (+) strand; PAM type: NRG; PAM sequence: CAG
taaatgagttactacacata

SEQ ID NO: 146721 - DNA, 20 bp, Artificial Sequence
  Description of Artificial Sequence: Synthetic oligonucleotide
  Target: ATXN1; (+) strand; PAM type: NRG; PAM sequence: AAG
gttactacacatacagcaca

SEQ ID NO: 146722 - DNA, 20 bp, Artificial Sequence
  Description of Artificial Sequence: Synthetic oligonucleotide
  Target: ATXN1; (+) strand; PAM type: NRG; PAM sequence: CAG
acatacagcacaaagaacat

SEQ ID NO: 146723 - DNA, 20 bp, Artificial Sequence
  Description of Artificial Sequence: Synthetic oligonucleotide
  Target: ATXN1; (+) strand; PAM type: NRG; PAM sequence: GAG
atacagcacaaagaacatca

SEQ ID NO: 146724 - DNA, 20 bp, Artificial Sequence
  Description of Artificial Sequence: Synthetic oligonucleotide
  Target: ATXN1; (+) strand; PAM type: NRG; PAM sequence: GAG
acaaagaacatcagagatgt

SEQ ID NO: 146725 - DNA, 20 bp, Artificial Sequence
  Description of Artificial Sequence: Synthetic oligonucleotide
  Target: ATXN1; (+) strand; PAM type: NRG; PAM sequence: TAG
cagagatgtgagcaaatgtt

SEQ ID NO: 146726 - DNA, 20 bp, Artificial Sequence
  Description of Artificial Sequence: Synthetic oligonucleotide
  Target: ATXN1; (+) strand; PAM type: NRG; PAM sequence: AAG
gtatcctttgaaatactaaa

SEQ ID NO: 146727 - DNA, 20 bp, Artificial Sequence
  Description of Artificial Sequence: Synthetic oligonucleotide
  Target: ATXN1; (+) strand; PAM type: NRG; PAM sequence: GAG
atcctttgaaatactaaaaa

SEQ ID NO: 146728 - DNA, 20 bp, Artificial Sequence
  Description of Artificial Sequence: Synthetic oligonucleotide
  Target: ATXN1; (+) strand; PAM type: NRG; PAM sequence: AAG
taaaaagagcactgaatttg

SEQ ID NO: 146729 - DNA, 20 bp, Artificial Sequence
  Description of Artificial Sequence: Synthetic oligonucleotide
  Target: ATXN1; (+) strand; PAM type: NRG; PAM sequence: CAG
agagcactgaatttgaagtc

SEQ ID NO: 146730 - DNA, 20 bp, Artificial Sequence
  Description of Artificial Sequence: Synthetic oligonucleotide
  Target: ATXN1; (+) strand; PAM type: NRG; PAM sequence: TGG
gcactgaatttgaagtccag

SEQ ID NO: 146731 - DNA, 20 bp, Artificial Sequence
  Description of Artificial Sequence: Synthetic oligonucleotide
  Target: ATXN1; (+) strand; PAM type: NRG; PAM sequence: GAG
ccgccattgatctactgtat

SEQ ID NO: 146732 - DNA, 20 bp, Artificial Sequence
  Description of Artificial Sequence: Synthetic oligonucleotide
  Target: ATXN1; (+) strand; PAM type: NRG; PAM sequence: TAG
attgatctactgtatgagct

SEQ ID NO: 146733 - DNA, 20 bp, Artificial Sequence
  Description of Artificial Sequence: Synthetic oligonucleotide
  Target: ATXN1; (+) strand; PAM type: NRG; PAM sequence: AGG
ttgatctactgtatgagctt

SEQ ID NO: 146734 - DNA, 20 bp, Artificial Sequence
  Description of Artificial Sequence: Synthetic oligonucleotide
  Target: ATXN1; (+) strand; PAM type: NRG; PAM sequence: AAG
tctactgtatgagcttaggc

SEQ ID NO: 146735 - DNA, 20 bp, Artificial Sequence
  Description of Artificial Sequence: Synthetic oligonucleotide
  Target: ATXN1; (+) strand; PAM type: NRG; PAM sequence: AAG
tgagcttaggcaagtccctc

SEQ ID NO: 146736 - DNA, 20 bp, Artificial Sequence
  Description of Artificial Sequence: Synthetic oligonucleotide
  Target: ATXN1; (+) strand; PAM type: NRG; PAM sequence: GAG
gcaagtccctcaagcttcct

SEQ ID NO: 146737 - DNA, 20 bp, Artificial Sequence
  Description of Artificial Sequence: Synthetic oligonucleotide
  Target: ATXN1; (+) strand; PAM type: NRG; PAM sequence: TGG
actgtcctcatctgtaaaaa

SEQ ID NO: 146738 - DNA, 20 bp, Artificial Sequence
  Description of Artificial Sequence: Synthetic oligonucleotide
  Target: ATXN1; (+) strand; PAM type: NRG; PAM sequence: GGG
ctgtcctcatctgtaaaaat

SEQ ID NO: 146739 - DNA, 20 bp, Artificial Sequence
  Description of Artificial Sequence: Synthetic oligonucleotide
  Target: ATXN1; (+) strand; PAM type: NRG; PAM sequence: CAG
catctgtaaaaatgggatac

SEQ ID NO: 146740 - DNA, 20 bp, Artificial Sequence
  Description of Artificial Sequence: Synthetic oligonucleotide
  Target: ATXN1; (+) strand; PAM type: NRG; PAM sequence: CGG
ctgtaaaaatgggataccag

SEQ ID NO: 146741 - DNA, 20 bp, Artificial Sequence
  Description of Artificial Sequence: Synthetic oligonucleotide
  Target: ATXN1; (+) strand; PAM type: NRG; PAM sequence: CAG
cagcggccttgcttcctttc

SEQ ID NO: 146742 - DNA, 20 bp, Artificial Sequence
  Description of Artificial Sequence: Synthetic oligonucleotide
  Target: ATXN1; (+) strand; PAM type: NRG; PAM sequence: AAG
cttcctttccagaacatcac

SEQ ID NO: 146743 - DNA, 20 bp, Artificial Sequence
  Description of Artificial Sequence: Synthetic oligonucleotide
  Target: ATXN1; (+) strand; PAM type: NRG; PAM sequence: AAG
tccagaacatcacaagaaac

SEQ ID NO: 146744 - DNA, 20 bp, Artificial Sequence
  Description of Artificial Sequence: Synthetic oligonucleotide
  Target: ATXN1; (+) strand; PAM type: NRG; PAM sequence: TGG
acatcacaagaaacaagcaa

SEQ ID NO: 146745 - DNA, 20 bp, Artificial Sequence
  Description of Artificial Sequence: Synthetic oligonucleotide
  Target: ATXN1; (+) strand; PAM type: NRG; PAM sequence: AAG
tcacaagaaacaagcaatgg

SEQ ID NO: 146746 - DNA, 20 bp, Artificial Sequence
  Description of Artificial Sequence: Synthetic oligonucleotide
  Target: ATXN1; (+) strand; PAM type: NRG; PAM sequence: AAG
agaaacaagcaatggaagac

SEQ ID NO: 146747 - DNA, 20 bp, Artificial Sequence
  Description of Artificial Sequence: Synthetic oligonucleotide
  Target: ATXN1; (+) strand; PAM type: NRG; PAM sequence: AGG
gaaacaagcaatggaagaca

SEQ ID NO: 146748 - DNA, 20 bp, Artificial Sequence
  Description of Artificial Sequence: Synthetic oligonucleotide
  Target: ATXN1; (+) strand; PAM type: NRG; PAM sequence: AAG
atggaagacaaggtatgtga

SEQ ID NO: 146749 - DNA, 20 bp, Artificial Sequence
  Description of Artificial Sequence: Synthetic oligonucleotide
  Target: ATXN1; (+) strand; PAM type: NRG; PAM sequence: AGG
tggaagacaaggtatgtgaa

SEQ ID NO: 146750 - DNA, 20 bp, Artificial Sequence
  Description of Artificial Sequence: Synthetic oligonucleotide
  Target: ATXN1; (+) strand; PAM type: NRG; PAM sequence: GGG
ggaagacaaggtatgtgaaa

SEQ ID NO: 146751 - DNA, 20 bp, Artificial Sequence
  Description of Artificial Sequence: Synthetic oligonucleotide
  Target: ATXN1; (+) strand; PAM type: NRG; PAM sequence: TGG
caaggtatgtgaaagggctt

SEQ ID NO: 146752 - DNA, 20 bp, Artificial Sequence
  Description of Artificial Sequence: Synthetic oligonucleotide
  Target: ATXN1; (+) strand; PAM type: NRG; PAM sequence: AAG
ggtatgtgaaagggctttgg

SEQ ID NO: 146753 - DNA, 20 bp, Artificial Sequence
  Description of Artificial Sequence: Synthetic oligonucleotide
  Target: ATXN1; (+) strand; PAM type: NRG; PAM sequence: AAG
aaagggctttggaagctaaa

SEQ ID NO: 146754 - DNA, 20 bp, Artificial Sequence
  Description of Artificial Sequence: Synthetic oligonucleotide
  Target: ATXN1; (+) strand; PAM type: NRG; PAM sequence: CAG
gaattatcgtcatcaacttt

SEQ ID NO: 146755 - DNA, 20 bp, Artificial Sequence
  Description of Artificial Sequence: Synthetic oligonucleotide
  Target: ATXN1; (+) strand; PAM type: NRG; PAM sequence: AAG
catcaactttcagcctctca

SEQ ID NO: 146756 - DNA, 20 bp, Artificial Sequence
  Description of Artificial Sequence: Synthetic oligonucleotide
  Target: ATXN1; (+) strand; PAM type: NRG; PAM sequence: AAG
ctttcagcctctcaaagcca

SEQ ID NO: 146757 - DNA, 20 bp, Artificial Sequence
  Description of Artificial Sequence: Synthetic oligonucleotide
  Target: ATXN1; (+) strand; PAM type: NRG; PAM sequence: GAG
ttcagcctctcaaagccaaa

SEQ ID NO: 146758 - DNA, 20 bp, Artificial Sequence
  Description of Artificial Sequence: Synthetic oligonucleotide
  Target: ATXN1; (+) strand; PAM type: NRG; PAM sequence: AGG
tcagcctctcaaagccaaag

SEQ ID NO: 146759 - DNA, 20 bp, Artificial Sequence
  Description of Artificial Sequence: Synthetic oligonucleotide
  Target: ATXN1; (+) strand; PAM type: NRG; PAM sequence: GAG
tattccattctctcctgcct

SEQ ID NO: 146760 - DNA, 20 bp, Artificial Sequence
  Description of Artificial Sequence: Synthetic oligonucleotide
  Target: ATXN1; (+) strand; PAM type: NRG; PAM sequence: AAG
ctgcctgagaatttaatact

SEQ ID NO: 146761 - DNA, 20 bp, Artificial Sequence
  Description of Artificial Sequence: Synthetic oligonucleotide
  Target: ATXN1; (+) strand; PAM type: NRG; PAM sequence: CAG
gagaatttaatactaagcat

SEQ ID NO: 146762 - DNA, 20 bp, Artificial Sequence
  Description of Artificial Sequence: Synthetic oligonucleotide
  Target: ATXN1; (+) strand; PAM type: NRG; PAM sequence: TGG
taagcatcagttccaaaacc

SEQ ID NO: 146763 - DNA, 20 bp, Artificial Sequence
  Description of Artificial Sequence: Synthetic oligonucleotide
  Target: ATXN1; (+) strand; PAM type: NRG; PAM sequence: CAG
cactgaactgctaatcataa

SEQ ID NO: 146764 - DNA, 20 bp, Artificial Sequence
  Description of Artificial Sequence: Synthetic oligonucleotide
  Target: ATXN1; (+) strand; PAM type: NRG; PAM sequence: CAG
atcataacagaacacatgtc

SEQ ID NO: 146765 - DNA, 20 bp, Artificial Sequence
  Description of Artificial Sequence: Synthetic oligonucleotide
  Target: ATXN1; (+) strand; PAM type: NRG; PAM sequence: CAG
agaacacatgtccagtcacc

SEQ ID NO: 146766 - DNA, 20 bp, Artificial Sequence
  Description of Artificial Sequence: Synthetic oligonucleotide
  Target: ATXN1; (+) strand; PAM type: NRG; PAM sequence: AGG
gaacacatgtccagtcaccc

SEQ ID NO: 146767 - DNA, 20 bp, Artificial Sequence
  Description of Artificial Sequence: Synthetic oligonucleotide
  Target: ATXN1; (+) strand; PAM type: NRG; PAM sequence: CAG
tcacccaggacttgatcaaa

SEQ ID NO: 146768 - DNA, 20 bp, Artificial Sequence
  Description of Artificial Sequence: Synthetic oligonucleotide
  Target: ATXN1; (+) strand; PAM type: NRG; PAM sequence: GAG
tccttctgcacacccaccgt

SEQ ID NO: 146769 - DNA, 20 bp, Artificial Sequence
  Description of Artificial Sequence: Synthetic oligonucleotide
  Target: ATXN1; (+) strand; PAM type: NRG; PAM sequence: TGG
aacataattgatgctcatca

SEQ ID NO: 146770 - DNA, 20 bp, Artificial Sequence
  Description of Artificial Sequence: Synthetic oligonucleotide
  Target: ATXN1; (+) strand; PAM type: NRG; PAM sequence: AAG
tgatgctcatcatggcccta

SEQ ID NO: 146771 - DNA, 20 bp, Artificial Sequence
  Description of Artificial Sequence: Synthetic oligonucleotide
  Target: ATXN1; (+) strand; PAM type: NRG; PAM sequence: AAG
tcatggccctaaagcactcc

SEQ ID NO: 146772 - DNA, 20 bp, Artificial Sequence
  Description of Artificial Sequence: Synthetic oligonucleotide
  Target: ATXN1; (+) strand; PAM type: NRG; PAM sequence: AAG
taaagcactccaagactctg

SEQ ID NO: 146773 - DNA, 20 bp, Artificial Sequence
  Description of Artificial Sequence: Synthetic oligonucleotide
  Target: ATXN1; (+) strand; PAM type: NRG; PAM sequence: CAG
ccaagactctgaagtacctt

SEQ ID NO: 146774 - DNA, 20 bp, Artificial Sequence
  Description of Artificial Sequence: Synthetic oligonucleotide
  Target: ATXN1; (+) strand; PAM type: NRG; PAM sequence: AGG
caagactctgaagtaccttc

SEQ ID NO: 146775 - DNA, 20 bp, Artificial Sequence
  Description of Artificial Sequence: Synthetic oligonucleotide
  Target: ATXN1; (+) strand; PAM type: NRG; PAM sequence: GGG
aagactctgaagtaccttca

SEQ ID NO: 146776 - DNA, 20 bp, Artificial Sequence
  Description of Artificial Sequence: Synthetic oligonucleotide
  Target: ATXN1; (+) strand; PAM type: NRG; PAM sequence: AAG
ctctgaagtaccttcaggga

SEQ ID NO: 146777 - DNA, 20 bp, Artificial Sequence
  Description of Artificial Sequence: Synthetic oligonucleotide
  Target: ATXN1; (+) strand; PAM type: NRG; PAM sequence: CAG
gggaaagattaaattatgtt

SEQ ID NO: 146778 - DNA, 20 bp, Artificial Sequence
  Description of Artificial Sequence: Synthetic oligonucleotide
  Target: ATXN1; (+) strand; PAM type: NRG; PAM sequence: TAG
agattaaattatgttcagcc

SEQ ID NO: 146779 - DNA, 20 bp, Artificial Sequence
  Description of Artificial Sequence: Synthetic oligonucleotide
  Target: ATXN1; (+) strand; PAM type: NRG; PAM sequence: AAG
gttcagcctagtttattatg

SEQ ID NO: 146780 - DNA, 20 bp, Artificial Sequence
  Description of Artificial Sequence: Synthetic oligonucleotide
  Target: ATXN1; (+) strand; PAM type: NRG; PAM sequence: TGG
tactcaaattctttgaaaat

SEQ ID NO: 146781 - DNA, 20 bp, Artificial Sequence
  Description of Artificial Sequence: Synthetic oligonucleotide
  Target: ATXN1; (+) strand; PAM type: NRG; PAM sequence: TAG
ttctttgaaaattggtgacc

SEQ ID NO: 146782 - DNA, 20 bp, Artificial Sequence
  Description of Artificial Sequence: Synthetic oligonucleotide
  Target: ATXN1; (+) strand; PAM type: NRG; PAM sequence: AGG
tctttgaaaattggtgacct

SEQ ID NO: 146783 - DNA, 20 bp, Artificial Sequence
  Description of Artificial Sequence: Synthetic oligonucleotide
  Target: ATXN1; (+) strand; PAM type: NRG; PAM sequence: AAG
gaaaattggtgacctaggaa

SEQ ID NO: 146784 - DNA, 20 bp, Artificial Sequence
  Description of Artificial Sequence: Synthetic oligonucleotide
  Target: ATXN1; (+) strand; PAM type: NRG; PAM sequence: CAG
ttggtgacctaggaaaagca

SEQ ID NO: 146785 - DNA, 20 bp, Artificial Sequence
  Description of Artificial Sequence: Synthetic oligonucleotide
  Target: ATXN1; (+) strand; PAM type: NRG; PAM sequence: GAG
ggtgacctaggaaaagcaca

SEQ ID NO: 146786 - DNA, 20 bp, Artificial Sequence
  Description of Artificial Sequence: Synthetic oligonucleotide
  Target: ATXN1; (+) strand; PAM type: NRG; PAM sequence: GAG
tgacctaggaaaagcacaga

SEQ ID NO: 146787 - DNA, 20 bp, Artificial Sequence
  Description of Artificial Sequence: Synthetic oligonucleotide
  Target: ATXN1; (+) strand; PAM type: NRG; PAM sequence: AAG
ctaggaaaagcacagagagt

SEQ ID NO: 146788 - DNA, 20 bp, Artificial Sequence
  Description of Artificial Sequence: Synthetic oligonucleotide
  Target: ATXN1; (+) strand; PAM type: NRG; PAM sequence: CAG
aaagcacagagagtaagtca

SEQ ID NO: 146789 - DNA, 20 bp, Artificial Sequence
  Description of Artificial Sequence: Synthetic oligonucleotide
  Target: ATXN1; (+) strand; PAM type: NRG; PAM sequence: AGG
aagcacagagagtaagtcac

SEQ ID NO: 146790 - DNA, 20 bp, Artificial Sequence
  Description of Artificial Sequence: Synthetic oligonucleotide
  Target: ATXN1; (+) strand; PAM type: NRG; PAM sequence: TGG
agagtaagtcacaggctctc

SEQ ID NO: 146791 - DNA, 20 bp, Artificial Sequence
  Description of Artificial Sequence: Synthetic oligonucleotide
  Target: ATXN1; (+) strand; PAM type: NRG; PAM sequence: TGG
gtcacaggctctctggtaac

SEQ ID NO: 146792 - DNA, 20 bp, Artificial Sequence
  Description of Artificial Sequence: Synthetic oligonucleotide
  Target: ATXN1; (+) strand; PAM type: NRG; PAM sequence: AAG
acaggctctctggtaactgg

SEQ ID NO: 146793 - DNA, 20 bp, Artificial Sequence
  Description of Artificial Sequence: Synthetic oligonucleotide
  Target: ATXN1; (+) strand; PAM type: NRG; PAM sequence: CAG
aactggaagcctctcctcac

SEQ ID NO: 146794 - DNA, 20 bp, Artificial Sequence
  Description of Artificial Sequence: Synthetic oligonucleotide
  Target: ATXN1; (+) strand; PAM type: NRG; PAM sequence: CAG
tctcctcaccagtccacccc

SEQ ID NO: 146795 - DNA, 20 bp, Artificial Sequence
  Description of Artificial Sequence: Synthetic oligonucleotide
  Target: ATXN1; (+) strand; PAM type: NRG; PAM sequence: CAG
ccacccccagtcacccttca

SEQ ID NO: 146796 - DNA, 20 bp, Artificial Sequence
  Description of Artificial Sequence: Synthetic oligonucleotide
  Target: ATXN1; (+) strand; PAM type: NRG; PAM sequence: GAG
acccccagtcacccttcaca

SEQ ID NO: 146797 - DNA, 20 bp, Artificial Sequence
  Description of Artificial Sequence: Synthetic oligonucleotide
  Target: ATXN1; (+) strand; PAM type: NRG; PAM sequence: CAG
agagttaattgtaaaaaata

SEQ ID NO: 146798 - DNA, 20 bp, Artificial Sequence
  Description of Artificial Sequence: Synthetic oligonucleotide
  Target: ATXN1; (+) strand; PAM type: NRG; PAM sequence: TAG
gtaaaaaatacagtccaccc

SEQ ID NO: 146799 - DNA, 20 bp, Artificial Sequence
  Description of Artificial Sequence: Synthetic oligonucleotide
  Target: ATXN1; (+) strand; PAM type: NRG; PAM sequence: AGG
taaaaaatacagtccaccct

SEQ ID NO: 146800 - DNA, 20 bp, Artificial Sequence
  Description of Artificial Sequence: Synthetic oligonucleotide
  Target: ATXN1; (+) strand; PAM type: NRG; PAM sequence: GGG
aaaaaatacagtccacccta

SEQ ID NO: 146801 - DNA, 20 bp, Artificial Sequence
  Description of Artificial Sequence: Synthetic oligonucleotide
  Target: ATXN1; (+) strand; PAM type: NRG; PAM sequence: TAG
aaatacagtccaccctaggg

SEQ ID NO: 146802 - DNA, 20 bp, Artificial Sequence
  Description of Artificial Sequence: Synthetic oligonucleotide
  Target: ATXN1; (+) strand; PAM type: NRG; PAM sequence: AGG
aatacagtccaccctagggt

SEQ ID NO: 146803 - DNA, 20 bp, Artificial Sequence
  Description of Artificial Sequence: Synthetic oligonucleotide
  Target: ATXN1; (+) strand; PAM type: NRG; PAM sequence: TGG
caccctagggtaggaaaaac

SEQ ID NO: 146804 - DNA, 20 bp, Artificial Sequence
  Description of Artificial Sequence: Synthetic oligonucleotide
  Target: ATXN1; (+) strand; PAM type: NRG; PAM sequence: GGG
accctagggtaggaaaaact

SEQ ID NO: 146805 - DNA, 20 bp, Artificial Sequence
  Description of Artificial Sequence: Synthetic oligonucleotide
  Target: ATXN1; (+) strand; PAM type: NRG; PAM sequence: AAG
ttccgacacactaattataa

SEQ ID NO: 146806 - DNA, 20 bp, Artificial Sequence
  Description of Artificial Sequence: Synthetic oligonucleotide
  Target: ATXN1; (+) strand; PAM type: NRG; PAM sequence: AAG
acactaattataaaagtcaa

SEQ ID NO: 146807 - DNA, 20 bp, Artificial Sequence
  Description of Artificial Sequence: Synthetic oligonucleotide
  Target: ATXN1; (+) strand; PAM type: NRG; PAM sequence: TGG
ttataaaagtcaaaagaact

SEQ ID NO: 146808 - DNA, 20 bp, Artificial Sequence
  Description of Artificial Sequence: Synthetic oligonucleotide
  Target: ATXN1; (+) strand; PAM type: NRG; PAM sequence: AAG
cttggccttgcctaatcttc

SEQ ID NO: 146809 - DNA, 20 bp, Artificial Sequence
  Description of Artificial Sequence: Synthetic oligonucleotide
  Target: ATXN1; (+) strand; PAM type: NRG; PAM sequence: AGG
ttggccttgcctaatcttca

SEQ ID NO: 146810 - DNA, 20 bp, Artificial Sequence
  Description of Artificial Sequence: Synthetic oligonucleotide
  Target: ATXN1; (+) strand; PAM type: NRG; PAM sequence: CAG
cttcaaggatcactaatgtg

SEQ ID NO: 146811 - DNA, 20 bp, Artificial Sequence
  Description of Artificial Sequence: Synthetic oligonucleotide
  Target: ATXN1; (+) strand; PAM type: NRG; PAM sequence: AAG
actaatgtgcagaaatacaa

SEQ ID NO: 146812 - DNA, 20 bp, Artificial Sequence
  Description of Artificial Sequence: Synthetic oligonucleotide
  Target: ATXN1; (+) strand; PAM type: NRG; PAM sequence: AAG
atgaaaaatttaatctacct

SEQ ID NO: 146813 - DNA, 20 bp, Artificial Sequence
  Description of Artificial Sequence: Synthetic oligonucleotide
  Target: ATXN1; (+) strand; PAM type: NRG; PAM sequence: TAG
agatgcctacatgtttcaaa

SEQ ID NO: 146814 - DNA, 20 bp, Artificial Sequence
  Description of Artificial Sequence: Synthetic oligonucleotide
  Target: ATXN1; (+) strand; PAM type: NRG; PAM sequence: AAG
aatagacttttgttcttgct

SEQ ID NO: 146815 - DNA, 20 bp, Artificial Sequence
  Description of Artificial Sequence: Synthetic oligonucleotide
  Target: ATXN1; (+) strand; PAM type: NRG; PAM sequence: CAG
atatatcactatccgattat

SEQ ID NO: 146816 - DNA, 20 bp, Artificial Sequence
  Description of Artificial Sequence: Synthetic oligonucleotide
  Target: ATXN1; (+) strand; PAM type: NRG; PAM sequence: CAG
agtactcaaaaatataaaaa

SEQ ID NO: 146817 - DNA, 20 bp, Artificial Sequence
  Description of Artificial Sequence: Synthetic oligonucleotide
  Target: ATXN1; (+) strand; PAM type: NRG; PAM sequence: GAG
tactcaaaaatataaaaaca

SEQ ID NO: 146818 - DNA, 20 bp, Artificial Sequence
  Description of Artificial Sequence: Synthetic oligonucleotide
  Target: ATXN1; (+) strand; PAM type: NRG; PAM sequence: AGG
actcaaaaatataaaaacag

SEQ ID NO: 146819 - DNA, 20 bp, Artificial Sequence
  Description of Artificial Sequence: Synthetic oligonucleotide
  Target: ATXN1; (+) strand; PAM type: NRG; PAM sequence: GAG
tcaaaaatataaaaacagag

SEQ ID NO: 146820 - DNA, 20 bp, Artificial Sequence
  Description of Artificial Sequence: Synthetic oligonucleotide
  Target: ATXN1; (+) strand; PAM type: NRG; PAM sequence: AAG
aaatataaaaacagaggagt

SEQ ID NO: 146821 - DNA, 20 bp, Artificial Sequence
  Description of Artificial Sequence: Synthetic oligonucleotide
  Target: ATXN1; (+) strand; PAM type: NRG; PAM sequence: TAG
ataaaaacagaggagtaagt

SEQ ID NO: 146822 - DNA, 20 bp, Artificial Sequence
  Description of Artificial Sequence: Synthetic oligonucleotide
  Target: ATXN1; (+) strand; PAM type: NRG; PAM sequence: GAG
taagttagtattatgctcct

SEQ ID NO: 146823 - DNA, 20 bp, Artificial Sequence
  Description of Artificial Sequence: Synthetic oligonucleotide
  Target: ATXN1; (+) strand; PAM type: NRG; PAM sequence: AAG
gttagtattatgctcctgag

SEQ ID NO: 146824 - DNA, 20 bp, Artificial Sequence
  Description of Artificial Sequence: Synthetic oligonucleotide
  Target: ATXN1; (+) strand; PAM type: NRG; PAM sequence: GAG
tagtattatgctcctgagaa

SEQ ID NO: 146825 - DNA, 20 bp, Artificial Sequence
  Description of Artificial Sequence: Synthetic oligonucleotide
  Target: ATXN1; (+) strand; PAM type: NRG; PAM sequence: AGG
agtattatgctcctgagaag

SEQ ID NO: 146826 - DNA, 20 bp, Artificial Sequence
  Description of Artificial Sequence: Synthetic oligonucleotide
  Target: ATXN1; (+) strand; PAM type: NRG; PAM sequence: TAG
gagaagaggaaattaacatt

SEQ ID NO: 146827 - DNA, 20 bp, Artificial Sequence
  Description of Artificial Sequence: Synthetic oligonucleotide
  Target: ATXN1; (+) strand; PAM type: NRG; PAM sequence: TGG
gaaattaacatttagtttac

SEQ ID NO: 146828 - DNA, 20 bp, Artificial Sequence
  Description of Artificial Sequence: Synthetic oligonucleotide
  Target: ATXN1; (+) strand; PAM type: NRG; PAM sequence: GGG
aaattaacatttagtttact

SEQ ID NO: 146829 - DNA, 20 bp, Artificial Sequence
  Description of Artificial Sequence: Synthetic oligonucleotide
  Target: ATXN1; (+) strand; PAM type: NRG; PAM sequence: AAG
taacatttagtttactgggt

SEQ ID NO: 146830 - DNA, 20 bp, Artificial Sequence
  Description of Artificial Sequence: Synthetic oligonucleotide
  Target: ATXN1; (+) strand; PAM type: NRG; PAM sequence: AAG
tttctttttttttttttttt

SEQ ID NO: 146831 - DNA, 20 bp, Artificial Sequence
  Description of Artificial Sequence: Synthetic oligonucleotide
  Target: ATXN1; (+) strand; PAM type: NRG; PAM sequence: GAG
tcttttttttttttttttaa

SEQ ID NO: 146832 - DNA, 20 bp, Artificial Sequence
  Description of Artificial Sequence: Synthetic oligonucleotide
  Target: ATXN1; (+) strand; PAM type: NRG; PAM sequence: CGG
ttttttttttttttaagaga

SEQ ID NO: 146833 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttaagagacg

SEQ ID NO: 146834 - DNA, 20 bp, Artificial Sequence
  Description of Artificial Sequence: Synthetic oligonucleotide
  Target: ATXN1; (+) strand; PAM type: NRG; PAM sequence: CAG
acggagtctcgctctgtcgc

SEQ ID NO: 146835 - DNA, 20 bp, Artificial Sequence
  Description of Artificial Sequence: Synthetic oligonucleotide
  Target: ATXN1; (+) strand; PAM type: NRG; PAM sequence: AGG
cggagtctcgctctgtcgcc

SEQ ID NO: 146836 - DNA, 20 bp, Artificial Sequence
  Description of Artificial Sequence: Synthetic oligonucleotide
  Target: ATXN1; (+) strand; PAM type: NRG; PAM sequence: TGG
gtctcgctctgtcgccaggc

SEQ ID NO: 146837 - DNA, 20 bp, Artificial Sequence
  Description of Artificial Sequence: Synthetic oligonucleotide
  Target: ATXN1; (+) strand; PAM type: NRG; PAM sequence: GAG
ctcgctctgtcgccaggctg

SEQ ID NO: 146838 - DNA, 20 bp, Artificial Sequence
  Description of Artificial Sequence: Synthetic oligonucleotide
  Target: ATXN1; (+) strand; PAM type: NRG; PAM sequence: CAG
tctgtcgccaggctggagtg

SEQ ID NO: 146839 - DNA, 20 bp, Artificial Sequence
  Description of Artificial Sequence: Synthetic oligonucleotide
  Target: ATXN1; (+) strand; PAM type: NRG; PAM sequence: TGG
gtcgccaggctggagtgcag

SEQ ID NO: 146840 - DNA, 20 bp, Artificial Sequence
  Description of Artificial Sequence: Synthetic oligonucleotide
  Target: ATXN1; (+) strand; PAM type: NRG; PAM sequence: TGG
ggagtgcagtggtgtgatct

SEQ ID NO: 146841 - DNA, 20 bp, Artificial Sequence
  Description of Artificial Sequence: Synthetic oligonucleotide
  Target: ATXN1; (+) strand; PAM type: NRG; PAM sequence: AAG
gtgtgatcttggctcactgc

SEQ ID NO: 146842 - DNA, 20 bp, Artificial Sequence
  Description of Artificial Sequence: Synthetic oligonucleotide
  Target: ATXN1; (+) strand; PAM type: NRG; PAM sequence: TGG
ctgcaagctccgccgcctcc

SEQ ID NO: 146843 - DNA, 20 bp, Artificial Sequence
  Description of Artificial Sequence: Synthetic oligonucleotide
  Target: ATXN1; (+) strand; PAM type: NRG; PAM sequence: TAG
gctccgccgcctcctggttc

SEQ ID NO: 146844 - DNA, 20 bp, Artificial Sequence
  Description of Artificial Sequence: Synthetic oligonucleotide
  Target: ATXN1; (+) strand; PAM type: NRG; PAM sequence: CAG
ttctagcaactctcctgcct

SEQ ID NO: 146845 - DNA, 20 bp, Artificial Sequence
  Description of Artificial Sequence: Synthetic oligonucleotide
  Target: ATXN1; (+) strand; PAM type: NRG; PAM sequence: AAG
ctctcctgcctcagcctccc

SEQ ID NO: 146846 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccaag

SEQ ID NO: 146847 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtagc

SEQ ID NO: 146848 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagct

SEQ ID NO: 146849 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggatta

SEQ ID NO: 146850 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggattac

SEQ ID NO: 146851 - DNA, 20 bp, Artificial Sequence
  Description of Artificial Sequence: Synthetic oligonucleotide
  Target: ATXN1; (+) strand; PAM type: NRG; PAM sequence: CAG
caggtgtgtgccaccacgcc

SEQ ID NO: 146852 - DNA, 20 bp, Artificial Sequence
  Description of Artificial Sequence: Synthetic oligonucleotide
  Target: ATXN1; (+) strand; PAM type: NRG; PAM sequence: TAG
ccagctaattttttgtattt

SEQ ID NO: 146853 - DNA, 20 bp, Artificial Sequence
  Description of Artificial Sequence: Synthetic oligonucleotide
  Target: ATXN1; (+) strand; PAM type: NRG; PAM sequence: TGG
gctaattttttgtattttag

SEQ ID NO: 146854 - DNA, 20 bp, Artificial Sequence
  Description of Artificial Sequence: Synthetic oligonucleotide
  Target: ATXN1; (+) strand; PAM type: NRG; PAM sequence: GAG
taattttttgtattttagtg

SEQ ID NO: 146855 - DNA, 20 bp, Artificial Sequence
  Description of Artificial Sequence: Synthetic oligonucleotide
  Target: ATXN1; (+) strand; PAM type: NRG; PAM sequence: AGG
aattttttgtattttagtgg

SEQ ID NO: 146856 - DNA, 20 bp, Artificial Sequence
  Description of Artificial Sequence: Synthetic oligonucleotide
  Target: ATXN1; (+) strand; PAM type: NRG; PAM sequence: TGG
tttttgtattttagtggagg

SEQ ID NO: 146857 - DNA, 20 bp, Artificial Sequence
  Description of Artificial Sequence: Synthetic oligonucleotide
  Target: ATXN1; (+) strand; PAM type: NRG; PAM sequence: GGG
ttttgtattttagtggaggt

SEQ ID NO: 146858 - DNA, 20 bp, Artificial Sequence
  Description of Artificial Sequence: Synthetic oligonucleotide
  Target: ATXN1; (+) strand; PAM type: NRG; PAM sequence: GGG
tttgtattttagtggaggtg

SEQ ID NO: 146859 - DNA, 20 bp, Artificial Sequence
  Description of Artificial Sequence: Synthetic oligonucleotide
  Target: ATXN1; (+) strand; PAM type: NRG; PAM sequence: CAG
tggggtttcaccatgttgcc

SEQ ID NO: 146860 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccatgttgccc

SEQ ID NO: 146861 - DNA, 20 bp, Artificial Sequence
  Description of Artificial Sequence: Synthetic oligonucleotide
  Target: ATXN1; (+) strand; PAM type: NRG; PAM sequence: AAG
cacaattgtcccttctttaa

SEQ ID NO: 146862 - DNA, 20 bp, Artificial Sequence
  Description of Artificial Sequence: Synthetic oligonucleotide
  Target: ATXN1; (+) strand; PAM type: NRG; PAM sequence: GAG
gaaattatgtctatgttaat

SEQ ID NO: 146863 - DNA, 20 bp, Artificial Sequence
  Description of Artificial Sequence: Synthetic oligonucleotide
  Target: ATXN1; (+) strand; PAM type: NRG; PAM sequence: AGG
aaattatgtctatgttaatg

SEQ ID NO: 146864 - DNA, 20 bp, Artificial Sequence
  Description of Artificial Sequence: Synthetic oligonucleotide
  Target: ATXN1; (+) strand; PAM type: NRG; PAM sequence: AAG
ggaacgtaacaaaataatga

SEQ ID NO: 146865 - DNA, 20 bp, Artificial Sequence
  Description of Artificial Sequence: Synthetic oligonucleotide
  Target: ATXN1; (+) strand; PAM type: NRG; PAM sequence: AGG
gaacgtaacaaaataatgaa

SEQ ID NO: 146866 - DNA, 20 bp, Artificial Sequence
  Description of Artificial Sequence: Synthetic oligonucleotide
  Target: ATXN1; (+) strand; PAM type: NRG; PAM sequence: TGG
tgaaaggctaaaccgtatta

SEQ ID NO: 146867 - DNA, 20 bp, Artificial Sequence
  Description of Artificial Sequence: Synthetic oligonucleotide
  Target: ATXN1; (+) strand; PAM type: NRG; PAM sequence: AAG
aaaccgtattatggttgtaa

SEQ ID NO: 146868 - DNA, 20 bp, Artificial Sequence
  Description of Artificial Sequence: Synthetic oligonucleotide
  Target: ATXN1; (+) strand; PAM type: NRG; PAM sequence: CAG
gtattatggttgtaaaagca

SEQ ID NO: 146869 - DNA, 20 bp, Artificial Sequence
  Description of Artificial Sequence: Synthetic oligonucleotide
  Target: ATXN1; (+) strand; PAM type: NRG; PAM sequence: TAG
tttaaattatttcaacactg

SEQ ID NO: 146870 - DNA, 20 bp, Artificial Sequence
  Description of Artificial Sequence: Synthetic oligonucleotide
  Target: ATXN1; (+) strand; PAM type: NRG; PAM sequence: TAG
attatgttatcttttccgat

SEQ ID NO: 146871 - DNA, 20 bp, Artificial Sequence
  Description of Artificial Sequence: Synthetic oligonucleotide
  Target: ATXN1; (+) strand; PAM type: NRG; PAM sequence: TGG
tatcttttccgattagaaac

SEQ ID NO: 146872 - DNA, 20 bp, Artificial Sequence
  Description of Artificial Sequence: Synthetic oligonucleotide
  Target: ATXN1; (+) strand; PAM type: NRG; PAM sequence: GGG
atcttttccgattagaaact

SEQ ID NO: 146873 - DNA, 20 bp, Artificial Sequence
  Description of Artificial Sequence: Synthetic oligonucleotide
  Target: ATXN1; (+) strand; PAM type: NRG; PAM sequence: CAG
agaaactgggaaacacacgt

SEQ ID NO: 146874 - DNA, 20 bp, Artificial Sequence
  Description of Artificial Sequence: Synthetic oligonucleotide
  Target: ATXN1; (+) strand; PAM type: NRG; PAM sequence: AAG
gggaaacacacgtcagcctt

SEQ ID NO: 146875 - DNA, 20 bp, Artificial Sequence
  Description of Artificial Sequence: Synthetic oligonucleotide
  Target: ATXN1; (+) strand; PAM type: NRG; PAM sequence: AGG
ggaaacacacgtcagcctta

SEQ ID NO: 146876 - DNA, 20 bp, Artificial Sequence
  Description of Artificial Sequence: Synthetic oligonucleotide
  Target: ATXN1; (+) strand; PAM type: NRG; PAM sequence: CAG
cagccttaaggactacattt

SEQ ID NO: 146877 - DNA, 20 bp, Artificial Sequence
  Description of Artificial Sequence: Synthetic oligonucleotide
  Target: ATXN1; (+) strand; PAM type: NRG; PAM sequence: GAG
gccttaaggactacatttca

SEQ ID NO: 146878 - DNA, 20 bp, Artificial Sequence
  Description of Artificial Sequence: Synthetic oligonucleotide
  Target: ATXN1; (+) strand; PAM type: NRG; PAM sequence: GAG
aaggactacatttcagagct

SEQ ID NO: 146879 - DNA, 20 bp, Artificial Sequence
  Description of Artificial Sequence: Synthetic oligonucleotide
  Target: ATXN1; (+) strand; PAM type: NRG; PAM sequence: GAG
ggactacatttcagagctga

SEQ ID NO: 146880 - DNA, 20 bp, Artificial Sequence
  Description of Artificial Sequence: Synthetic oligonucleotide
  Target: ATXN1; (+) strand; PAM type: NRG; PAM sequence: GAG
actacatttcagagctgaga

SEQ ID NO: 146881 - DNA, 20 bp, Artificial Sequence
  Description of Artificial Sequence: Synthetic oligonucleotide
  Target: ATXN1; (+) strand; PAM type: NRG; PAM sequence: AAG
ttcagagctgagagagaaac

SEQ ID NO: 146882 - DNA, 20 bp, Artificial Sequence
  Description of Artificial Sequence: Synthetic oligonucleotide
  Target: ATXN1; (+) strand; PAM type: NRG; PAM sequence: TGG
agagctgagagagaaacaag

SEQ ID NO: 146883 - DNA, 20 bp, Artificial Sequence
  Description of Artificial Sequence: Synthetic oligonucleotide
  Target: ATXN1; (+) strand; PAM type: NRG; PAM sequence: TGG
tccaactcacatctcctctc

SEQ ID NO: 146884 - DNA, 20 bp, Artificial Sequence
  Description of Artificial Sequence: Synthetic oligonucleotide
  Target: ATXN1; (+) strand; PAM type: NRG; PAM sequence: GAG
caactcacatctcctctctg

SEQ ID NO: 146885 - DNA, 20 bp, Artificial Sequence
  Description of Artificial Sequence: Synthetic oligonucleotide
  Target: ATXN1; (+) strand; PAM type: NRG; PAM sequence: AAG
ctctctggagaattcctgat

SEQ ID NO: 146886 - DNA, 20 bp, Artificial Sequence
  Description of Artificial Sequence: Synthetic oligonucleotide
  Target: ATXN1; (+) strand; PAM type: NRG; PAM sequence: GAG
ctctggagaattcctgataa

SEQ ID NO: 146887 - DNA, 20 bp, Artificial Sequence
  Description of Artificial Sequence: Synthetic oligonucleotide
  Target: ATXN1; (+) strand; PAM type: NRG; PAM sequence: AGG
tctggagaattcctgataag

SEQ ID NO: 146888 - DNA, 20 bp, Artificial Sequence
  Description of Artificial Sequence: Synthetic oligonucleotide
  Target: ATXN1; (+) strand; PAM type: NRG; PAM sequence: GGG
ctggagaattcctgataaga

SEQ ID NO: 146889 - DNA, 20 bp, Artificial Sequence
  Description of Artificial Sequence: Synthetic oligonucleotide
  Target: ATXN1; (+) strand; PAM type: NRG; PAM sequence: CAG
tacctctgtttgaacatctc

SEQ ID NO: 146890 - DNA, 20 bp, Artificial Sequence
  Description of Artificial Sequence: Synthetic oligonucleotide
  Target: ATXN1; (+) strand; PAM type: NRG; PAM sequence: CAG
tgtttgaacatctccagtga

SEQ ID NO: 146891 - DNA, 20 bp, Artificial Sequence
  Description of Artificial Sequence: Synthetic oligonucleotide
  Target: ATXN1; (+) strand; PAM type: NRG; PAM sequence: GAG
tttgaacatctccagtgaca

SEQ ID NO: 146892 - DNA, 20 bp, Artificial Sequence
  Description of Artificial Sequence: Synthetic oligonucleotide
  Target: ATXN1; (+) strand; PAM type: NRG; PAM sequence: AGG
ttgaacatctccagtgacag

SEQ ID NO: 146893 - DNA, 20 bp, Artificial Sequence
  Description of Artificial Sequence: Synthetic oligonucleotide
  Target: ATXN1; (+) strand; PAM type: NRG; PAM sequence: CAG
ggtttcactgctaaatcaat

SEQ ID NO: 146894 - DNA, 20 bp, Artificial Sequence
  Description of Artificial Sequence: Synthetic oligonucleotide
  Target: ATXN1; (+) strand; PAM type: NRG; PAM sequence: TAG
caatcagcttgttccatttt

SEQ ID NO: 146895 - DNA, 20 bp, Artificial Sequence
  Description of Artificial Sequence: Synthetic oligonucleotide
  Target: ATXN1; (+) strand; PAM type: NRG; PAM sequence: CAG
cagcttgttccatttttaga

SEQ ID NO: 146896 - DNA, 20 bp, Artificial Sequence
  Description of Artificial Sequence: Synthetic oligonucleotide
  Target: ATXN1; (+) strand; PAM type: NRG; PAM sequence: CAG
ttttagacagtcctgattgc

SEQ ID NO: 146897 - DNA, 20 bp, Artificial Sequence
  Description of Artificial Sequence: Synthetic oligonucleotide
  Target: ATXN1; (+) strand; PAM type: NRG; PAM sequence: AAG
ttgccagaatgttcctcctc

SEQ ID NO: 146898 - DNA, 20 bp, Artificial Sequence
  Description of Artificial Sequence: Synthetic oligonucleotide
  Target: ATXN1; (+) strand; PAM type: NRG; PAM sequence: TGG
ccagaatgttcctcctcaag

SEQ ID NO: 146899 - DNA, 20 bp, Artificial Sequence
  Description of Artificial Sequence: Synthetic oligonucleotide
  Target: ATXN1; (+) strand; PAM type: NRG; PAM sequence: GAG
agaatgttcctcctcaagtg

SEQ ID NO: 146900 - DNA, 20 bp, Artificial Sequence
  Description of Artificial Sequence: Synthetic oligonucleotide
  Target: ATXN1; (+) strand; PAM type: NRG; PAM sequence: TAG
aagtggagtcgaactctccc

SEQ ID NO: 146901 - DNA, 20 bp, Artificial Sequence
  Description of Artificial Sequence: Synthetic oligonucleotide
  Target: ATXN1; (+) strand; PAM type: NRG; PAM sequence: AGG
agtggagtcgaactctccct

SEQ ID NO: 146902 - DNA, 20 bp, Artificial Sequence
  Description of Artificial Sequence: Synthetic oligonucleotide
  Target: ATXN1; (+) strand; PAM type: NRG; PAM sequence: GGG
gtggagtcgaactctcccta

SEQ ID NO: 146903 - DNA, 20 bp, Artificial Sequence
  Description of Artificial Sequence: Synthetic oligonucleotide
  Target: ATXN1; (+) strand; PAM type: NRG; PAM sequence: TAG
gttaacttccctcctgttct

SEQ ID NO: 146904 - DNA, 20 bp, Artificial Sequence
  Description of Artificial Sequence: Synthetic oligonucleotide
  Target: ATXN1; (+) strand; PAM type: NRG; PAM sequence: TGG
tccctcctgttcttagttct

SEQ ID NO: 146905 - DNA, 20 bp, Artificial Sequence
  Description of Artificial Sequence: Synthetic oligonucleotide
  Target: ATXN1; (+) strand; PAM type: NRG; PAM sequence: CAG
tgcgtactctaccaccactt

SEQ ID NO: 146906 - DNA, 20 bp, Artificial Sequence
  Description of Artificial Sequence: Synthetic oligonucleotide
  Target: ATXN1; (+) strand; PAM type: NRG; PAM sequence: AAG
tactctaccaccacttcagt

SEQ ID NO: 146907 - DNA, 20 bp, Artificial Sequence
  Description of Artificial Sequence: Synthetic oligonucleotide
  Target: ATXN1; (+) strand; PAM type: NRG; PAM sequence: CAG
taagtgatttcacttcctgt

SEQ ID NO: 146908 - DNA, 20 bp, Artificial Sequence
  Description of Artificial Sequence: Synthetic oligonucleotide
  Target: ATXN1; (+) strand; PAM type: NRG; PAM sequence: AGG
aagtgatttcacttcctgtc

SEQ ID NO: 146909 - DNA, 20 bp, Artificial Sequence
  Description of Artificial Sequence: Synthetic oligonucleotide
  Target: ATXN1; (+) strand; PAM type: NRG; PAM sequence: TAG
cttcctgtcaggccctttgc

SEQ ID NO: 146910 - DNA, 20 bp, Artificial Sequence
  Description of Artificial Sequence: Synthetic oligonucleotide
  Target: ATXN1; (+) strand; PAM type: NRG; PAM sequence: CAG
gctagcctcactcattttat

SEQ ID NO: 146911 - DNA, 20 bp, Artificial Sequence
  Description of Artificial Sequence: Synthetic oligonucleotide
  Target: ATXN1; (+) strand; PAM type: NRG; PAM sequence: TAG
gcctcactcattttatcagt

SEQ ID NO: 146912 - DNA, 20 bp, Artificial Sequence
  Description of Artificial Sequence: Synthetic oligonucleotide
  Target: ATXN1; (+) strand; PAM type: NRG; PAM sequence: AGG
cctcactcattttatcagtt

SEQ ID NO: 146913 - DNA, 20 bp, Artificial Sequence
  Description of Artificial Sequence: Synthetic oligonucleotide
  Target: ATXN1; (+) strand; PAM type: NRG; PAM sequence: TGG
tttatcagttaggtaatgac

SEQ ID NO: 146914 - DNA, 20 bp, Artificial Sequence
  Description of Artificial Sequence: Synthetic oligonucleotide
  Target: ATXN1; (+) strand; PAM type: NRG; PAM sequence: CAG
cactgttattctgtgaacca

SEQ ID NO: 146915 - DNA, 20 bp, Artificial Sequence
  Description of Artificial Sequence: Synthetic oligonucleotide
  Target: ATXN1; (+) strand; PAM type: NRG; PAM sequence: AAG
caaccacctaccacccactg

SEQ ID NO: 146916 - DNA, 20 bp, Artificial Sequence
  Description of Artificial Sequence: Synthetic oligonucleotide
  Target: ATXN1; (+) strand; PAM type: NRG; PAM sequence: TGG
ccacctaccacccactgaag

SEQ ID NO: 146917 - DNA, 20 bp, Artificial Sequence
  Description of Artificial Sequence: Synthetic oligonucleotide
  Target: ATXN1; (+) strand; PAM type: NRG; PAM sequence: TGG
cctaccacccactgaagtgg

SEQ ID NO: 146918 - DNA, 20 bp, Artificial Sequence
  Description of Artificial Sequence: Synthetic oligonucleotide
  Target: ATXN1; (+) strand; PAM type: NRG; PAM sequence: TGG
cccactgaagtggtggctct

SEQ ID NO: 146919 - DNA, 20 bp, Artificial Sequence
  Description of Artificial Sequence: Synthetic oligonucleotide
  Target: ATXN1; (+) strand; PAM type: NRG; PAM sequence: GGG
ccactgaagtggtggctctt

SEQ ID NO: 146920 - DNA, 20 bp, Artificial Sequence
  Description of Artificial Sequence: Synthetic oligonucleotide
  Target: ATXN1; (+) strand; PAM type: NRG; PAM sequence: TGG
gtggtggctcttgggcacca

SEQ ID NO: 146921 - DNA, 20 bp, Artificial Sequence
  Description of Artificial Sequence: Synthetic oligonucleotide
  Target: ATXN1; (+) strand; PAM type: NRG; PAM sequence: TGG
ctcttgggcaccatggctct

SEQ ID NO: 146922 - DNA, 20 bp, Artificial Sequence
  Description of Artificial Sequence: Synthetic oligonucleotide
  Target: ATXN1; (+) strand; PAM type: NRG; PAM sequence: GGG
tcttgggcaccatggctctt

SEQ ID NO: 146923 - DNA, 20 bp, Artificial Sequence
  Description of Artificial Sequence: Synthetic oligonucleotide
  Target: ATXN1; (+) strand; PAM type: NRG; PAM sequence: GGG
cttgggcaccatggctcttg

SEQ ID NO: 146924 - DNA, 20 bp, Artificial Sequence
  Description of Artificial Sequence: Synthetic oligonucleotide
  Target: ATXN1; (+) strand; PAM type: NRG; PAM sequence: TGG
accatggctcttggggacca

SEQ ID NO: 146925 - DNA, 20 bp, Artificial Sequence
  Description of Artificial Sequence: Synthetic oligonucleotide
  Target: ATXN1; (+) strand; PAM type: NRG; PAM sequence: TGG
tcttggggaccatggctcta

SEQ ID NO: 146926 - DNA, 20 bp, Artificial Sequence
  Description of Artificial Sequence: Synthetic oligonucleotide
  Target: ATXN1; (+) strand; PAM type: NRG; PAM sequence: GAG
ttggggaccatggctctatg

SEQ ID NO: 146927 - DNA, 20 bp, Artificial Sequence
  Description of Artificial Sequence: Synthetic oligonucleotide
  Target: ATXN1; (+) strand; PAM type: NRG; PAM sequence: TGG
tggctctatggagactatga

SEQ ID NO: 146928 - DNA, 20 bp, Artificial Sequence
  Description of Artificial Sequence: Synthetic oligonucleotide
  Target: ATXN1; (+) strand; PAM type: NRG; PAM sequence: GGG
ggctctatggagactatgat

SEQ ID NO: 146929 - DNA, 20 bp, Artificial Sequence
  Description of Artificial Sequence: Synthetic oligonucleotide
  Target: ATXN1; (+) strand; PAM type: NRG; PAM sequence: TGG
tatggagactatgatgggca

SEQ ID NO: 146930 - DNA, 20 bp, Artificial Sequence
  Description of Artificial Sequence: Synthetic oligonucleotide
  Target: ATXN1; (+) strand; PAM type: NRG; PAM sequence: AAG
actatgatgggcatggtcct

SEQ ID NO: 146931 - DNA, 20 bp, Artificial Sequence
  Description of Artificial Sequence: Synthetic oligonucleotide
  Target: ATXN1; (+) strand; PAM type: NRG; PAM sequence: AGG
ctatgatgggcatggtccta

SEQ ID NO: 146932 - DNA, 20 bp, Artificial Sequence
  Description of Artificial Sequence: Synthetic oligonucleotide
  Target: ATXN1; (+) strand; PAM type: NRG; PAM sequence: TGG
gcatggtcctaaggccatta

SEQ ID NO: 146933 - DNA, 20 bp, Artificial Sequence
  Description of Artificial Sequence: Synthetic oligonucleotide
  Target: ATXN1; (+) strand; PAM type: NRG; PAM sequence: GGG
catggtcctaaggccattat

SEQ ID NO: 146934 - DNA, 20 bp, Artificial Sequence
  Description of Artificial Sequence: Synthetic oligonucleotide
  Target: ATXN1; (+) strand; PAM type: NRG; PAM sequence: TGG
aaggccattatgggatattt

SEQ ID NO: 146935 - DNA, 20 bp, Artificial Sequence
  Description of Artificial Sequence: Synthetic oligonucleotide
  Target: ATXN1; (+) strand; PAM type: NRG; PAM sequence: TGG
tgggatattttggactttac

SEQ ID NO: 146936 - DNA, 20 bp, Artificial Sequence
  Description of Artificial Sequence: Synthetic oligonucleotide
  Target: ATXN1; (+) strand; PAM type: NRG; PAM sequence: GGG
gggatattttggactttact

SEQ ID NO: 146937 - DNA, 20 bp, Artificial Sequence
  Description of Artificial Sequence: Synthetic oligonucleotide
  Target: ATXN1; (+) strand; PAM type: NRG; PAM sequence: GGG
ggatattttggactttactg

SEQ ID NO: 146938 - DNA, 20 bp, Artificial Sequence
  Description of Artificial Sequence: Synthetic oligonucleotide
  Target: ATXN1; (+) strand; PAM type: NRG; PAM sequence: GAG
atcacatacactgtttctct

SEQ ID NO: 146939 - DNA, 20 bp, Artificial Sequence
  Description of Artificial Sequence: Synthetic oligonucleotide
  Target: ATXN1; (+) strand; PAM type: NRG; PAM sequence: TAG
cactgtttctctgagaaact

SEQ ID NO: 146940 - DNA, 20 bp, Artificial Sequence
  Description of Artificial Sequence: Synthetic oligonucleotide
  Target: ATXN1; (+) strand; PAM type: NRG; PAM sequence: AAG
agacttacaatctttctgaa

SEQ ID NO: 146941 - DNA, 20 bp, Artificial Sequence
  Description of Artificial Sequence: Synthetic oligonucleotide
  Target: ATXN1; (+) strand; PAM type: NRG; PAM sequence: AGG
gacttacaatctttctgaaa

SEQ ID NO: 146942 - DNA, 20 bp, Artificial Sequence
  Description of Artificial Sequence: Synthetic oligonucleotide
  Target: ATXN1; (+) strand; PAM type: NRG; PAM sequence: TAG
gaaaaggatacattataaat

SEQ ID NO: 146943 - DNA, 20 bp, Artificial Sequence
  Description of Artificial Sequence: Synthetic oligonucleotide
  Target: ATXN1; (+) strand; PAM type: NRG; PAM sequence: TGG
taaattagtatttctacttt

SEQ ID NO: 146944 - DNA, 20 bp, Artificial Sequence
  Description of Artificial Sequence: Synthetic oligonucleotide
  Target: ATXN1; (+) strand; PAM type: NRG; PAM sequence: GGG
aaattagtatttctactttt

SEQ ID NO: 146945 - DNA, 20 bp, Artificial Sequence
  Description of Artificial Sequence: Synthetic oligonucleotide
  Target: ATXN1; (+) strand; PAM type: NRG; PAM sequence: GAG
ttgggaaaaatctgtttcat

SEQ ID NO: 146946 - DNA, 20 bp, Artificial Sequence
  Description of Artificial Sequence: Synthetic oligonucleotide
  Target: ATXN1; (+) strand; PAM type: NRG; PAM sequence: AAG
aaatctgtttcatgagaaac

SEQ ID NO: 146947 - DNA, 20 bp, Artificial Sequence
  Description of Artificial Sequence: Synthetic oligonucleotide
  Target: ATXN1; (+) strand; PAM type: NRG; PAM sequence: AGG
aatctgtttcatgagaaaca

SEQ ID NO: 146948 - DNA, 20 bp, Artificial Sequence
  Description of Artificial Sequence: Synthetic oligonucleotide
  Target: ATXN1; (+) strand; PAM type: NRG; PAM sequence: AAG
aatttatcactctgtctttt

SEQ ID NO: 146949 - DNA, 20 bp, Artificial Sequence
  Description of Artificial Sequence: Synthetic oligonucleotide
  Target: ATXN1; (+) strand; PAM type: NRG; PAM sequence: CAG
ttatcactctgtcttttaag

SEQ ID NO: 146950 - DNA, 20 bp, Artificial Sequence
  Description of Artificial Sequence: Synthetic oligonucleotide
  Target: ATXN1; (+) strand; PAM type: NRG; PAM sequence: GAG
tgtcttttaagcagtcttat

SEQ ID NO: 146951 - DNA, 20 bp, Artificial Sequence
  Description of Artificial Sequence: Synthetic oligonucleotide
  Target: ATXN1; (+) strand; PAM type: NRG; PAM sequence: AAG
tttaagcagtcttatgagcc

SEQ ID NO: 146952 - DNA, 20 bp, Artificial Sequence
  Description of Artificial Sequence: Synthetic oligonucleotide
  Target: ATXN1; (+) strand; PAM type: NRG; PAM sequence: CAG
agcagtcttatgagccaagt

SEQ ID NO: 146953 - DNA, 20 bp, Artificial Sequence
  Description of Artificial Sequence: Synthetic oligonucleotide
  Target: ATXN1; (+) strand; PAM type: NRG; PAM sequence: TAG
atgcatgcataaaaattcca

SEQ ID NO: 146954 - DNA, 20 bp, Artificial Sequence
  Description of Artificial Sequence: Synthetic oligonucleotide
  Target: ATXN1; (+) strand; PAM type: NRG; PAM sequence: CAG
ttccatagctcctcctcctg

SEQ ID NO: 146955 - DNA, 20 bp, Artificial Sequence
  Description of Artificial Sequence: Synthetic oligonucleotide
  Target: ATXN1; (+) strand; PAM type: NRG; PAM sequence: TAG
catagctcctcctcctgcag

SEQ ID NO: 146956 - DNA, 20 bp, Artificial Sequence
  Description of Artificial Sequence: Synthetic oligonucleotide
  Target: ATXN1; (+) strand; PAM type: NRG; PAM sequence: AAG
agctcctcctcctgcagtag

SEQ ID NO: 146957 - DNA, 20 bp, Artificial Sequence
  Description of Artificial Sequence: Synthetic oligonucleotide
  Target: ATXN1; (+) strand; PAM type: NRG; PAM sequence: CAG
tcctcctcctgcagtagaag

SEQ ID NO: 146958 - DNA, 20 bp, Artificial Sequence
  Description of Artificial Sequence: Synthetic oligonucleotide
  Target: ATXN1; (+) strand; PAM type: NRG; PAM sequence: AAG
tcctcctgcagtagaagcag

SEQ ID NO: 146959 - DNA, 20 bp, Artificial Sequence
  Description of Artificial Sequence: Synthetic oligonucleotide
  Target: ATXN1; (+) strand; PAM type: NRG; PAM sequence: TAG
tcctgcagtagaagcagaag

SEQ ID NO: 146960 - DNA, 20 bp, Artificial Sequence
  Description of Artificial Sequence: Synthetic oligonucleotide
  Target: ATXN1; (+) strand; PAM type: NRG; PAM sequence: CAG
tgcagtagaagcagaagtag

SEQ ID NO: 146961 - DNA, 20 bp, Artificial Sequence
  Description of Artificial Sequence: Synthetic oligonucleotide
  Target: ATXN1; (+) strand; PAM type: NRG; PAM sequence: GAG
cagtagaagcagaagtagca

SEQ ID NO: 146962 - DNA, 20 bp, Artificial Sequence
  Description of Artificial Sequence: Synthetic oligonucleotide
  Target: ATXN1; (+) strand; PAM type: NRG; PAM sequence: TGG
agaagcagaagtagcagagc

SEQ ID NO: 146963 - DNA, 20 bp, Artificial Sequence
  Description of Artificial Sequence: Synthetic oligonucleotide
  Target: ATXN1; (+) strand; PAM type: NRG; PAM sequence: TAG
tagcagagctggcaaacctg

SEQ ID NO: 146964 - DNA, 20 bp, Artificial Sequence
  Description of Artificial Sequence: Synthetic oligonucleotide
  Target: ATXN1; (+) strand; PAM type: NRG; PAM sequence: CAG
gctggcaaacctgtagtatc

SEQ ID NO: 146965 - DNA, 20 bp, Artificial Sequence
  Description of Artificial Sequence: Synthetic oligonucleotide
  Target: ATXN1; (+) strand; PAM type: NRG; PAM sequence: TGG
agatgactacctctgtttcc

SEQ ID NO: 146966 - DNA, 20 bp, Artificial Sequence
  Description of Artificial Sequence: Synthetic oligonucleotide
  Target: ATXN1; (+) strand; PAM type: NRG; PAM sequence: CAG
acctctgtttcctggaataa

SEQ ID NO: 146967 - DNA, 20 bp, Artificial Sequence
  Description of Artificial Sequence: Synthetic oligonucleotide
  Target: ATXN1; (+) strand; PAM type: NRG; PAM sequence: AAG
tctgtttcctggaataacag

SEQ ID NO: 146968 - DNA, 20 bp, Artificial Sequence
  Description of Artificial Sequence: Synthetic oligonucleotide
  Target: ATXN1; (+) strand; PAM type: NRG; PAM sequence: AAG
tcctggaataacagaagctg

SEQ ID NO: 146969 - DNA, 20 bp, Artificial Sequence
  Description of Artificial Sequence: Synthetic oligonucleotide
  Target: ATXN1; (+) strand; PAM type: NRG; PAM sequence: CAG
taacagaagctgaagatgaa

SEQ ID NO: 146970 - DNA, 20 bp, Artificial Sequence
  Description of Artificial Sequence: Synthetic oligonucleotide
  Target: ATXN1; (+) strand; PAM type: NRG; PAM sequence: AGG
aacagaagctgaagatgaac

SEQ ID NO: 146971 - DNA, 20 bp, Artificial Sequence
  Description of Artificial Sequence: Synthetic oligonucleotide
  Target: ATXN1; (+) strand; PAM type: NRG; PAM sequence: CAG
atgaacaggtcatcatctcc

SEQ ID NO: 146972 - DNA, 20 bp, Artificial Sequence
  Description of Artificial Sequence: Synthetic oligonucleotide
  Target: ATXN1; (+) strand; PAM type: NRG; PAM sequence: AGG
tgaacaggtcatcatctccc

SEQ ID NO: 146973 - DNA, 20 bp, Artificial Sequence
  Description of Artificial Sequence: Synthetic oligonucleotide
  Target: ATXN1; (+) strand; PAM type: NRG; PAM sequence: AAG
tcatctcccaggtaccaccc

SEQ ID NO: 146974 - DNA, 20 bp, Artificial Sequence
  Description of Artificial Sequence: Synthetic oligonucleotide
  Target: ATXN1; (+) strand; PAM type: NRG; PAM sequence: AAG
caggtaccacccaagtaccc

SEQ ID NO: 146975 - DNA, 20 bp, Artificial Sequence
  Description of Artificial Sequence: Synthetic oligonucleotide
  Target: ATXN1; (+) strand; PAM type: NRG; PAM sequence: AAG
taccacccaagtacccaagc

SEQ ID NO: 146976 - DNA, 20 bp, Artificial Sequence
  Description of Artificial Sequence: Synthetic oligonucleotide
  Target: ATXN1; (+) strand; PAM type: NRG; PAM sequence: CAG
aagtacccaagcaagcccac

SEQ ID NO: 146977 - DNA, 20 bp, Artificial Sequence
  Description of Artificial Sequence: Synthetic oligonucleotide
  Target: ATXN1; (+) strand; PAM type: NRG; PAM sequence: AGG
agtacccaagcaagcccacc

SEQ ID NO: 146978 - DNA, 20 bp, Artificial Sequence
  Description of Artificial Sequence: Synthetic oligonucleotide
  Target: ATXN1; (+) strand; PAM type: NRG; PAM sequence: TGG
aagcaagcccaccaggtgtg

SEQ ID NO: 146979 - DNA, 20 bp, Artificial Sequence
  Description of Artificial Sequence: Synthetic oligonucleotide
  Target: ATXN1; (+) strand; PAM type: NRG; PAM sequence: GGG
agcaagcccaccaggtgtgt

SEQ ID NO: 146980 - DNA, 20 bp, Artificial Sequence
  Description of Artificial Sequence: Synthetic oligonucleotide
  Target: ATXN1; (+) strand; PAM type: NRG; PAM sequence: TAG
ccaggtgtgtgggacaattc

SEQ ID NO: 146981 - DNA, 20 bp, Artificial Sequence
  Description of Artificial Sequence: Synthetic oligonucleotide
  Target: ATXN1; (+) strand; PAM type: NRG; PAM sequence: GAG
aggtgtgtgggacaattcta

SEQ ID NO: 146982 - DNA, 20 bp, Artificial Sequence
  Description of Artificial Sequence: Synthetic oligonucleotide
  Target: ATXN1; (+) strand; PAM type: NRG; PAM sequence: TGG
gtgggacaattctagagccc

SEQ ID NO: 146983 - DNA, 20 bp, Artificial Sequence
  Description of Artificial Sequence: Synthetic oligonucleotide
  Target: ATXN1; (+) strand; PAM type: NRG; PAM sequence: GGG
tgggacaattctagagccct

SEQ ID NO: 146984 - DNA, 20 bp, Artificial Sequence
  Description of Artificial Sequence: Synthetic oligonucleotide
  Target: ATXN1; (+) strand; PAM type: NRG; PAM sequence: CAG
caattctagagccctgggcc

SEQ ID NO: 146985 - DNA, 20 bp, Artificial Sequence
  Description of Artificial Sequence: Synthetic oligonucleotide
  Target: ATXN1; (+) strand; PAM type: NRG; PAM sequence: TAG
ctagagccctgggcccagcc

SEQ ID NO: 146986 - DNA, 20 bp, Artificial Sequence
  Description of Artificial Sequence: Synthetic oligonucleotide
  Target: ATXN1; (+) strand; PAM type: NRG; PAM sequence: AGG
tagagccctgggcccagcct

SEQ ID NO: 146987 - DNA, 20 bp, Artificial Sequence
  Description of Artificial Sequence: Synthetic oligonucleotide
  Target: ATXN1; (+) strand; PAM type: NRG; PAM sequence: CGG
gccctgggcccagcctagga

SEQ ID NO: 146988 - DNA, 20 bp, Artificial Sequence
  Description of Artificial Sequence: Synthetic oligonucleotide
  Target: ATXN1; (+) strand; PAM type: NRG; PAM sequence: GAG
cctgggcccagcctaggacg

SEQ ID NO: 146989 - DNA, 20 bp, Artificial Sequence
  Description of Artificial Sequence: Synthetic oligonucleotide
  Target: ATXN1; (+) strand; PAM type: NRG; PAM sequence: CAG
ggcccagcctaggacggaga

SEQ ID NO: 146990 - DNA, 20 bp, Artificial Sequence
  Description of Artificial Sequence: Synthetic oligonucleotide
  Target: ATXN1; (+) strand; PAM type: NRG; PAM sequence: AAG
taggacggagacagcttctg

SEQ ID NO: 146991 - DNA, 20 bp, Artificial Sequence
  Description of Artificial Sequence: Synthetic oligonucleotide
  Target: ATXN1; (+) strand; PAM type: NRG; PAM sequence: TAG
gagacagcttctgaagttct

SEQ ID NO: 146992 - DNA, 20 bp, Artificial Sequence
  Description of Artificial Sequence: Synthetic oligonucleotide
  Target: ATXN1; (+) strand; PAM type: NRG; PAM sequence: CAG
agttcttagtctacatctaa

SEQ ID NO: 146993 - DNA, 20 bp, Artificial Sequence
  Description of Artificial Sequence: Synthetic oligonucleotide
  Target: ATXN1; (+) strand; PAM type: NRG; PAM sequence: AGG
gttcttagtctacatctaac

SEQ ID NO: 146994 - DNA, 20 bp, Artificial Sequence
  Description of Artificial Sequence: Synthetic oligonucleotide
  Target: ATXN1; (+) strand; PAM type: NRG; PAM sequence: TGG
cctgtctttcctccttgctg

SEQ ID NO: 146995 - DNA, 20 bp, Artificial Sequence
  Description of Artificial Sequence: Synthetic oligonucleotide
  Target: ATXN1; (+) strand; PAM type: NRG; PAM sequence: AAG
ccttgctgtggttaacactg

SEQ ID NO: 146996 - DNA, 20 bp, Artificial Sequence
  Description of Artificial Sequence: Synthetic oligonucleotide
  Target: ATXN1; (+) strand; PAM type: NRG; PAM sequence: TAG
tgtggttaacactgaagttc

SEQ ID NO: 146997 - DNA, 20 bp, Artificial Sequence
  Description of Artificial Sequence: Synthetic oligonucleotide
  Target: ATXN1; (+) strand; PAM type: NRG; PAM sequence: TAG
agttctagaaaatgtcctat

SEQ ID NO: 146998 - DNA, 20 bp, Artificial Sequence
  Description of Artificial Sequence: Synthetic oligonucleotide
  Target: ATXN1; (+) strand; PAM type: NRG; PAM sequence: GAG
cctattagtaccttcatctt

SEQ ID NO: 146999 - DNA, 20 bp, Artificial Sequence
  Description of Artificial Sequence: Synthetic oligonucleotide
  Target: ATXN1; (+) strand; PAM type: NRG; PAM sequence: GAG
tattagtaccttcatcttga

SEQ ID NO: 147000 - DNA, 20 bp, Artificial Sequence
  Description of Artificial Sequence: Synthetic oligonucleotide
  Target: ATXN1; (+) strand; PAM type: NRG; PAM sequence: AGG
attagtaccttcatcttgag

SEQ ID NO: 147001 - DNA, 20 bp, Artificial Sequence
  Description of Artificial Sequence: Synthetic oligonucleotide
  Target: ATXN1; (+) strand; PAM type: NRG; PAM sequence: AAG
tcttgagaggtgaatgattt

SEQ ID NO: 147002 - DNA, 20 bp, Artificial Sequence
  Description of Artificial Sequence: Synthetic oligonucleotide
  Target: ATXN1; (+) strand; PAM type: NRG; PAM sequence: AAG
tgagaggtgaatgatttaag

SEQ ID NO: 147003 - DNA, 20 bp, Artificial Sequence
  Description of Artificial Sequence: Synthetic oligonucleotide
  Target: ATXN1; (+) strand; PAM type: NRG; PAM sequence: GAG
agaggtgaatgatttaagaa

SEQ ID NO: 147004 - DNA, 20 bp, Artificial Sequence
  Description of Artificial Sequence: Synthetic oligonucleotide
  Target: ATXN1; (+) strand; PAM type: NRG; PAM sequence: AAG
ggtgaatgatttaagaagag

SEQ ID NO: 147005 - DNA, 20 bp, Artificial Sequence
  Description of Artificial Sequence: Synthetic oligonucleotide
  Target: ATXN1; (+) strand; PAM type: NRG; PAM sequence: TGG
tattttacccaatgtccatt

SEQ ID NO: 147006 - DNA, 20 bp, Artificial Sequence
  Description of Artificial Sequence: Synthetic oligonucleotide
  Target: ATXN1; (+) strand; PAM type: NRG; PAM sequence: GGG
attttacccaatgtccattt

SEQ ID NO: 147007 - DNA, 20 bp, Artificial Sequence
  Description of Artificial Sequence: Synthetic oligonucleotide
  Target: ATXN1; (+) strand; PAM type: NRG; PAM sequence: CAG
ttacccaatgtccatttggg

SEQ ID NO: 147008 - DNA, 20 bp, Artificial Sequence
  Description of Artificial Sequence: Synthetic oligonucleotide
  Target: ATXN1; (+) strand; PAM type: NRG; PAM sequence: CAG
agttactaaacttaaaaatg

SEQ ID NO: 147009 - DNA, 20 bp, Artificial Sequence
  Description of Artificial Sequence: Synthetic oligonucleotide
  Target: ATXN1; (+) strand; PAM type: NRG; PAM sequence: TGG
ctaaacttaaaaatgcagcc

SEQ ID NO: 147010 - DNA, 20 bp, Artificial Sequence
  Description of Artificial Sequence: Synthetic oligonucleotide
  Target: ATXN1; (+) strand; PAM type: NRG; PAM sequence: GGG
taaacttaaaaatgcagcct

SEQ ID NO: 147011 - DNA, 20 bp, Artificial Sequence
  Description of Artificial Sequence: Synthetic oligonucleotide
  Target: ATXN1; (+) strand; PAM type: NRG; PAM sequence: TGG
taaaaatgcagcctgggcaa

SEQ ID NO: 147012 - DNA, 20 bp, Artificial Sequence
  Description of Artificial Sequence: Synthetic oligonucleotide
  Target: ATXN1; (+) strand; PAM type: NRG; PAM sequence: GAG
tgcagcctgggcaatggaat

SEQ ID NO: 147013 - DNA, 20 bp, Artificial Sequence
  Description of Artificial Sequence: Synthetic oligonucleotide
  Target: ATXN1; (+) strand; PAM type: NRG; PAM sequence: AAG
ataaattaaaaacaaaaaat

SEQ ID NO: 147014 - DNA, 20 bp, Artificial Sequence
  Description of Artificial Sequence: Synthetic oligonucleotide
  Target: ATXN1; (+) strand; PAM type: NRG; PAM sequence: TGG
ttaaaaacaaaaaataagtg

SEQ ID NO: 147015 - DNA, 20 bp, Artificial Sequence
  Description of Artificial Sequence: Synthetic oligonucleotide
  Target: ATXN1; (+) strand; PAM type: NRG; PAM sequence: AAG
aaaaataagtgtggtcgcac

SEQ ID NO: 147016 - DNA, 20 bp, Artificial Sequence
  Description of Artificial Sequence: Synthetic oligonucleotide
  Target: ATXN1; (+) strand; PAM type: NRG; PAM sequence: TAG
agtgtggtcgcacaagtctg

SEQ ID NO: 147017 - DNA, 20 bp, Artificial Sequence
  Description of Artificial Sequence: Synthetic oligonucleotide
  Target: ATXN1; (+) strand; PAM type: NRG; PAM sequence: TAG
gtcgcacaagtctgtagtcc

SEQ ID NO: 147018 - DNA, 20 bp, Artificial Sequence
  Description of Artificial Sequence: Synthetic oligonucleotide
  Target: ATXN1; (+) strand; PAM type: NRG; PAM sequence: CAG
agtctgtagtcctagctact

SEQ ID NO: 147019 - DNA, 20 bp, Artificial Sequence
  Description of Artificial Sequence: Synthetic oligonucleotide
  Target: ATXN1; (+) strand; PAM type: NRG; PAM sequence: CAG
ctgtagtcctagctactcag

SEQ ID NO: 147020 - DNA, 20 bp, Artificial Sequence
  Description of Artificial Sequence: Synthetic oligonucleotide
  Target: ATXN1; (+) strand; PAM type: NRG; PAM sequence: AGG
tgtagtcctagctactcagc

SEQ ID NO: 147021 - DNA, 20 bp, Artificial Sequence
  Description of Artificial Sequence: Synthetic oligonucleotide
  Target: ATXN1; (+) strand; PAM type: NRG; PAM sequence: GAG
tcctagctactcagcaggct

SEQ ID NO: 147022 - DNA, 20 bp, Artificial Sequence
  Description of Artificial Sequence: Synthetic oligonucleotide
  Target: ATXN1; (+) strand; PAM type: NRG; PAM sequence: AGG
cctagctactcagcaggctg

SEQ ID NO: 147023 - DNA, 20 bp, Artificial Sequence
  Description of Artificial Sequence: Synthetic oligonucleotide
  Target: ATXN1; (+) strand; PAM type: NRG; PAM sequence: CGG
agctactcagcaggctgagg

SEQ ID NO: 147024 - DNA, 20 bp, Artificial Sequence
  Description of Artificial Sequence: Synthetic oligonucleotide
  Target: ATXN1; (+) strand; PAM type: NRG; PAM sequence: GGG
gctactcagcaggctgaggc

SEQ ID NO: 147025 - DNA, 20 bp, Artificial Sequence
  Description of Artificial Sequence: Synthetic oligonucleotide
  Target: ATXN1; (+) strand; PAM type: NRG; PAM sequence: GAG
tactcagcaggctgaggcgg

SEQ ID NO: 147026 - DNA, 20 bp, Artificial Sequence
  Description of Artificial Sequence: Synthetic oligonucleotide
  Target: ATXN1; (+) strand; PAM type: NRG; PAM sequence: AGG
actcagcaggctgaggcggg

SEQ ID NO: 147027 - DNA, 20 bp, Artificial Sequence
  Description of Artificial Sequence: Synthetic oligonucleotide
  Target: ATXN1; (+) strand; PAM type: NRG; PAM sequence: TGG
ggctgaggcgggaggatcac

SEQ ID NO: 147028 - DNA, 20 bp, Artificial Sequence
  Description of Artificial Sequence: Synthetic oligonucleotide
  Target: ATXN1; (+) strand; PAM type: NRG; PAM sequence: GAG
ctgaggcgggaggatcactg

SEQ ID NO: 147029 - DNA, 20 bp, Artificial Sequence
  Description of Artificial Sequence: Synthetic oligonucleotide
  Target: ATXN1; (+) strand; PAM type: NRG; PAM sequence: CAG
gcgggaggatcactggagcc

SEQ ID NO: 147030 - DNA, 20 bp, Artificial Sequence
  Description of Artificial Sequence: Synthetic oligonucleotide
  Target: ATXN1; (+) strand; PAM type: NRG; PAM sequence: AGG
cgggaggatcactggagccc

SEQ ID NO: 147031 - DNA, 20 bp, Artificial Sequence
  Description of Artificial Sequence: Synthetic oligonucleotide
  Target: ATXN1; (+) strand; PAM type: NRG; PAM sequence: GAG
ggaggatcactggagcccag

SEQ ID NO: 147032 - DNA, 20 bp, Artificial Sequence
  Description of Artificial Sequence: Synthetic oligonucleotide
  Target: ATXN1; (+) strand; PAM type: NRG; PAM sequence: CAG
agcccaggagttcgacacta

SEQ ID NO: 147033 - DNA, 20 bp, Artificial Sequence
  Description of Artificial Sequence: Synthetic oligonucleotide
  Target: ATXN1; (+) strand; PAM type: NRG; PAM sequence: GAG
caggagttcgacactacagt

SEQ ID NO: 147034 - DNA, 20 bp, Artificial Sequence
  Description of Artificial Sequence: Synthetic oligonucleotide
  Target: ATXN1; (+) strand; PAM type: NRG; PAM sequence: TGG
gacactacagtgagctatga

SEQ ID NO: 147035 - DNA, 20 bp, Artificial Sequence
  Description of Artificial Sequence: Synthetic oligonucleotide
  Target: ATXN1; (+) strand; PAM type: NRG; PAM sequence: TGG
atgatggcaccactaccctc

SEQ ID NO: 147036 - DNA, 20 bp, Artificial Sequence
  Description of Artificial Sequence: Synthetic oligonucleotide
  Target: ATXN1; (+) strand; PAM type: NRG; PAM sequence: TGG
ggcaccactaccctctggcc

SEQ ID NO: 147037 - DNA, 20 bp, Artificial Sequence
  Description of Artificial Sequence: Synthetic oligonucleotide
  Target: ATXN1; (+) strand; PAM type: NRG; PAM sequence: GGG
gcaccactaccctctggcct

SEQ ID NO: 147038 - DNA, 20 bp, Artificial Sequence
  Description of Artificial Sequence: Synthetic oligonucleotide
  Target: ATXN1; (+) strand; PAM type: NRG; PAM sequence: CAG
ctaccctctggcctgggcaa

SEQ ID NO: 147039 - DNA, 20 bp, Artificial Sequence
  Description of Artificial Sequence: Synthetic oligonucleotide
  Target: ATXN1; (+) strand; PAM type: NRG; PAM sequence: GAG
accctctggcctgggcaaca

SEQ ID NO: 147040 - DNA, 20 bp, Artificial Sequence
  Description of Artificial Sequence: Synthetic oligonucleotide
  Target: ATXN1; (+) strand; PAM type: NRG; PAM sequence: GAG
tctggcctgggcaacagagt

SEQ ID NO: 147041 - DNA, 20 bp, Artificial Sequence
  Description of Artificial Sequence: Synthetic oligonucleotide
  Target: ATXN1; (+) strand; PAM type: NRG; PAM sequence: CAG
ataaatatcacgtataccga

SEQ ID NO: 147042 - DNA, 20 bp, Artificial Sequence
  Description of Artificial Sequence: Synthetic oligonucleotide
  Target: ATXN1; (+) strand; PAM type: NRG; PAM sequence: TGG
attaatgtcttatttaaccc

SEQ ID NO: 147043 - DNA, 20 bp, Artificial Sequence
  Description of Artificial Sequence: Synthetic oligonucleotide
  Target: ATXN1; (+) strand; PAM type: NRG; PAM sequence: CAG
atgtcttatttaaccctgga

SEQ ID NO: 147044 - DNA, 20 bp, Artificial Sequence
  Description of Artificial Sequence: Synthetic oligonucleotide
  Target: ATXN1; (+) strand; PAM type: NRG; PAM sequence: TGG
ttaaccctggacagctctcc

SEQ ID NO: 147045 - DNA, 20 bp, Artificial Sequence
  Description of Artificial Sequence: Synthetic oligonucleotide
  Target: ATXN1; (+) strand; PAM type: NRG; PAM sequence: GGG
taaccctggacagctctcct

SEQ ID NO: 147046 - DNA, 20 bp, Artificial Sequence
  Description of Artificial Sequence: Synthetic oligonucleotide
  Target: ATXN1; (+) strand; PAM type: NRG; PAM sequence: TAG
acagctctcctgggctctct

SEQ ID NO: 147047 - DNA, 20 bp, Artificial Sequence
  Description of Artificial Sequence: Synthetic oligonucleotide
  Target: ATXN1; (+) strand; PAM type: NRG; PAM sequence: CAG
ctctcttagccttcaccact

SEQ ID NO: 147048 - DNA, 20 bp, Artificial Sequence
  Description of Artificial Sequence: Synthetic oligonucleotide
  Target: ATXN1; (+) strand; PAM type: NRG; PAM sequence: TGG
agccttcaccactcagaaca

SEQ ID NO: 147049 - DNA, 20 bp, Artificial Sequence
  Description of Artificial Sequence: Synthetic oligonucleotide
  Target: ATXN1; (+) strand; PAM type: NRG; PAM sequence: CAG
gaacatggctatgaatgcct

SEQ ID NO: 147050 - DNA, 20 bp, Artificial Sequence
  Description of Artificial Sequence: Synthetic oligonucleotide
  Target: ATXN1; (+) strand; PAM type: NRG; PAM sequence: AGG
aacatggctatgaatgcctc

SEQ ID NO: 147051 - DNA, 20 bp, Artificial Sequence
  Description of Artificial Sequence: Synthetic oligonucleotide
  Target: ATXN1; (+) strand; PAM type: NRG; PAM sequence: TGG
atgaatgcctcaggccacac

SEQ ID NO: 147052 - DNA, 20 bp, Artificial Sequence
  Description of Artificial Sequence: Synthetic oligonucleotide
  Target: ATXN1; (+) strand; PAM type: NRG; PAM sequence: TAG
atgcctcaggccacactggc

SEQ ID NO: 147053 - DNA, 20 bp, Artificial Sequence
  Description of Artificial Sequence: Synthetic oligonucleotide
  Target: ATXN1; (+) strand; PAM type: NRG; PAM sequence: AGG
tgcctcaggccacactggct

SEQ ID NO: 147054 - DNA, 20 bp, Artificial Sequence
  Description of Artificial Sequence: Synthetic oligonucleotide
  Target: ATXN1; (+) strand; PAM type: NRG; PAM sequence: TGG
ctcaggccacactggctagg

SEQ ID NO: 147055 - DNA, 20 bp, Artificial Sequence
  Description of Artificial Sequence: Synthetic oligonucleotide
  Target: ATXN1; (+) strand; PAM type: NRG; PAM sequence: GAG
caggccacactggctaggtg

SEQ ID NO: 147056 - DNA, 20 bp, Artificial Sequence
  Description of Artificial Sequence: Synthetic oligonucleotide
  Target: ATXN1; (+) strand; PAM type: NRG; PAM sequence: GAG
ggccacactggctaggtgga

SEQ ID NO: 147057 - DNA, 20 bp, Artificial Sequence
  Description of Artificial Sequence: Synthetic oligonucleotide
  Target: ATXN1; (+) strand; PAM type: NRG; PAM sequence: GAG
ccacactggctaggtggaga

SEQ ID NO: 147058 - DNA, 20 bp, Artificial Sequence
  Description of Artificial Sequence: Synthetic oligonucleotide
  Target: ATXN1; (+) strand; PAM type: NRG; PAM sequence: TAG
actggctaggtggagagagc

SEQ ID NO: 147059 - DNA, 20 bp, Artificial Sequence
  Description of Artificial Sequence: Synthetic oligonucleotide
  Target: ATXN1; (+) strand; PAM type: NRG; PAM sequence: AGG
ctggctaggtggagagagct

SEQ ID NO: 147060 - DNA, 20 bp, Artificial Sequence
  Description of Artificial Sequence: Synthetic oligonucleotide
  Target: ATXN1; (+) strand; PAM type: NRG; PAM sequence: GAG
aggtggagagagctaggaat

SEQ ID NO: 147061 - DNA, 20 bp, Artificial Sequence
  Description of Artificial Sequence: Synthetic oligonucleotide
  Target: ATXN1; (+) strand; PAM type: NRG; PAM sequence: CAG
gagaattaatgtatatgatt

SEQ ID NO: 147062 - DNA, 20 bp, Artificial Sequence
  Description of Artificial Sequence: Synthetic oligonucleotide
  Target: ATXN1; (+) strand; PAM type: NRG; PAM sequence: TAG
ttaatgtatatgattcagct

SEQ ID NO: 147063 - DNA, 20 bp, Artificial Sequence
  Description of Artificial Sequence: Synthetic oligonucleotide
  Target: ATXN1; (+) strand; PAM type: NRG; PAM sequence: CAG
attcagcttagtgattttat

SEQ ID NO: 147064 - DNA, 20 bp, Artificial Sequence
  Description of Artificial Sequence: Synthetic oligonucleotide
  Target: ATXN1; (+) strand; PAM type: NRG; PAM sequence: TGG
attttatcagattgattatc

SEQ ID NO: 147065 - DNA, 20 bp, Artificial Sequence
  Description of Artificial Sequence: Synthetic oligonucleotide
  Target: ATXN1; (+) strand; PAM type: NRG; PAM sequence: AAG
ttgattatctggtttctctt

SEQ ID NO: 147066 - DNA, 20 bp, Artificial Sequence
  Description of Artificial Sequence: Synthetic oligonucleotide
  Target: ATXN1; (+) strand; PAM type: NRG; PAM sequence: CAG
tctggtttctcttaagttta

SEQ ID NO: 147067 - DNA, 20 bp, Artificial Sequence
  Description of Artificial Sequence: Synthetic oligonucleotide
  Target: ATXN1; (+) strand; PAM type: NRG; PAM sequence: TAG
ttctcttaagtttacagata

SEQ ID NO: 147068 - DNA, 20 bp, Artificial Sequence
  Description of Artificial Sequence: Synthetic oligonucleotide
  Target: ATXN1; (+) strand; PAM type: NRG; PAM sequence: AGG
tctcttaagtttacagatat

SEQ ID NO: 147069 - DNA, 20 bp, Artificial Sequence
  Description of Artificial Sequence: Synthetic oligonucleotide
  Target: ATXN1; (+) strand; PAM type: NRG; PAM sequence: AAG
acagatataggcaaatatga

SEQ ID NO: 147070 - DNA, 20 bp, Artificial Sequence
  Description of Artificial Sequence: Synthetic oligonucleotide
  Target: ATXN1; (+) strand; PAM type: NRG; PAM sequence: AGG
cagatataggcaaatatgaa

SEQ ID NO: 147071 - DNA, 20 bp, Artificial Sequence
  Description of Artificial Sequence: Synthetic oligonucleotide
  Target: ATXN1; (+) strand; PAM type: NRG; PAM sequence: GAG
gatataggcaaatatgaaag

SEQ ID NO: 147072 - DNA, 20 bp, Artificial Sequence
  Description of Artificial Sequence: Synthetic oligonucleotide
  Target: ATXN1; (+) strand; PAM type: NRG; PAM sequence: AAG
gcaaatatgaaaggagattg

SEQ ID NO: 147073 - DNA, 20 bp, Artificial Sequence
  Description of Artificial Sequence: Synthetic oligonucleotide
  Target: ATXN1; (+) strand; PAM type: NRG; PAM sequence: AAG
agattgaagacatgacaacc

SEQ ID NO: 147074 - DNA, 20 bp, Artificial Sequence
  Description of Artificial Sequence: Synthetic oligonucleotide
  Target: ATXN1; (+) strand; PAM type: NRG; PAM sequence: AAG
gaagacatgacaaccaagac

SEQ ID NO: 147075 - DNA, 20 bp, Artificial Sequence
  Description of Artificial Sequence: Synthetic oligonucleotide
  Target: ATXN1; (+) strand; PAM type: NRG; PAM sequence: TAG
gacatgacaaccaagacaag

SEQ ID NO: 147076 - DNA, 20 bp, Artificial Sequence
  Description of Artificial Sequence: Synthetic oligonucleotide
  Target: ATXN1; (+) strand; PAM type: NRG; PAM sequence: TAG
tgacaaccaagacaagtaga

SEQ ID NO: 147077 - DNA, 20 bp, Artificial Sequence
  Description of Artificial Sequence: Synthetic oligonucleotide
  Target: ATXN1; (+) strand; PAM type: NRG; PAM sequence: AGG
gacaaccaagacaagtagat

SEQ ID NO: 147078 - DNA, 20 bp, Artificial Sequence
  Description of Artificial Sequence: Synthetic oligonucleotide
  Target: ATXN1; (+) strand; PAM type: NRG; PAM sequence: CAG
accaagacaagtagatagga

SEQ ID NO: 147079 - DNA, 20 bp, Artificial Sequence
  Description of Artificial Sequence: Synthetic oligonucleotide
  Target: ATXN1; (+) strand; PAM type: NRG; PAM sequence: GAG
caagacaagtagataggaca

SEQ ID NO: 147080 - DNA, 20 bp, Artificial Sequence
  Description of Artificial Sequence: Synthetic oligonucleotide
  Target: ATXN1; (+) strand; PAM type: NRG; PAM sequence: AGG
aagacaagtagataggacag

SEQ ID NO: 147081 - DNA, 20 bp, Artificial Sequence
  Description of Artificial Sequence: Synthetic oligonucleotide
  Target: ATXN1; (+) strand; PAM type: NRG; PAM sequence: TGG
agtagataggacagaggctg

SEQ ID NO: 147082 - DNA, 20 bp, Artificial Sequence
  Description of Artificial Sequence: Synthetic oligonucleotide
  Target: ATXN1; (+) strand; PAM type: NRG; PAM sequence: GAG
aggacagaggctgtggcatc

SEQ ID NO: 147083 - DNA, 20 bp, Artificial Sequence
  Description of Artificial Sequence: Synthetic oligonucleotide
  Target: ATXN1; (+) strand; PAM type: NRG; PAM sequence: AAG
acagaggctgtggcatcgag

SEQ ID NO: 147084 - DNA, 20 bp, Artificial Sequence
  Description of Artificial Sequence: Synthetic oligonucleotide
  Target: ATXN1; (+) strand; PAM type: NRG; PAM sequence: GAG
gtggcatcgagaagaattat

SEQ ID NO: 147085 - DNA, 20 bp, Artificial Sequence
  Description of Artificial Sequence: Synthetic oligonucleotide
  Target: ATXN1; (+) strand; PAM type: NRG; PAM sequence: GAG
gagaagaattatgagctttt

SEQ ID NO: 147086 - DNA, 20 bp, Artificial Sequence
  Description of Artificial Sequence: Synthetic oligonucleotide
  Target: ATXN1; (+) strand; PAM type: NRG; PAM sequence: AGG
agaagaattatgagcttttg

SEQ ID NO: 147087 - DNA, 20 bp, Artificial Sequence
  Description of Artificial Sequence: Synthetic oligonucleotide
  Target: ATXN1; (+) strand; PAM type: NRG; PAM sequence: CAG
attatgagcttttgaggcat

SEQ ID NO: 147088 - DNA, 20 bp, Artificial Sequence
  Description of Artificial Sequence: Synthetic oligonucleotide
  Target: ATXN1; (+) strand; PAM type: NRG; PAM sequence: AGG
ttatgagcttttgaggcatc

SEQ ID NO: 147089 - DNA, 20 bp, Artificial Sequence
  Description of Artificial Sequence: Synthetic oligonucleotide
  Target: ATXN1; (+) strand; PAM type: NRG; PAM sequence: GAG
catcaggacgctactatgtc

SEQ ID NO: 147090 - DNA, 20 bp, Artificial Sequence
  Description of Artificial Sequence: Synthetic oligonucleotide
  Target: ATXN1; (+) strand; PAM type: NRG; PAM sequence: AGG
atcaggacgctactatgtcg

SEQ ID NO: 147091 - DNA, 20 bp, Artificial Sequence
  Description of Artificial Sequence: Synthetic oligonucleotide
  Target: ATXN1; (+) strand; PAM type: NRG; PAM sequence: CAG
atgtcgaggtaataacttca

SEQ ID NO: 147092 - DNA, 20 bp, Artificial Sequence
  Description of Artificial Sequence: Synthetic oligonucleotide
  Target: ATXN1; (+) strand; PAM type: NRG; PAM sequence: AAG
aacttcacagaaatgacaat

SEQ ID NO: 147093 - DNA, 20 bp, Artificial Sequence
  Description of Artificial Sequence: Synthetic oligonucleotide
  Target: ATXN1; (+) strand; PAM type: NRG; PAM sequence: AAG
agaaatgacaataagtctcc

SEQ ID NO: 147094 - DNA, 20 bp, Artificial Sequence
  Description of Artificial Sequence: Synthetic oligonucleotide
  Target: ATXN1; (+) strand; PAM type: NRG; PAM sequence: AAG
caataagtctccaagaaaaa

SEQ ID NO: 147095 - DNA, 20 bp, Artificial Sequence
  Description of Artificial Sequence: Synthetic oligonucleotide
  Target: ATXN1; (+) strand; PAM type: NRG; PAM sequence: TAG
gttaaattatattcactata

SEQ ID NO: 147096 - DNA, 20 bp, Artificial Sequence
  Description of Artificial Sequence: Synthetic oligonucleotide
  Target: ATXN1; (+) strand; PAM type: NRG; PAM sequence: TAG
aaattatattcactatatag

SEQ ID NO: 147097 - DNA, 20 bp, Artificial Sequence
  Description of Artificial Sequence: Synthetic oligonucleotide
  Target: ATXN1; (+) strand; PAM type: NRG; PAM sequence: TAG
ctatatagtagcactctact

SEQ ID NO: 147098 - DNA, 20 bp, Artificial Sequence
  Description of Artificial Sequence: Synthetic oligonucleotide
  Target: ATXN1; (+) strand; PAM type: NRG; PAM sequence: AGG
tatatagtagcactctactt

SEQ ID NO: 147099 - DNA, 20 bp, Artificial Sequence
  Description of Artificial Sequence: Synthetic oligonucleotide
  Target: ATXN1; (+) strand; PAM type: NRG; PAM sequence: AAG
atagtagcactctacttagg

SEQ ID NO: 147100 - DNA, 20 bp, Artificial Sequence
  Description of Artificial Sequence: Synthetic oligonucleotide
  Target: ATXN1; (+) strand; PAM type: NRG; PAM sequence: AGG
tagtagcactctacttagga

SEQ ID NO: 147101 - DNA, 20 bp, Artificial Sequence
  Description of Artificial Sequence: Synthetic oligonucleotide
  Target: ATXN1; (+) strand; PAM type: NRG; PAM sequence: GGG
agtagcactctacttaggaa

SEQ ID NO: 147102 - DNA, 20 bp, Artificial Sequence
  Description of Artificial Sequence: Synthetic oligonucleotide
  Target: ATXN1; (+) strand; PAM type: NRG; PAM sequence: GAG
tagcactctacttaggaagg

SEQ ID NO: 147103 - DNA, 20 bp, Artificial Sequence
  Description of Artificial Sequence: Synthetic oligonucleotide
  Target: ATXN1; (+) strand; PAM type: NRG; PAM sequence: AGG
agcactctacttaggaaggg

SEQ ID NO: 147104 - DNA, 20 bp, Artificial Sequence
  Description of Artificial Sequence: Synthetic oligonucleotide
  Target: ATXN1; (+) strand; PAM type: NRG; PAM sequence: CGG
cattttacaatgatttctgc

SEQ ID NO: 147105 - DNA, 20 bp, Artificial Sequence
  Description of Artificial Sequence: Synthetic oligonucleotide
  Target: ATXN1; (+) strand; PAM type: NRG; PAM sequence: GAG
gatttctgccggaaaatgtt

SEQ ID NO: 147106 - DNA, 20 bp, Artificial Sequence
  Description of Artificial Sequence: Synthetic oligonucleotide
  Target: ATXN1; (+) strand; PAM type: NRG; PAM sequence: CAG
tctcccctttctaacaatgt

SEQ ID NO: 147107 - DNA, 20 bp, Artificial Sequence
  Description of Artificial Sequence: Synthetic oligonucleotide
  Target: ATXN1; (+) strand; PAM type: NRG; PAM sequence: GAG
atgcatttaaataatattct

SEQ ID NO: 147108 - DNA, 20 bp, Artificial Sequence
  Description of Artificial Sequence: Synthetic oligonucleotide
  Target: ATXN1; (+) strand; PAM type: NRG; PAM sequence: TGG
ttctgagtaaatatactatc

SEQ ID NO: 147109 - DNA, 20 bp, Artificial Sequence
  Description of Artificial Sequence: Synthetic oligonucleotide
  Target: ATXN1; (+) strand; PAM type: NRG; PAM sequence: AAG
tgagtaaatatactatctgg

SEQ ID NO: 147110 - DNA, 20 bp, Artificial Sequence
  Description of Artificial Sequence: Synthetic oligonucleotide
  Target: ATXN1; (+) strand; PAM type: NRG; PAM sequence: CAG
gtaaatatactatctggaag

SEQ ID NO: 147111 - DNA, 20 bp, Artificial Sequence
  Description of Artificial Sequence: Synthetic oligonucleotide
  Target: ATXN1; (+) strand; PAM type: NRG; PAM sequence: CAG
ctatctggaagcagttattt

SEQ ID NO: 147112 - DNA, 20 bp, Artificial Sequence
  Description of Artificial Sequence: Synthetic oligonucleotide
  Target: ATXN1; (+) strand; PAM type: NRG; PAM sequence: AGG
tatctggaagcagttatttc

SEQ ID NO: 147113 - DNA, 20 bp, Artificial Sequence
  Description of Artificial Sequence: Synthetic oligonucleotide
  Target: ATXN1; (+) strand; PAM type: NRG; PAM sequence: GAG
tctggaagcagttatttcag

SEQ ID NO: 147114 - DNA, 20 bp, Artificial Sequence
  Description of Artificial Sequence: Synthetic oligonucleotide
  Target: ATXN1; (+) strand; PAM type: NRG; PAM sequence: TAG
ttaaatatttaaatctttac

SEQ ID NO: 147115 - DNA, 20 bp, Artificial Sequence
  Description of Artificial Sequence: Synthetic oligonucleotide
  Target: ATXN1; (+) strand; PAM type: NRG; PAM sequence: GAG
aaatatttaaatctttacta

SEQ ID NO: 147116 - DNA, 20 bp, Artificial Sequence
  Description of Artificial Sequence: Synthetic oligonucleotide
  Target: ATXN1; (+) strand; PAM type: NRG; PAM sequence: TGG
aaatctttactagagaaata

SEQ ID NO: 147117 - DNA, 20 bp, Artificial Sequence
  Description of Artificial Sequence: Synthetic oligonucleotide
  Target: ATXN1; (+) strand; PAM type: NRG; PAM sequence: AAG
tctttactagagaaatatgg

SEQ ID NO: 147118 - DNA, 20 bp, Artificial Sequence
  Description of Artificial Sequence: Synthetic oligonucleotide
  Target: ATXN1; (+) strand; PAM type: NRG; PAM sequence: AAG
tactagagaaatatggaagt

SEQ ID NO: 147119 - DNA, 20 bp, Artificial Sequence
  Description of Artificial Sequence: Synthetic oligonucleotide
  Target: ATXN1; (+) strand; PAM type: NRG; PAM sequence: AAG
aaatatggaagtaagaacaa

SEQ ID NO: 147120 - DNA, 20 bp, Artificial Sequence
  Description of Artificial Sequence: Synthetic oligonucleotide
  Target: ATXN1; (+) strand; PAM type: NRG; PAM sequence: GAG
aacaaaagtgaataatcatt

SEQ ID NO: 147121 - DNA, 20 bp, Artificial Sequence
  Description of Artificial Sequence: Synthetic oligonucleotide
  Target: ATXN1; (+) strand; PAM type: NRG; PAM sequence: AGG
acaaaagtgaataatcattg

SEQ ID NO: 147122 - DNA, 20 bp, Artificial Sequence
  Description of Artificial Sequence: Synthetic oligonucleotide
  Target: ATXN1; (+) strand; PAM type: NRG; PAM sequence: AAG
ataatcattgaggaactctt

SEQ ID NO: 147123 - DNA, 20 bp, Artificial Sequence
  Description of Artificial Sequence: Synthetic oligonucleotide
  Target: ATXN1; (+) strand; PAM type: NRG; PAM sequence: CGG
tgaggaactcttaagaatta

SEQ ID NO: 147124 - DNA, 20 bp, Artificial Sequence
  Description of Artificial Sequence: Synthetic oligonucleotide
  Target: ATXN1; (+) strand; PAM type: NRG; PAM sequence: TAG
acggttttgcattctctgtg

SEQ ID NO: 147125 - DNA, 20 bp, Artificial Sequence
  Description of Artificial Sequence: Synthetic oligonucleotide
  Target: ATXN1; (+) strand; PAM type: NRG; PAM sequence: GAG
ggttttgcattctctgtgta

SEQ ID NO: 147126 - DNA, 20 bp, Artificial Sequence
  Description of Artificial Sequence: Synthetic oligonucleotide
  Target: ATXN1; (+) strand; PAM type: NRG; PAM sequence: GAG
ttttgcattctctgtgtaga

SEQ ID NO: 147127 - DNA, 20 bp, Artificial Sequence
  Description of Artificial Sequence: Synthetic oligonucleotide
  Target: ATXN1; (+) strand; PAM type: NRG; PAM sequence: AGG
tttgcattctctgtgtagag

SEQ ID NO: 147128 - DNA, 20 bp, Artificial Sequence
  Description of Artificial Sequence: Synthetic oligonucleotide
  Target: ATXN1; (+) strand; PAM type: NRG; PAM sequence: TGG
gtgtagagaggaacctatga

SEQ ID NO: 147129 - DNA, 20 bp, Artificial Sequence
  Description of Artificial Sequence: Synthetic oligonucleotide
  Target: ATXN1; (+) strand; PAM type: NRG; PAM sequence: GGG
tgtagagaggaacctatgat

SEQ ID NO: 147130 - DNA, 20 bp, Artificial Sequence
  Description of Artificial Sequence: Synthetic oligonucleotide
  Target: ATXN1; (+) strand; PAM type: NRG; PAM sequence: TGG
aaatttcctttttgacctac

SEQ ID NO: 147131 - DNA, 20 bp, Artificial Sequence
  Description of Artificial Sequence: Synthetic oligonucleotide
  Target: ATXN1; (+) strand; PAM type: NRG; PAM sequence: TAG
ttcctttttgacctactggt

SEQ ID NO: 147132 - DNA, 20 bp, Artificial Sequence
  Description of Artificial Sequence: Synthetic oligonucleotide
  Target: ATXN1; (+) strand; PAM type: NRG; PAM sequence: AAG
tactggttagtgctgtcata

SEQ ID NO: 147133 - DNA, 20 bp, Artificial Sequence
  Description of Artificial Sequence: Synthetic oligonucleotide
  Target: ATXN1; (+) strand; PAM type: NRG; PAM sequence: CAG
gtgctgtcataaagcccctc

SEQ ID NO: 147134 - DNA, 20 bp, Artificial Sequence
  Description of Artificial Sequence: Synthetic oligonucleotide
  Target: ATXN1; (+) strand; PAM type: NRG; PAM sequence: TAG
gtcataaagcccctccagct

SEQ ID NO: 147135 - DNA, 20 bp, Artificial Sequence
  Description of Artificial Sequence: Synthetic oligonucleotide
  Target: ATXN1; (+) strand; PAM type: NRG; PAM sequence: AGG
tcataaagcccctccagctt

SEQ ID NO: 147136 - DNA, 20 bp, Artificial Sequence
  Description of Artificial Sequence: Synthetic oligonucleotide
  Target: ATXN1; (+) strand; PAM type: NRG; PAM sequence: GAG
ccctccagcttaggcgacct

SEQ ID NO: 147137 - DNA, 20 bp, Artificial Sequence
  Description of Artificial Sequence: Synthetic oligonucleotide
  Target: ATXN1; (+) strand; PAM type: NRG; PAM sequence: GAG
ctccagcttaggcgacctga

SEQ ID NO: 147138 - DNA, 20 bp, Artificial Sequence
  Description of Artificial Sequence: Synthetic oligonucleotide
  Target: ATXN1; (+) strand; PAM type: NRG; PAM sequence: CAG
aatttttaaaaccctctttt

SEQ ID NO: 147139 - DNA, 20 bp, Artificial Sequence
  Description of Artificial Sequence: Synthetic oligonucleotide
  Target: ATXN1; (+) strand; PAM type: NRG; PAM sequence: TAG
ttaaaaccctcttttcagaa

SEQ ID NO: 147140 - DNA, 20 bp, Artificial Sequence
  Description of Artificial Sequence: Synthetic oligonucleotide
  Target: ATXN1; (+) strand; PAM type: NRG; PAM sequence: TGG
aaaccctcttttcagaatag

SEQ ID NO: 147141 - DNA, 20 bp, Artificial Sequence
  Description of Artificial Sequence: Synthetic oligonucleotide
  Target: ATXN1; (+) strand; PAM type: NRG; PAM sequence: AAG
ctcttttcagaatagtggaa

SEQ ID NO: 147142 - DNA, 20 bp, Artificial Sequence
  Description of Artificial Sequence: Synthetic oligonucleotide
  Target: ATXN1; (+) strand; PAM type: NRG; PAM sequence: AGG
tcttttcagaatagtggaaa

SEQ ID NO: 147143 - DNA, 20 bp, Artificial Sequence
  Description of Artificial Sequence: Synthetic oligonucleotide
  Target: ATXN1; (+) strand; PAM type: NRG; PAM sequence: AAG
tttctccccttctcatttcc

SEQ ID NO: 147144 - DNA, 20 bp, Artificial Sequence
  Description of Artificial Sequence: Synthetic oligonucleotide
  Target: ATXN1; (+) strand; PAM type: NRG; PAM sequence: GAG
tctccccttctcatttccaa

SEQ ID NO: 147145 - DNA, 20 bp, Artificial Sequence
  Description of Artificial Sequence: Synthetic oligonucleotide
  Target: ATXN1; (+) strand; PAM type: NRG; PAM sequence: AAG
cccttctcatttccaagaga

SEQ ID NO: 147146 - DNA, 20 bp, Artificial Sequence
  Description of Artificial Sequence: Synthetic oligonucleotide
  Target: ATXN1; (+) strand; PAM type: NRG; PAM sequence: AGG
ccttctcatttccaagagaa

SEQ ID NO: 147147 - DNA, 20 bp, Artificial Sequence
  Description of Artificial Sequence: Synthetic oligonucleotide
  Target: ATXN1; (+) strand; PAM type: NRG; PAM sequence: TAG
tctcatttccaagagaaagg

SEQ ID NO: 147148 - DNA, 20 bp, Artificial Sequence
  Description of Artificial Sequence: Synthetic oligonucleotide
  Target: ATXN1; (+) strand; PAM type: NRG; PAM sequence: AAG
aaaggtagtgttgaccctaa

SEQ ID NO: 147149 - DNA, 20 bp, Artificial Sequence
  Description of Artificial Sequence: Synthetic oligonucleotide
  Target: ATXN1; (+) strand; PAM type: NRG; PAM sequence: AAG
tagtgttgaccctaaaagct

SEQ ID NO: 147150 - DNA, 20 bp, Artificial Sequence
  Description of Artificial Sequence: Synthetic oligonucleotide
  Target: ATXN1; (+) strand; PAM type: NRG; PAM sequence: GAG
gtgttgaccctaaaagctaa

SEQ ID NO: 147151 - DNA, 20 bp, Artificial Sequence
  Description of Artificial Sequence: Synthetic oligonucleotide
  Target: ATXN1; (+) strand; PAM type: NRG; PAM sequence: GAG
gttgaccctaaaagctaaga

SEQ ID NO: 147152 - DNA, 20 bp, Artificial Sequence
  Description of Artificial Sequence: Synthetic oligonucleotide
  Target: ATXN1; (+) strand; PAM type: NRG; PAM sequence: AGG
ttgaccctaaaagctaagag

SEQ ID NO: 147153 - DNA, 20 bp, Artificial Sequence
  Description of Artificial Sequence: Synthetic oligonucleotide
  Target: ATXN1; (+) strand; PAM type: NRG; PAM sequence: AAG
cctaaaagctaagagaggaa

SEQ ID NO: 147154 - DNA, 20 bp, Artificial Sequence
  Description of Artificial Sequence: Synthetic oligonucleotide
  Target: ATXN1; (+) strand; PAM type: NRG; PAM sequence: TAG
aagctaagagaggaaaagac

SEQ ID NO: 147155 - DNA, 20 bp, Artificial Sequence
  Description of Artificial Sequence: Synthetic oligonucleotide
  Target: ATXN1; (+) strand; PAM type: NRG; PAM sequence: TGG
aaaagactagatgtgtgttg

SEQ ID NO: 147156 - DNA, 20 bp, Artificial Sequence
  Description of Artificial Sequence: Synthetic oligonucleotide
  Target: ATXN1; (+) strand; PAM type: NRG; PAM sequence: TGG
atattcttgctatataaaca

SEQ ID NO: 147157 - DNA, 20 bp, Artificial Sequence
  Description of Artificial Sequence: Synthetic oligonucleotide
  Target: ATXN1; (+) strand; PAM type: NRG; PAM sequence: TAG
ttcttgctatataaacatgg

SEQ ID NO: 147158 - DNA, 20 bp, Artificial Sequence
  Description of Artificial Sequence: Synthetic oligonucleotide
  Target: ATXN1; (+) strand; PAM type: NRG; PAM sequence: CAG
tataaacatggtagttccat

SEQ ID NO: 147159 - DNA, 20 bp, Artificial Sequence
  Description of Artificial Sequence: Synthetic oligonucleotide
  Target: ATXN1; (+) strand; PAM type: NRG; PAM sequence: AAG
aacatggtagttccatcagt

SEQ ID NO: 147160 - DNA, 20 bp, Artificial Sequence
  Description of Artificial Sequence: Synthetic oligonucleotide
  Target: ATXN1; (+) strand; PAM type: NRG; PAM sequence: GAG
catggtagttccatcagtaa

SEQ ID NO: 147161 - DNA, 20 bp, Artificial Sequence
  Description of Artificial Sequence: Synthetic oligonucleotide
  Target: ATXN1; (+) strand; PAM type: NRG; PAM sequence: AAG
gttccatcagtaagagtttt

SEQ ID NO: 147162 - DNA, 20 bp, Artificial Sequence
  Description of Artificial Sequence: Synthetic oligonucleotide
  Target: ATXN1; (+) strand; PAM type: NRG; PAM sequence: AGG
ttccatcagtaagagtttta

SEQ ID NO: 147163 - DNA, 20 bp, Artificial Sequence
  Description of Artificial Sequence: Synthetic oligonucleotide
  Target: ATXN1; (+) strand; PAM type: NRG; PAM sequence: AAG
catcagtaagagttttaagg

SEQ ID NO: 147164 - DNA, 20 bp, Artificial Sequence
  Description of Artificial Sequence: Synthetic oligonucleotide
  Target: ATXN1; (+) strand; PAM type: NRG; PAM sequence: TGG
taagagttttaaggaagcgt

SEQ ID NO: 147165 - DNA, 20 bp, Artificial Sequence
  Description of Artificial Sequence: Synthetic oligonucleotide
  Target: ATXN1; (+) strand; PAM type: NRG; PAM sequence: GAG
agttttaaggaagcgttggc

SEQ ID NO: 147166 - DNA, 20 bp, Artificial Sequence
  Description of Artificial Sequence: Synthetic oligonucleotide
  Target: ATXN1; (+) strand; PAM type: NRG; PAM sequence: AGG
gttttaaggaagcgttggcg

SEQ ID NO: 147167 - DNA, 20 bp, Artificial Sequence
  Description of Artificial Sequence: Synthetic oligonucleotide
  Target: ATXN1; (+) strand; PAM type: NRG; PAM sequence: TGG
ggcgaggcttgctcactctt

SEQ ID NO: 147168 - DNA, 20 bp, Artificial Sequence
  Description of Artificial Sequence: Synthetic oligonucleotide
  Target: ATXN1; (+) strand; PAM type: NRG; PAM sequence: GGG
gcgaggcttgctcactcttt

SEQ ID NO: 147169 - DNA, 20 bp, Artificial Sequence
  Description of Artificial Sequence: Synthetic oligonucleotide
  Target: ATXN1; (+) strand; PAM type: NRG; PAM sequence: GAG
ggacaccacactgtcacaat

SEQ ID NO: 147170 - DNA, 20 bp, Artificial Sequence
  Description of Artificial Sequence: Synthetic oligonucleotide
  Target: ATXN1; (+) strand; PAM type: NRG; PAM sequence: TAG
caccacactgtcacaatgag

SEQ ID NO: 147171 - DNA, 20 bp, Artificial Sequence
  Description of Artificial Sequence: Synthetic oligonucleotide
  Target: ATXN1; (+) strand; PAM type: NRG; PAM sequence: CAG
gcaccaacaccaccacgtta

SEQ ID NO: 147172 - DNA, 20 bp, Artificial Sequence
  Description of Artificial Sequence: Synthetic oligonucleotide
  Target: ATXN1; (+) strand; PAM type: NRG; PAM sequence: TGG
ccaacaccaccacgttacag

SEQ ID NO: 147173 - DNA, 20 bp, Artificial Sequence
  Description of Artificial Sequence: Synthetic oligonucleotide
  Target: ATXN1; (+) strand; PAM type: NRG; PAM sequence: CAG
acgttacagtggaaacgcca

SEQ ID NO: 147174 - DNA, 20 bp, Artificial Sequence
  Description of Artificial Sequence: Synthetic oligonucleotide
  Target: ATXN1; (+) strand; PAM type: NRG; PAM sequence: TGG
ttacagtggaaacgccacag

SEQ ID NO: 147175 - DNA, 20 bp, Artificial Sequence
  Description of Artificial Sequence: Synthetic oligonucleotide
  Target: ATXN1; (+) strand; PAM type: NRG; PAM sequence: GAG
acagtggaaacgccacagtg

SEQ ID NO: 147176 - DNA, 20 bp, Artificial Sequence
  Description of Artificial Sequence: Synthetic oligonucleotide
  Target: ATXN1; (+) strand; PAM type: NRG; PAM sequence: TAG
tggaaacgccacagtggagc

SEQ ID NO: 147177 - DNA, 20 bp, Artificial Sequence
  Description of Artificial Sequence: Synthetic oligonucleotide
  Target: ATXN1; (+) strand; PAM type: NRG; PAM sequence: CAG
cgccacagtggagctagtaa

SEQ ID NO: 147178 - DNA, 20 bp, Artificial Sequence
  Description of Artificial Sequence: Synthetic oligonucleotide
  Target: ATXN1; (+) strand; PAM type: NRG; PAM sequence: GAG
ccacagtggagctagtaaca

SEQ ID NO: 147179 - DNA, 20 bp, Artificial Sequence
  Description of Artificial Sequence: Synthetic oligonucleotide
  Target: ATXN1; (+) strand; PAM type: NRG; PAM sequence: TAG
tggagctagtaacagagtgt

SEQ ID NO: 147180 - DNA, 20 bp, Artificial Sequence
  Description of Artificial Sequence: Synthetic oligonucleotide
  Target: ATXN1; (+) strand; PAM type: NRG; PAM sequence: TAG
tagtaacagagtgttagtat

SEQ ID NO: 147181 - DNA, 20 bp, Artificial Sequence
  Description of Artificial Sequence: Synthetic oligonucleotide
  Target: ATXN1; (+) strand; PAM type: NRG; PAM sequence: CGG
taacagagtgttagtattag

SEQ ID NO: 147182 - DNA, 20 bp, Artificial Sequence
  Description of Artificial Sequence: Synthetic oligonucleotide
  Target: ATXN1; (+) strand; PAM type: NRG; PAM sequence: GGG
aacagagtgttagtattagc

SEQ ID NO: 147183 - DNA, 20 bp, Artificial Sequence
  Description of Artificial Sequence: Synthetic oligonucleotide
  Target: ATXN1; (+) strand; PAM type: NRG; PAM sequence: TGG
agcgggatgaatacacctgc

SEQ ID NO: 147184 - DNA, 20 bp, Artificial Sequence
  Description of Artificial Sequence: Synthetic oligonucleotide
  Target: ATXN1; (+) strand; PAM type: NRG; PAM sequence: TAG
atacacctgctggtgcaatt

SEQ ID NO: 147185 - DNA, 20 bp, Artificial Sequence
  Description of Artificial Sequence: Synthetic oligonucleotide
  Target: ATXN1; (+) strand; PAM type: NRG; PAM sequence: AGG
tacacctgctggtgcaattt

SEQ ID NO: 147186 - DNA, 20 bp, Artificial Sequence
  Description of Artificial Sequence: Synthetic oligonucleotide
  Target: ATXN1; (+) strand; PAM type: NRG; PAM sequence: CAG
atttaggtgaatttccataa

SEQ ID NO: 147187 - DNA, 20 bp, Artificial Sequence
  Description of Artificial Sequence: Synthetic oligonucleotide
  Target: ATXN1; (+) strand; PAM type: NRG; PAM sequence: TAG
ttccataacagaacatatat

SEQ ID NO: 147188 - DNA, 20 bp, Artificial Sequence
  Description of Artificial Sequence: Synthetic oligonucleotide
  Target: ATXN1; (+) strand; PAM type: NRG; PAM sequence: TAG
tatattagttaattttgctt

SEQ ID NO: 147189 - DNA, 20 bp, Artificial Sequence
  Description of Artificial Sequence: Synthetic oligonucleotide
  Target: ATXN1; (+) strand; PAM type: NRG; PAM sequence: TGG
ttttgctttagattatgaat

SEQ ID NO: 147190 - DNA, 20 bp, Artificial Sequence
  Description of Artificial Sequence: Synthetic oligonucleotide
  Target: ATXN1; (+) strand; PAM type: NRG; PAM sequence: GGG
tttgctttagattatgaatt

SEQ ID NO: 147191 - DNA, 20 bp, Artificial Sequence
  Description of Artificial Sequence: Synthetic oligonucleotide
  Target: ATXN1; (+) strand; PAM type: NRG; PAM sequence: TAG
tatgaattgggaaaattcct

SEQ ID NO: 147192 - DNA, 20 bp, Artificial Sequence
  Description of Artificial Sequence: Synthetic oligonucleotide
  Target: ATXN1; (+) strand; PAM type: NRG; PAM sequence: TAG
aaaattccttagcatattat

SEQ ID NO: 147193 - DNA, 20 bp, Artificial Sequence
  Description of Artificial Sequence: Synthetic oligonucleotide
  Target: ATXN1; (+) strand; PAM type: NRG; PAM sequence: CAG
ttattagcatattatcatat

SEQ ID NO: 147194 - DNA, 20 bp, Artificial Sequence
  Description of Artificial Sequence: Synthetic oligonucleotide
  Target: ATXN1; (+) strand; PAM type: NRG; PAM sequence: AAG
tatcatatcagcataacaac

SEQ ID NO: 147195 - DNA, 20 bp, Artificial Sequence
  Description of Artificial Sequence: Synthetic oligonucleotide
  Target: ATXN1; (+) strand; PAM type: NRG; PAM sequence: AAG
tcagcataacaacaagtatt

SEQ ID NO: 147196 - DNA, 20 bp, Artificial Sequence
  Description of Artificial Sequence: Synthetic oligonucleotide
  Target: ATXN1; (+) strand; PAM type: NRG; PAM sequence: AGG
cagcataacaacaagtatta

SEQ ID NO: 147197 - DNA, 20 bp, Artificial Sequence
  Description of Artificial Sequence: Synthetic oligonucleotide
  Target: ATXN1; (+) strand; PAM type: NRG; PAM sequence: AAG
gacacaaaaattctaattac

SEQ ID NO: 147198 - DNA, 20 bp, Artificial Sequence
  Description of Artificial Sequence: Synthetic oligonucleotide
  Target: ATXN1; (+) strand; PAM type: NRG; PAM sequence: AAG
caaaaattctaattacaagt

SEQ ID NO: 147199 - DNA, 20 bp, Artificial Sequence
  Description of Artificial Sequence: Synthetic oligonucleotide
  Target: ATXN1; (+) strand; PAM type: NRG; PAM sequence: TGG
tctgtttgcttttttaccct

SEQ ID NO: 147200 - DNA, 20 bp, Artificial Sequence
  Description of Artificial Sequence: Synthetic oligonucleotide
  Target: ATXN1; (+) strand; PAM type: NRG; PAM sequence: AAG
ttttacccttggacttgtct

SEQ ID NO: 147201 - DNA, 20 bp, Artificial Sequence
  Description of Artificial Sequence: Synthetic oligonucleotide
  Target: ATXN1; (+) strand; PAM type: NRG; PAM sequence: CAG
gacttgtctaagactctact

SEQ ID NO: 147202 - DNA, 20 bp, Artificial Sequence
  Description of Artificial Sequence: Synthetic oligonucleotide
  Target: ATXN1; (+) strand; PAM type: NRG; PAM sequence: AGG
acttgtctaagactctactc

SEQ ID NO: 147203 - DNA, 20 bp, Artificial Sequence
  Description of Artificial Sequence: Synthetic oligonucleotide
  Target: ATXN1; (+) strand; PAM type: NRG; PAM sequence: CAG
cttctcttcccttcaaatcc

SEQ ID NO: 147204 - DNA, 20 bp, Artificial Sequence
  Description of Artificial Sequence: Synthetic oligonucleotide
  Target: ATXN1; (+) strand; PAM type: NRG; PAM sequence: AAG
cttcccttcaaatcccagtt

SEQ ID NO: 147205 - DNA, 20 bp, Artificial Sequence
  Description of Artificial Sequence: Synthetic oligonucleotide
  Target: ATXN1; (+) strand; PAM type: NRG; PAM sequence: AGG
ttcccttcaaatcccagtta

SEQ ID NO: 147206 - DNA, 20 bp, Artificial Sequence
  Description of Artificial Sequence: Synthetic oligonucleotide
  Target: ATXN1; (+) strand; PAM type: NRG; PAM sequence: GAG
cccttcaaatcccagttaag

SEQ ID NO: 147207 - DNA, 20 bp, Artificial Sequence
  Description of Artificial Sequence: Synthetic oligonucleotide
  Target: ATXN1; (+) strand; PAM type: NRG; PAM sequence: TAG
ccagttaaggagacgccatt

SEQ ID NO: 147208 - DNA, 20 bp, Artificial Sequence
  Description of Artificial Sequence: Synthetic oligonucleotide
  Target: ATXN1; (+) strand; PAM type: NRG; PAM sequence: TAG
aggagacgccatttagaata

SEQ ID NO: 147209 - DNA, 20 bp, Artificial Sequence
  Description of Artificial Sequence: Synthetic oligonucleotide
  Target: ATXN1; (+) strand; PAM type: NRG; PAM sequence: CAG
ctgttgattcatctttttaa

SEQ ID NO: 147210 - DNA, 20 bp, Artificial Sequence
  Description of Artificial Sequence: Synthetic oligonucleotide
  Target: ATXN1; (+) strand; PAM type: NRG; PAM sequence: TGG
taacagcactcttttttttt

SEQ ID NO: 147211 - DNA, 20 bp, Artificial Sequence
  Description of Artificial Sequence: Synthetic oligonucleotide
  Target: ATXN1; (+) strand; PAM type: NRG; PAM sequence: TAG
ttttttggtacaaaaatctc

SEQ ID NO: 147212 - DNA, 20 bp, Artificial Sequence
  Description of Artificial Sequence: Synthetic oligonucleotide
  Target: ATXN1; (+) strand; PAM type: NRG; PAM sequence: AGG
tttttggtacaaaaatctct

SEQ ID NO: 147213 - DNA, 20 bp, Artificial Sequence
  Description of Artificial Sequence: Synthetic oligonucleotide
  Target: ATXN1; (+) strand; PAM type: NRG; PAM sequence: GGG
ttttggtacaaaaatctcta

SEQ ID NO: 147214 - DNA, 20 bp, Artificial Sequence
  Description of Artificial Sequence: Synthetic oligonucleotide
  Target: ATXN1; (+) strand; PAM type: NRG; PAM sequence: CAG
cttaaatcctttttcccacc

SEQ ID NO: 147215 - DNA, 20 bp, Artificial Sequence
  Description of Artificial Sequence: Synthetic oligonucleotide
  Target: ATXN1; (+) strand; PAM type: NRG; PAM sequence: AAG
ttcccacccagtgctctctg

SEQ ID NO: 147216 - DNA, 20 bp, Artificial Sequence
  Description of Artificial Sequence: Synthetic oligonucleotide
  Target: ATXN1; (+) strand; PAM type: NRG; PAM sequence: GAG
cccacccagtgctctctgaa

SEQ ID NO: 147217 - DNA, 20 bp, Artificial Sequence
  Description of Artificial Sequence: Synthetic oligonucleotide
  Target: ATXN1; (+) strand; PAM type: NRG; PAM sequence: AAG
ccagtgctctctgaagagct

SEQ ID NO: 147218 - DNA, 20 bp, Artificial Sequence
  Description of Artificial Sequence: Synthetic oligonucleotide
  Target: ATXN1; (+) strand; PAM type: NRG; PAM sequence: AGG
cagtgctctctgaagagcta

SEQ ID NO: 147219 - DNA, 20 bp, Artificial Sequence
  Description of Artificial Sequence: Synthetic oligonucleotide
  Target: ATXN1; (+) strand; PAM type: NRG; PAM sequence: AAG
gctaactttttccttttcta

SEQ ID NO: 147220 - DNA, 20 bp, Artificial Sequence
  Description of Artificial Sequence: Synthetic oligonucleotide
  Target: ATXN1; (+) strand; PAM type: NRG; PAM sequence: TAG
tttcctatgctgtttcccca

SEQ ID NO: 147221 - DNA, 20 bp, Artificial Sequence
  Description of Artificial Sequence: Synthetic oligonucleotide
  Target: ATXN1; (+) strand; PAM type: NRG; PAM sequence: CAG
cttcatgtctcatataaaaa

SEQ ID NO: 147222 - DNA, 20 bp, Artificial Sequence
  Description of Artificial Sequence: Synthetic oligonucleotide
  Target: ATXN1; (+) strand; PAM type: NRG; PAM sequence: TGG
tataaaaacagcactctcac

SEQ ID NO: 147223 - DNA, 20 bp, Artificial Sequence
  Description of Artificial Sequence: Synthetic oligonucleotide
  Target: ATXN1; (+) strand; PAM type: NRG; PAM sequence: GGG
ataaaaacagcactctcact

SEQ ID NO: 147224 - DNA, 20 bp, Artificial Sequence
  Description of Artificial Sequence: Synthetic oligonucleotide
  Target: ATXN1; (+) strand; PAM type: NRG; PAM sequence: TGG
atgtttttaattgactcatt

SEQ ID NO: 147225 - DNA, 20 bp, Artificial Sequence
  Description of Artificial Sequence: Synthetic oligonucleotide
  Target: ATXN1; (+) strand; PAM type: NRG; PAM sequence: GAG
ttttaattgactcatttggt

SEQ ID NO: 147226 - DNA, 20 bp, Artificial Sequence
  Description of Artificial Sequence: Synthetic oligonucleotide
  Target: ATXN1; (+) strand; PAM type: NRG; PAM sequence: AGG
tttaattgactcatttggtg

SEQ ID NO: 147227 - DNA, 20 bp, Artificial Sequence
  Description of Artificial Sequence: Synthetic oligonucleotide
  Target: ATXN1; (+) strand; PAM type: NRG; PAM sequence: TAG
tcatttggtgaggctctccc

SEQ ID NO: 147228 - DNA, 20 bp, Artificial Sequence
  Description of Artificial Sequence: Synthetic oligonucleotide
  Target: ATXN1; (+) strand; PAM type: NRG; PAM sequence: CAG
gctctccctagctaaatgaa

SEQ ID NO: 147229 - DNA, 20 bp, Artificial Sequence
  Description of Artificial Sequence: Synthetic oligonucleotide
  Target: ATXN1; (+) strand; PAM type: NRG; PAM sequence: AAG
atgaacagtctgccttttca

SEQ ID NO: 147230 - DNA, 20 bp, Artificial Sequence
  Description of Artificial Sequence: Synthetic oligonucleotide
  Target: ATXN1; (+) strand; PAM type: NRG; PAM sequence: AGG
tgaacagtctgccttttcaa

SEQ ID NO: 147231 - DNA, 20 bp, Artificial Sequence
  Description of Artificial Sequence: Synthetic oligonucleotide
  Target: ATXN1; (+) strand; PAM type: NRG; PAM sequence: GAG
accaaacatttcttccttct

SEQ ID NO: 147232 - DNA, 20 bp, Artificial Sequence
  Description of Artificial Sequence: Synthetic oligonucleotide
  Target: ATXN1; (+) strand; PAM type: NRG; PAM sequence: AAG
tattttaaactcttctaaca

SEQ ID NO: 147233 - DNA, 20 bp, Artificial Sequence
  Description of Artificial Sequence: Synthetic oligonucleotide
  Target: ATXN1; (+) strand; PAM type: NRG; PAM sequence: TGG
tcttctaacaaagccaaaca

SEQ ID NO: 147234 - DNA, 20 bp, Artificial Sequence
  Description of Artificial Sequence: Synthetic oligonucleotide
  Target: ATXN1; (+) strand; PAM type: NRG; PAM sequence: CAG
aaagccaaacatggattaaa

SEQ ID NO: 147235 - DNA, 20 bp, Artificial Sequence
  Description of Artificial Sequence: Synthetic oligonucleotide
  Target: ATXN1; (+) strand; PAM type: NRG; PAM sequence: AAG
tggattaaacagcgttacat

SEQ ID NO: 147236 - DNA, 20 bp, Artificial Sequence
  Description of Artificial Sequence: Synthetic oligonucleotide
  Target: ATXN1; (+) strand; PAM type: NRG; PAM sequence: CAG
gcgttacataagtctcttca

SEQ ID NO: 147237 - DNA, 20 bp, Artificial Sequence
  Description of Artificial Sequence: Synthetic oligonucleotide
  Target: ATXN1; (+) strand; PAM type: NRG; PAM sequence: AAG
taagtctcttcacagcacct

SEQ ID NO: 147238 - DNA, 20 bp, Artificial Sequence
  Description of Artificial Sequence: Synthetic oligonucleotide
  Target: ATXN1; (+) strand; PAM type: NRG; PAM sequence: TAG
cacagcacctaagttcaaat

SEQ ID NO: 147239 - DNA, 20 bp, Artificial Sequence
  Description of Artificial Sequence: Synthetic oligonucleotide
  Target: ATXN1; (+) strand; PAM type: NRG; PAM sequence: AGG
acagcacctaagttcaaatt

SEQ ID NO: 147240 - DNA, 20 bp, Artificial Sequence
  Description of Artificial Sequence: Synthetic oligonucleotide
  Target: ATXN1; (+) strand; PAM type: NRG; PAM sequence: AAG
ctaagttcaaattaggaatc

SEQ ID NO: 147241 - DNA, 20 bp, Artificial Sequence
  Description of Artificial Sequence: Synthetic oligonucleotide
  Target: ATXN1; (+) strand; PAM type: NRG; PAM sequence: TGG
aatcaagtcccaataaccaa

SEQ ID NO: 147242 - DNA, 20 bp, Artificial Sequence
  Description of Artificial Sequence: Synthetic oligonucleotide
  Target: ATXN1; (+) strand; PAM type: NRG; PAM sequence: GGG
atcaagtcccaataaccaat

SEQ ID NO: 147243 - DNA, 20 bp, Artificial Sequence
  Description of Artificial Sequence: Synthetic oligonucleotide
  Target: ATXN1; (+) strand; PAM type: NRG; PAM sequence: TGG
tcccaataaccaatgggaca

SEQ ID NO: 147244 - DNA, 20 bp, Artificial Sequence
  Description of Artificial Sequence: Synthetic oligonucleotide
  Target: ATXN1; (+) strand; PAM type: NRG; PAM sequence: TAG
atactgttttcaccaataaa

SEQ ID NO: 147245 - DNA, 20 bp, Artificial Sequence
  Description of Artificial Sequence: Synthetic oligonucleotide
  Target: ATXN1; (+) strand; PAM type: NRG; PAM sequence: AAG
caataaatagccaccccatc

SEQ ID NO: 147246 - DNA, 20 bp, Artificial Sequence
  Description of Artificial Sequence: Synthetic oligonucleotide
  Target: ATXN1; (+) strand; PAM type: NRG; PAM sequence: TAG
catcaagctgccccatcgac

SEQ ID NO: 147247 - DNA, 20 bp, Artificial Sequence
  Description of Artificial Sequence: Synthetic oligonucleotide
  Target: ATXN1; (+) strand; PAM type: NRG; PAM sequence: AGG
atcaagctgccccatcgact

SEQ ID NO: 147248 - DNA, 20 bp, Artificial Sequence
  Description of Artificial Sequence: Synthetic oligonucleotide
  Target: ATXN1; (+) strand; PAM type: NRG; PAM sequence: AAG
aagctgccccatcgactagg

SEQ ID NO: 147249 - DNA, 20 bp, Artificial Sequence
  Description of Artificial Sequence: Synthetic oligonucleotide
  Target: ATXN1; (+) strand; PAM type: NRG; PAM sequence: GAG
gctgccccatcgactaggaa

SEQ ID NO: 147250 - DNA, 20 bp, Artificial Sequence
  Description of Artificial Sequence: Synthetic oligonucleotide
  Target: ATXN1; (+) strand; PAM type: NRG; PAM sequence: AGG
ctgccccatcgactaggaag

SEQ ID NO: 147251 - DNA, 20 bp, Artificial Sequence
  Description of Artificial Sequence: Synthetic oligonucleotide
  Target: ATXN1; (+) strand; PAM type: NRG; PAM sequence: CAG
cgactaggaagaggcccact

SEQ ID NO: 147252 - DNA, 20 bp, Artificial Sequence
  Description of Artificial Sequence: Synthetic oligonucleotide
  Target: ATXN1; (+) strand; PAM type: NRG; PAM sequence: AGG
gactaggaagaggcccactc

SEQ ID NO: 147253 - DNA, 20 bp, Artificial Sequence
  Description of Artificial Sequence: Synthetic oligonucleotide
  Target: ATXN1; (+) strand; PAM type: NRG; PAM sequence: CGG
aagaggcccactcaggcacc

SEQ ID NO: 147254 - DNA, 20 bp, Artificial Sequence
  Description of Artificial Sequence: Synthetic oligonucleotide
  Target: ATXN1; (+) strand; PAM type: NRG; PAM sequence: AAG
aggcccactcaggcacccgg

SEQ ID NO: 147255 - DNA, 20 bp, Artificial Sequence
  Description of Artificial Sequence: Synthetic oligonucleotide
  Target: ATXN1; (+) strand; PAM type: NRG; PAM sequence: CAG
ggcacccggaagctttgccc

SEQ ID NO: 147256 - DNA, 20 bp, Artificial Sequence
  Description of Artificial Sequence: Synthetic oligonucleotide
  Target: ATXN1; (+) strand; PAM type: NRG; PAM sequence: GAG
cacccggaagctttgcccca

SEQ ID NO: 147257 - DNA, 20 bp, Artificial Sequence
  Description of Artificial Sequence: Synthetic oligonucleotide
  Target: ATXN1; (+) strand; PAM type: NRG; PAM sequence: GAG
cccggaagctttgccccaga

SEQ ID NO: 147258 - DNA, 20 bp, Artificial Sequence
  Description of Artificial Sequence: Synthetic oligonucleotide
  Target: ATXN1; (+) strand; PAM type: NRG; PAM sequence: CAG
ggaagctttgccccagagag

SEQ ID NO: 147259 - DNA, 20 bp, Artificial Sequence
  Description of Artificial Sequence: Synthetic oligonucleotide
  Target: ATXN1; (+) strand; PAM type: NRG; PAM sequence: GAG
tttgccccagagagcagaat

SEQ ID NO: 147260 - DNA, 20 bp, Artificial Sequence
  Description of Artificial Sequence: Synthetic oligonucleotide
  Target: ATXN1; (+) strand; PAM type: NRG; PAM sequence: AGG
ttgccccagagagcagaatg

SEQ ID NO: 147261 - DNA, 20 bp, Artificial Sequence
  Description of Artificial Sequence: Synthetic oligonucleotide
  Target: ATXN1; (+) strand; PAM type: NRG; PAM sequence: CAG
gaaactataccactgctctg

SEQ ID NO: 147262 - DNA, 20 bp, Artificial Sequence
  Description of Artificial Sequence: Synthetic oligonucleotide
  Target: ATXN1; (+) strand; PAM type: NRG; PAM sequence: CAG
ctgcagacatatctcaccca

SEQ ID NO: 147263 - DNA, 20 bp, Artificial Sequence
  Description of Artificial Sequence: Synthetic oligonucleotide
  Target: ATXN1; (+) strand; PAM type: NRG; PAM sequence: CAG
ccacagtgctttcctattgc

SEQ ID NO: 147264 - DNA, 20 bp, Artificial Sequence
  Description of Artificial Sequence: Synthetic oligonucleotide
  Target: ATXN1; (+) strand; PAM type: NRG; PAM sequence: AGG
cacagtgctttcctattgcc

SEQ ID NO: 147265 - DNA, 20 bp, Artificial Sequence
  Description of Artificial Sequence: Synthetic oligonucleotide
  Target: ATXN1; (+) strand; PAM type: NRG; PAM sequence: GAG
cagtgctttcctattgccag

SEQ ID NO: 147266 - DNA, 20 bp, Artificial Sequence
  Description of Artificial Sequence: Synthetic oligonucleotide
  Target: ATXN1; (+) strand; PAM type: NRG; PAM sequence: CGG
tttcctattgccaggagcac

SEQ ID NO: 147267 - DNA, 20 bp, Artificial Sequence
  Description of Artificial Sequence: Synthetic oligonucleotide
  Target: ATXN1; (+) strand; PAM type: NRG; PAM sequence: GGG
ttcctattgccaggagcacc

SEQ ID NO: 147268 - DNA, 20 bp, Artificial Sequence
  Description of Artificial Sequence: Synthetic oligonucleotide
  Target: ATXN1; (+) strand; PAM type: NRG; PAM sequence: GAG
cctattgccaggagcaccgg

SEQ ID NO: 147269 - DNA, 20 bp, Artificial Sequence
  Description of Artificial Sequence: Synthetic oligonucleotide
  Target: ATXN1; (+) strand; PAM type: NRG; PAM sequence: AGG
ctattgccaggagcaccggg

SEQ ID NO: 147270 - DNA, 20 bp, Artificial Sequence
  Description of Artificial Sequence: Synthetic oligonucleotide
  Target: ATXN1; (+) strand; PAM type: NRG; PAM sequence: GGG
tattgccaggagcaccggga

SEQ ID NO: 147271 - DNA, 20 bp, Artificial Sequence
  Description of Artificial Sequence: Synthetic oligonucleotide
  Target: ATXN1; (+) strand; PAM type: NRG; PAM sequence: TGG
attctaatcatcccttctaa

SEQ ID NO: 147272 - DNA, 20 bp, Artificial Sequence
  Description of Artificial Sequence: Synthetic oligonucleotide
  Target: ATXN1; (+) strand; PAM type: NRG; PAM sequence: CAG
aatcatcccttctaatggcg

SEQ ID NO: 147273 - DNA, 20 bp, Artificial Sequence
  Description of Artificial Sequence: Synthetic oligonucleotide
  Target: ATXN1; (+) strand; PAM type: NRG; PAM sequence: AAG
atcccttctaatggcgcagc

SEQ ID NO: 147274 - DNA, 20 bp, Artificial Sequence
  Description of Artificial Sequence: Synthetic oligonucleotide
  Target: ATXN1; (+) strand; PAM type: NRG; PAM sequence: GAG
cccttctaatggcgcagcaa

SEQ ID NO: 147275 - DNA, 20 bp, Artificial Sequence
  Description of Artificial Sequence: Synthetic oligonucleotide
  Target: ATXN1; (+) strand; PAM type: NRG; PAM sequence: CAG
gcgcagcaagagatcatgca

SEQ ID NO: 147276 - DNA, 20 bp, Artificial Sequence
  Description of Artificial Sequence: Synthetic oligonucleotide
  Target: ATXN1; (+) strand; PAM type: NRG; PAM sequence: GAG
gcagcaagagatcatgcaca

SEQ ID NO: 147277 - DNA, 20 bp, Artificial Sequence
  Description of Artificial Sequence: Synthetic oligonucleotide
  Target: ATXN1; (+) strand; PAM type: NRG; PAM sequence: AGG
cagcaagagatcatgcacag

SEQ ID NO: 147278 - DNA, 20 bp, Artificial Sequence
  Description of Artificial Sequence: Synthetic oligonucleotide
  Target: ATXN1; (+) strand; PAM type: NRG; PAM sequence: CGG
gagatcatgcacagaggtga

SEQ ID NO: 147279 - DNA, 20 bp, Artificial Sequence
  Description of Artificial Sequence: Synthetic oligonucleotide
  Target: ATXN1; (+) strand; PAM type: NRG; PAM sequence: GGG
agatcatgcacagaggtgac

SEQ ID NO: 147280 - DNA, 20 bp, Artificial Sequence
  Description of Artificial Sequence: Synthetic oligonucleotide
  Target: ATXN1; (+) strand; PAM type: NRG; PAM sequence: GGG
gatcatgcacagaggtgacg

SEQ ID NO: 147281 - DNA, 20 bp, Artificial Sequence
  Description of Artificial Sequence: Synthetic oligonucleotide
  Target: ATXN1; (+) strand; PAM type: NRG; PAM sequence: AAG
atgcacagaggtgacgggga

SEQ ID NO: 147282 - DNA, 20 bp, Artificial Sequence
  Description of Artificial Sequence: Synthetic oligonucleotide
  Target: ATXN1; (+) strand; PAM type: NRG; PAM sequence: AAG
acagaggtgacggggaaaga

SEQ ID NO: 147283 - DNA, 20 bp, Artificial Sequence
  Description of Artificial Sequence: Synthetic oligonucleotide
  Target: ATXN1; (+) strand; PAM type: NRG; PAM sequence: GAG
agaggtgacggggaaagaaa

SEQ ID NO: 147284 - DNA, 20 bp, Artificial Sequence
  Description of Artificial Sequence: Synthetic oligonucleotide
  Target: ATXN1; (+) strand; PAM type: NRG; PAM sequence: CAG
ggtgacggggaaagaaagag

SEQ ID NO: 147285 - DNA, 20 bp, Artificial Sequence
  Description of Artificial Sequence: Synthetic oligonucleotide
  Target: ATXN1; (+) strand; PAM type: NRG; PAM sequence: TGG
agagcagtgccactactctg

SEQ ID NO: 147286 - DNA, 20 bp, Artificial Sequence
  Description of Artificial Sequence: Synthetic oligonucleotide
  Target: ATXN1; (+) strand; PAM type: NRG; PAM sequence: CAG
acactcattattcatttaaa

SEQ ID NO: 147287 - DNA, 20 bp, Artificial Sequence
  Description of Artificial Sequence: Synthetic oligonucleotide
  Target: ATXN1; (+) strand; PAM type: NRG; PAM sequence: AAG
attcatttaaacagcaccta

SEQ ID NO: 147288 - DNA, 20 bp, Artificial Sequence
  Description of Artificial Sequence: Synthetic oligonucleotide
  Target: ATXN1; (+) strand; PAM type: NRG; PAM sequence: AAG
acagcacctaaagaaccttc

SEQ ID NO: 147289 - DNA, 20 bp, Artificial Sequence
  Description of Artificial Sequence: Synthetic oligonucleotide
  Target: ATXN1; (+) strand; PAM type: NRG; PAM sequence: TAG
taaacacatcactctatcat

SEQ ID NO: 147290 - DNA, 20 bp, Artificial Sequence
  Description of Artificial Sequence: Synthetic oligonucleotide
  Target: ATXN1; (+) strand; PAM type: NRG; PAM sequence: AAG
atcattagtgactgttgctg

SEQ ID NO: 147291 - DNA, 20 bp, Artificial Sequence
  Description of Artificial Sequence: Synthetic oligonucleotide
  Target: ATXN1; (+) strand; PAM type: NRG; PAM sequence: AAG
attagtgactgttgctgaag

SEQ ID NO: 147292 - DNA, 20 bp, Artificial Sequence
  Description of Artificial Sequence: Synthetic oligonucleotide
  Target: ATXN1; (+) strand; PAM type: NRG; PAM sequence: AGG
ttagtgactgttgctgaaga

SEQ ID NO: 147293 - DNA, 20 bp, Artificial Sequence
  Description of Artificial Sequence: Synthetic oligonucleotide
  Target: ATXN1; (+) strand; PAM type: NRG; PAM sequence: GGG
tagtgactgttgctgaagaa

SEQ ID NO: 147294 - DNA, 20 bp, Artificial Sequence
  Description of Artificial Sequence: Synthetic oligonucleotide
  Target: ATXN1; (+) strand; PAM type: NRG; PAM sequence: GAG
atatgattgtattaacatgt

SEQ ID NO: 147295 - DNA, 20 bp, Artificial Sequence
  Description of Artificial Sequence: Synthetic oligonucleotide
  Target: ATXN1; (+) strand; PAM type: NRG; PAM sequence: AGG
tatgattgtattaacatgtg

SEQ ID NO: 147296 - DNA, 20 bp, Artificial Sequence
  Description of Artificial Sequence: Synthetic oligonucleotide
  Target: ATXN1; (+) strand; PAM type: NRG; PAM sequence: AAG
gattgtattaacatgtgagg

SEQ ID NO: 147297 - DNA, 20 bp, Artificial Sequence
  Description of Artificial Sequence: Synthetic oligonucleotide
  Target: ATXN1; (+) strand; PAM type: NRG; PAM sequence: TAG
aagctgaaatgaattttctt

SEQ ID NO: 147298 - DNA, 20 bp, Artificial Sequence
  Description of Artificial Sequence: Synthetic oligonucleotide
  Target: ATXN1; (+) strand; PAM type: NRG; PAM sequence: GAG
gctgaaatgaattttcttta

SEQ ID NO: 147299 - DNA, 20 bp, Artificial Sequence
  Description of Artificial Sequence: Synthetic oligonucleotide
  Target: ATXN1; (+) strand; PAM type: NRG; PAM sequence: CAG
gaaatgaattttctttagag

SEQ ID NO: 147300 - DNA, 20 bp, Artificial Sequence
  Description of Artificial Sequence: Synthetic oligonucleotide
  Target: ATXN1; (+) strand; PAM type: NRG; PAM sequence: TAG
attttctttagagcagctca

SEQ ID NO: 147301 - DNA, 20 bp, Artificial Sequence
  Description of Artificial Sequence: Synthetic oligonucleotide
  Target: ATXN1; (+) strand; PAM type: NRG; PAM sequence: CAG
gcccctcccattctcactcc

SEQ ID NO: 147302 - DNA, 20 bp, Artificial Sequence
  Description of Artificial Sequence: Synthetic oligonucleotide
  Target: ATXN1; (+) strand; PAM type: NRG; PAM sequence: TAG
cctcccattctcactcccag

SEQ ID NO: 147303 - DNA, 20 bp, Artificial Sequence
  Description of Artificial Sequence: Synthetic oligonucleotide
  Target: ATXN1; (+) strand; PAM type: NRG; PAM sequence: TGG
ccattctcactcccagtagc

SEQ ID NO: 147304 - DNA, 20 bp, Artificial Sequence
  Description of Artificial Sequence: Synthetic oligonucleotide
  Target: ATXN1; (+) strand; PAM type: NRG; PAM sequence: GGG
cattctcactcccagtagct

SEQ ID NO: 147305 - DNA, 20 bp, Artificial Sequence
  Description of Artificial Sequence: Synthetic oligonucleotide
  Target: ATXN1; (+) strand; PAM type: NRG; PAM sequence: GAG
ttctcactcccagtagctgg

SEQ ID NO: 147306 - DNA, 20 bp, Artificial Sequence
  Description of Artificial Sequence: Synthetic oligonucleotide
  Target: ATXN1; (+) strand; PAM type: NRG; PAM sequence: AAG
agatgatgcttcattgttct

SEQ ID NO: 147307 - DNA, 20 bp, Artificial Sequence
  Description of Artificial Sequence: Synthetic oligonucleotide
  Target: ATXN1; (+) strand; PAM type: NRG; PAM sequence: TAG
atgcttcattgttctaagct

SEQ ID NO: 147308 - DNA, 20 bp, Artificial Sequence
  Description of Artificial Sequence: Synthetic oligonucleotide
  Target: ATXN1; (+) strand; PAM type: NRG; PAM sequence: AAG
aacaaataaaccttttgcta

SEQ ID NO: 147309 - DNA, 20 bp, Artificial Sequence
  Description of Artificial Sequence: Synthetic oligonucleotide
  Target: ATXN1; (+) strand; PAM type: NRG; PAM sequence: TGG
aaataaaccttttgctaaag

SEQ ID NO: 147310 - DNA, 20 bp, Artificial Sequence
  Description of Artificial Sequence: Synthetic oligonucleotide
  Target: ATXN1; (+) strand; PAM type: NRG; PAM sequence: CAG
agtggattaaaacatctcaa

SEQ ID NO: 147311 - DNA, 20 bp, Artificial Sequence
  Description of Artificial Sequence: Synthetic oligonucleotide
  Target: ATXN1; (+) strand; PAM type: NRG; PAM sequence: CGG
ttaaaacatctcaacagcta

SEQ ID NO: 147312 - DNA, 20 bp, Artificial Sequence
  Description of Artificial Sequence: Synthetic oligonucleotide
  Target: ATXN1; (+) strand; PAM type: NRG; PAM sequence: CAG
caacagctacggcacacatg

SEQ ID NO: 147313 - DNA, 20 bp, Artificial Sequence
  Description of Artificial Sequence: Synthetic oligonucleotide
  Target: ATXN1; (+) strand; PAM type: NRG; PAM sequence: AAG
cggcacacatgcagtcatta

SEQ ID NO: 147314 - DNA, 20 bp, Artificial Sequence
  Description of Artificial Sequence: Synthetic oligonucleotide
  Target: ATXN1; (+) strand; PAM type: NRG; PAM sequence: CAG
tgcagtcattaaagactgtt

SEQ ID NO: 147315 - DNA, 20 bp, Artificial Sequence
  Description of Artificial Sequence: Synthetic oligonucleotide
  Target: ATXN1; (+) strand; PAM type: NRG; PAM sequence: TAG
attaaagactgttcagcata

SEQ ID NO: 147316 - DNA, 20 bp, Artificial Sequence
  Description of Artificial Sequence: Synthetic oligonucleotide
  Target: ATXN1; (+) strand; PAM type: NRG; PAM sequence: CAG
aagactgttcagcatataga

SEQ ID NO: 147317 - DNA, 20 bp, Artificial Sequence
  Description of Artificial Sequence: Synthetic oligonucleotide
  Target: ATXN1; (+) strand; PAM type: NRG; PAM sequence: CAG
atatagacagataatttcca

SEQ ID NO: 147318 - DNA, 20 bp, Artificial Sequence
  Description of Artificial Sequence: Synthetic oligonucleotide
  Target: ATXN1; (+) strand; PAM type: NRG; PAM sequence: TGG
cagataatttccacagtgta

SEQ ID NO: 147319 - DNA, 20 bp, Artificial Sequence
  Description of Artificial Sequence: Synthetic oligonucleotide
  Target: ATXN1; (+) strand; PAM type: NRG; PAM sequence: AAG
atttccacagtgtatggttt

SEQ ID NO: 147320 - DNA, 20 bp, Artificial Sequence
  Description of Artificial Sequence: Synthetic oligonucleotide
  Target: ATXN1; (+) strand; PAM type: NRG; PAM sequence: AAG
tccacagtgtatggtttaag

SEQ ID NO: 147321 - DNA, 20 bp, Artificial Sequence
  Description of Artificial Sequence: Synthetic oligonucleotide
  Target: ATXN1; (+) strand; PAM type: NRG; PAM sequence: CAG
gtatggtttaagaagttaaa

SEQ ID NO: 147322 - DNA, 20 bp, Artificial Sequence
  Description of Artificial Sequence: Synthetic oligonucleotide
  Target: ATXN1; (+) strand; PAM type: NRG; PAM sequence: AAG
ggtttaagaagttaaacaga

SEQ ID NO: 147323 - DNA, 20 bp, Artificial Sequence
  Description of Artificial Sequence: Synthetic oligonucleotide
  Target: ATXN1; (+) strand; PAM type: NRG; PAM sequence: CAG
gaagttaaacagaaagttaa

SEQ ID NO: 147324 - DNA, 20 bp, Artificial Sequence
  Description of Artificial Sequence: Synthetic oligonucleotide
  Target: ATXN1; (+) strand; PAM type: NRG; PAM sequence: GAG
agttaaacagaaagttaaca

SEQ ID NO: 147325 - DNA, 20 bp, Artificial Sequence
  Description of Artificial Sequence: Synthetic oligonucleotide
  Target: ATXN1; (+) strand; PAM type: NRG; PAM sequence: AAG
taacagagaaactgttcttg

SEQ ID NO: 147326 - DNA, 20 bp, Artificial Sequence
  Description of Artificial Sequence: Synthetic oligonucleotide
  Target: ATXN1; (+) strand; PAM type: NRG; PAM sequence: GAG
agaaactgttcttgaagtat

SEQ ID NO: 147327 - DNA, 20 bp, Artificial Sequence
  Description of Artificial Sequence: Synthetic oligonucleotide
  Target: ATXN1; (+) strand; PAM type: NRG; PAM sequence: AAG
cttgaagtatgagaatgatt

SEQ ID NO: 147328 - DNA, 20 bp, Artificial Sequence
  Description of Artificial Sequence: Synthetic oligonucleotide
  Target: ATXN1; (+) strand; PAM type: NRG; PAM sequence: TGG
gaagtatgagaatgattaag

SEQ ID NO: 147329 - DNA, 20 bp, Artificial Sequence
  Description of Artificial Sequence: Synthetic oligonucleotide
  Target: ATXN1; (+) strand; PAM type: NRG; PAM sequence: AAG
agtggaaatgttaaattttc

SEQ ID NO: 147330 - DNA, 20 bp, Artificial Sequence
  Description of Artificial Sequence: Synthetic oligonucleotide
  Target: ATXN1; (+) strand; PAM type: NRG; PAM sequence: AGG
gtggaaatgttaaattttca

SEQ ID NO: 147331 - DNA, 20 bp, Artificial Sequence
  Description of Artificial Sequence: Synthetic oligonucleotide
  Target: ATXN1; (+) strand; PAM type: NRG; PAM sequence: AAG
aatgttaaattttcaaggca

SEQ ID NO: 147332 - DNA, 20 bp, Artificial Sequence
  Description of Artificial Sequence: Synthetic oligonucleotide
  Target: ATXN1; (+) strand; PAM type: NRG; PAM sequence: AAG
ttaaaaaaaaaaaaaaaaaa

SEQ ID NO: 147333 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaagatcttcactg

SEQ ID NO: 147334 - DNA, 20 bp, Artificial Sequence
  Description of Artificial Sequence: Synthetic oligonucleotide
  Target: ATXN1; (+) strand; PAM type: NRG; PAM sequence: AAG
agatcttcactgaagctaaa

SEQ ID NO: 147335 - DNA, 20 bp, Artificial Sequence
  Description of Artificial Sequence: Synthetic oligonucleotide
  Target: ATXN1; (+) strand; PAM type: NRG; PAM sequence: AAG
ctaaaaagacatgaccaatg

SEQ ID NO: 147336 - DNA, 20 bp, Artificial Sequence
  Description of Artificial Sequence: Synthetic oligonucleotide
  Target: ATXN1; (+) strand; PAM type: NRG; PAM sequence: AGG
taaaaagacatgaccaatga

SEQ ID NO: 147337 - DNA, 20 bp, Artificial Sequence
  Description of Artificial Sequence: Synthetic oligonucleotide
  Target: ATXN1; (+) strand; PAM type: NRG; PAM sequence: AAG
agacatgaccaatgaaggaa

SEQ ID NO: 147338 - DNA, 20 bp, Artificial Sequence
  Description of Artificial Sequence: Synthetic oligonucleotide
  Target: ATXN1; (+) strand; PAM type: NRG; PAM sequence: TAG
atgaaggaaaagcattaaat

SEQ ID NO: 147339 - DNA, 20 bp, Artificial Sequence
  Description of Artificial Sequence: Synthetic oligonucleotide
  Target: ATXN1; (+) strand; PAM type: NRG; PAM sequence: AGG
tgaaggaaaagcattaaatt

SEQ ID NO: 147340 - DNA, 20 bp, Artificial Sequence
  Description of Artificial Sequence: Synthetic oligonucleotide
  Target: ATXN1; (+) strand; PAM type: NRG; PAM sequence: GAG
aaggaaaagcattaaattag

SEQ ID NO: 147341 - DNA, 20 bp, Artificial Sequence
  Description of Artificial Sequence: Synthetic oligonucleotide
  Target: ATXN1; (+) strand; PAM type: NRG; PAM sequence: TGG
aaagcattaaattaggagtc

SEQ ID NO: 147342 - DNA, 20 bp, Artificial Sequence
  Description of Artificial Sequence: Synthetic oligonucleotide
  Target: ATXN1; (+) strand; PAM type: NRG; PAM sequence: GAG
agcattaaattaggagtctg

SEQ ID NO: 147343 - DNA, 20 bp, Artificial Sequence
  Description of Artificial Sequence: Synthetic oligonucleotide
  Target: ATXN1; (+) strand; PAM type: NRG; PAM sequence: TGG
taaattaggagtctggagtc

SEQ ID NO: 147344 - DNA, 20 bp, Artificial Sequence
  Description of Artificial Sequence: Synthetic oligonucleotide
  Target: ATXN1; (+) strand; PAM type: NRG; PAM sequence: CAG
ggagtctggagtctggtttt

SEQ ID NO: 147345 - DNA, 20 bp, Artificial Sequence
  Description of Artificial Sequence: Synthetic oligonucleotide
  Target: ATXN1; (+) strand; PAM type: NRG; PAM sequence: CAG
tggagtctggttttcagcct

SEQ ID NO: 147346 - DNA, 20 bp, Artificial Sequence
  Description of Artificial Sequence: Synthetic oligonucleotide
  Target: ATXN1; (+) strand; PAM type: NRG; PAM sequence: CAG
agcctcagccatcaaacaaa

SEQ ID NO: 147347 - DNA, 20 bp, Artificial Sequence
  Description of Artificial Sequence: Synthetic oligonucleotide
  Target: ATXN1; (+) strand; PAM type: NRG; PAM sequence: AGG
gcctcagccatcaaacaaac

SEQ ID NO: 147348 - DNA, 20 bp, Artificial Sequence
  Description of Artificial Sequence: Synthetic oligonucleotide
  Target: ATXN1; (+) strand; PAM type: NRG; PAM sequence: TAG
aacaaacaggctgtgtgttg

SEQ ID NO: 147349 - DNA, 20 bp, Artificial Sequence
  Description of Artificial Sequence: Synthetic oligonucleotide
  Target: ATXN1; (+) strand; PAM type: NRG; PAM sequence: AGG
acaaacaggctgtgtgttgt

SEQ ID NO: 147350 - DNA, 20 bp, Artificial Sequence
  Description of Artificial Sequence: Synthetic oligonucleotide
  Target: ATXN1; (+) strand; PAM type: NRG; PAM sequence: GAG
aaacaggctgtgtgttgtag

SEQ ID NO: 147351 - DNA, 20 bp, Artificial Sequence
  Description of Artificial Sequence: Synthetic oligonucleotide
  Target: ATXN1; (+) strand; PAM type: NRG; PAM sequence: TGG
caggctgtgtgttgtaggag

SEQ ID NO: 147352 - DNA, 20 bp, Artificial Sequence
  Description of Artificial Sequence: Synthetic oligonucleotide
  Target: ATXN1; (+) strand; PAM type: NRG; PAM sequence: AAG
agtggtcatttaaccgcact

SEQ ID NO: 147353 - DNA, 20 bp, Artificial Sequence
  Description of Artificial Sequence: Synthetic oligonucleotide
  Target: ATXN1; (+) strand; PAM type: NRG; PAM sequence: TAG
aaatgtttcctctgtaaaat

SEQ ID NO: 147354 - DNA, 20 bp, Artificial Sequence
  Description of Artificial Sequence: Synthetic oligonucleotide
  Target: ATXN1; (+) strand; PAM type: NRG; PAM sequence: TAG
cctctgtaaaattagaacat

SEQ ID NO: 147355 - DNA, 20 bp, Artificial Sequence
  Description of Artificial Sequence: Synthetic oligonucleotide
  Target: ATXN1; (+) strand; PAM type: NRG; PAM sequence: AGG
ctctgtaaaattagaacatt

SEQ ID NO: 147356 - DNA, 20 bp, Artificial Sequence
  Description of Artificial Sequence: Synthetic oligonucleotide
  Target: ATXN1; (+) strand; PAM type: NRG; PAM sequence: AAG
tagaacattaggttcaatta

SEQ ID NO: 147357 - DNA, 20 bp, Artificial Sequence
  Description of Artificial Sequence: Synthetic oligonucleotide
  Target: ATXN1; (+) strand; PAM type: NRG; PAM sequence: AAG
aggttcaattaaagccattt

SEQ ID NO: 147358 - DNA, 20 bp, Artificial Sequence
  Description of Artificial Sequence: Synthetic oligonucleotide
  Target: ATXN1; (+) strand; PAM type: NRG; PAM sequence: AAG
taatacctgctttttcaact

SEQ ID NO: 147359 - DNA, 20 bp, Artificial Sequence
  Description of Artificial Sequence: Synthetic oligonucleotide
  Target: ATXN1; (+) strand; PAM type: NRG; PAM sequence: AAG
caactaagctaattttttaa

SEQ ID NO: 147360 - DNA, 20 bp, Artificial Sequence
  Description of Artificial Sequence: Synthetic oligonucleotide
  Target: ATXN1; (+) strand; PAM type: NRG; PAM sequence: AGG
aactaagctaattttttaaa

SEQ ID NO: 147361 - DNA, 20 bp, Artificial Sequence
  Description of Artificial Sequence: Synthetic oligonucleotide
  Target: ATXN1; (+) strand; PAM type: NRG; PAM sequence: CAG
taagctaattttttaaaagg

SEQ ID NO: 147362 - DNA, 20 bp, Artificial Sequence
  Description of Artificial Sequence: Synthetic oligonucleotide
  Target: ATXN1; (+) strand; PAM type: NRG; PAM sequence: CAG
taaaaggcagaaaatctaac

SEQ ID NO: 147363 - DNA, 20 bp, Artificial Sequence
  Description of Artificial Sequence: Synthetic oligonucleotide
  Target: ATXN1; (+) strand; PAM type: NRG; PAM sequence: AAG
ggcagaaaatctaaccagaa

SEQ ID NO: 147364 - DNA, 20 bp, Artificial Sequence
  Description of Artificial Sequence: Synthetic oligonucleotide
  Target: ATXN1; (+) strand; PAM type: NRG; PAM sequence: CAG
tgtacaacataaactttgtc

SEQ ID NO: 147365 - DNA, 20 bp, Artificial Sequence
  Description of Artificial Sequence: Synthetic oligonucleotide
  Target: ATXN1; (+) strand; PAM type: NRG; PAM sequence: CAG
cataaactttgtccagaaat

SEQ ID NO: 147366 - DNA, 20 bp, Artificial Sequence
  Description of Artificial Sequence: Synthetic oligonucleotide
  Target: ATXN1; (+) strand; PAM type: NRG; PAM sequence: AAG
aatcagtatctgctcttcca

SEQ ID NO: 147367 - DNA, 20 bp, Artificial Sequence
  Description of Artificial Sequence: Synthetic oligonucleotide
  Target: ATXN1; (+) strand; PAM type: NRG; PAM sequence: TAG
tctgctcttccaaagaaaaa

SEQ ID NO: 147368 - DNA, 20 bp, Artificial Sequence
  Description of Artificial Sequence: Synthetic oligonucleotide
  Target: ATXN1; (+) strand; PAM type: NRG; PAM sequence: CAG
gccttttgttttctattgtt

SEQ ID NO: 147369 - DNA, 20 bp, Artificial Sequence
  Description of Artificial Sequence: Synthetic oligonucleotide
  Target: ATXN1; (+) strand; PAM type: NRG; PAM sequence: CAG
gttttctattgttcagtgta

SEQ ID NO: 147370 - DNA, 20 bp, Artificial Sequence
  Description of Artificial Sequence: Synthetic oligonucleotide
  Target: ATXN1; (+) strand; PAM type: NRG; PAM sequence: AAG
tcagtgtacagcttaccact

SEQ ID NO: 147371 - DNA, 20 bp, Artificial Sequence
  Description of Artificial Sequence: Synthetic oligonucleotide
  Target: ATXN1; (+) strand; PAM type: NRG; PAM sequence: AAG
tgtacagcttaccactaagc

SEQ ID NO: 147372 - DNA, 20 bp, Artificial Sequence
  Description of Artificial Sequence: Synthetic oligonucleotide
  Target: ATXN1; (+) strand; PAM type: NRG; PAM sequence: AGG
gtacagcttaccactaagca

SEQ ID NO: 147373 - DNA, 20 bp, Artificial Sequence
  Description of Artificial Sequence: Synthetic oligonucleotide
  Target: ATXN1; (+) strand; PAM type: NRG; PAM sequence: TGG
cactaagcaaggaataaatg

SEQ ID NO: 147374 - DNA, 20 bp, Artificial Sequence
  Description of Artificial Sequence: Synthetic oligonucleotide
  Target: ATXN1; (+) strand; PAM type: NRG; PAM sequence: GGG
actaagcaaggaataaatgt

SEQ ID NO: 147375 - DNA, 20 bp, Artificial Sequence
  Description of Artificial Sequence: Synthetic oligonucleotide
  Target: ATXN1; (+) strand; PAM type: NRG; PAM sequence: GGG
ctaagcaaggaataaatgtg

SEQ ID NO: 147376 - DNA, 20 bp, Artificial Sequence
  Description of Artificial Sequence: Synthetic oligonucleotide
  Target: ATXN1; (+) strand; PAM type: NRG; PAM sequence: CAG
aaggaataaatgtggggcta

SEQ ID NO: 147377 - DNA, 20 bp, Artificial Sequence
  Description of Artificial Sequence: Synthetic oligonucleotide
  Target: ATXN1; (+) strand; PAM type: NRG; PAM sequence: CAG
tacagttcatctgtatgtgc

SEQ ID NO: 147378 - DNA, 20 bp, Artificial Sequence
  Description of Artificial Sequence: Synthetic oligonucleotide
  Target: ATXN1; (+) strand; PAM type: NRG; PAM sequence: AAG
tgtgccagcatgttactttc

SEQ ID NO: 147379 - DNA, 20 bp, Artificial Sequence
  Description of Artificial Sequence: Synthetic oligonucleotide
  Target: ATXN1; (+) strand; PAM type: NRG; PAM sequence: AGG
gtgccagcatgttactttca

SEQ ID NO: 147380 - DNA, 20 bp, Artificial Sequence
  Description of Artificial Sequence: Synthetic oligonucleotide
  Target: ATXN1; (+) strand; PAM type: NRG; PAM sequence: GGG
tgccagcatgttactttcaa

SEQ ID NO: 147381 - DNA, 20 bp, Artificial Sequence
  Description of Artificial Sequence: Synthetic oligonucleotide
  Target: ATXN1; (+) strand; PAM type: NRG; PAM sequence: CAG
gcatgttactttcaagggtt

SEQ ID NO: 147382 - DNA, 20 bp, Artificial Sequence
  Description of Artificial Sequence: Synthetic oligonucleotide
  Target: ATXN1; (+) strand; PAM type: NRG; PAM sequence: TAG
tgttactttcaagggttcag

SEQ ID NO: 147383 - DNA, 20 bp, Artificial Sequence
  Description of Artificial Sequence: Synthetic oligonucleotide
  Target: ATXN1; (+) strand; PAM type: NRG; PAM sequence: CGG
tcaagggttcagtagctcca

SEQ ID NO: 147384 - DNA, 20 bp, Artificial Sequence
  Description of Artificial Sequence: Synthetic oligonucleotide
  Target: ATXN1; (+) strand; PAM type: NRG; PAM sequence: CAG
agggttcagtagctccacgg

SEQ ID NO: 147385 - DNA, 20 bp, Artificial Sequence
  Description of Artificial Sequence: Synthetic oligonucleotide
  Target: ATXN1; (+) strand; PAM type: NRG; PAM sequence: AAG
ttcagtagctccacggcaga

SEQ ID NO: 147386 - DNA, 20 bp, Artificial Sequence
  Description of Artificial Sequence: Synthetic oligonucleotide
  Target: ATXN1; (+) strand; PAM type: NRG; PAM sequence: CAG
catttcaaaacctacaaaaa

SEQ ID NO: 147387 - DNA, 20 bp, Artificial Sequence
  Description of Artificial Sequence: Synthetic oligonucleotide
  Target: ATXN1; (+) strand; PAM type: NRG; PAM sequence: AAG
acaaaaacagctccaaaatt

SEQ ID NO: 147388 - DNA, 20 bp, Artificial Sequence
  Description of Artificial Sequence: Synthetic oligonucleotide
  Target: ATXN1; (+) strand; PAM type: NRG; PAM sequence: CAG
aaacagctccaaaattaagc

SEQ ID NO: 147389 - DNA, 20 bp, Artificial Sequence
  Description of Artificial Sequence: Synthetic oligonucleotide
  Target: ATXN1; (+) strand; PAM type: NRG; PAM sequence: TAG
tgtcatccatctgaacctgt

SEQ ID NO: 147390 - DNA, 20 bp, Artificial Sequence
  Description of Artificial Sequence: Synthetic oligonucleotide
  Target: ATXN1; (+) strand; PAM type: NRG; PAM sequence: AAG
ctgaacctgttagaaatctc

SEQ ID NO: 147391 - DNA, 20 bp, Artificial Sequence
  Description of Artificial Sequence: Synthetic oligonucleotide
  Target: ATXN1; (+) strand; PAM type: NRG; PAM sequence: TAG
tagaaatctcaagctcgtca

SEQ ID NO: 147392 - DNA, 20 bp, Artificial Sequence
  Description of Artificial Sequence: Synthetic oligonucleotide
  Target: ATXN1; (+) strand; PAM type: NRG; PAM sequence: GAG
cattcaatgttttacaaatt

SEQ ID NO: 147393 - DNA, 20 bp, Artificial Sequence
  Description of Artificial Sequence: Synthetic oligonucleotide
  Target: ATXN1; (+) strand; PAM type: NRG; PAM sequence: AAG
aatgacaaaaataaaaataa

SEQ ID NO: 147394 - DNA, 20 bp, Artificial Sequence
  Description of Artificial Sequence: Synthetic oligonucleotide
  Target: ATXN1; (+) strand; PAM type: NRG; PAM sequence: AGG
atgacaaaaataaaaataaa

SEQ ID NO: 147395 - DNA, 20 bp, Artificial Sequence
  Description of Artificial Sequence: Synthetic oligonucleotide
  Target: ATXN1; (+) strand; PAM type: NRG; PAM sequence: AAG
aaaaataaaaataaaaggta

SEQ ID NO: 147396 - DNA, 20 bp, Artificial Sequence
  Description of Artificial Sequence: Synthetic oligonucleotide
  Target: ATXN1; (+) strand; PAM type: NRG; PAM sequence: GAG
aaataaaaataaaaggtaaa

SEQ ID NO: 147397 - DNA, 20 bp, Artificial Sequence
  Description of Artificial Sequence: Synthetic oligonucleotide
  Target: ATXN1; (+) strand; PAM type: NRG; PAM sequence: AAG
aaaaggtaaagagaacactg

SEQ ID NO: 147398 - DNA, 20 bp, Artificial Sequence
  Description of Artificial Sequence: Synthetic oligonucleotide
  Target: ATXN1; (+) strand; PAM type: NRG; PAM sequence: AGG
aaaggtaaagagaacactga

SEQ ID NO: 147399 - DNA, 20 bp, Artificial Sequence
  Description of Artificial Sequence: Synthetic oligonucleotide
  Target: ATXN1; (+) strand; PAM type: NRG; PAM sequence: TAG
gtaaagagaacactgaaggt

SEQ ID NO: 147400 - DNA, 20 bp, Artificial Sequence
  Description of Artificial Sequence: Synthetic oligonucleotide
  Target: ATXN1; (+) strand; PAM type: NRG; PAM sequence: AGG
taaagagaacactgaaggtt

SEQ ID NO: 147401 - DNA, 20 bp, Artificial Sequence
  Description of Artificial Sequence: Synthetic oligonucleotide
  Target: ATXN1; (+) strand; PAM type: NRG; PAM sequence: GAG
aagagaacactgaaggttag

SEQ ID NO: 147402 - DNA, 20 bp, Artificial Sequence
  Description of Artificial Sequence: Synthetic oligonucleotide
  Target: ATXN1; (+) strand; PAM type: NRG; PAM sequence: TAG
agaacactgaaggttaggag

SEQ ID NO: 147403 - DNA, 20 bp, Artificial Sequence
  Description of Artificial Sequence: Synthetic oligonucleotide
  Target: ATXN1; (+) strand; PAM type: NRG; PAM sequence: AGG
gaacactgaaggttaggagt

SEQ ID NO: 147404 - DNA, 20 bp, Artificial Sequence
  Description of Artificial Sequence: Synthetic oligonucleotide
  Target: ATXN1; (+) strand; PAM type: NRG; PAM sequence: GAG
actgaaggttaggagtaggt

SEQ ID NO: 147405 - DNA, 20 bp, Artificial Sequence
  Description of Artificial Sequence: Synthetic oligonucleotide
  Target: ATXN1; (+) strand; PAM type: NRG; PAM sequence: AGG
ctgaaggttaggagtaggtg

SEQ ID NO: 147406 - DNA, 20 bp, Artificial Sequence
  Description of Artificial Sequence: Synthetic oligonucleotide
  Target: ATXN1; (+) strand; PAM type: NRG; PAM sequence: TGG
aggttaggagtaggtgagga

SEQ ID NO: 147407 - DNA, 20 bp, Artificial Sequence
  Description of Artificial Sequence: Synthetic oligonucleotide
  Target: ATXN1; (+) strand; PAM type: NRG; PAM sequence: GGG
ggttaggagtaggtgaggat

SEQ ID NO: 147408 - DNA, 20 bp, Artificial Sequence
  Description of Artificial Sequence: Synthetic oligonucleotide
  Target: ATXN1; (+) strand; PAM type: NRG; PAM sequence: AAG
ggagtaggtgaggatgggaa

SEQ ID NO: 147409 - DNA, 20 bp, Artificial Sequence
  Description of Artificial Sequence: Synthetic oligonucleotide
  Target: ATXN1; (+) strand; PAM type: NRG; PAM sequence: AGG
gagtaggtgaggatgggaaa

SEQ ID NO: 147410 - DNA, 20 bp, Artificial Sequence
  Description of Artificial Sequence: Synthetic oligonucleotide
  Target: ATXN1; (+) strand; PAM type: NRG; PAM sequence: GGG
agtaggtgaggatgggaaaa

SEQ ID NO: 147411 - DNA, 20 bp, Artificial Sequence
  Description of Artificial Sequence: Synthetic oligonucleotide
  Target: ATXN1; (+) strand; PAM type: NRG; PAM sequence: AAG
aggtgaggatgggaaaaggg

SEQ ID NO: 147412 - DNA, 20 bp, Artificial Sequence
  Description of Artificial Sequence: Synthetic oligonucleotide
  Target: ATXN1; (+) strand; PAM type: NRG; PAM sequence: CGG
aagggaagaacaaacatgtc

SEQ ID NO: 147413 - DNA, 20 bp, Artificial Sequence
  Description of Artificial Sequence: Synthetic oligonucleotide
  Target: ATXN1; (+) strand; PAM type: NRG; PAM sequence: CAG
caaacatgtccggctgaatt

SEQ ID NO: 147414 - DNA, 20 bp, Artificial Sequence
  Description of Artificial Sequence: Synthetic oligonucleotide
  Target: ATXN1; (+) strand; PAM type: NRG; PAM sequence: GAG
aacatgtccggctgaattca

SEQ ID NO: 147415 - DNA, 20 bp, Artificial Sequence
  Description of Artificial Sequence: Synthetic oligonucleotide
  Target: ATXN1; (+) strand; PAM type: NRG; PAM sequence: TAG
tgtccggctgaattcagagc

SEQ ID NO: 147416 - DNA, 20 bp, Artificial Sequence
  Description of Artificial Sequence: Synthetic oligonucleotide
  Target: ATXN1; (+) strand; PAM type: NRG; PAM sequence: AAG
tgaattcagagctagattcc

SEQ ID NO: 147417 - DNA, 20 bp, Artificial Sequence
  Description of Artificial Sequence: Synthetic oligonucleotide
  Target: ATXN1; (+) strand; PAM type: NRG; PAM sequence: TGG
attcagagctagattccaag

SEQ ID NO: 147418 - DNA, 20 bp, Artificial Sequence
  Description of Artificial Sequence: Synthetic oligonucleotide
  Target: ATXN1; (+) strand; PAM type: NRG; PAM sequence: GGG
ttcagagctagattccaagt

SEQ ID NO: 147419 - DNA, 20 bp, Artificial Sequence
  Description of Artificial Sequence: Synthetic oligonucleotide
  Target: ATXN1; (+) strand; PAM type: NRG; PAM sequence: CAG
gctagattccaagtgggttt

SEQ ID NO: 147420 - DNA, 20 bp, Artificial Sequence
  Description of Artificial Sequence: Synthetic oligonucleotide
  Target: ATXN1; (+) strand; PAM type: NRG; PAM sequence: AGG
ctagattccaagtgggtttc

SEQ ID NO: 147421 - DNA, 20 bp, Artificial Sequence
  Description of Artificial Sequence: Synthetic oligonucleotide
  Target: ATXN1; (+) strand; PAM type: NRG; PAM sequence: GGG
tagattccaagtgggtttca

SEQ ID NO: 147422 - DNA, 20 bp, Artificial Sequence
  Description of Artificial Sequence: Synthetic oligonucleotide
  Target: ATXN1; (+) strand; PAM type: NRG; PAM sequence: GAG
gattccaagtgggtttcagg

SEQ ID NO: 147423 - DNA, 20 bp, Artificial Sequence
  Description of Artificial Sequence: Synthetic oligonucleotide
  Target: ATXN1; (+) strand; PAM type: NRG; PAM sequence: AGG
attccaagtgggtttcaggg

SEQ ID NO: 147424 - DNA, 20 bp, Artificial Sequence
  Description of Artificial Sequence: Synthetic oligonucleotide
  Target: ATXN1; (+) strand; PAM type: NRG; PAM sequence: AAG
gtgggtttcagggaggactg

SEQ ID NO: 147425 - DNA, 20 bp, Artificial Sequence
  Description of Artificial Sequence: Synthetic oligonucleotide
  Target: ATXN1; (+) strand; PAM type: NRG; PAM sequence: CAG
gtttcagggaggactgaagt

SEQ ID NO: 147426 - DNA, 20 bp, Artificial Sequence
  Description of Artificial Sequence: Synthetic oligonucleotide
  Target: ATXN1; (+) strand; PAM type: NRG; PAM sequence: GAG
ttcagggaggactgaagtca

SEQ ID NO: 147427 - DNA, 20 bp, Artificial Sequence
  Description of Artificial Sequence: Synthetic oligonucleotide
  Target: ATXN1; (+) strand; PAM type: NRG; PAM sequence: CAG
tttcaccatctgtttattca

SEQ ID NO: 147428 - DNA, 20 bp, Artificial Sequence
  Description of Artificial Sequence: Synthetic oligonucleotide
  Target: ATXN1; (+) strand; PAM type: NRG; PAM sequence: CAG
cagctttacctttgactcat

SEQ ID NO: 147429 - DNA, 20 bp, Artificial Sequence
  Description of Artificial Sequence: Synthetic oligonucleotide
  Target: ATXN1; (+) strand; PAM type: NRG; PAM sequence: GAG
gctttacctttgactcatca

SEQ ID NO: 147430 - DNA, 20 bp, Artificial Sequence
  Description of Artificial Sequence: Synthetic oligonucleotide
  Target: ATXN1; (+) strand; PAM type: NRG; PAM sequence: GAG
tacctttgactcatcagagt

SEQ ID NO: 147431 - DNA, 20 bp, Artificial Sequence
  Description of Artificial Sequence: Synthetic oligonucleotide
  Target: ATXN1; (+) strand; PAM type: NRG; PAM sequence: AGG
acctttgactcatcagagtg

SEQ ID NO: 147432 - DNA, 20 bp, Artificial Sequence
  Description of Artificial Sequence: Synthetic oligonucleotide
  Target: ATXN1; (+) strand; PAM type: NRG; PAM sequence: TGG
tgaggtctgaaaactgtttg

SEQ ID NO: 147433 - DNA, 20 bp, Artificial Sequence
  Description of Artificial Sequence: Synthetic oligonucleotide
  Target: ATXN1; (+) strand; PAM type: NRG; PAM sequence: GGG
gaggtctgaaaactgtttgt

SEQ ID NO: 147434 - DNA, 20 bp, Artificial Sequence
  Description of Artificial Sequence: Synthetic oligonucleotide
  Target: ATXN1; (+) strand; PAM type: NRG; PAM sequence: TAG
tgaaaactgtttgtgggtca

SEQ ID NO: 147435 - DNA, 20 bp, Artificial Sequence
  Description of Artificial Sequence: Synthetic oligonucleotide
  Target: ATXN1; (+) strand; PAM type: NRG; PAM sequence: AAG
tgtttgtgggtcatagtaaa

SEQ ID NO: 147436 - DNA, 20 bp, Artificial Sequence
  Description of Artificial Sequence: Synthetic oligonucleotide
  Target: ATXN1; (+) strand; PAM type: NRG; PAM sequence: GAG
tttgtgggtcatagtaaaaa

SEQ ID NO: 147437 - DNA, 20 bp, Artificial Sequence
  Description of Artificial Sequence: Synthetic oligonucleotide
  Target: ATXN1; (+) strand; PAM type: NRG; PAM sequence: AAG
tcatagtaaaaagagttctg

SEQ ID NO: 147438 - DNA, 20 bp, Artificial Sequence
  Description of Artificial Sequence: Synthetic oligonucleotide
  Target: ATXN1; (+) strand; PAM type: NRG; PAM sequence: AGG
catagtaaaaagagttctga

SEQ ID NO: 147439 - DNA, 20 bp, Artificial Sequence
  Description of Artificial Sequence: Synthetic oligonucleotide
  Target: ATXN1; (+) strand; PAM type: NRG; PAM sequence: CAG
ctgaaggacaatgtgacttc

SEQ ID NO: 147440 - DNA, 20 bp, Artificial Sequence
  Description of Artificial Sequence: Synthetic oligonucleotide
  Target: ATXN1; (+) strand; PAM type: NRG; PAM sequence: AGG
tgaaggacaatgtgacttcc

SEQ ID NO: 147441 - DNA, 20 bp, Artificial Sequence
  Description of Artificial Sequence: Synthetic oligonucleotide
  Target: ATXN1; (+) strand; PAM type: NRG; PAM sequence: GGG
gaaggacaatgtgacttcca

SEQ ID NO: 147442 - DNA, 20 bp, Artificial Sequence
  Description of Artificial Sequence: Synthetic oligonucleotide
  Target: ATXN1; (+) strand; PAM type: NRG; PAM sequence: GAG
aggacaatgtgacttccagg

SEQ ID NO: 147443 - DNA, 20 bp, Artificial Sequence
  Description of Artificial Sequence: Synthetic oligonucleotide
  Target: ATXN1; (+) strand; PAM type: NRG; PAM sequence: GAG
gacaatgtgacttccaggga

SEQ ID NO: 147444 - DNA, 20 bp, Artificial Sequence
  Description of Artificial Sequence: Synthetic oligonucleotide
  Target: ATXN1; (+) strand; PAM type: NRG; PAM sequence: AGG
acaatgtgacttccagggag

SEQ ID NO: 147445 - DNA, 20 bp, Artificial Sequence
  Description of Artificial Sequence: Synthetic oligonucleotide
  Target: ATXN1; (+) strand; PAM type: NRG; PAM sequence: AAG
tgtgacttccagggagaggt

SEQ ID NO: 147446 - DNA, 20 bp, Artificial Sequence
  Description of Artificial Sequence: Synthetic oligonucleotide
  Target: ATXN1; (+) strand; PAM type: NRG; PAM sequence: GAG
taagccaacctacactgcat

SEQ ID NO: 147447 - DNA, 20 bp, Artificial Sequence
  Description of Artificial Sequence: Synthetic oligonucleotide
  Target: ATXN1; (+) strand; PAM type: NRG; PAM sequence: CAG
ccaacctacactgcatgagc

SEQ ID NO: 147448 - DNA, 20 bp, Artificial Sequence
  Description of Artificial Sequence: Synthetic oligonucleotide
  Target: ATXN1; (+) strand; PAM type: NRG; PAM sequence: CAG
acctacactgcatgagccag

SEQ ID NO: 147449 - DNA, 20 bp, Artificial Sequence
  Description of Artificial Sequence: Synthetic oligonucleotide
  Target: ATXN1; (+) strand; PAM type: NRG; PAM sequence: GAG
ctacactgcatgagccagca

SEQ ID NO: 147450 - DNA, 20 bp, Artificial Sequence
  Description of Artificial Sequence: Synthetic oligonucleotide
  Target: ATXN1; (+) strand; PAM type: NRG; PAM sequence: CAG
cactgcatgagccagcagag

SEQ ID NO: 147451 - DNA, 20 bp, Artificial Sequence
  Description of Artificial Sequence: Synthetic oligonucleotide
  Target: ATXN1; (+) strand; PAM type: NRG; PAM sequence: AAG
gccagcagagcagacactga

SEQ ID NO: 147452 - DNA, 20 bp, Artificial Sequence
  Description of Artificial Sequence: Synthetic oligonucleotide
  Target: ATXN1; (+) strand; PAM type: NRG; PAM sequence: AGG
ccagcagagcagacactgaa

SEQ ID NO: 147453 - DNA, 20 bp, Artificial Sequence
  Description of Artificial Sequence: Synthetic oligonucleotide
  Target: ATXN1; (+) strand; PAM type: NRG; PAM sequence: AAG
agcagacactgaaaggtgat

SEQ ID NO: 147454 - DNA, 20 bp, Artificial Sequence
  Description of Artificial Sequence: Synthetic oligonucleotide
  Target: ATXN1; (+) strand; PAM type: NRG; PAM sequence: AAG
agacactgaaaggtgataag

SEQ ID NO: 147455 - DNA, 20 bp, Artificial Sequence
  Description of Artificial Sequence: Synthetic oligonucleotide
  Target: ATXN1; (+) strand; PAM type: NRG; PAM sequence: AAG
tgaaaggtgataagaagaaa

SEQ ID NO: 147456 - DNA, 20 bp, Artificial Sequence
  Description of Artificial Sequence: Synthetic oligonucleotide
  Target: ATXN1; (+) strand; PAM type: NRG; PAM sequence: AAG
aaggtgataagaagaaaaag

SEQ ID NO: 147457 - DNA, 20 bp, Artificial Sequence
  Description of Artificial Sequence: Synthetic oligonucleotide
  Target: ATXN1; (+) strand; PAM type: NRG; PAM sequence: AAG
gcacttgtttttattaacgt

SEQ ID NO: 147458 - DNA, 20 bp, Artificial Sequence
  Description of Artificial Sequence: Synthetic oligonucleotide
  Target: ATXN1; (+) strand; PAM type: NRG; PAM sequence: CAG
taagacctcaccaacttcct

SEQ ID NO: 147459 - DNA, 20 bp, Artificial Sequence
  Description of Artificial Sequence: Synthetic oligonucleotide
  Target: ATXN1; (+) strand; PAM type: NRG; PAM sequence: CAG
gacttccccaaatgaaatgt

SEQ ID NO: 147460 - DNA, 20 bp, Artificial Sequence
  Description of Artificial Sequence: Synthetic oligonucleotide
  Target: ATXN1; (+) strand; PAM type: NRG; PAM sequence: GAG
tgtcagactcgcatgattct

SEQ ID NO: 147461 - DNA, 20 bp, Artificial Sequence
  Description of Artificial Sequence: Synthetic oligonucleotide
  Target: ATXN1; (+) strand; PAM type: NRG; PAM sequence: AAG
agactcgcatgattctgagt

SEQ ID NO: 147462 - DNA, 20 bp, Artificial Sequence
  Description of Artificial Sequence: Synthetic oligonucleotide
  Target: ATXN1; (+) strand; PAM type: NRG; PAM sequence: TAG
taagaatcaactgtgtccct

SEQ ID NO: 147463 - DNA, 20 bp, Artificial Sequence
  Description of Artificial Sequence: Synthetic oligonucleotide
  Target: ATXN1; (+) strand; PAM type: NRG; PAM sequence: AAG
gaatcaactgtgtcccttag

SEQ ID NO: 147464 - DNA, 20 bp, Artificial Sequence
  Description of Artificial Sequence: Synthetic oligonucleotide
  Target: ATXN1; (+) strand; PAM type: NRG; PAM sequence: CAG
gaagaaaaacatcccaaatt

SEQ ID NO: 147465 - DNA, 20 bp, Artificial Sequence
  Description of Artificial Sequence: Synthetic oligonucleotide
  Target: ATXN1; (+) strand; PAM type: NRG; PAM sequence: TGG
cccaaattcagtgataatcg

SEQ ID NO: 147466 - DNA, 20 bp, Artificial Sequence
  Description of Artificial Sequence: Synthetic oligonucleotide
  Target: ATXN1; (+) strand; PAM type: NRG; PAM sequence: GGG
ccaaattcagtgataatcgt

SEQ ID NO: 147467 - DNA, 20 bp, Artificial Sequence
  Description of Artificial Sequence: Synthetic oligonucleotide
  Target: ATXN1; (+) strand; PAM type: NRG; PAM sequence: TAG
ggccattctttttgaccaaa

SEQ ID NO: 147468 - DNA, 20 bp, Artificial Sequence
  Description of Artificial Sequence: Synthetic oligonucleotide
  Target: ATXN1; (+) strand; PAM type: NRG; PAM sequence: CAG
tttttttaatgtaaatttcc

SEQ ID NO: 147469 - DNA, 20 bp, Artificial Sequence
  Description of Artificial Sequence: Synthetic oligonucleotide
  Target: ATXN1; (+) strand; PAM type: NRG; PAM sequence: TAG
ttttaatgtaaatttcccag

SEQ ID NO: 147470 - DNA, 20 bp, Artificial Sequence
  Description of Artificial Sequence: Synthetic oligonucleotide
  Target: ATXN1; (+) strand; PAM type: NRG; PAM sequence: AGG
tttaatgtaaatttcccagt

SEQ ID NO: 147471 - DNA, 20 bp, Artificial Sequence
  Description of Artificial Sequence: Synthetic oligonucleotide
  Target: ATXN1; (+) strand; PAM type: NRG; PAM sequence: AAG
aatgtaaatttcccagtagg

SEQ ID NO: 147472 - DNA, 20 bp, Artificial Sequence
  Description of Artificial Sequence: Synthetic oligonucleotide
  Target: ATXN1; (+) strand; PAM type: NRG; PAM sequence: CAG
tttcccagtaggaagcaaca

SEQ ID NO: 147473 - DNA, 20 bp, Artificial Sequence
  Description of Artificial Sequence: Synthetic oligonucleotide
  Target: ATXN1; (+) strand; PAM type: NRG; PAM sequence: CAG
cagtaggaagcaacacagta

SEQ ID NO: 147474 - DNA, 20 bp, Artificial Sequence
  Description of Artificial Sequence: Synthetic oligonucleotide
  Target: ATXN1; (+) strand; PAM type: NRG; PAM sequence: GAG
gtaggaagcaacacagtaca

SEQ ID NO: 147475 - DNA, 20 bp, Artificial Sequence
  Description of Artificial Sequence: Synthetic oligonucleotide
  Target: ATXN1; (+) strand; PAM type: NRG; PAM sequence: CAG
aataaaattcttaatccgct

SEQ ID NO: 147476 - DNA, 20 bp, Artificial Sequence
  Description of Artificial Sequence: Synthetic oligonucleotide
  Target: ATXN1; (+) strand; PAM type: NRG; PAM sequence: AGG
ataaaattcttaatccgctc

SEQ ID NO: 147477 - DNA, 20 bp, Artificial Sequence
  Description of Artificial Sequence: Synthetic oligonucleotide
  Target: ATXN1; (+) strand; PAM type: NRG; PAM sequence: AAG
aaaatgatccgctgaatgaa

SEQ ID NO: 147478 - DNA, 20 bp, Artificial Sequence
  Description of Artificial Sequence: Synthetic oligonucleotide
  Target: ATXN1; (+) strand; PAM type: NRG; PAM sequence: AAG
gatccgctgaatgaaaagaa

SEQ ID NO: 147479 - DNA, 20 bp, Artificial Sequence
  Description of Artificial Sequence: Synthetic oligonucleotide
  Target: ATXN1; (+) strand; PAM type: NRG; PAM sequence: AAG
atgaaaagaaaagctattcc

SEQ ID NO: 147480 - DNA, 20 bp, Artificial Sequence
  Description of Artificial Sequence: Synthetic oligonucleotide
  Target: ATXN1; (+) strand; PAM type: NRG; PAM sequence: AAG
tcacaaaataaactattatt

SEQ ID NO: 147481 - DNA, 20 bp, Artificial Sequence
  Description of Artificial Sequence: Synthetic oligonucleotide
  Target: ATXN1; (+) strand; PAM type: NRG; PAM sequence: TGG
aataaactattattaagcca

SEQ ID NO: 147482 - DNA, 20 bp, Artificial Sequence
  Description of Artificial Sequence: Synthetic oligonucleotide
  Target: ATXN1; (+) strand; PAM type: NRG; PAM sequence: AAG
aaactattattaagccatgg

SEQ ID NO: 147483 - DNA, 20 bp, Artificial Sequence
  Description of Artificial Sequence: Synthetic oligonucleotide
  Target: ATXN1; (+) strand; PAM type: NRG; PAM sequence: CAG
tgtattctcactctcctttt

SEQ ID NO: 147484 - DNA, 20 bp, Artificial Sequence
  Description of Artificial Sequence: Synthetic oligonucleotide
  Target: ATXN1; (+) strand; PAM type: NRG; PAM sequence: TGG
acatttttatgaaacacatg

SEQ ID NO: 147485 - DNA, 20 bp, Artificial Sequence
  Description of Artificial Sequence: Synthetic oligonucleotide
  Target: ATXN1; (+) strand; PAM type: NRG; PAM sequence: TAG
tttttatgaaacacatgtgg

SEQ ID NO: 147486 - DNA, 20 bp, Artificial Sequence
  Description of Artificial Sequence: Synthetic oligonucleotide
  Target: ATXN1; (+) strand; PAM type: NRG; PAM sequence: AGG
ttttatgaaacacatgtggt

SEQ ID NO: 147487 - DNA, 20 bp, Artificial Sequence
  Description of Artificial Sequence: Synthetic oligonucleotide
  Target: ATXN1; (+) strand; PAM type: NRG; PAM sequence: CAG
tatgaaacacatgtggtagg

SEQ ID NO: 147488 - DNA, 20 bp, Artificial Sequence
  Description of Artificial Sequence: Synthetic oligonucleotide
  Target: ATXN1; (+) strand; PAM type: NRG; PAM sequence: CAG
ggtaggcagtttgtgctttg

SEQ ID NO: 147489 - DNA, 20 bp, Artificial Sequence
  Description of Artificial Sequence: Synthetic oligonucleotide
  Target: ATXN1; (+) strand; PAM type: NRG; PAM sequence: CAG
aggcagtttgtgctttgcag

SEQ ID NO: 147490 - DNA, 20 bp, Artificial Sequence
  Description of Artificial Sequence: Synthetic oligonucleotide
  Target: ATXN1; (+) strand; PAM type: NRG; PAM sequence: GAG
gcagtttgtgctttgcagca

SEQ ID NO: 147491 - DNA, 20 bp, Artificial Sequence
  Description of Artificial Sequence: Synthetic oligonucleotide
  Target: ATXN1; (+) strand; PAM type: NRG; PAM sequence: TGG
tttcccaattaaaaaaatcc

SEQ ID NO: 147492 - DNA, 20 bp, Artificial Sequence
  Description of Artificial Sequence: Synthetic oligonucleotide
  Target: ATXN1; (+) strand; PAM type: NRG; PAM sequence: GGG
ttcccaattaaaaaaatcct

SEQ ID NO: 147493 - DNA, 20 bp, Artificial Sequence
  Description of Artificial Sequence: Synthetic oligonucleotide
  Target: ATXN1; (+) strand; PAM type: NRG; PAM sequence: GGG
tcccaattaaaaaaatcctg

SEQ ID NO: 147494 - DNA, 20 bp, Artificial Sequence
  Description of Artificial Sequence: Synthetic oligonucleotide
  Target: ATXN1; (+) strand; PAM type: NRG; PAM sequence: CAG
aaaaaaatcctggggtcttc

SEQ ID NO: 147495 - DNA, 20 bp, Artificial Sequence
  Description of Artificial Sequence: Synthetic oligonucleotide
  Target: ATXN1; (+) strand; PAM type: NRG; PAM sequence: AGG
aaaaaatcctggggtcttcc

SEQ ID NO: 147496 - DNA, 20 bp, Artificial Sequence
  Description of Artificial Sequence: Synthetic oligonucleotide
  Target: ATXN1; (+) strand; PAM type: NRG; PAM sequence: CGG
atcctggggtcttccaggac

SEQ ID NO: 147497 - DNA, 20 bp, Artificial Sequence
  Description of Artificial Sequence: Synthetic oligonucleotide
  Target: ATXN1; (+) strand; PAM type: NRG; PAM sequence: TGG
ttccttgttctcctccatgc

SEQ ID NO: 147498 - DNA, 20 bp, Artificial Sequence
  Description of Artificial Sequence: Synthetic oligonucleotide
  Target: ATXN1; (+) strand; PAM type: NRG; PAM sequence: TGG
ctcctccatgctggtcaaac

SEQ ID NO: 147499 - DNA, 20 bp, Artificial Sequence
  Description of Artificial Sequence: Synthetic oligonucleotide
  Target: ATXN1; (+) strand; PAM type: NRG; PAM sequence: TGG
tgctggtcaaactggcgatc

SEQ ID NO: 147500 - DNA, 20 bp, Artificial Sequence
  Description of Artificial Sequence: Synthetic oligonucleotide
  Target: ATXN1; (+) strand; PAM type: NRG; PAM sequence: CAG
ggtcaaactggcgatctgga

SEQ ID NO: 147501 - DNA, 20 bp, Artificial Sequence
  Description of Artificial Sequence: Synthetic oligonucleotide
  Target: ATXN1; (+) strand; PAM type: NRG; PAM sequence: AGG
gtcaaactggcgatctggac

SEQ ID NO: 147502 - DNA, 20 bp, Artificial Sequence
  Description of Artificial Sequence: Synthetic oligonucleotide
  Target: ATXN1; (+) strand; PAM type: NRG; PAM sequence: TGG
ggcgatctggacaggctctt

SEQ ID NO: 147503 - DNA, 20 bp, Artificial Sequence
  Description of Artificial Sequence: Synthetic oligonucleotide
  Target: ATXN1; (+) strand; PAM type: NRG; PAM sequence: GAG
cgatctggacaggctctttg

SEQ ID NO: 147504 - DNA, 20 bp, Artificial Sequence
  Description of Artificial Sequence: Synthetic oligonucleotide
  Target: ATXN1; (+) strand; PAM type: NRG; PAM sequence: AAG
ctggacaggctctttggagc

SEQ ID NO: 147505 - DNA, 20 bp, Artificial Sequence
  Description of Artificial Sequence: Synthetic oligonucleotide
  Target: ATXN1; (+) strand; PAM type: NRG; PAM sequence: AGG
tggacaggctctttggagca

SEQ ID NO: 147506 - DNA, 20 bp, Artificial Sequence
  Description of Artificial Sequence: Synthetic oligonucleotide
  Target: ATXN1; (+) strand; PAM type: NRG; PAM sequence: AAG
agcaaggtgctcaactcttg

SEQ ID NO: 147507 - DNA, 20 bp, Artificial Sequence
  Description of Artificial Sequence: Synthetic oligonucleotide
  Target: ATXN1; (+) strand; PAM type: NRG; PAM sequence: TAG
ggtgctcaactcttgaagaa

SEQ ID NO: 147508 - DNA, 20 bp, Artificial Sequence
  Description of Artificial Sequence: Synthetic oligonucleotide
  Target: ATXN1; (+) strand; PAM type: NRG; PAM sequence: TGG
caactcttgaagaatagtat

SEQ ID NO: 147509 - DNA, 20 bp, Artificial Sequence
  Description of Artificial Sequence: Synthetic oligonucleotide
  Target: ATXN1; (+) strand; PAM type: NRG; PAM sequence: AAG
tcttgaagaatagtattggc

SEQ ID NO: 147510 - DNA, 20 bp, Artificial Sequence
  Description of Artificial Sequence: Synthetic oligonucleotide
  Target: ATXN1; (+) strand; PAM type: NRG; PAM sequence: AGG
cttgaagaatagtattggca

SEQ ID NO: 147511 - DNA, 20 bp, Artificial Sequence
  Description of Artificial Sequence: Synthetic oligonucleotide
  Target: ATXN1; (+) strand; PAM type: NRG; PAM sequence: TGG
gaatagtattggcaaggact

SEQ ID NO: 147512 - DNA, 20 bp, Artificial Sequence
  Description of Artificial Sequence: Synthetic oligonucleotide
  Target: ATXN1; (+) strand; PAM type: NRG; PAM sequence: GGG
aatagtattggcaaggactt

SEQ ID NO: 147513 - DNA, 20 bp, Artificial Sequence
  Description of Artificial Sequence: Synthetic oligonucleotide
  Target: ATXN1; (+) strand; PAM type: NRG; PAM sequence: GGG
atagtattggcaaggacttg

SEQ ID NO: 147514 - DNA, 20 bp, Artificial Sequence
  Description of Artificial Sequence: Synthetic oligonucleotide
  Target: ATXN1; (+) strand; PAM type: NRG; PAM sequence: TGG
gggatgtacttctctgcatc

SEQ ID NO: 147515 - DNA, 20 bp, Artificial Sequence
  Description of Artificial Sequence: Synthetic oligonucleotide
  Target: ATXN1; (+) strand; PAM type: NRG; PAM sequence: GGG
ggatgtacttctctgcatct

SEQ ID NO: 147516 - DNA, 20 bp, Artificial Sequence
  Description of Artificial Sequence: Synthetic oligonucleotide
  Target: ATXN1; (+) strand; PAM type: NRG; PAM sequence: GGG
gatgtacttctctgcatctg

SEQ ID NO: 147517 - DNA, 20 bp, Artificial Sequence
  Description of Artificial Sequence: Synthetic oligonucleotide
  Target: ATXN1; (+) strand; PAM type: NRG; PAM sequence: CAG
acttctctgcatctggggtg

SEQ ID NO: 147518 - DNA, 20 bp, Artificial Sequence
  Description of Artificial Sequence: Synthetic oligonucleotide
  Target: ATXN1; (+) strand; PAM type: NRG; PAM sequence: AAG
tctgcatctggggtgcagaa

SEQ ID NO: 147519 - DNA, 20 bp, Artificial Sequence
  Description of Artificial Sequence: Synthetic oligonucleotide
  Target: ATXN1; (+) strand; PAM type: NRG; PAM sequence: AAG
atctggggtgcagaaaagat

SEQ ID NO: 147520 - DNA, 20 bp, Artificial Sequence
  Description of Artificial Sequence: Synthetic oligonucleotide
  Target: ATXN1; (+) strand; PAM type: NRG; PAM sequence: CAG
gtgcagaaaagataagaaca

SEQ ID NO: 147521 - DNA, 20 bp, Artificial Sequence
  Description of Artificial Sequence: Synthetic oligonucleotide
  Target: ATXN1; (+) strand; PAM type: NRG; PAM sequence: TGG
ccctgttcttatgtttctgc

SEQ ID NO: 147522 - DNA, 20 bp, Artificial Sequence
  Description of Artificial Sequence: Synthetic oligonucleotide
  Target: ATXN1; (+) strand; PAM type: NRG; PAM sequence: CAG
ctgtgctctgcaacccccac

SEQ ID NO: 147523 - DNA, 20 bp, Artificial Sequence
  Description of Artificial Sequence: Synthetic oligonucleotide
  Target: ATXN1; (+) strand; PAM type: NRG; PAM sequence: CGG
ccccaccagccgacccctta

SEQ ID NO: 147524 - DNA, 20 bp, Artificial Sequence
  Description of Artificial Sequence: Synthetic oligonucleotide
  Target: ATXN1; (+) strand; PAM type: NRG; PAM sequence: AAG
gctgcctgacaacatgatca

SEQ ID NO: 147525 - DNA, 20 bp, Artificial Sequence
  Description of Artificial Sequence: Synthetic oligonucleotide
  Target: ATXN1; (+) strand; PAM type: NRG; PAM sequence: AGG
ctgcctgacaacatgatcaa

SEQ ID NO: 147526 - DNA, 20 bp, Artificial Sequence
  Description of Artificial Sequence: Synthetic oligonucleotide
  Target: ATXN1; (+) strand; PAM type: NRG; PAM sequence: GAG
gcctgacaacatgatcaaag

SEQ ID NO: 147527 - DNA, 20 bp, Artificial Sequence
  Description of Artificial Sequence: Synthetic oligonucleotide
  Target: ATXN1; (+) strand; PAM type: NRG; PAM sequence: AGG
cctgacaacatgatcaaagg

SEQ ID NO: 147528 - DNA, 20 bp, Artificial Sequence
  Description of Artificial Sequence: Synthetic oligonucleotide
  Target: ATXN1; (+) strand; PAM type: NRG; PAM sequence: GGG
ctgacaacatgatcaaagga

SEQ ID NO: 147529 - DNA, 20 bp, Artificial Sequence
  Description of Artificial Sequence: Synthetic oligonucleotide
  Target: ATXN1; (+) strand; PAM type: NRG; PAM sequence: TGG
acaacatgatcaaaggaggg

SEQ ID NO: 147530 - DNA, 20 bp, Artificial Sequence
  Description of Artificial Sequence: Synthetic oligonucleotide
  Target: ATXN1; (+) strand; PAM type: NRG; PAM sequence: AAG
acatgatcaaaggagggtgg

SEQ ID NO: 147531 - DNA, 20 bp, Artificial Sequence
  Description of Artificial Sequence: Synthetic oligonucleotide
  Target: ATXN1; (+) strand; PAM type: NRG; PAM sequence: GAG
atgatcaaaggagggtggaa

SEQ ID NO: 147532 - DNA, 20 bp, Artificial Sequence
  Description of Artificial Sequence: Synthetic oligonucleotide
  Target: ATXN1; (+) strand; PAM type: NRG; PAM sequence: AGG
tgatcaaaggagggtggaag

SEQ ID NO: 147533 - DNA, 20 bp, Artificial Sequence
  Description of Artificial Sequence: Synthetic oligonucleotide
  Target: ATXN1; (+) strand; PAM type: NRG; PAM sequence: GAG
atcaaaggagggtggaagag

SEQ ID NO: 147534 - DNA, 20 bp, Artificial Sequence
  Description of Artificial Sequence: Synthetic oligonucleotide
  Target: ATXN1; (+) strand; PAM type: NRG; PAM sequence: GAG
caaaggagggtggaagagga

SEQ ID NO: 147535 - DNA, 20 bp, Artificial Sequence
  Description of Artificial Sequence: Synthetic oligonucleotide
  Target: ATXN1; (+) strand; PAM type: NRG; PAM sequence: AAG
gagggtggaagaggagagcc

SEQ ID NO: 147536 - DNA, 20 bp, Artificial Sequence
  Description of Artificial Sequence: Synthetic oligonucleotide
  Target: ATXN1; (+) strand; PAM type: NRG; PAM sequence: CAG
gccaagtttaataaccttac

SEQ ID NO: 147537 - DNA, 20 bp, Artificial Sequence
  Description of Artificial Sequence: Synthetic oligonucleotide
  Target: ATXN1; (+) strand; PAM type: NRG; PAM sequence: AGG
ccaagtttaataaccttacc

SEQ ID NO: 147538 - DNA, 20 bp, Artificial Sequence
  Description of Artificial Sequence: Synthetic oligonucleotide
  Target: ATXN1; (+) strand; PAM type: NRG; PAM sequence: GAG
aagtttaataaccttaccag

SEQ ID NO: 147539 - DNA, 20 bp, Artificial Sequence
  Description of Artificial Sequence: Synthetic oligonucleotide
  Target: ATXN1; (+) strand; PAM type: NRG; PAM sequence: CAG
taataaccttaccaggagat

SEQ ID NO: 147540 - DNA, 20 bp, Artificial Sequence
  Description of Artificial Sequence: Synthetic oligonucleotide
  Target: ATXN1; (+) strand; PAM type: NRG; PAM sequence: TGG
taccaggagatcagattgtc

SEQ ID NO: 147541 - DNA, 20 bp, Artificial Sequence
  Description of Artificial Sequence: Synthetic oligonucleotide
  Target: ATXN1; (+) strand; PAM type: NRG; PAM sequence: GGG
accaggagatcagattgtct

SEQ ID NO: 147542 - DNA, 20 bp, Artificial Sequence
  Description of Artificial Sequence: Synthetic oligonucleotide
  Target: ATXN1; (+) strand; PAM type: NRG; PAM sequence: GGG
ccaggagatcagattgtctg

SEQ ID NO: 147543 - DNA, 20 bp, Artificial Sequence
  Description of Artificial Sequence: Synthetic oligonucleotide
  Target: ATXN1; (+) strand; PAM type: NRG; PAM sequence: AAG
agatcagattgtctggggcc

SEQ ID NO: 147544 - DNA, 20 bp, Artificial Sequence
  Description of Artificial Sequence: Synthetic oligonucleotide
  Target: ATXN1; (+) strand; PAM type: NRG; PAM sequence: CAG
tcagattgtctggggccaag

SEQ ID NO: 147545 - DNA, 20 bp, Artificial Sequence
  Description of Artificial Sequence: Synthetic oligonucleotide
  Target: ATXN1; (+) strand; PAM type: NRG; PAM sequence: AAG
gattgtctggggccaagcag

SEQ ID NO: 147546 - DNA, 20 bp, Artificial Sequence
  Description of Artificial Sequence: Synthetic oligonucleotide
  Target: ATXN1; (+) strand; PAM type: NRG; PAM sequence: GAG
tggggccaagcagaagtcct

SEQ ID NO: 147547 - DNA, 20 bp, Artificial Sequence
  Description of Artificial Sequence: Synthetic oligonucleotide
  Target: ATXN1; (+) strand; PAM type: NRG; PAM sequence: TAG
gccaagcagaagtcctgaga

SEQ ID NO: 147548 - DNA, 20 bp, Artificial Sequence
  Description of Artificial Sequence: Synthetic oligonucleotide
  Target: ATXN1; (+) strand; PAM type: NRG; PAM sequence: TGG
ctgagatagctgctgaatcc

SEQ ID NO: 147549 - DNA, 20 bp, Artificial Sequence
  Description of Artificial Sequence: Synthetic oligonucleotide
  Target: ATXN1; (+) strand; PAM type: NRG; PAM sequence: CAG
tgctgaatcctggccattta

SEQ ID NO: 147550 - DNA, 20 bp, Artificial Sequence
  Description of Artificial Sequence: Synthetic oligonucleotide
  Target: ATXN1; (+) strand; PAM type: NRG; PAM sequence: GAG
ctgaatcctggccatttaca

SEQ ID NO: 147551 - DNA, 20 bp, Artificial Sequence
  Description of Artificial Sequence: Synthetic oligonucleotide
  Target: ATXN1; (+) strand; PAM type: NRG; PAM sequence: CAG
aatcctggccatttacagag

SEQ ID NO: 147552 - DNA, 20 bp, Artificial Sequence
  Description of Artificial Sequence: Synthetic oligonucleotide
  Target: ATXN1; (+) strand; PAM type: NRG; PAM sequence: TAG
tttacagagcagcacaaaac

SEQ ID NO: 147553 - DNA, 20 bp, Artificial Sequence
  Description of Artificial Sequence: Synthetic oligonucleotide
  Target: ATXN1; (+) strand; PAM type: NRG; PAM sequence: CGG
tcctgttccttttcctgccg

SEQ ID NO: 147554 - DNA, 20 bp, Artificial Sequence
  Description of Artificial Sequence: Synthetic oligonucleotide
  Target: ATXN1; (+) strand; PAM type: NRG; PAM sequence: TGG
ttttcctgccgcggttgcca

SEQ ID NO: 147555 - DNA, 20 bp, Artificial Sequence
  Description of Artificial Sequence: Synthetic oligonucleotide
  Target: ATXN1; (+) strand; PAM type: NRG; PAM sequence: CAG
ccgacccaaacaatataccc

SEQ ID NO: 147556 - DNA, 20 bp, Artificial Sequence
  Description of Artificial Sequence: Synthetic oligonucleotide
  Target: ATXN1; (+) strand; PAM type: NRG; PAM sequence: CAG
caaacaatataccccagctt

SEQ ID NO: 147557 - DNA, 20 bp, Artificial Sequence
  Description of Artificial Sequence: Synthetic oligonucleotide
  Target: ATXN1; (+) strand; PAM type: NRG; PAM sequence: TGG
accccagcttcagcctcctt

SEQ ID NO: 147558 - DNA, 20 bp, Artificial Sequence
  Description of Artificial Sequence: Synthetic oligonucleotide
  Target: ATXN1; (+) strand; PAM type: NRG; PAM sequence: CAG
ggcttcctaaccgccaccca

SEQ ID NO: 147559 - DNA, 20 bp, Artificial Sequence
  Description of Artificial Sequence: Synthetic oligonucleotide
  Target: ATXN1; (+) strand; PAM type: NRG; PAM sequence: TGG
cacccacagacctccaaacg

SEQ ID NO: 147560 - DNA, 20 bp, Artificial Sequence
  Description of Artificial Sequence: Synthetic oligonucleotide
  Target: ATXN1; (+) strand; PAM type: NRG; PAM sequence: GGG
acccacagacctccaaacgt

SEQ ID NO: 147561 - DNA, 20 bp, Artificial Sequence
  Description of Artificial Sequence: Synthetic oligonucleotide
  Target: ATXN1; (+) strand; PAM type: NRG; PAM sequence: CAG
cacagacctccaaacgtggg

SEQ ID NO: 147562 - DNA, 20 bp, Artificial Sequence
  Description of Artificial Sequence: Synthetic oligonucleotide
  Target: ATXN1; (+) strand; PAM type: NRG; PAM sequence: AGG
acagacctccaaacgtgggc

SEQ ID NO: 147563 - DNA, 20 bp, Artificial Sequence
  Description of Artificial Sequence: Synthetic oligonucleotide
  Target: ATXN1; (+) strand; PAM type: NRG; PAM sequence: GAG
agacctccaaacgtgggcag

SEQ ID NO: 147564 - DNA, 20 bp, Artificial Sequence
  Description of Artificial Sequence: Synthetic oligonucleotide
  Target: ATXN1; (+) strand; PAM type: NRG; PAM sequence: AGG
gacctccaaacgtgggcagg

SEQ ID NO: 147565 - DNA, 20 bp, Artificial Sequence
  Description of Artificial Sequence: Synthetic oligonucleotide
  Target: ATXN1; (+) strand; PAM type: NRG; PAM sequence: GAG
cctccaaacgtgggcaggag

SEQ ID NO: 147566 - DNA, 20 bp, Artificial Sequence
  Description of Artificial Sequence: Synthetic oligonucleotide
  Target: ATXN1; (+) strand; PAM type: NRG; PAM sequence: AGG
ctccaaacgtgggcaggagg

SEQ ID NO: 147567 - DNA, 20 bp, Artificial Sequence
  Description of Artificial Sequence: Synthetic oligonucleotide
  Target: ATXN1; (+) strand; PAM type: NRG; PAM sequence: TGG
aggtgaaaactgctcaccga

SEQ ID NO: 147568 - DNA, 20 bp, Artificial Sequence
  Description of Artificial Sequence: Synthetic oligonucleotide
  Target: ATXN1; (+) strand; PAM type: NRG; PAM sequence: GGG
ggtgaaaactgctcaccgat

SEQ ID NO: 147569 - DNA, 20 bp, Artificial Sequence
  Description of Artificial Sequence: Synthetic oligonucleotide
  Target: ATXN1; (+) strand; PAM type: NRG; PAM sequence: GAG
actgctcaccgatgggaatt

SEQ ID NO: 147570 - DNA, 20 bp, Artificial Sequence
  Description of Artificial Sequence: Synthetic oligonucleotide
  Target: ATXN1; (+) strand; PAM type: NRG; PAM sequence: AGG
ctgctcaccgatgggaattg

SEQ ID NO: 147571 - DNA, 20 bp, Artificial Sequence
  Description of Artificial Sequence: Synthetic oligonucleotide
  Target: ATXN1; (+) strand; PAM type: NRG; PAM sequence: GAG
gctcaccgatgggaattgag

SEQ ID NO: 147572 - DNA, 20 bp, Artificial Sequence
  Description of Artificial Sequence: Synthetic oligonucleotide
  Target: ATXN1; (+) strand; PAM type: NRG; PAM sequence: TAG
accgatgggaattgaggagc

SEQ ID NO: 147573 - DNA, 20 bp, Artificial Sequence
  Description of Artificial Sequence: Synthetic oligonucleotide
  Target: ATXN1; (+) strand; PAM type: NRG; PAM sequence: AGG
ccgatgggaattgaggagct

SEQ ID NO: 147574 - DNA, 20 bp, Artificial Sequence
  Description of Artificial Sequence: Synthetic oligonucleotide
  Target: ATXN1; (+) strand; PAM type: NRG; PAM sequence: TAG
atgggaattgaggagctagg

SEQ ID NO: 147575 - DNA, 20 bp, Artificial Sequence
  Description of Artificial Sequence: Synthetic oligonucleotide
  Target: ATXN1; (+) strand; PAM type: NRG; PAM sequence: GAG
gggaattgaggagctaggta

SEQ ID NO: 147576 - DNA, 20 bp, Artificial Sequence
  Description of Artificial Sequence: Synthetic oligonucleotide
  Target: ATXN1; (+) strand; PAM type: NRG; PAM sequence: AGG
ggaattgaggagctaggtag

SEQ ID NO: 147577 - DNA, 20 bp, Artificial Sequence
  Description of Artificial Sequence: Synthetic oligonucleotide
  Target: ATXN1; (+) strand; PAM type: NRG; PAM sequence: TGG
ttgaggagctaggtagagga

SEQ ID NO: 147578 - DNA, 20 bp, Artificial Sequence
  Description of Artificial Sequence: Synthetic oligonucleotide
  Target: ATXN1; (+) strand; PAM type: NRG; PAM sequence: AAG
ggagctaggtagaggatgga

SEQ ID NO: 147579 - DNA, 20 bp, Artificial Sequence
  Description of Artificial Sequence: Synthetic oligonucleotide
  Target: ATXN1; (+) strand; PAM type: NRG; PAM sequence: AGG
gagctaggtagaggatggaa

SEQ ID NO: 147580 - DNA, 20 bp, Artificial Sequence
  Description of Artificial Sequence: Synthetic oligonucleotide
  Target: ATXN1; (+) strand; PAM type: NRG; PAM sequence: GGG
agctaggtagaggatggaaa

SEQ ID NO: 147581 - DNA, 20 bp, Artificial Sequence
  Description of Artificial Sequence: Synthetic oligonucleotide
  Target: ATXN1; (+) strand; PAM type: NRG; PAM sequence: GGG
gctaggtagaggatggaaag

SEQ ID NO: 147582 - DNA, 20 bp, Artificial Sequence
  Description of Artificial Sequence: Synthetic oligonucleotide
  Target: ATXN1; (+) strand; PAM type: NRG; PAM sequence: TGG
tagaggatggaaaggggatc

SEQ ID NO: 147583 - DNA, 20 bp, Artificial Sequence
  Description of Artificial Sequence: Synthetic oligonucleotide
  Target: ATXN1; (+) strand; PAM type: NRG; PAM sequence: GGG
agaggatggaaaggggatct

SEQ ID NO: 147584 - DNA, 20 bp, Artificial Sequence
  Description of Artificial Sequence: Synthetic oligonucleotide
  Target: ATXN1; (+) strand; PAM type: NRG; PAM sequence: CAG
tggaaaggggatctgggctg

SEQ ID NO: 147585 - DNA, 20 bp, Artificial Sequence
  Description of Artificial Sequence: Synthetic oligonucleotide
  Target: ATXN1; (+) strand; PAM type: NRG; PAM sequence: CAG
aggggatctgggctgcagat

SEQ ID NO: 147586 - DNA, 20 bp, Artificial Sequence
  Description of Artificial Sequence: Synthetic oligonucleotide
  Target: ATXN1; (+) strand; PAM type: NRG; PAM sequence: CGG
atctgggctgcagatcagcc

SEQ ID NO: 147587 - DNA, 20 bp, Artificial Sequence
  Description of Artificial Sequence: Synthetic oligonucleotide
  Target: ATXN1; (+) strand; PAM type: NRG; PAM sequence: GAG
ctgggctgcagatcagcccg

SEQ ID NO: 147588 - DNA, 20 bp, Artificial Sequence
  Description of Artificial Sequence: Synthetic oligonucleotide
  Target: ATXN1; (+) strand; PAM type: NRG; PAM sequence: AGG
tgggctgcagatcagcccgg

SEQ ID NO: 147589 - DNA, 20 bp, Artificial Sequence
  Description of Artificial Sequence: Synthetic oligonucleotide
  Target: ATXN1; (+) strand; PAM type: NRG; PAM sequence: GGG
gggctgcagatcagcccgga

SEQ ID NO: 147590 - DNA, 20 bp, Artificial Sequence
  Description of Artificial Sequence: Synthetic oligonucleotide
  Target: ATXN1; (+) strand; PAM type: NRG; PAM sequence: TGG
tcagcccggagggtgtaacg

SEQ ID NO: 147591 - DNA, 20 bp, Artificial Sequence
  Description of Artificial Sequence: Synthetic oligonucleotide
  Target: ATXN1; (+) strand; PAM type: NRG; PAM sequence: AAG
cccggagggtgtaacgtggt

SEQ ID NO: 147592 - DNA, 20 bp, Artificial Sequence
  Description of Artificial Sequence: Synthetic oligonucleotide
  Target: ATXN1; (+) strand; PAM type: NRG; PAM sequence: CAG
ggagggtgtaacgtggtaag

SEQ ID NO: 147593 - DNA, 20 bp, Artificial Sequence
  Description of Artificial Sequence: Synthetic oligonucleotide
  Target: ATXN1; (+) strand; PAM type: NRG; PAM sequence: TAG
gtaagcagacgtgctgcttt

SEQ ID NO: 147594 - DNA, 20 bp, Artificial Sequence
  Description of Artificial Sequence: Synthetic oligonucleotide
  Target: ATXN1; (+) strand; PAM type: NRG; PAM sequence: TAG
gacgtgctgcttttagctgc

SEQ ID NO: 147595 - DNA, 20 bp, Artificial Sequence
  Description of Artificial Sequence: Synthetic oligonucleotide
  Target: ATXN1; (+) strand; PAM type: NRG; PAM sequence: AGG
acgtgctgcttttagctgct

SEQ ID NO: 147596 - DNA, 20 bp, Artificial Sequence
  Description of Artificial Sequence: Synthetic oligonucleotide
  Target: ATXN1; (+) strand; PAM type: NRG; PAM sequence: GAG
ctgctaggctttgcttctgt

SEQ ID NO: 147597 - DNA, 20 bp, Artificial Sequence
  Description of Artificial Sequence: Synthetic oligonucleotide
  Target: ATXN1; (+) strand; PAM type: NRG; PAM sequence: AAG
tgagttttcacctcatttct

SEQ ID NO: 147598 - DNA, 20 bp, Artificial Sequence
  Description of Artificial Sequence: Synthetic oligonucleotide
  Target: ATXN1; (+) strand; PAM type: NRG; PAM sequence: TGG
gttttcacctcatttctaag

SEQ ID NO: 147599 - DNA, 20 bp, Artificial Sequence
  Description of Artificial Sequence: Synthetic oligonucleotide
  Target: ATXN1; (+) strand; PAM type: NRG; PAM sequence: CAG
cctcatttctaagtggaaaa

SEQ ID NO: 147600 - DNA, 20 bp, Artificial Sequence
  Description of Artificial Sequence: Synthetic oligonucleotide
  Target: ATXN1; (+) strand; PAM type: NRG; PAM sequence: AAG
ctaagtggaaaacagatctt

SEQ ID NO: 147601 - DNA, 20 bp, Artificial Sequence
  Description of Artificial Sequence: Synthetic oligonucleotide
  Target: ATXN1; (+) strand; PAM type: NRG; PAM sequence: AAG
agtggaaaacagatcttaag

SEQ ID NO: 147602 - DNA, 20 bp, Artificial Sequence
  Description of Artificial Sequence: Synthetic oligonucleotide
  Target: ATXN1; (+) strand; PAM type: NRG; PAM sequence: AAG
aaacagatcttaagaagaaa

SEQ ID NO: 147603 - DNA, 20 bp, Artificial Sequence
  Description of Artificial Sequence: Synthetic oligonucleotide
  Target: ATXN1; (+) strand; PAM type: NRG; PAM sequence: CAG
tcttaagaagaaaaagaaac

SEQ ID NO: 147604 - DNA, 20 bp, Artificial Sequence
  Description of Artificial Sequence: Synthetic oligonucleotide
  Target: ATXN1; (+) strand; PAM type: NRG; PAM sequence: TGG
aaccagctaaaaacccaaca

SEQ ID NO: 147605 - DNA, 20 bp, Artificial Sequence
  Description of Artificial Sequence: Synthetic oligonucleotide
  Target: ATXN1; (+) strand; PAM type: NRG; PAM sequence: GGG
accagctaaaaacccaacat

SEQ ID NO: 147606 - DNA, 20 bp, Artificial Sequence
  Description of Artificial Sequence: Synthetic oligonucleotide
  Target: ATXN1; (+) strand; PAM type: NRG; PAM sequence: TGG
ttactatcacctttaaactt

SEQ ID NO: 147607 - DNA, 20 bp, Artificial Sequence
  Description of Artificial Sequence: Synthetic oligonucleotide
  Target: ATXN1; (+) strand; PAM type: NRG; PAM sequence: TAG
tcacctttaaactttggttt

SEQ ID NO: 147608 - DNA, 20 bp, Artificial Sequence
  Description of Artificial Sequence: Synthetic oligonucleotide
  Target: ATXN1; (+) strand; PAM type: NRG; PAM sequence: TGG
gttttagcacctttaaactc

SEQ ID NO: 147609 - DNA, 20 bp, Artificial Sequence
  Description of Artificial Sequence: Synthetic oligonucleotide
  Target: ATXN1; (+) strand; PAM type: NRG; PAM sequence: CAG
ctctggaatgaaccgtgaac

SEQ ID NO: 147610 - DNA, 20 bp, Artificial Sequence
  Description of Artificial Sequence: Synthetic oligonucleotide
  Target: ATXN1; (+) strand; PAM type: NRG; PAM sequence: TGG
ccgtgaaccagcaaaacaaa

SEQ ID NO: 147611 - DNA, 20 bp, Artificial Sequence
  Description of Artificial Sequence: Synthetic oligonucleotide
  Target: ATXN1; (+) strand; PAM type: NRG; PAM sequence: AAG
atggaaaaaaaaaaaacaaa

SEQ ID NO: 147612 - DNA, 20 bp, Artificial Sequence
  Description of Artificial Sequence: Synthetic oligonucleotide
  Target: ATXN1; (+) strand; PAM type: NRG; PAM sequence: CAG
gaaaaaaaaaaaacaaaaag

SEQ ID NO: 147613 - DNA, 20 bp, Artificial Sequence
  Description of Artificial Sequence: Synthetic oligonucleotide
  Target: ATXN1; (+) strand; PAM type: NRG; PAM sequence: TGG
aacaaaaagcagcgacctcc

SEQ ID NO: 147614 - DNA, 20 bp, Artificial Sequence
  Description of Artificial Sequence: Synthetic oligonucleotide
  Target: ATXN1; (+) strand; PAM type: NRG; PAM sequence: GGG
acaaaaagcagcgacctcct

SEQ ID NO: 147615 - DNA, 20 bp, Artificial Sequence
  Description of Artificial Sequence: Synthetic oligonucleotide
  Target: ATXN1; (+) strand; PAM type: NRG; PAM sequence: TGG
aagcagcgacctcctgggta

SEQ ID NO: 147616 - DNA, 20 bp, Artificial Sequence
  Description of Artificial Sequence: Synthetic oligonucleotide
  Target: ATXN1; (+) strand; PAM type: NRG; PAM sequence: CAG
tgggtatggtaatatctgaa

SEQ ID NO: 147617 - DNA, 20 bp, Artificial Sequence
  Description of Artificial Sequence: Synthetic oligonucleotide
  Target: ATXN1; (+) strand; PAM type: NRG; PAM sequence: AAG
gtatggtaatatctgaacag

SEQ ID NO: 147618 - DNA, 20 bp, Artificial Sequence
  Description of Artificial Sequence: Synthetic oligonucleotide
  Target: ATXN1; (+) strand; PAM type: NRG; PAM sequence: GAG
ggtaatatctgaacagaagc

SEQ ID NO: 147619 - DNA, 20 bp, Artificial Sequence
  Description of Artificial Sequence: Synthetic oligonucleotide
  Target: ATXN1; (+) strand; PAM type: NRG; PAM sequence: AGG
gtaatatctgaacagaagcg

SEQ ID NO: 147620 - DNA, 20 bp, Artificial Sequence
  Description of Artificial Sequence: Synthetic oligonucleotide
  Target: ATXN1; (+) strand; PAM type: NRG; PAM sequence: TGG
atctgaacagaagcgaggtt

SEQ ID NO: 147621 - DNA, 20 bp, Artificial Sequence
  Description of Artificial Sequence: Synthetic oligonucleotide
  Target: ATXN1; (+) strand; PAM type: NRG; PAM sequence: GGG
tctgaacagaagcgaggttt

SEQ ID NO: 147622 - DNA, 20 bp, Artificial Sequence
  Description of Artificial Sequence: Synthetic oligonucleotide
  Target: ATXN1; (+) strand; PAM type: NRG; PAM sequence: GAG
tgaacagaagcgaggtttgg

SEQ ID NO: 147623 - DNA, 20 bp, Artificial Sequence
  Description of Artificial Sequence: Synthetic oligonucleotide
  Target: ATXN1; (+) strand; PAM type: NRG; PAM sequence: AGG
gaacagaagcgaggtttggg

SEQ ID NO: 147624 - DNA, 20 bp, Artificial Sequence
  Description of Artificial Sequence: Synthetic oligonucleotide
  Target: ATXN1; (+) strand; PAM type: NRG; PAM sequence: GGG
aacagaagcgaggtttggga

SEQ ID NO: 147625 - DNA, 20 bp, Artificial Sequence
  Description of Artificial Sequence: Synthetic oligonucleotide
  Target: ATXN1; (+) strand; PAM type: NRG; PAM sequence: GGG
acagaagcgaggtttgggag

SEQ ID NO: 147626 - DNA, 20 bp, Artificial Sequence
  Description of Artificial Sequence: Synthetic oligonucleotide
  Target: ATXN1; (+) strand; PAM type: NRG; PAM sequence: TGG
cgaggtttgggaggggatgt

SEQ ID NO: 147627 - DNA, 20 bp, Artificial Sequence
  Description of Artificial Sequence: Synthetic oligonucleotide
  Target: ATXN1; (+) strand; PAM type: NRG; PAM sequence: CAG
ttgggaggggatgttggcat

SEQ ID NO: 147628 - DNA, 20 bp, Artificial Sequence
  Description of Artificial Sequence: Synthetic oligonucleotide
  Target: ATXN1; (+) strand; PAM type: NRG; PAM sequence: AGG
tgggaggggatgttggcatc

SEQ ID NO: 147629 - DNA, 20 bp, Artificial Sequence
  Description of Artificial Sequence: Synthetic oligonucleotide
  Target: ATXN1; (+) strand; PAM type: NRG; PAM sequence: GGG
gggaggggatgttggcatca

SEQ ID NO: 147630 - DNA, 20 bp, Artificial Sequence
  Description of Artificial Sequence: Synthetic oligonucleotide
  Target: ATXN1; (+) strand; PAM type: NRG; PAM sequence: TAG
ggcatcagggtgataaaccc

SEQ ID NO: 147631 - DNA, 20 bp, Artificial Sequence
  Description of Artificial Sequence: Synthetic oligonucleotide
  Target: ATXN1; (+) strand; PAM type: NRG; PAM sequence: AGG
gcatcagggtgataaaccct

SEQ ID NO: 147632 - DNA, 20 bp, Artificial Sequence
  Description of Artificial Sequence: Synthetic oligonucleotide
  Target: ATXN1; (+) strand; PAM type: NRG; PAM sequence: TGG
agggtgataaaccctaggaa

SEQ ID NO: 147633 - DNA, 20 bp, Artificial Sequence
  Description of Artificial Sequence: Synthetic oligonucleotide
  Target: ATXN1; (+) strand; PAM type: NRG; PAM sequence: TGG
gcatacgtgttgtgacgttc

SEQ ID NO: 147634 - DNA, 20 bp, Artificial Sequence
  Description of Artificial Sequence: Synthetic oligonucleotide
  Target: ATXN1; (+) strand; PAM type: NRG; PAM sequence: AAG
gtgacgttctggtttaaaac

SEQ ID NO: 147635 - DNA, 20 bp, Artificial Sequence
  Description of Artificial Sequence: Synthetic oligonucleotide
  Target: ATXN1; (+) strand; PAM type: NRG; PAM sequence: AAG
ttaaaacaagttcctatttg

SEQ ID NO: 147636 - DNA, 20 bp, Artificial Sequence
  Description of Artificial Sequence: Synthetic oligonucleotide
  Target: ATXN1; (+) strand; PAM type: NRG; PAM sequence: AAG
atttgaagatgccattaaaa

SEQ ID NO: 147637 - DNA, 20 bp, Artificial Sequence
  Description of Artificial Sequence: Synthetic oligonucleotide
  Target: ATXN1; (+) strand; PAM type: NRG; PAM sequence: TAG
aagatgccattaaaaaagtt

SEQ ID NO: 147638 - DNA, 20 bp, Artificial Sequence
  Description of Artificial Sequence: Synthetic oligonucleotide
  Target: ATXN1; (+) strand; PAM type: NRG; PAM sequence: CAG
ccattaaaaaagtttagata

SEQ ID NO: 147639 - DNA, 20 bp, Artificial Sequence
  Description of Artificial Sequence: Synthetic oligonucleotide
  Target: ATXN1; (+) strand; PAM type: NRG; PAM sequence: AAG
ttagatacagaaactacaca

SEQ ID NO: 147640 - DNA, 20 bp, Artificial Sequence
  Description of Artificial Sequence: Synthetic oligonucleotide
  Target: ATXN1; (+) strand; PAM type: NRG; PAM sequence: AAG
atacagaaactacacaaaga

SEQ ID NO: 147641 - DNA, 20 bp, Artificial Sequence
  Description of Artificial Sequence: Synthetic oligonucleotide
  Target: ATXN1; (+) strand; PAM type: NRG; PAM sequence: GAG
acagaaactacacaaagaaa

SEQ ID NO: 147642 - DNA, 20 bp, Artificial Sequence
  Description of Artificial Sequence: Synthetic oligonucleotide
  Target: ATXN1; (+) strand; PAM type: NRG; PAM sequence: CAG
aaactacacaaagaaagaga

SEQ ID NO: 147643 - DNA, 20 bp, Artificial Sequence
  Description of Artificial Sequence: Synthetic oligonucleotide
  Target: ATXN1; (+) strand; PAM type: NRG; PAM sequence: GAG
actacacaaagaaagagaca

SEQ ID NO: 147644 - DNA, 20 bp, Artificial Sequence
  Description of Artificial Sequence: Synthetic oligonucleotide
  Target: ATXN1; (+) strand; PAM type: NRG; PAM sequence: AGG
ctacacaaagaaagagacag

SEQ ID NO: 147645 - DNA, 20 bp, Artificial Sequence
  Description of Artificial Sequence: Synthetic oligonucleotide
  Target: ATXN1; (+) strand; PAM type: NRG; PAM sequence: AAG
aagaaagagacagaggaaaa

SEQ ID NO: 147646 - DNA, 20 bp, Artificial Sequence
  Description of Artificial Sequence: Synthetic oligonucleotide
  Target: ATXN1; (+) strand; PAM type: NRG; PAM sequence: AAG
aaagagacagaggaaaaaag

SEQ ID NO: 147647 - DNA, 20 bp, Artificial Sequence
  Description of Artificial Sequence: Synthetic oligonucleotide
  Target: ATXN1; (+) strand; PAM type: NRG; PAM sequence: CAG
acacatgttgaaactaacaa

SEQ ID NO: 147648 - DNA, 20 bp, Artificial Sequence
  Description of Artificial Sequence: Synthetic oligonucleotide
  Target: ATXN1; (+) strand; PAM type: NRG; PAM sequence: TAG
tgttgaaactaacaacagac

SEQ ID NO: 147649 - DNA, 20 bp, Artificial Sequence
  Description of Artificial Sequence: Synthetic oligonucleotide
  Target: ATXN1; (+) strand; PAM type: NRG; PAM sequence: CAG
aaactaacaacagactagcc

SEQ ID NO: 147650 - DNA, 20 bp, Artificial Sequence
  Description of Artificial Sequence: Synthetic oligonucleotide
  Target: ATXN1; (+) strand; PAM type: NRG; PAM sequence: AGG
aactaacaacagactagccc

SEQ ID NO: 147651 - DNA, 20 bp, Artificial Sequence
  Description of Artificial Sequence: Synthetic oligonucleotide
  Target: ATXN1; (+) strand; PAM type: NRG; PAM sequence: GGG
actaacaacagactagccca

SEQ ID NO: 147652 - DNA, 20 bp, Artificial Sequence
  Description of Artificial Sequence: Synthetic oligonucleotide
  Target: ATXN1; (+) strand; PAM type: NRG; PAM sequence: TGG
caacagactagcccagggaa

SEQ ID NO: 147653 - DNA, 20 bp, Artificial Sequence
  Description of Artificial Sequence: Synthetic oligonucleotide
  Target: ATXN1; (+) strand; PAM type: NRG; PAM sequence: CAG
ctagcccagggaatggcgct

SEQ ID NO: 147654 - DNA, 20 bp, Artificial Sequence
  Description of Artificial Sequence: Synthetic oligonucleotide
  Target: ATXN1; (+) strand; PAM type: NRG; PAM sequence: AGG
tagcccagggaatggcgctc

SEQ ID NO: 147655 - DNA, 20 bp, Artificial Sequence
  Description of Artificial Sequence: Synthetic oligonucleotide
  Target: ATXN1; (+) strand; PAM type: NRG; PAM sequence: TGG
agggaatggcgctcaggcga

SEQ ID NO: 147656 - DNA, 20 bp, Artificial Sequence
  Description of Artificial Sequence: Synthetic oligonucleotide
  Target: ATXN1; (+) strand; PAM type: NRG; PAM sequence: GAG
ggaatggcgctcaggcgatg

SEQ ID NO: 147657 - DNA, 20 bp, Artificial Sequence
  Description of Artificial Sequence: Synthetic oligonucleotide
  Target: ATXN1; (+) strand; PAM type: NRG; PAM sequence: TGG
gcgatggagcacctatgctc

SEQ ID NO: 147658 - DNA, 20 bp, Artificial Sequence
  Description of Artificial Sequence: Synthetic oligonucleotide
  Target: ATXN1; (+) strand; PAM type: NRG; PAM sequence: GGG
cgatggagcacctatgctct

SEQ ID NO: 147659 - DNA, 20 bp, Artificial Sequence
  Description of Artificial Sequence: Synthetic oligonucleotide
  Target: ATXN1; (+) strand; PAM type: NRG; PAM sequence: AAG
gagcacctatgctctgggac

SEQ ID NO: 147660 - DNA, 20 bp, Artificial Sequence
  Description of Artificial Sequence: Synthetic oligonucleotide
  Target: ATXN1; (+) strand; PAM type: NRG; PAM sequence: TGG
cctatgctctgggacaagca

SEQ ID NO: 147661 - DNA, 20 bp, Artificial Sequence
  Description of Artificial Sequence: Synthetic oligonucleotide
  Target: ATXN1; (+) strand; PAM type: NRG; PAM sequence: CAG
ggacaagcatggccactgtc

SEQ ID NO: 147662 - DNA, 20 bp, Artificial Sequence
  Description of Artificial Sequence: Synthetic oligonucleotide
  Target: ATXN1; (+) strand; PAM type: NRG; PAM sequence: AAG
agcatggccactgtccagct

SEQ ID NO: 147663 - DNA, 20 bp, Artificial Sequence
  Description of Artificial Sequence: Synthetic oligonucleotide
  Target: ATXN1; (+) strand; PAM type: NRG; PAM sequence: AAG
tggccactgtccagctaagc

SEQ ID NO: 147664 - DNA, 20 bp, Artificial Sequence
  Description of Artificial Sequence: Synthetic oligonucleotide
  Target: ATXN1; (+) strand; PAM type: NRG; PAM sequence: TGG
aagcaagccattaacccttt

SEQ ID NO: 147665 - DNA, 20 bp, Artificial Sequence
  Description of Artificial Sequence: Synthetic oligonucleotide
  Target: ATXN1; (+) strand; PAM type: NRG; PAM sequence: CGG
ttcacttcttcatctataaa

SEQ ID NO: 147666 - DNA, 20 bp, Artificial Sequence
  Description of Artificial Sequence: Synthetic oligonucleotide
  Target: ATXN1; (+) strand; PAM type: NRG; PAM sequence: GGG
tcacttcttcatctataaac

SEQ ID NO: 147667 - DNA, 20 bp, Artificial Sequence
  Description of Artificial Sequence: Synthetic oligonucleotide
  Target: ATXN1; (+) strand; PAM type: NRG; PAM sequence: GGG
cacttcttcatctataaacg

SEQ ID NO: 147668 - DNA, 20 bp, Artificial Sequence
  Description of Artificial Sequence: Synthetic oligonucleotide
  Target: ATXN1; (+) strand; PAM type: NRG; PAM sequence: CAG
ttcttcatctataaacgggg

SEQ ID NO: 147669 - DNA, 20 bp, Artificial Sequence
  Description of Artificial Sequence: Synthetic oligonucleotide
  Target: ATXN1; (+) strand; PAM type: NRG; PAM sequence: GAG
cttcatctataaacggggca

SEQ ID NO: 147670 - DNA, 20 bp, Artificial Sequence
  Description of Artificial Sequence: Synthetic oligonucleotide
  Target: ATXN1; (+) strand; PAM type: NRG; PAM sequence: AAG
catctataaacggggcagag

SEQ ID NO: 147671 - DNA, 20 bp, Artificial Sequence
  Description of Artificial Sequence: Synthetic oligonucleotide
  Target: ATXN1; (+) strand; PAM type: NRG; PAM sequence: AGG
atctataaacggggcagaga

SEQ ID NO: 147672 - DNA, 20 bp, Artificial Sequence
  Description of Artificial Sequence: Synthetic oligonucleotide
  Target: ATXN1; (+) strand; PAM type: NRG; PAM sequence: GGG
tctataaacggggcagagaa

SEQ ID NO: 147673 - DNA, 20 bp, Artificial Sequence
  Description of Artificial Sequence: Synthetic oligonucleotide
  Target: ATXN1; (+) strand; PAM type: NRG; PAM sequence: GGG
ctataaacggggcagagaag

SEQ ID NO: 147674 - DNA, 20 bp, Artificial Sequence
  Description of Artificial Sequence: Synthetic oligonucleotide
  Target: ATXN1; (+) strand; PAM type: NRG; PAM sequence: GAG
ataaacggggcagagaaggg

SEQ ID NO: 147675 - DNA, 20 bp, Artificial Sequence
  Description of Artificial Sequence: Synthetic oligonucleotide
  Target: ATXN1; (+) strand; PAM type: NRG; PAM sequence: AAG
aacggggcagagaaggggag

SEQ ID NO: 147676 - DNA, 20 bp, Artificial Sequence
  Description of Artificial Sequence: Synthetic oligonucleotide
  Target: ATXN1; (+) strand; PAM type: NRG; PAM sequence: AGG
acggggcagagaaggggaga

SEQ ID NO: 147677 - DNA, 20 bp, Artificial Sequence
  Description of Artificial Sequence: Synthetic oligonucleotide
  Target: ATXN1; (+) strand; PAM type: NRG; PAM sequence: GAG
ggggcagagaaggggagaag

SEQ ID NO: 147678 - DNA, 20 bp, Artificial Sequence
  Description of Artificial Sequence: Synthetic oligonucleotide
  Target: ATXN1; (+) strand; PAM type: NRG; PAM sequence: TAG
gcagagaaggggagaaggag

SEQ ID NO: 147679 - DNA, 20 bp, Artificial Sequence
  Description of Artificial Sequence: Synthetic oligonucleotide
  Target: ATXN1; (+) strand; PAM type: NRG; PAM sequence: AGG
cagagaaggggagaaggagt

SEQ ID NO: 147680 - DNA, 20 bp, Artificial Sequence
  Description of Artificial Sequence: Synthetic oligonucleotide
  Target: ATXN1; (+) strand; PAM type: NRG; PAM sequence: AAG
ctttaaattcctttacacac

SEQ ID NO: 147681 - DNA, 20 bp, Artificial Sequence
  Description of Artificial Sequence: Synthetic oligonucleotide
  Target: ATXN1; (+) strand; PAM type: NRG; PAM sequence: CAG
aaattcctttacacacaaga

SEQ ID NO: 147682 - DNA, 20 bp, Artificial Sequence
  Description of Artificial Sequence: Synthetic oligonucleotide
  Target: ATXN1; (+) strand; PAM type: NRG; PAM sequence: AGG
aattcctttacacacaagac

SEQ ID NO: 147683 - DNA, 20 bp, Artificial Sequence
  Description of Artificial Sequence: Synthetic oligonucleotide
  Target: ATXN1; (+) strand; PAM type: NRG; PAM sequence: GGG
attcctttacacacaagaca

SEQ ID NO: 147684 - DNA, 20 bp, Artificial Sequence
  Description of Artificial Sequence: Synthetic oligonucleotide
  Target: ATXN1; (+) strand; PAM type: NRG; PAM sequence: TAG
ctcaccactcctattcaaca

SEQ ID NO: 147685 - DNA, 20 bp, Artificial Sequence
  Description of Artificial Sequence: Synthetic oligonucleotide
  Target: ATXN1; (+) strand; PAM type: NRG; PAM sequence: TGG
actcctattcaacatagtgt

SEQ ID NO: 147686 - DNA, 20 bp, Artificial Sequence
  Description of Artificial Sequence: Synthetic oligonucleotide
  Target: ATXN1; (+) strand; PAM type: NRG; PAM sequence: AAG
cctattcaacatagtgttgg

SEQ ID NO: 147687 - DNA, 20 bp, Artificial Sequence
  Description of Artificial Sequence: Synthetic oligonucleotide
  Target: ATXN1; (+) strand; PAM type: NRG; PAM sequence: TGG
caacatagtgttggaagttc

SEQ ID NO: 147688 - DNA, 20 bp, Artificial Sequence
  Description of Artificial Sequence: Synthetic oligonucleotide
  Target: ATXN1; (+) strand; PAM type: NRG; PAM sequence: CAG
atagtgttggaagttctggc

SEQ ID NO: 147689 - DNA, 20 bp, Artificial Sequence
  Description of Artificial Sequence: Synthetic oligonucleotide
  Target: ATXN1; (+) strand; PAM type: NRG; PAM sequence: AGG
tagtgttggaagttctggcc

SEQ ID NO: 147690 - DNA, 20 bp, Artificial Sequence
  Description of Artificial Sequence: Synthetic oligonucleotide
  Target: ATXN1; (+) strand; PAM type: NRG; PAM sequence: GGG
agtgttggaagttctggcca

SEQ ID NO: 147691 - DNA, 20 bp, Artificial Sequence
  Description of Artificial Sequence: Synthetic oligonucleotide
  Target: ATXN1; (+) strand; PAM type: NRG; PAM sequence: CAG
gaagttctggccagggcaat

SEQ ID NO: 147692 - DNA, 20 bp, Artificial Sequence
  Description of Artificial Sequence: Synthetic oligonucleotide
  Target: ATXN1; (+) strand; PAM type: NRG; PAM sequence: AGG
aagttctggccagggcaatc

SEQ ID NO: 147693 - DNA, 20 bp, Artificial Sequence
  Description of Artificial Sequence: Synthetic oligonucleotide
  Target: ATXN1; (+) strand; PAM type: NRG; PAM sequence: CAG
ttctggccagggcaatcagg

SEQ ID NO: 147694 - DNA, 20 bp, Artificial Sequence
  Description of Artificial Sequence: Synthetic oligonucleotide
  Target: ATXN1; (+) strand; PAM type: NRG; PAM sequence: AGG
tctggccagggcaatcaggc

SEQ ID NO: 147695 - DNA, 20 bp, Artificial Sequence
  Description of Artificial Sequence: Synthetic oligonucleotide
  Target: ATXN1; (+) strand; PAM type: NRG; PAM sequence: GAG
tggccagggcaatcaggcag

SEQ ID NO: 147696 - DNA, 20 bp, Artificial Sequence
  Description of Artificial Sequence: Synthetic oligonucleotide
  Target: ATXN1; (+) strand; PAM type: NRG; PAM sequence: AAG
ccagggcaatcaggcaggag

SEQ ID NO: 147697 - DNA, 20 bp, Artificial Sequence
  Description of Artificial Sequence: Synthetic oligonucleotide
  Target: ATXN1; (+) strand; PAM type: NRG; PAM sequence: AGG
cagggcaatcaggcaggaga

SEQ ID NO: 147698 - DNA, 20 bp, Artificial Sequence
  Description of Artificial Sequence: Synthetic oligonucleotide
  Target: ATXN1; (+) strand; PAM type: NRG; PAM sequence: AAG
tcaggcaggagaaggaaata

SEQ ID NO: 147699 - DNA, 20 bp, Artificial Sequence
  Description of Artificial Sequence: Synthetic oligonucleotide
  Target: ATXN1; (+) strand; PAM type: NRG; PAM sequence: GAG
aggcaggagaaggaaataaa

SEQ ID NO: 147700 - DNA, 20 bp, Artificial Sequence
  Description of Artificial Sequence: Synthetic oligonucleotide
  Target: ATXN1; (+) strand; PAM type: NRG; PAM sequence: TAG
ggaaataaagagtattcaat

SEQ ID NO: 147701 - DNA, 20 bp, Artificial Sequence
  Description of Artificial Sequence: Synthetic oligonucleotide
  Target: ATXN1; (+) strand; PAM type: NRG; PAM sequence: AGG
gaaataaagagtattcaatt

SEQ ID NO: 147702 - DNA, 20 bp, Artificial Sequence
  Description of Artificial Sequence: Synthetic oligonucleotide
  Target: ATXN1; (+) strand; PAM type: NRG; PAM sequence: AAG
aaagagtattcaattaggaa

SEQ ID NO: 147703 - DNA, 20 bp, Artificial Sequence
  Description of Artificial Sequence: Synthetic oligonucleotide
  Target: ATXN1; (+) strand; PAM type: NRG; PAM sequence: GAG
agagtattcaattaggaaaa

SEQ ID NO: 147704 - DNA, 20 bp, Artificial Sequence
  Description of Artificial Sequence: Synthetic oligonucleotide
  Target: ATXN1; (+) strand; PAM type: NRG; PAM sequence: AGG
gagtattcaattaggaaaag

SEQ ID NO: 147705 - DNA, 20 bp, Artificial Sequence
  Description of Artificial Sequence: Synthetic oligonucleotide
  Target: ATXN1; (+) strand; PAM type: NRG; PAM sequence: AAG
tattcaattaggaaaagagg

SEQ ID NO: 147706 - DNA, 20 bp, Artificial Sequence
  Description of Artificial Sequence: Synthetic oligonucleotide
  Target: ATXN1; (+) strand; PAM type: NRG; PAM sequence: CAG
agtcaaattgtccctgtttg

SEQ ID NO: 147707 - DNA, 20 bp, Artificial Sequence
  Description of Artificial Sequence: Synthetic oligonucleotide
  Target: ATXN1; (+) strand; PAM type: NRG; PAM sequence: TAG
agatgacatgatcatatatc

SEQ ID NO: 147708 - DNA, 20 bp, Artificial Sequence
  Description of Artificial Sequence: Synthetic oligonucleotide
  Target: ATXN1; (+) strand; PAM type: NRG; PAM sequence: CAG
tctagaaaaccccattgtct

SEQ ID NO: 147709 - DNA, 20 bp, Artificial Sequence
  Description of Artificial Sequence: Synthetic oligonucleotide
  Target: ATXN1; (+) strand; PAM type: NRG; PAM sequence: AAG
gtctcagcccaaatctcctt

SEQ ID NO: 147710 - DNA, 20 bp, Artificial Sequence
  Description of Artificial Sequence: Synthetic oligonucleotide
  Target: ATXN1; (+) strand; PAM type: NRG; PAM sequence: AAG
ccaaatctccttaagctgat

SEQ ID NO: 147711 - DNA, 20 bp, Artificial Sequence
  Description of Artificial Sequence: Synthetic oligonucleotide
  Target: ATXN1; (+) strand; PAM type: NRG; PAM sequence: CAG
cttaagctgataagcaacgt

SEQ ID NO: 147712 - DNA, 20 bp, Artificial Sequence
  Description of Artificial Sequence: Synthetic oligonucleotide
  Target: ATXN1; (+) strand; PAM type: NRG; PAM sequence: AAG
gctgataagcaacgtcagca

SEQ ID NO: 147713 - DNA, 20 bp, Artificial Sequence
  Description of Artificial Sequence: Synthetic oligonucleotide
  Target: ATXN1; (+) strand; PAM type: NRG; PAM sequence: GAG
aagcaacgtcagcaaagtct

SEQ ID NO: 147714 - DNA, 20 bp, Artificial Sequence
  Description of Artificial Sequence: Synthetic oligonucleotide
  Target: ATXN1; (+) strand; PAM type: NRG; PAM sequence: AGG
agcaacgtcagcaaagtctg

SEQ ID NO: 147715 - DNA, 20 bp, Artificial Sequence
  Description of Artificial Sequence: Synthetic oligonucleotide
  Target: ATXN1; (+) strand; PAM type: NRG; PAM sequence: AAG
aatcaatgtgcaaaaatcac

SEQ ID NO: 147716 - DNA, 20 bp, Artificial Sequence
  Description of Artificial Sequence: Synthetic oligonucleotide
  Target: ATXN1; (+) strand; PAM type: NRG; PAM sequence: CAG
gcattcttatacaccactaa

SEQ ID NO: 147717 - DNA, 20 bp, Artificial Sequence
  Description of Artificial Sequence: Synthetic oligonucleotide
  Target: ATXN1; (+) strand; PAM type: NRG; PAM sequence: CAG
atacaccactaacagacaaa

SEQ ID NO: 147718 - DNA, 20 bp, Artificial Sequence
  Description of Artificial Sequence: Synthetic oligonucleotide
  Target: ATXN1; (+) strand; PAM type: NRG; PAM sequence: GAG
acaccactaacagacaaaca

SEQ ID NO: 147719 - DNA, 20 bp, Artificial Sequence
  Description of Artificial Sequence: Synthetic oligonucleotide
  Target: ATXN1; (+) strand; PAM type: NRG; PAM sequence: GAG
accactaacagacaaacaga

SEQ ID NO: 147720 - DNA, 20 bp, Artificial Sequence
  Description of Artificial Sequence: Synthetic oligonucleotide
  Target: ATXN1; (+) strand; PAM type: NRG; PAM sequence: GAG
caaacagagagccaaatcat

SEQ ID NO: 147721 - DNA, 20 bp, Artificial Sequence
  Description of Artificial Sequence: Synthetic oligonucleotide
  Target: ATXN1; (+) strand; PAM type: NRG; PAM sequence: AAG
tcctattcacaactgcttca

SEQ ID NO: 147722 - DNA, 20 bp, Artificial Sequence
  Description of Artificial Sequence: Synthetic oligonucleotide
  Target: ATXN1; (+) strand; PAM type: NRG; PAM sequence: GAG
ctattcacaactgcttcaaa

SEQ ID NO: 147723 - DNA, 20 bp, Artificial Sequence
  Description of Artificial Sequence: Synthetic oligonucleotide
  Target: ATXN1; (+) strand; PAM type: NRG; PAM sequence: TAG
ttcaaagagaataaaatacc

SEQ ID NO: 147724 - DNA, 20 bp, Artificial Sequence
  Description of Artificial Sequence: Synthetic oligonucleotide
  Target: ATXN1; (+) strand; PAM type: NRG; PAM sequence: AGG
tcaaagagaataaaatacct

SEQ ID NO: 147725 - DNA, 20 bp, Artificial Sequence
  Description of Artificial Sequence: Synthetic oligonucleotide
  Target: ATXN1; (+) strand; PAM type: NRG; PAM sequence: AAG
tacctaggaatccaacttac

SEQ ID NO: 147726 - DNA, 20 bp, Artificial Sequence
  Description of Artificial Sequence: Synthetic oligonucleotide
  Target: ATXN1; (+) strand; PAM type: NRG; PAM sequence: AGG
acctaggaatccaacttaca

SEQ ID NO: 147727 - DNA, 20 bp, Artificial Sequence
  Description of Artificial Sequence: Synthetic oligonucleotide
  Target: ATXN1; (+) strand; PAM type: NRG; PAM sequence: GGG
cctaggaatccaacttacaa

SEQ ID NO: 147728 - DNA, 20 bp, Artificial Sequence
  Description of Artificial Sequence: Synthetic oligonucleotide
  Target: ATXN1; (+) strand; PAM type: NRG; PAM sequence: AAG
tccaacttacaagggatgtg

SEQ ID NO: 147729 - DNA, 20 bp, Artificial Sequence
  Description of Artificial Sequence: Synthetic oligonucleotide
  Target: ATXN1; (+) strand; PAM type: NRG; PAM sequence: AAG
gggatgtgaagaaccccttc

SEQ ID NO: 147730 - DNA, 20 bp, Artificial Sequence
  Description of Artificial Sequence: Synthetic oligonucleotide
  Target: ATXN1; (+) strand; PAM type: NRG; PAM sequence: AGG
ggatgtgaagaaccccttca

SEQ ID NO: 147731 - DNA, 20 bp, Artificial Sequence
  Description of Artificial Sequence: Synthetic oligonucleotide
  Target: ATXN1; (+) strand; PAM type: NRG; PAM sequence: GAG
atgtgaagaaccccttcaag

SEQ ID NO: 147732 - DNA, 20 bp, Artificial Sequence
  Description of Artificial Sequence: Synthetic oligonucleotide
  Target: ATXN1; (+) strand; PAM type: NRG; PAM sequence: AAG
accactgctcaacgaaataa

SEQ ID NO: 147733 - DNA, 20 bp, Artificial Sequence
  Description of Artificial Sequence: Synthetic oligonucleotide
  Target: ATXN1; (+) strand; PAM type: NRG; PAM sequence: GAG
cactgctcaacgaaataaaa

SEQ ID NO: 147734 - DNA, 20 bp, Artificial Sequence
  Description of Artificial Sequence: Synthetic oligonucleotide
  Target: ATXN1; (+) strand; PAM type: NRG; PAM sequence: AGG
actgctcaacgaaataaaag

SEQ ID NO: 147735 - DNA, 20 bp, Artificial Sequence
  Description of Artificial Sequence: Synthetic oligonucleotide
  Target: ATXN1; (+) strand; PAM type: NRG; PAM sequence: TGG
taaaagaggatacaaacaaa

SEQ ID NO: 147736 - DNA, 20 bp, Artificial Sequence
  Description of Artificial Sequence: Synthetic oligonucleotide
  Target: ATXN1; (+) strand; PAM type: NRG; PAM sequence: AAG
aagaggatacaaacaaatgg

SEQ ID NO: 147737 - DNA, 20 bp, Artificial Sequence
  Description of Artificial Sequence: Synthetic oligonucleotide
  Target: ATXN1; (+) strand; PAM type: NRG; PAM sequence: TGG
ggaagaacattccatgctca

SEQ ID NO: 147738 - DNA, 20 bp, Artificial Sequence
  Description of Artificial Sequence: Synthetic oligonucleotide
  Target: ATXN1; (+) strand; PAM type: NRG; PAM sequence: AAG
gaacattccatgctcatgga

SEQ ID NO: 147739 - DNA, 20 bp, Artificial Sequence
  Description of Artificial Sequence: Synthetic oligonucleotide
  Target: ATXN1; (+) strand; PAM type: NRG; PAM sequence: AGG
aacattccatgctcatggaa

SEQ ID NO: 147740 - DNA, 20 bp, Artificial Sequence
  Description of Artificial Sequence: Synthetic oligonucleotide
  Target: ATXN1; (+) strand; PAM type: NRG; PAM sequence: AAG
attccatgctcatggaaagg

SEQ ID NO: 147741 - DNA, 20 bp, Artificial Sequence
  Description of Artificial Sequence: Synthetic oligonucleotide
  Target: ATXN1; (+) strand; PAM type: NRG; PAM sequence: AAG
ccatgctcatggaaaggaag

SEQ ID NO: 147742 - DNA, 20 bp, Artificial Sequence
  Description of Artificial Sequence: Synthetic oligonucleotide
  Target: ATXN1; (+) strand; PAM type: NRG; PAM sequence: TGG
aagaagcaatatcgtcaaaa

SEQ ID NO: 147743 - DNA, 20 bp, Artificial Sequence
  Description of Artificial Sequence: Synthetic oligonucleotide
  Target: ATXN1; (+) strand; PAM type: NRG; PAM sequence: AAG
tcaaaatggccatactgccc

SEQ ID NO: 147744 - DNA, 20 bp, Artificial Sequence
  Description of Artificial Sequence: Synthetic oligonucleotide
  Target: ATXN1; (+) strand; PAM type: NRG; PAM sequence: AGG
caaaatggccatactgccca

SEQ ID NO: 147745 - DNA, 20 bp, Artificial Sequence
  Description of Artificial Sequence: Synthetic oligonucleotide
  Target: ATXN1; (+) strand; PAM type: NRG; PAM sequence: TAG
atactgcccaaggtaattta

SEQ ID NO: 147746 - DNA, 20 bp, Artificial Sequence
  Description of Artificial Sequence: Synthetic oligonucleotide
  Target: ATXN1; (+) strand; PAM type: NRG; PAM sequence: AAG
gattcaatgccatccccatc

SEQ ID NO: 147747 - DNA, 20 bp, Artificial Sequence
  Description of Artificial Sequence: Synthetic oligonucleotide
  Target: ATXN1; (+) strand; PAM type: NRG; PAM sequence: CAG
gctaccaatgactttcttca

SEQ ID NO: 147748 - DNA, 20 bp, Artificial Sequence
  Description of Artificial Sequence: Synthetic oligonucleotide
  Target: ATXN1; (+) strand; PAM type: NRG; PAM sequence: TGG
aatgactttcttcacagaat

SEQ ID NO: 147749 - DNA, 20 bp, Artificial Sequence
  Description of Artificial Sequence: Synthetic oligonucleotide
  Target: ATXN1; (+) strand; PAM type: NRG; PAM sequence: AAG
aattggaaaaaactacttta

SEQ ID NO: 147750 - DNA, 20 bp, Artificial Sequence
  Description of Artificial Sequence: Synthetic oligonucleotide
  Target: ATXN1; (+) strand; PAM type: NRG; PAM sequence: TGG
aaactactttaaagttcata

SEQ ID NO: 147751 - DNA, 20 bp, Artificial Sequence
  Description of Artificial Sequence: Synthetic oligonucleotide
  Target: ATXN1; (+) strand; PAM type: NRG; PAM sequence: AAG
aagttcatatggaaccaaaa

SEQ ID NO: 147752 - DNA, 20 bp, Artificial Sequence
  Description of Artificial Sequence: Synthetic oligonucleotide
  Target: ATXN1; (+) strand; PAM type: NRG; PAM sequence: GAG
gttcatatggaaccaaaaaa

SEQ ID NO: 147753 - DNA, 20 bp, Artificial Sequence
  Description of Artificial Sequence: Synthetic oligonucleotide
  Target: ATXN1; (+) strand; PAM type: NRG; PAM sequence: AAG
aaaaaagagcccacattgcc

SEQ ID NO: 147754 - DNA, 20 bp, Artificial Sequence
  Description of Artificial Sequence: Synthetic oligonucleotide
  Target: ATXN1; (+) strand; PAM type: NRG; PAM sequence: AAG
cacattgccaagtcaatcct

SEQ ID NO: 147755 - DNA, 20 bp, Artificial Sequence
  Description of Artificial Sequence: Synthetic oligonucleotide
  Target: ATXN1; (+) strand; PAM type: NRG; PAM sequence: AAG
ccaagtcaatcctaagccaa

SEQ ID NO: 147756 - DNA, 20 bp, Artificial Sequence
  Description of Artificial Sequence: Synthetic oligonucleotide
  Target: ATXN1; (+) strand; PAM type: NRG; PAM sequence: AAG
aatcctaagccaaaagaaca

SEQ ID NO: 147757 - DNA, 20 bp, Artificial Sequence
  Description of Artificial Sequence: Synthetic oligonucleotide
  Target: ATXN1; (+) strand; PAM type: NRG; PAM sequence: TGG
ctaagccaaaagaacaaagc

SEQ ID NO: 147758 - DNA, 20 bp, Artificial Sequence
  Description of Artificial Sequence: Synthetic oligonucleotide
  Target: ATXN1; (+) strand; PAM type: NRG; PAM sequence: GAG
aagccaaaagaacaaagctg

SEQ ID NO: 147759 - DNA, 20 bp, Artificial Sequence
  Description of Artificial Sequence: Synthetic oligonucleotide
  Target: ATXN1; (+) strand; PAM type: NRG; PAM sequence: AGG
agccaaaagaacaaagctgg

SEQ ID NO: 147760 - DNA, 20 bp, Artificial Sequence
  Description of Artificial Sequence: Synthetic oligonucleotide
  Target: ATXN1; (+) strand; PAM type: NRG; PAM sequence: AAG
ctgacttcaaactatactac

SEQ ID NO: 147761 - DNA, 20 bp, Artificial Sequence
  Description of Artificial Sequence: Synthetic oligonucleotide
  Target: ATXN1; (+) strand; PAM type: NRG; PAM sequence: AGG
tgacttcaaactatactaca

SEQ ID NO: 147762 - DNA, 20 bp, Artificial Sequence
  Description of Artificial Sequence: Synthetic oligonucleotide
  Target: ATXN1; (+) strand; PAM type: NRG; PAM sequence: CAG
caaactatactacaaggcta

SEQ ID NO: 147763 - DNA, 20 bp, Artificial Sequence
  Description of Artificial Sequence: Synthetic oligonucleotide
  Target: ATXN1; (+) strand; PAM type: NRG; PAM sequence: CAG
caaggctacagtaatcaaaa

SEQ ID NO: 147764 - DNA, 20 bp, Artificial Sequence
  Description of Artificial Sequence: Synthetic oligonucleotide
  Target: ATXN1; (+) strand; PAM type: NRG; PAM sequence: TGG
ctacagtaatcaaaacagca

SEQ ID NO: 147765 - DNA, 20 bp, Artificial Sequence
  Description of Artificial Sequence: Synthetic oligonucleotide
  Target: ATXN1; (+) strand; PAM type: NRG; PAM sequence: TGG
taatcaaaacagcatggtac

SEQ ID NO: 147766 - DNA, 20 bp, Artificial Sequence
  Description of Artificial Sequence: Synthetic oligonucleotide
  Target: ATXN1; (+) strand; PAM type: NRG; PAM sequence: CAG
gcatggtactggtaccaaaa

SEQ ID NO: 147767 - DNA, 20 bp, Artificial Sequence
  Description of Artificial Sequence: Synthetic oligonucleotide
  Target: ATXN1; (+) strand; PAM type: NRG; PAM sequence: GAG
atggtactggtaccaaaaca

SEQ ID NO: 147768 - DNA, 20 bp, Artificial Sequence
  Description of Artificial Sequence: Synthetic oligonucleotide
  Target: ATXN1; (+) strand; PAM type: NRG; PAM sequence: TAG
ctggtaccaaaacagagata

SEQ ID NO: 147769 - DNA, 20 bp, Artificial Sequence
  Description of Artificial Sequence: Synthetic oligonucleotide
  Target: ATXN1; (+) strand; PAM type: NRG; PAM sequence: TGG
aaaacagagatatagaccaa

SEQ ID NO: 147770 - DNA, 20 bp, Artificial Sequence
  Description of Artificial Sequence: Synthetic oligonucleotide
  Target: ATXN1; (+) strand; PAM type: NRG; PAM sequence: CAG
agagatatagaccaatggaa

SEQ ID NO: 147771 - DNA, 20 bp, Artificial Sequence
  Description of Artificial Sequence: Synthetic oligonucleotide
  Target: ATXN1; (+) strand; PAM type: NRG; PAM sequence: CAG
tatagaccaatggaacagaa

SEQ ID NO: 147772 - DNA, 20 bp, Artificial Sequence
  Description of Artificial Sequence: Synthetic oligonucleotide
  Target: ATXN1; (+) strand; PAM type: NRG; PAM sequence: GAG
tagaccaatggaacagaaca

SEQ ID NO: 147773 - DNA, 20 bp, Artificial Sequence
  Description of Artificial Sequence: Synthetic oligonucleotide
  Target: ATXN1; (+) strand; PAM type: NRG; PAM sequence: CAG
atggaacagaacagagccct

SEQ ID NO: 147774 - DNA, 20 bp, Artificial Sequence
  Description of Artificial Sequence: Synthetic oligonucleotide
  Target: ATXN1; (+) strand; PAM type: NRG; PAM sequence: AAG
ttgacaaacctgacaaaaac

SEQ ID NO: 147775 - DNA, 20 bp, Artificial Sequence
  Description of Artificial Sequence: Synthetic oligonucleotide
  Target: ATXN1; (+) strand; PAM type: NRG; PAM sequence: TGG
aacctgacaaaaacaagaaa

SEQ ID NO: 147776 - DNA, 20 bp, Artificial Sequence
  Description of Artificial Sequence: Synthetic oligonucleotide
  Target: ATXN1; (+) strand; PAM type: NRG; PAM sequence: GGG
acctgacaaaaacaagaaat

SEQ ID NO: 147777 - DNA, 20 bp, Artificial Sequence
  Description of Artificial Sequence: Synthetic oligonucleotide
  Target: ATXN1; (+) strand; PAM type: NRG; PAM sequence: GGG
cctgacaaaaacaagaaatg

SEQ ID NO: 147778 - DNA, 20 bp, Artificial Sequence
  Description of Artificial Sequence: Synthetic oligonucleotide
  Target: ATXN1; (+) strand; PAM type: NRG; PAM sequence: AAG
acaaaaacaagaaatgggga

SEQ ID NO: 147779 - DNA, 20 bp, Artificial Sequence
  Description of Artificial Sequence: Synthetic oligonucleotide
  Target: ATXN1; (+) strand; PAM type: NRG; PAM sequence: AGG
caaaaacaagaaatggggaa

SEQ ID NO: 147780 - DNA, 20 bp, Artificial Sequence
  Description of Artificial Sequence: Synthetic oligonucleotide
  Target: ATXN1; (+) strand; PAM type: NRG; PAM sequence: TGG
aggattccctatttaataaa

SEQ ID NO: 147781 - DNA, 20 bp, Artificial Sequence
  Description of Artificial Sequence: Synthetic oligonucleotide
  Target: ATXN1; (+) strand; PAM type: NRG; PAM sequence: TGG
ccctatttaataaatggtgc

SEQ ID NO: 147782 - DNA, 20 bp, Artificial Sequence
  Description of Artificial Sequence: Synthetic oligonucleotide
  Target: ATXN1; (+) strand; PAM type: NRG; PAM sequence: GGG
cctatttaataaatggtgct

SEQ ID NO: 147783 - DNA, 20 bp, Artificial Sequence
  Description of Artificial Sequence: Synthetic oligonucleotide
  Target: ATXN1; (+) strand; PAM type: NRG; PAM sequence: TGG
ataaatggtgctgggaaaac

SEQ ID NO: 147784 - DNA, 20 bp, Artificial Sequence
  Description of Artificial Sequence: Synthetic oligonucleotide
  Target: ATXN1; (+) strand; PAM type: NRG; PAM sequence: TAG
atggtgctgggaaaactggc

SEQ ID NO: 147785 - DNA, 20 bp, Artificial Sequence
  Description of Artificial Sequence: Synthetic oligonucleotide
  Target: ATXN1; (+) strand; PAM type: NRG; PAM sequence: TAG
gaaaactggctagccatatg

SEQ ID NO: 147786 - DNA, 20 bp, Artificial Sequence
  Description of Artificial Sequence: Synthetic oligonucleotide
  Target: ATXN1; (+) strand; PAM type: NRG; PAM sequence: AAG
actggctagccatatgtaga

SEQ ID NO: 147787 - DNA, 20 bp, Artificial Sequence
  Description of Artificial Sequence: Synthetic oligonucleotide
  Target: ATXN1; (+) strand; PAM type: NRG; PAM sequence: AAG
ccttatacaaaaattaattc

SEQ ID NO: 147788 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattaattcaaga

SEQ ID NO: 147789 - DNA, 20 bp, Artificial Sequence
  Description of Artificial Sequence: Synthetic oligonucleotide
  Target: ATXN1; (+) strand; PAM type: NRG; PAM sequence: AAG
aattaattcaagatggatta

SEQ ID NO: 147790 - DNA, 20 bp, Artificial Sequence
  Description of Artificial Sequence: Synthetic oligonucleotide
  Target: ATXN1; (+) strand; PAM type: NRG; PAM sequence: TAG
tggattaaagacttaaatgt

SEQ ID NO: 147791 - DNA, 20 bp, Artificial Sequence
  Description of Artificial Sequence: Synthetic oligonucleotide
  Target: ATXN1; (+) strand; PAM type: NRG; PAM sequence: TAG
acctaaaaccataaaaaccc

SEQ ID NO: 147792 - DNA, 20 bp, Artificial Sequence
  Description of Artificial Sequence: Synthetic oligonucleotide
  Target: ATXN1; (+) strand; PAM type: NRG; PAM sequence: AAG
taaaaccataaaaaccctag

SEQ ID NO: 147793 - DNA, 20 bp, Artificial Sequence
  Description of Artificial Sequence: Synthetic oligonucleotide
  Target: ATXN1; (+) strand; PAM type: NRG; PAM sequence: TAG
aaaaaccctagaagaaaacc

SEQ ID NO: 147794 - DNA, 20 bp, Artificial Sequence
  Description of Artificial Sequence: Synthetic oligonucleotide
  Target: ATXN1; (+) strand; PAM type: NRG; PAM sequence: AGG
aaaaccctagaagaaaacct

SEQ ID NO: 147795 - DNA, 20 bp, Artificial Sequence
  Description of Artificial Sequence: Synthetic oligonucleotide
  Target: ATXN1; (+) strand; PAM type: NRG; PAM sequence: CAG
aaaacctaggcaataccatt

SEQ ID NO: 147796 - DNA, 20 bp, Artificial Sequence
  Description of Artificial Sequence: Synthetic oligonucleotide
  Target: ATXN1; (+) strand; PAM type: NRG; PAM sequence: AGG
aaacctaggcaataccattc

SEQ ID NO: 147797 - DNA, 20 bp, Artificial Sequence
  Description of Artificial Sequence: Synthetic oligonucleotide
  Target: ATXN1; (+) strand; PAM type: NRG; PAM sequence: TAG
aggcaataccattcaggaca

SEQ ID NO: 147798 - DNA, 20 bp, Artificial Sequence
  Description of Artificial Sequence: Synthetic oligonucleotide
  Target: ATXN1; (+) strand; PAM type: NRG; PAM sequence: AGG
ggcaataccattcaggacat

SEQ ID NO: 147799 - DNA, 20 bp, Artificial Sequence
  Description of Artificial Sequence: Synthetic oligonucleotide
  Target: ATXN1; (+) strand; PAM type: NRG; PAM sequence: TGG
taccattcaggacataggca

SEQ ID NO: 147800 - DNA, 20 bp, Artificial Sequence
  Description of Artificial Sequence: Synthetic oligonucleotide
  Target: ATXN1; (+) strand; PAM type: NRG; PAM sequence: GGG
accattcaggacataggcat

SEQ ID NO: 147801 - DNA, 20 bp, Artificial Sequence
  Description of Artificial Sequence: Synthetic oligonucleotide
  Target: ATXN1; (+) strand; PAM type: NRG; PAM sequence: AAG
cttcatgtctaaaacaccaa

SEQ ID NO: 147802 - DNA, 20 bp, Artificial Sequence
  Description of Artificial Sequence: Synthetic oligonucleotide
  Target: ATXN1; (+) strand; PAM type: NRG; PAM sequence: TGG
gtctaaaacaccaaaagcaa

SEQ ID NO: 147803 - DNA, 20 bp, Artificial Sequence
  Description of Artificial Sequence: Synthetic oligonucleotide
  Target: ATXN1; (+) strand; PAM type: NRG; PAM sequence: AAG
accaaaagcaatggcaacaa

SEQ ID NO: 147804 - DNA, 20 bp, Artificial Sequence
  Description of Artificial Sequence: Synthetic oligonucleotide
  Target: ATXN1; (+) strand; PAM type: NRG; PAM sequence: TGG
caaaagccaaaattgtcaaa

SEQ ID NO: 147805 - DNA, 20 bp, Artificial Sequence
  Description of Artificial Sequence: Synthetic oligonucleotide
  Target: ATXN1; (+) strand; PAM type: NRG; PAM sequence: GGG
aaaagccaaaattgtcaaat

SEQ ID NO: 147806 - DNA, 20 bp, Artificial Sequence
  Description of Artificial Sequence: Synthetic oligonucleotide
  Target: ATXN1; (+) strand; PAM type: NRG; PAM sequence: AAG
aatgggatctaattaaacta

SEQ ID NO: 147807 - DNA, 20 bp, Artificial Sequence
  Description of Artificial Sequence: Synthetic oligonucleotide
  Target: ATXN1; (+) strand; PAM type: NRG; PAM sequence: GAG
tgggatctaattaaactaaa

SEQ ID NO: 147808 - DNA, 20 bp, Artificial Sequence
  Description of Artificial Sequence: Synthetic oligonucleotide
  Target: ATXN1; (+) strand; PAM type: NRG; PAM sequence: CAG
taaactaaagagcttctgca

SEQ ID NO: 147809 - DNA, 20 bp, Artificial Sequence
  Description of Artificial Sequence: Synthetic oligonucleotide
  Target: ATXN1; (+) strand; PAM type: NRG; PAM sequence: AAG
aaagagcttctgcacagcca

SEQ ID NO: 147810 - DNA, 20 bp, Artificial Sequence
  Description of Artificial Sequence: Synthetic oligonucleotide
  Target: ATXN1; (+) strand; PAM type: NRG; PAM sequence: CGG
acagccaaagaaactaccat

SEQ ID NO: 147811 - DNA, 20 bp, Artificial Sequence
  Description of Artificial Sequence: Synthetic oligonucleotide
  Target: ATXN1; (+) strand; PAM type: NRG; PAM sequence: GAG
agccaaagaaactaccatcg

SEQ ID NO: 147812 - DNA, 20 bp, Artificial Sequence
  Description of Artificial Sequence: Synthetic oligonucleotide
  Target: ATXN1; (+) strand; PAM type: NRG; PAM sequence: CAG
gaaactaccatcggagtgaa

SEQ ID NO: 147813 - DNA, 20 bp, Artificial Sequence
  Description of Artificial Sequence: Synthetic oligonucleotide
  Target: ATXN1; (+) strand; PAM type: NRG; PAM sequence: AGG
aaactaccatcggagtgaac

SEQ ID NO: 147814 - DNA, 20 bp, Artificial Sequence
  Description of Artificial Sequence: Synthetic oligonucleotide
  Target: ATXN1; (+) strand; PAM type: NRG; PAM sequence: CAG
cggagtgaacaggcaaccta

SEQ ID NO: 147815 - DNA, 20 bp, Artificial Sequence
  Description of Artificial Sequence: Synthetic oligonucleotide
  Target: ATXN1; (+) strand; PAM type: NRG; PAM sequence: TGG
tgaacaggcaacctacagaa

SEQ ID NO: 147816 - DNA, 20 bp, Artificial Sequence
  Description of Artificial Sequence: Synthetic oligonucleotide
  Target: ATXN1; (+) strand; PAM type: NRG; PAM sequence: GGG
gaacaggcaacctacagaat

SEQ ID NO: 147817 - DNA, 20 bp, Artificial Sequence
  Description of Artificial Sequence: Synthetic oligonucleotide
  Target: ATXN1; (+) strand; PAM type: NRG; PAM sequence: GAG
acaggcaacctacagaatgg

SEQ ID NO: 147818 - DNA, 20 bp, Artificial Sequence
  Description of Artificial Sequence: Synthetic oligonucleotide
  Target: ATXN1; (+) strand; PAM type: NRG; PAM sequence: CGG
aatttttgcaatctactcat

SEQ ID NO: 147819 - DNA, 20 bp, Artificial Sequence
  Description of Artificial Sequence: Synthetic oligonucleotide
  Target: ATXN1; (+) strand; PAM type: NRG; PAM sequence: AAG
tgcaatctactcatcggaca

SEQ ID NO: 147820 - DNA, 20 bp, Artificial Sequence
  Description of Artificial Sequence: Synthetic oligonucleotide
  Target: ATXN1; (+) strand; PAM type: NRG; PAM sequence: AGG
gcaatctactcatcggacaa

SEQ ID NO: 147821 - DNA, 20 bp, Artificial Sequence
  Description of Artificial Sequence: Synthetic oligonucleotide
  Target: ATXN1; (+) strand; PAM type: NRG; PAM sequence: GGG
caatctactcatcggacaaa

SEQ ID NO: 147822 - DNA, 20 bp, Artificial Sequence
  Description of Artificial Sequence: Synthetic oligonucleotide
  Target: ATXN1; (+) strand; PAM type: NRG; PAM sequence: CAG
tcggacaaagggctaatatc

SEQ ID NO: 147823 - DNA, 20 bp, Artificial Sequence
  Description of Artificial Sequence: Synthetic oligonucleotide
  Target: ATXN1; (+) strand; PAM type: NRG; PAM sequence: AAG
gctaatatccagaatctaca

SEQ ID NO: 147824 - DNA, 20 bp, Artificial Sequence
  Description of Artificial Sequence: Synthetic oligonucleotide
  Target: ATXN1; (+) strand; PAM type: NRG; PAM sequence: AAG
aagaactcaaacaaatttac

SEQ ID NO: 147825 - DNA, 20 bp, Artificial Sequence
  Description of Artificial Sequence: Synthetic oligonucleotide
  Target: ATXN1; (+) strand; PAM type: NRG; PAM sequence: AAG
aaacaaacaaccccatcaaa

SEQ ID NO: 147826 - DNA, 20 bp, Artificial Sequence
  Description of Artificial Sequence: Synthetic oligonucleotide
  Target: ATXN1; (+) strand; PAM type: NRG; PAM sequence: TGG
caaacaaccccatcaaaaag

SEQ ID NO: 147827 - DNA, 20 bp, Artificial Sequence
  Description of Artificial Sequence: Synthetic oligonucleotide
  Target: ATXN1; (+) strand; PAM type: NRG; PAM sequence: GGG
aaacaaccccatcaaaaagt

SEQ ID NO: 147828 - DNA, 20 bp, Artificial Sequence
  Description of Artificial Sequence: Synthetic oligonucleotide
  Target: ATXN1; (+) strand; PAM type: NRG; PAM sequence: AAG
accccatcaaaaagtgggcg

SEQ ID NO: 147829 - DNA, 20 bp, Artificial Sequence
  Description of Artificial Sequence: Synthetic oligonucleotide
  Target: ATXN1; (+) strand; PAM type: NRG; PAM sequence: AGG
ccccatcaaaaagtgggcga

SEQ ID NO: 147830 - DNA, 20 bp, Artificial Sequence
  Description of Artificial Sequence: Synthetic oligonucleotide
  Target: ATXN1; (+) strand; PAM type: NRG; PAM sequence: TAG
aagtgggcgaaggatatgaa

SEQ ID NO: 147831 - DNA, 20 bp, Artificial Sequence
  Description of Artificial Sequence: Synthetic oligonucleotide
  Target: ATXN1; (+) strand; PAM type: NRG; PAM sequence: AAG
tatgaatagacacttctcaa

SEQ ID NO: 147832 - DNA, 20 bp, Artificial Sequence
  Description of Artificial Sequence: Synthetic oligonucleotide
  Target: ATXN1; (+) strand; PAM type: NRG; PAM sequence: AAG
gaatagacacttctcaaaag

SEQ ID NO: 147833 - DNA, 20 bp, Artificial Sequence
  Description of Artificial Sequence: Synthetic oligonucleotide
  Target: ATXN1; (+) strand; PAM type: NRG; PAM sequence: CAG
ctcaaaagaagacatttatg

SEQ ID NO: 147834 - DNA, 20 bp, Artificial Sequence
  Description of Artificial Sequence: Synthetic oligonucleotide
  Target: ATXN1; (+) strand; PAM type: NRG; PAM sequence: AAG
gaagacatttatgcagccaa

SEQ ID NO: 147835 - DNA, 20 bp, Artificial Sequence
  Description of Artificial Sequence: Synthetic oligonucleotide
  Target: ATXN1; (+) strand; PAM type: NRG; PAM sequence: TGG
caaaaaatgctcatcatcac

SEQ ID NO: 147836 - DNA, 20 bp, Artificial Sequence
  Description of Artificial Sequence: Synthetic oligonucleotide
  Target: ATXN1; (+) strand; PAM type: NRG; PAM sequence: CAG
tgctcatcatcactggccat

SEQ ID NO: 147837 - DNA, 20 bp, Artificial Sequence
  Description of Artificial Sequence: Synthetic oligonucleotide
  Target: ATXN1; (+) strand; PAM type: NRG; PAM sequence: GAG
ctcatcatcactggccatca

SEQ ID NO: 147838 - DNA, 20 bp, Artificial Sequence
  Description of Artificial Sequence: Synthetic oligonucleotide
  Target: ATXN1; (+) strand; PAM type: NRG; PAM sequence: CAG
aatgacataccatctcacac

SEQ ID NO: 147839 - DNA, 20 bp, Artificial Sequence
  Description of Artificial Sequence: Synthetic oligonucleotide
  Target: ATXN1; (+) strand; PAM type: NRG; PAM sequence: TAG
acataccatctcacaccagt

SEQ ID NO: 147840 - DNA, 20 bp, Artificial Sequence
  Description of Artificial Sequence: Synthetic oligonucleotide
  Target: ATXN1; (+) strand; PAM type: NRG; PAM sequence: TGG
ccatctcacaccagttagaa

SEQ ID NO: 147841 - DNA, 20 bp, Artificial Sequence
  Description of Artificial Sequence: Synthetic oligonucleotide
  Target: ATXN1; (+) strand; PAM type: NRG; PAM sequence: AAG
ttagaatggcaatcattaaa

SEQ ID NO: 147842 - DNA, 20 bp, Artificial Sequence
  Description of Artificial Sequence: Synthetic oligonucleotide
  Target: ATXN1; (+) strand; PAM type: NRG; PAM sequence: CAG
aatggcaatcattaaaaagt

SEQ ID NO: 147843 - DNA, 20 bp, Artificial Sequence
  Description of Artificial Sequence: Synthetic oligonucleotide
  Target: ATXN1; (+) strand; PAM type: NRG; PAM sequence: AGG
atggcaatcattaaaaagtc

SEQ ID NO: 147844 - DNA, 20 bp, Artificial Sequence
  Description of Artificial Sequence: Synthetic oligonucleotide
  Target: ATXN1; (+) strand; PAM type: NRG; PAM sequence: CAG
attaaaaagtcaggaaacaa

SEQ ID NO: 147845 - DNA, 20 bp, Artificial Sequence
  Description of Artificial Sequence: Synthetic oligonucleotide
  Target: ATXN1; (+) strand; PAM type: NRG; PAM sequence: AGG
ttaaaaagtcaggaaacaac

SEQ ID NO: 147846 - DNA, 20 bp, Artificial Sequence
  Description of Artificial Sequence: Synthetic oligonucleotide
  Target: ATXN1; (+) strand; PAM type: NRG; PAM sequence: TGG
agtcaggaaacaacaggtgc

SEQ ID NO: 147847 - DNA, 20 bp, Artificial Sequence
  Description of Artificial Sequence: Synthetic oligonucleotide
  Target: ATXN1; (+) strand; PAM type: NRG; PAM sequence: GAG
tcaggaaacaacaggtgctg

SEQ ID NO: 147848 - DNA, 20 bp, Artificial Sequence
  Description of Artificial Sequence: Synthetic oligonucleotide
  Target: ATXN1; (+) strand; PAM type: NRG; PAM sequence: GAG
aggaaacaacaggtgctgga

SEQ ID NO: 147849 - DNA, 20 bp, Artificial Sequence
  Description of Artificial Sequence: Synthetic oligonucleotide
  Target: ATXN1; (+) strand; PAM type: NRG; PAM sequence: AGG
ggaaacaacaggtgctggag

SEQ ID NO: 147850 - DNA, 20 bp, Artificial Sequence
  Description of Artificial Sequence: Synthetic oligonucleotide
  Target: ATXN1; (+) strand; PAM type: NRG; PAM sequence: TGG
aacaggtgctggagaggatg

SEQ ID NO: 147851 - DNA, 20 bp, Artificial Sequence
  Description of Artificial Sequence: Synthetic oligonucleotide
  Target: ATXN1; (+) strand; PAM type: NRG; PAM sequence: GAG
caggtgctggagaggatgtg

SEQ ID NO: 147852 - DNA, 20 bp, Artificial Sequence
  Description of Artificial Sequence: Synthetic oligonucleotide
  Target: ATXN1; (+) strand; PAM type: NRG; PAM sequence: TAG
ctggagaggatgtggagaca

SEQ ID NO: 147853 - DNA, 20 bp, Artificial Sequence
  Description of Artificial Sequence: Synthetic oligonucleotide
  Target: ATXN1; (+) strand; PAM type: NRG; PAM sequence: AGG
tggagaggatgtggagacat

SEQ ID NO: 147854 - DNA, 20 bp, Artificial Sequence
  Description of Artificial Sequence: Synthetic oligonucleotide
  Target: ATXN1; (+) strand; PAM type: NRG; PAM sequence: TGG
gaacatttttacactgtttg

SEQ ID NO: 147855 - DNA, 20 bp, Artificial Sequence
  Description of Artificial Sequence: Synthetic oligonucleotide
  Target: ATXN1; (+) strand; PAM type: NRG; PAM sequence: GGG
aacatttttacactgtttgt

SEQ ID NO: 147856 - DNA, 20 bp, Artificial Sequence
  Description of Artificial Sequence: Synthetic oligonucleotide
  Target: ATXN1; (+) strand; PAM type: NRG; PAM sequence: TAG
ctgtttgtgggactgtaaac

SEQ ID NO: 147857 - DNA, 20 bp, Artificial Sequence
  Description of Artificial Sequence: Synthetic oligonucleotide
  Target: ATXN1; (+) strand; PAM type: NRG; PAM sequence: TGG
gtaaactagttcaaccattg

SEQ ID NO: 147858 - DNA, 20 bp, Artificial Sequence
  Description of Artificial Sequence: Synthetic oligonucleotide
  Target: ATXN1; (+) strand; PAM type: NRG; PAM sequence: AAG
aactagttcaaccattgtgg

SEQ ID NO: 147859 - DNA, 20 bp, Artificial Sequence
  Description of Artificial Sequence: Synthetic oligonucleotide
  Target: ATXN1; (+) strand; PAM type: NRG; PAM sequence: CAG
agttcaaccattgtggaagt

SEQ ID NO: 147860 - DNA, 20 bp, Artificial Sequence
  Description of Artificial Sequence: Synthetic oligonucleotide
  Target: ATXN1; (+) strand; PAM type: NRG; PAM sequence: TGG
aaccattgtggaagtcagtg

SEQ ID NO: 147861 - DNA, 20 bp, Artificial Sequence
  Description of Artificial Sequence: Synthetic oligonucleotide
  Target: ATXN1; (+) strand; PAM type: NRG; PAM sequence: CAG
aagtcagtgtggcgattcct

SEQ ID NO: 147862 - DNA, 20 bp, Artificial Sequence
  Description of Artificial Sequence: Synthetic oligonucleotide
  Target: ATXN1; (+) strand; PAM type: NRG; PAM sequence: AGG
agtcagtgtggcgattcctc

SEQ ID NO: 147863 - DNA, 20 bp, Artificial Sequence
  Description of Artificial Sequence: Synthetic oligonucleotide
  Target: ATXN1; (+) strand; PAM type: NRG; PAM sequence: GGG
gtcagtgtggcgattcctca

SEQ ID NO: 147864 - DNA, 20 bp, Artificial Sequence
  Description of Artificial Sequence: Synthetic oligonucleotide
  Target: ATXN1; (+) strand; PAM type: NRG; PAM sequence: TAG
gtggcgattcctcagggatc

SEQ ID NO: 147865 - DNA, 20 bp, Artificial Sequence
  Description of Artificial Sequence: Synthetic oligonucleotide
  Target: ATXN1; (+) strand; PAM type: NRG; PAM sequence: TAG
attcctcagggatctagaac

SEQ ID NO: 147866 - DNA, 20 bp, Artificial Sequence
  Description of Artificial Sequence: Synthetic oligonucleotide
  Target: ATXN1; (+) strand; PAM type: NRG; PAM sequence: CAG
actagaaataccatttgacc

SEQ ID NO: 147867 - DNA, 20 bp, Artificial Sequence
  Description of Artificial Sequence: Synthetic oligonucleotide
  Target: ATXN1; (+) strand; PAM type: NRG; PAM sequence: TGG
tgacccagccatcccattac

SEQ ID NO: 147868 - DNA, 20 bp, Artificial Sequence
  Description of Artificial Sequence: Synthetic oligonucleotide
  Target: ATXN1; (+) strand; PAM type: NRG; PAM sequence: GGG
gacccagccatcccattact

SEQ ID NO: 147869 - DNA, 20 bp, Artificial Sequence
  Description of Artificial Sequence: Synthetic oligonucleotide
  Target: ATXN1; (+) strand; PAM type: NRG; PAM sequence: AAG
cattactgggtatataccaa

SEQ ID NO: 147870 - DNA, 20 bp, Artificial Sequence
  Description of Artificial Sequence: Synthetic oligonucleotide
  Target: ATXN1; (+) strand; PAM type: NRG; PAM sequence: AGG
attactgggtatataccaaa

SEQ ID NO: 147871 - DNA, 20 bp, Artificial Sequence
  Description of Artificial Sequence: Synthetic oligonucleotide
  Target: ATXN1; (+) strand; PAM type: NRG; PAM sequence: GAG
tactgggtatataccaaaag

SEQ ID NO: 147872 - DNA, 20 bp, Artificial Sequence
  Description of Artificial Sequence: Synthetic oligonucleotide
  Target: ATXN1; (+) strand; PAM type: NRG; PAM sequence: AAG
gtataaatcatgctgctata

SEQ ID NO: 147873 - DNA, 20 bp, Artificial Sequence
  Description of Artificial Sequence: Synthetic oligonucleotide
  Target: ATXN1; (+) strand; PAM type: NRG; PAM sequence: CGG
atgcacacgtatgtttattg

SEQ ID NO: 147874 - DNA, 20 bp, Artificial Sequence
  Description of Artificial Sequence: Synthetic oligonucleotide
  Target: ATXN1; (+) strand; PAM type: NRG; PAM sequence: TAG
tattgcggcactattcacaa

SEQ ID NO: 147875 - DNA, 20 bp, Artificial Sequence
  Description of Artificial Sequence: Synthetic oligonucleotide
  Target: ATXN1; (+) strand; PAM type: NRG; PAM sequence: AAG
cggcactattcacaatagca

SEQ ID NO: 147876 - DNA, 20 bp, Artificial Sequence
  Description of Artificial Sequence: Synthetic oligonucleotide
  Target: ATXN1; (+) strand; PAM type: NRG; PAM sequence: TGG
tattcacaatagcaaagact

SEQ ID NO: 147877 - DNA, 20 bp, Artificial Sequence
  Description of Artificial Sequence: Synthetic oligonucleotide
  Target: ATXN1; (+) strand; PAM type: NRG; PAM sequence: AAG
caacaatgataaactgcatt

SEQ ID NO: 147878 - DNA, 20 bp, Artificial Sequence
  Description of Artificial Sequence: Synthetic oligonucleotide
  Target: ATXN1; (+) strand; PAM type: NRG; PAM sequence: TGG
taaactgcattaagaaaatg

SEQ ID NO: 147879 - DNA, 20 bp, Artificial Sequence
  Description of Artificial Sequence: Synthetic oligonucleotide
  Target: ATXN1; (+) strand; PAM type: NRG; PAM sequence: CAG
aaaatgtggcacatacacac

SEQ ID NO: 147880 - DNA, 20 bp, Artificial Sequence
  Description of Artificial Sequence: Synthetic oligonucleotide
  Target: ATXN1; (+) strand; PAM type: NRG; PAM sequence: AGG
aaatgtggcacatacacacc

SEQ ID NO: 147881 - DNA, 20 bp, Artificial Sequence
  Description of Artificial Sequence: Synthetic oligonucleotide
  Target: ATXN1; (+) strand; PAM type: NRG; PAM sequence: GGG
aatgtggcacatacacacca

SEQ ID NO: 147882 - DNA, 20 bp, Artificial Sequence
  Description of Artificial Sequence: Synthetic oligonucleotide
  Target: ATXN1; (+) strand; PAM type: NRG; PAM sequence: CAG
acacaccagggaatactatg

SEQ ID NO: 147883 - DNA, 20 bp, Artificial Sequence
  Description of Artificial Sequence: Synthetic oligonucleotide
  Target: ATXN1; (+) strand; PAM type: NRG; PAM sequence: GAG
atgcagccataaaaaatgat

SEQ ID NO: 147884 - DNA, 20 bp, Artificial Sequence
  Description of Artificial Sequence: Synthetic oligonucleotide
  Target: ATXN1; (+) strand; PAM type: NRG; PAM sequence: TAG
tgatgagttcatgtcctttg

SEQ ID NO: 147885 - DNA, 20 bp, Artificial Sequence
  Description of Artificial Sequence: Synthetic oligonucleotide
  Target: ATXN1; (+) strand; PAM type: NRG; PAM sequence: AGG
gatgagttcatgtcctttgt

SEQ ID NO: 147886 - DNA, 20 bp, Artificial Sequence
  Description of Artificial Sequence: Synthetic oligonucleotide
  Target: ATXN1; (+) strand; PAM type: NRG; PAM sequence: GGG
atgagttcatgtcctttgta

SEQ ID NO: 147887 - DNA, 20 bp, Artificial Sequence
  Description of Artificial Sequence: Synthetic oligonucleotide
  Target: ATXN1; (+) strand; PAM type: NRG; PAM sequence: TGG
tcatgtcctttgtagggaca

SEQ ID NO: 147888 - DNA, 20 bp, Artificial Sequence
  Description of Artificial Sequence: Synthetic oligonucleotide
  Target: ATXN1; (+) strand; PAM type: NRG; PAM sequence: AAG
cctttgtagggacatggatg

SEQ ID NO: 147889 - DNA, 20 bp, Artificial Sequence
  Description of Artificial Sequence: Synthetic oligonucleotide
  Target: ATXN1; (+) strand; PAM type: NRG; PAM sequence: TGG
tgtagggacatggatgaagc

SEQ ID NO: 147890 - DNA, 20 bp, Artificial Sequence
  Description of Artificial Sequence: Synthetic oligonucleotide
  Target: ATXN1; (+) strand; PAM type: NRG; PAM sequence: CAG
aagctggaaaccatcattct

SEQ ID NO: 147891 - DNA, 20 bp, Artificial Sequence
  Description of Artificial Sequence: Synthetic oligonucleotide
  Target: ATXN1; (+) strand; PAM type: NRG; PAM sequence: AAG
cattctcagcaaactatcgc

SEQ ID NO: 147892 - DNA, 20 bp, Artificial Sequence
  Description of Artificial Sequence: Synthetic oligonucleotide
  Target: ATXN1; (+) strand; PAM type: NRG; PAM sequence: AGG
attctcagcaaactatcgca

SEQ ID NO: 147893 - DNA, 20 bp, Artificial Sequence
  Description of Artificial Sequence: Synthetic oligonucleotide
  Target: ATXN1; (+) strand; PAM type: NRG; PAM sequence: TAG
acaccgcatgttctcactca

SEQ ID NO: 147894 - DNA, 20 bp, Artificial Sequence
  Description of Artificial Sequence: Synthetic oligonucleotide
  Target: ATXN1; (+) strand; PAM type: NRG; PAM sequence: AGG
caccgcatgttctcactcat

SEQ ID NO: 147895 - DNA, 20 bp, Artificial Sequence
  Description of Artificial Sequence: Synthetic oligonucleotide
  Target: ATXN1; (+) strand; PAM type: NRG; PAM sequence: TGG
cgcatgttctcactcatagg

SEQ ID NO: 147896 - DNA, 20 bp, Artificial Sequence
  Description of Artificial Sequence: Synthetic oligonucleotide
  Target: ATXN1; (+) strand; PAM type: NRG; PAM sequence: GGG
gcatgttctcactcataggt

SEQ ID NO: 147897 - DNA, 20 bp, Artificial Sequence
  Description of Artificial Sequence: Synthetic oligonucleotide
  Target: ATXN1; (+) strand; PAM type: NRG; PAM sequence: GAG
ataggtgggaattgaacaat

SEQ ID NO: 147898 - DNA, 20 bp, Artificial Sequence
  Description of Artificial Sequence: Synthetic oligonucleotide
  Target: ATXN1; (+) strand; PAM type: NRG; PAM sequence: TGG
aattgaacaatgagaacact

SEQ ID NO: 147899 - DNA, 20 bp, Artificial Sequence
  Description of Artificial Sequence: Synthetic oligonucleotide
  Target: ATXN1; (+) strand; PAM type: NRG; PAM sequence: GGG
attgaacaatgagaacactt

SEQ ID NO: 147900 - DNA, 20 bp, Artificial Sequence
  Description of Artificial Sequence: Synthetic oligonucleotide
  Target: ATXN1; (+) strand; PAM type: NRG; PAM sequence: CAG
acaatgagaacacttgggca

SEQ ID NO: 147901 - DNA, 20 bp, Artificial Sequence
  Description of Artificial Sequence: Synthetic oligonucleotide
  Target: ATXN1; (+) strand; PAM type: NRG; PAM sequence: AGG
caatgagaacacttgggcac

SEQ ID NO: 147902 - DNA, 20 bp, Artificial Sequence
  Description of Artificial Sequence: Synthetic oligonucleotide
  Target: ATXN1; (+) strand; PAM type: NRG; PAM sequence: AAG
tgagaacacttgggcacagg

SEQ ID NO: 147903 - DNA, 20 bp, Artificial Sequence
  Description of Artificial Sequence: Synthetic oligonucleotide
  Target: ATXN1; (+) strand; PAM type: NRG; PAM sequence: AGG
gagaacacttgggcacagga

SEQ ID NO: 147904 - DNA, 20 bp, Artificial Sequence
  Description of Artificial Sequence: Synthetic oligonucleotide
  Target: ATXN1; (+) strand; PAM type: NRG; PAM sequence: GGG
agaacacttgggcacaggaa

SEQ ID NO: 147905 - DNA, 20 bp, Artificial Sequence
  Description of Artificial Sequence: Synthetic oligonucleotide
  Target: ATXN1; (+) strand; PAM type: NRG; PAM sequence: GGG
gaacacttgggcacaggaag

SEQ ID NO: 147906 - DNA, 20 bp, Artificial Sequence
  Description of Artificial Sequence: Synthetic oligonucleotide
  Target: ATXN1; (+) strand; PAM type: NRG; PAM sequence: CAG
ggaaggggaacaccacaccc

SEQ ID NO: 147907 - DNA, 20 bp, Artificial Sequence
  Description of Artificial Sequence: Synthetic oligonucleotide
  Target: ATXN1; (+) strand; PAM type: NRG; PAM sequence: AGG
gaaggggaacaccacacccc

SEQ ID NO: 147908 - DNA, 20 bp, Artificial Sequence
  Description of Artificial Sequence: Synthetic oligonucleotide
  Target: ATXN1; (+) strand; PAM type: NRG; PAM sequence: GGG
aaggggaacaccacacccca

SEQ ID NO: 147909 - DNA, 20 bp, Artificial Sequence
  Description of Artificial Sequence: Synthetic oligonucleotide
  Target: ATXN1; (+) strand; PAM type: NRG; PAM sequence: TGG
ccacaccccagggcctgttg

SEQ ID NO: 147910 - DNA, 20 bp, Artificial Sequence
  Description of Artificial Sequence: Synthetic oligonucleotide
  Target: ATXN1; (+) strand; PAM type: NRG; PAM sequence: GGG
cacaccccagggcctgttgt

SEQ ID NO: 147911 - DNA, 20 bp, Artificial Sequence
  Description of Artificial Sequence: Synthetic oligonucleotide
  Target: ATXN1; (+) strand; PAM type: NRG; PAM sequence: GGG
acaccccagggcctgttgtg

SEQ ID NO: 147912 - DNA, 20 bp, Artificial Sequence
  Description of Artificial Sequence: Synthetic oligonucleotide
  Target: ATXN1; (+) strand; PAM type: NRG; PAM sequence: TGG
ccccagggcctgttgtgggg

SEQ ID NO: 147913 - DNA, 20 bp, Artificial Sequence
  Description of Artificial Sequence: Synthetic oligonucleotide
  Target: ATXN1; (+) strand; PAM type: NRG; PAM sequence: GGG
cccagggcctgttgtggggt

SEQ ID NO: 147914 - DNA, 20 bp, Artificial Sequence
  Description of Artificial Sequence: Synthetic oligonucleotide
  Target: ATXN1; (+) strand; PAM type: NRG; PAM sequence: GGG
ccagggcctgttgtggggtg

SEQ ID NO: 147915 - DNA, 20 bp, Artificial Sequence
  Description of Artificial Sequence: Synthetic oligonucleotide
  Target: ATXN1; (+) strand; PAM type: NRG; PAM sequence: GGG
cagggcctgttgtggggtgg

SEQ ID NO: 147916 - DNA, 20 bp, Artificial Sequence
  Description of Artificial Sequence: Synthetic oligonucleotide
  Target: ATXN1; (+) strand; PAM type: NRG; PAM sequence: GGG
agggcctgttgtggggtggg

SEQ ID NO: 147917 - DNA, 20 bp, Artificial Sequence
  Description of Artificial Sequence: Synthetic oligonucleotide
  Target: ATXN1; (+) strand; PAM type: NRG; PAM sequence: AAG
gcctgttgtggggtgggggg

SEQ ID NO: 147918 - DNA, 20 bp, Artificial Sequence
  Description of Artificial Sequence: Synthetic oligonucleotide
  Target: ATXN1; (+) strand; PAM type: NRG; PAM sequence: AGG
cctgttgtggggtgggggga

SEQ ID NO: 147919 - DNA, 20 bp, Artificial Sequence
  Description of Artificial Sequence: Synthetic oligonucleotide
  Target: ATXN1; (+) strand; PAM type: NRG; PAM sequence: GGG
ctgttgtggggtggggggaa

SEQ ID NO: 147920 - DNA, 20 bp, Artificial Sequence
  Description of Artificial Sequence: Synthetic oligonucleotide
  Target: ATXN1; (+) strand; PAM type: NRG; PAM sequence: GGG
tgttgtggggtggggggaag

SEQ ID NO: 147921 - DNA, 20 bp, Artificial Sequence
  Description of Artificial Sequence: Synthetic oligonucleotide
  Target: ATXN1; (+) strand; PAM type: NRG; PAM sequence: GGG
gttgtggggtggggggaagg

SEQ ID NO: 147922 - DNA, 20 bp, Artificial Sequence
  Description of Artificial Sequence: Synthetic oligonucleotide
  Target: ATXN1; (+) strand; PAM type: NRG; PAM sequence: GAG
tgtggggtggggggaagggg

SEQ ID NO: 147923 - DNA, 20 bp, Artificial Sequence
  Description of Artificial Sequence: Synthetic oligonucleotide
  Target: ATXN1; (+) strand; PAM type: NRG; PAM sequence: AGG
gtggggtggggggaaggggg

SEQ ID NO: 147924 - DNA, 20 bp, Artificial Sequence
  Description of Artificial Sequence: Synthetic oligonucleotide
  Target: ATXN1; (+) strand; PAM type: NRG; PAM sequence: GGG
tggggtggggggaaggggga

SEQ ID NO: 147925 - DNA, 20 bp, Artificial Sequence
  Description of Artificial Sequence: Synthetic oligonucleotide
  Target: ATXN1; (+) strand; PAM type: NRG; PAM sequence: TAG
gtggggggaagggggaggga

SEQ ID NO: 147926 - DNA, 20 bp, Artificial Sequence
  Description of Artificial Sequence: Synthetic oligonucleotide
  Target: ATXN1; (+) strand; PAM type: NRG; PAM sequence: TAG
ggaagggggagggatagcat

SEQ ID NO: 147927 - DNA, 20 bp, Artificial Sequence
  Description of Artificial Sequence: Synthetic oligonucleotide
  Target: ATXN1; (+) strand; PAM type: NRG; PAM sequence: AGG
gaagggggagggatagcatt

SEQ ID NO: 147928 - DNA, 20 bp, Artificial Sequence
  Description of Artificial Sequence: Synthetic oligonucleotide
  Target: ATXN1; (+) strand; PAM type: NRG; PAM sequence: GAG
agggggagggatagcattag

SEQ ID NO: 147929 - DNA, 20 bp, Artificial Sequence
  Description of Artificial Sequence: Synthetic oligonucleotide
  Target: ATXN1; (+) strand; PAM type: NRG; PAM sequence: TGG
taatgtaaatgacgatttaa

SEQ ID NO: 147930 - DNA, 20 bp, Artificial Sequence
  Description of Artificial Sequence: Synthetic oligonucleotide
  Target: ATXN1; (+) strand; PAM type: NRG; PAM sequence: GGG
aatgtaaatgacgatttaat

SEQ ID NO: 147931 - DNA, 20 bp, Artificial Sequence
  Description of Artificial Sequence: Synthetic oligonucleotide
  Target: ATXN1; (+) strand; PAM type: NRG; PAM sequence: CAG
aaatgacgatttaatgggtg

SEQ ID NO: 147932 - DNA, 20 bp, Artificial Sequence
  Description of Artificial Sequence: Synthetic oligonucleotide
  Target: ATXN1; (+) strand; PAM type: NRG; PAM sequence: TGG
atgggtgcagtacaacaaca

SEQ ID NO: 147933 - DNA, 20 bp, Artificial Sequence
  Description of Artificial Sequence: Synthetic oligonucleotide
  Target: ATXN1; (+) strand; PAM type: NRG; PAM sequence: AAG
tacatatgtaacaaacctgc

SEQ ID NO: 147934 - DNA, 20 bp, Artificial Sequence
  Description of Artificial Sequence: Synthetic oligonucleotide
  Target: ATXN1; (+) strand; PAM type: NRG; PAM sequence: AAG
cacatctaccctaaaactta

SEQ ID NO: 147935 - DNA, 20 bp, Artificial Sequence
  Description of Artificial Sequence: Synthetic oligonucleotide
  Target: ATXN1; (+) strand; PAM type: NRG; PAM sequence: AAG
ctctttataacctctatgaa

SEQ ID NO: 147936 - DNA, 20 bp, Artificial Sequence
  Description of Artificial Sequence: Synthetic oligonucleotide
  Target: ATXN1; (+) strand; PAM type: NRG; PAM sequence: TAG
tctatgaaaagtattgcaac

SEQ ID NO: 147937 - DNA, 20 bp, Artificial Sequence
  Description of Artificial Sequence: Synthetic oligonucleotide
  Target: ATXN1; (+) strand; PAM type: NRG; PAM sequence: AGG
ctatgaaaagtattgcaact

SEQ ID NO: 147938 - DNA, 20 bp, Artificial Sequence
  Description of Artificial Sequence: Synthetic oligonucleotide
  Target: ATXN1; (+) strand; PAM type: NRG; PAM sequence: AAG
gaacaaaatcatgtaaacaa

SEQ ID NO: 147939 - DNA, 20 bp, Artificial Sequence
  Description of Artificial Sequence: Synthetic oligonucleotide
  Target: ATXN1; (+) strand; PAM type: NRG; PAM sequence: TGG
aatcatgtaaacaaaagact

SEQ ID NO: 147940 - DNA, 20 bp, Artificial Sequence
  Description of Artificial Sequence: Synthetic oligonucleotide
  Target: ATXN1; (+) strand; PAM type: NRG; PAM sequence: GAG
tcatgtaaacaaaagacttg

SEQ ID NO: 147941 - DNA, 20 bp, Artificial Sequence
  Description of Artificial Sequence: Synthetic oligonucleotide
  Target: ATXN1; (+) strand; PAM type: NRG; PAM sequence: TGG
aattttaacaatgactatac

SEQ ID NO: 147942 - DNA, 20 bp, Artificial Sequence
  Description of Artificial Sequence: Synthetic oligonucleotide
  Target: ATXN1; (+) strand; PAM type: NRG; PAM sequence: GGG
attttaacaatgactatact

SEQ ID NO: 147943 - DNA, 20 bp, Artificial Sequence
  Description of Artificial Sequence: Synthetic oligonucleotide
  Target: ATXN1; (+) strand; PAM type: NRG; PAM sequence: TGG
acaatgactatactgggctg

SEQ ID NO: 147944 - DNA, 20 bp, Artificial Sequence
  Description of Artificial Sequence: Synthetic oligonucleotide
  Target: ATXN1; (+) strand; PAM type: NRG; PAM sequence: GGG
caatgactatactgggctgt

SEQ ID NO: 147945 - DNA, 20 bp, Artificial Sequence
  Description of Artificial Sequence: Synthetic oligonucleotide
  Target: ATXN1; (+) strand; PAM type: NRG; PAM sequence: GGG
aatgactatactgggctgtg

SEQ ID NO: 147946 - DNA, 20 bp, Artificial Sequence
  Description of Artificial Sequence: Synthetic oligonucleotide
  Target: ATXN1; (+) strand; PAM type: NRG; PAM sequence: GGG
atgactatactgggctgtgg

SEQ ID NO: 147947 - DNA, 20 bp, Artificial Sequence
  Description of Artificial Sequence: Synthetic oligonucleotide
  Target: ATXN1; (+) strand; PAM type: NRG; PAM sequence: CAG
aaatgtttcctttctttact

SEQ ID NO: 147948 - DNA, 20 bp, Artificial Sequence
  Description of Artificial Sequence: Synthetic oligonucleotide
  Target: ATXN1; (+) strand; PAM type: NRG; PAM sequence: TAG
tttcctttctttactcagtt

SEQ ID NO: 147949 - DNA, 20 bp, Artificial Sequence
  Description of Artificial Sequence: Synthetic oligonucleotide
  Target: ATXN1; (+) strand; PAM type: NRG; PAM sequence: AGG
ttcctttctttactcagttt

SEQ ID NO: 147950 - DNA, 20 bp, Artificial Sequence
  Description of Artificial Sequence: Synthetic oligonucleotide
  Target: ATXN1; (+) strand; PAM type: NRG; PAM sequence: TAG
gaaactgtgcctataataaa

SEQ ID NO: 147951 - DNA, 20 bp, Artificial Sequence
  Description of Artificial Sequence: Synthetic oligonucleotide
  Target: ATXN1; (+) strand; PAM type: NRG; PAM sequence: TGG
tataataaatagtacatcta

SEQ ID NO: 147952 - DNA, 20 bp, Artificial Sequence
  Description of Artificial Sequence: Synthetic oligonucleotide
  Target: ATXN1; (+) strand; PAM type: NRG; PAM sequence: TGG
ctgaaatgcatatttaaaaa

SEQ ID NO: 147953 - DNA, 20 bp, Artificial Sequence
  Description of Artificial Sequence: Synthetic oligonucleotide
  Target: ATXN1; (+) strand; PAM type: NRG; PAM sequence: AAG
tgcatatttaaaaatggtta

SEQ ID NO: 147954 - DNA, 20 bp, Artificial Sequence
  Description of Artificial Sequence: Synthetic oligonucleotide
  Target: ATXN1; (+) strand; PAM type: NRG; PAM sequence: TGG
atatttaaaaatggttaaag

SEQ ID NO: 147955 - DNA, 20 bp, Artificial Sequence
  Description of Artificial Sequence: Synthetic oligonucleotide
  Target: ATXN1; (+) strand; PAM type: NRG; PAM sequence: GGG
tatttaaaaatggttaaagt

SEQ ID NO: 147956 - DNA, 20 bp, Artificial Sequence
  Description of Artificial Sequence: Synthetic oligonucleotide
  Target: ATXN1; (+) strand; PAM type: NRG; PAM sequence: TGG
taaaaatggttaaagtgggt

SEQ ID NO: 147957 - DNA, 20 bp, Artificial Sequence
  Description of Artificial Sequence: Synthetic oligonucleotide
  Target: ATXN1; (+) strand; PAM type: NRG; PAM sequence: GGG
aaaaatggttaaagtgggtt

SEQ ID NO: 147958 - DNA, 20 bp, Artificial Sequence
  Description of Artificial Sequence: Synthetic oligonucleotide
  Target: ATXN1; (+) strand; PAM type: NRG; PAM sequence: CAG
tggttaaagtgggttgggca

SEQ ID NO: 147959 - DNA, 20 bp, Artificial Sequence
  Description of Artificial Sequence: Synthetic oligonucleotide
  Target: ATXN1; (+) strand; PAM type: NRG; PAM sequence: TGG
ttaaagtgggttgggcacag

SEQ ID NO: 147960 - DNA, 20 bp, Artificial Sequence
  Description of Artificial Sequence: Synthetic oligonucleotide
  Target: ATXN1; (+) strand; PAM type: NRG; PAM sequence: CGG
gtggctcacgactgtaatcc

SEQ ID NO: 147961 - DNA, 20 bp, Artificial Sequence
  Description of Artificial Sequence: Synthetic oligonucleotide
  Target: ATXN1; (+) strand; PAM type: NRG; PAM sequence: TGG
cgactgtaatcccggcactt

SEQ ID NO: 147962 - DNA, 20 bp, Artificial Sequence
  Description of Artificial Sequence: Synthetic oligonucleotide
  Target: ATXN1; (+) strand; PAM type: NRG; PAM sequence: GGG
gactgtaatcccggcacttt

SEQ ID NO: 147963 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccggcactttgg

SEQ ID NO: 147964 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccggcactttggg

SEQ ID NO: 147965 - DNA, 20 bp, Artificial Sequence
  Description of Artificial Sequence: Synthetic oligonucleotide
  Target: ATXN1; (+) strand; PAM type: NRG; PAM sequence: GAG
tcccggcactttgggaggcc

SEQ ID NO: 147966 - DNA, 20 bp, Artificial Sequence
  Description of Artificial Sequence: Synthetic oligonucleotide
  Target: ATXN1; (+) strand; PAM type: NRG; PAM sequence: AGG
cccggcactttgggaggccg

SEQ ID NO: 147967 - DNA, 20 bp, Artificial Sequence
  Description of Artificial Sequence: Synthetic oligonucleotide
  Target: ATXN1; (+) strand; PAM type: NRG; PAM sequence: CGG
ggcactttgggaggccgagg

SEQ ID NO: 147968 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccgaggc

SEQ ID NO: 147969 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccgaggcggg

SEQ ID NO: 147970 - DNA, 20 bp, Artificial Sequence
  Description of Artificial Sequence: Synthetic oligonucleotide
  Target: ATXN1; (+) strand; PAM type: NRG; PAM sequence: GAG
ccgaggcgggtggatcacct

SEQ ID NO: 147971 - DNA, 20 bp, Artificial Sequence
  Description of Artificial Sequence: Synthetic oligonucleotide
  Target: ATXN1; (+) strand; PAM type: NRG; PAM sequence: AGG
cgaggcgggtggatcacctg

SEQ ID NO: 147972 - DNA, 20 bp, Artificial Sequence
  Description of Artificial Sequence: Synthetic oligonucleotide
  Target: ATXN1; (+) strand; PAM type: NRG; PAM sequence: CAG
gcgggtggatcacctgaggt

SEQ ID NO: 147973 - DNA, 20 bp, Artificial Sequence
  Description of Artificial Sequence: Synthetic oligonucleotide
  Target: ATXN1; (+) strand; PAM type: NRG; PAM sequence: AGG
cgggtggatcacctgaggtc

SEQ ID NO: 147974 - DNA, 20 bp, Artificial Sequence
  Description of Artificial Sequence: Synthetic oligonucleotide
  Target: ATXN1; (+) strand; PAM type: NRG; PAM sequence: GAG
ggtggatcacctgaggtcag

SEQ ID NO: 147975 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtcaggagttc

SEQ ID NO: 147976 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcgagaccaatc

SEQ ID NO: 147977 - DNA, 20 bp, Artificial Sequence
  Description of Artificial Sequence: Synthetic oligonucleotide
  Target: ATXN1; (+) strand; PAM type: NRG; PAM sequence: TAG
cgagaccaatctggccaaca

SEQ ID NO: 147978 - DNA, 20 bp, Artificial Sequence
  Description of Artificial Sequence: Synthetic oligonucleotide
  Target: ATXN1; (+) strand; PAM type: NRG; PAM sequence: TAG
ctctactaaaaatacaaaac

SEQ ID NO: 147979 - DNA, 20 bp, Artificial Sequence
  Description of Artificial Sequence: Synthetic oligonucleotide
  Target: ATXN1; (+) strand; PAM type: NRG; PAM sequence: TGG
actaaaaatacaaaactagc

SEQ ID NO: 147980 - DNA, 20 bp, Artificial Sequence
  Description of Artificial Sequence: Synthetic oligonucleotide
  Target: ATXN1; (+) strand; PAM type: NRG; PAM sequence: GGG
ctaaaaatacaaaactagct

SEQ ID NO: 147981 - DNA, 20 bp, Artificial Sequence
  Description of Artificial Sequence: Synthetic oligonucleotide
  Target: ATXN1; (+) strand; PAM type: NRG; PAM sequence: TGG
acaaaactagctgggtgtga

SEQ ID NO: 147982 - DNA, 20 bp, Artificial Sequence
  Description of Artificial Sequence: Synthetic oligonucleotide
  Target: ATXN1; (+) strand; PAM type: NRG; PAM sequence: CAG
atggcgcacgcctgtaatcc

SEQ ID NO: 147983 - DNA, 20 bp, Artificial Sequence
  Description of Artificial Sequence: Synthetic oligonucleotide
  Target: ATXN1; (+) strand; PAM type: NRG; PAM sequence: CGG
cgcctgtaatcccagctacc

SEQ ID NO: 147984 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagctaccc

SEQ ID NO: 147985 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctacccgg

SEQ ID NO: 147986 - DNA, 20 bp, Artificial Sequence
  Description of Artificial Sequence: Synthetic oligonucleotide
  Target: ATXN1; (+) strand; PAM type: NRG; PAM sequence: GAG
tcccagctacccgggagcct

SEQ ID NO: 147987 - DNA, 20 bp, Artificial Sequence
  Description of Artificial Sequence: Synthetic oligonucleotide
  Target: ATXN1; (+) strand; PAM type: NRG; PAM sequence: CAG
agctacccgggagcctgagc

SEQ ID NO: 147988 - DNA, 20 bp, Artificial Sequence
  Description of Artificial Sequence: Synthetic oligonucleotide
  Target: ATXN1; (+) strand; PAM type: NRG; PAM sequence: AGG
gctacccgggagcctgagcc

SEQ ID NO: 147989 - DNA, 20 bp, Artificial Sequence
  Description of Artificial Sequence: Synthetic oligonucleotide
  Target: ATXN1; (+) strand; PAM type: NRG; PAM sequence: GAG
tacccgggagcctgagccag

SEQ ID NO: 147990 - DNA, 20 bp, Artificial Sequence
  Description of Artificial Sequence: Synthetic oligonucleotide
  Target: ATXN1; (+) strand; PAM type: NRG; PAM sequence: TGG
ccaggagaattgcttgaacc

SEQ ID NO: 147991 - DNA, 20 bp, Artificial Sequence
  Description of Artificial Sequence: Synthetic oligonucleotide
  Target: ATXN1; (+) strand; PAM type: NRG; PAM sequence: GGG
caggagaattgcttgaacct

SEQ ID NO: 147992 - DNA, 20 bp, Artificial Sequence
  Description of Artificial Sequence: Synthetic oligonucleotide
  Target: ATXN1; (+) strand; PAM type: NRG; PAM sequence: GGG
aggagaattgcttgaacctg

SEQ ID NO: 147993 - DNA, 20 bp, Artificial Sequence
  Description of Artificial Sequence: Synthetic oligonucleotide
  Target: ATXN1; (+) strand; PAM type: NRG; PAM sequence: GGG
ggagaattgcttgaacctgg

SEQ ID NO: 147994 - DNA, 20 bp, Artificial Sequence
  Description of Artificial Sequence: Synthetic oligonucleotide
  Target: ATXN1; (+) strand; PAM type: NRG; PAM sequence: GGG
gagaattgcttgaacctggg

SEQ ID NO: 147995 - DNA, 20 bp, Artificial Sequence
  Description of Artificial Sequence: Synthetic oligonucleotide
  Target: ATXN1; (+) strand; PAM type: NRG; PAM sequence: TGG
aattgcttgaacctgggggg

SEQ ID NO: 147996 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaacctggggggtg

SEQ ID NO: 147997 - DNA, 20 bp, Artificial Sequence
  Description of Artificial Sequence: Synthetic oligonucleotide
  Target: ATXN1; (+) strand; PAM type: NRG; PAM sequence: AGG
tgcttgaacctggggggtgg

SEQ ID NO: 147998 - DNA, 20 bp, Artificial Sequence
  Description of Artificial Sequence: Synthetic oligonucleotide
  Target: ATXN1; (+) strand; PAM type: NRG; PAM sequence: CAG
aacctggggggtggaggttg

SEQ ID NO: 147999 - DNA, 20 bp, Artificial Sequence
  Description of Artificial Sequence: Synthetic oligonucleotide
  Target: ATXN1; (+) strand; PAM type: NRG; PAM sequence: GAG
tggggggtggaggttgcagt

SEQ ID NO: 148000 - DNA, 20 bp, Artificial Sequence
  Description of Artificial Sequence: Synthetic oligonucleotide
  Target: ATXN1; (+) strand; PAM type: NRG; PAM sequence: GAG
ggtggaggttgcagtgagct

SEQ ID NO: 148001 - DNA, 20 bp, Artificial Sequence
  Description of Artificial Sequence: Synthetic oligonucleotide
  Target: ATXN1; (+) strand; PAM type: NRG; PAM sequence: CAG
gagatcacaccactgcactc

SEQ ID NO: 148002 - DNA, 20 bp, Artificial Sequence
  Description of Artificial Sequence: Synthetic oligonucleotide
  Target: ATXN1; (+) strand; PAM type: NRG; PAM sequence: CAG
cacaccactgcactccagtg

SEQ ID NO: 148003 - DNA, 20 bp, Artificial Sequence
  Description of Artificial Sequence: Synthetic oligonucleotide
  Target: ATXN1; (+) strand; PAM type: NRG; PAM sequence: AGG
acaccactgcactccagtgc

SEQ ID NO: 148004 - DNA, 20 bp, Artificial Sequence
  Description of Artificial Sequence: Synthetic oligonucleotide
  Target: ATXN1; (+) strand; PAM type: NRG; PAM sequence: AAG
tgcactccagtgcaggcaac

SEQ ID NO: 148005 - DNA, 20 bp, Artificial Sequence
  Description of Artificial Sequence: Synthetic oligonucleotide
  Target: ATXN1; (+) strand; PAM type: NRG; PAM sequence: GAG
cactccagtgcaggcaacaa

SEQ ID NO: 148006 - DNA, 20 bp, Artificial Sequence
  Description of Artificial Sequence: Synthetic oligonucleotide
  Target: ATXN1; (+) strand; PAM type: NRG; PAM sequence: GAG
ccagtgcaggcaacaagagc

SEQ ID NO: 148007 - DNA, 20 bp, Artificial Sequence
  Description of Artificial Sequence: Synthetic oligonucleotide
  Target: ATXN1; (+) strand; PAM type: NRG; PAM sequence: AAG
gattccatctcaaaaaaaca

SEQ ID NO: 148008 - DNA, 20 bp, Artificial Sequence
  Description of Artificial Sequence: Synthetic oligonucleotide
  Target: ATXN1; (+) strand; PAM type: NRG; PAM sequence: CGG
aaacaaagcaataacaacaa

SEQ ID NO: 148009 - DNA, 20 bp, Artificial Sequence
  Description of Artificial Sequence: Synthetic oligonucleotide
  Target: ATXN1; (+) strand; PAM type: NRG; PAM sequence: AAG
agcaataacaacaacggtta

SEQ ID NO: 148010 - DNA, 20 bp, Artificial Sequence
  Description of Artificial Sequence: Synthetic oligonucleotide
  Target: ATXN1; (+) strand; PAM type: NRG; PAM sequence: CAG
aataacaacaacggttaaag

SEQ ID NO: 148011 - DNA, 20 bp, Artificial Sequence
  Description of Artificial Sequence: Synthetic oligonucleotide
  Target: ATXN1; (+) strand; PAM type: NRG; PAM sequence: CAG
aacaacaacggttaaagcag

SEQ ID NO: 148012 - DNA, 20 bp, Artificial Sequence
  Description of Artificial Sequence: Synthetic oligonucleotide
  Target: ATXN1; (+) strand; PAM type: NRG; PAM sequence: GAG
aaagcagcagcttttatgtt

SEQ ID NO: 148013 - DNA, 20 bp, Artificial Sequence
  Description of Artificial Sequence: Synthetic oligonucleotide
  Target: ATXN1; (+) strand; PAM type: NRG; PAM sequence: AAG
ttaaaaacttaaatctgtat

SEQ ID NO: 148014 - DNA, 20 bp, Artificial Sequence
  Description of Artificial Sequence: Synthetic oligonucleotide
  Target: ATXN1; (+) strand; PAM type: NRG; PAM sequence: GAG
aaaaacttaaatctgtataa

SEQ ID NO: 148015 - DNA, 20 bp, Artificial Sequence
  Description of Artificial Sequence: Synthetic oligonucleotide
  Target: ATXN1; (+) strand; PAM type: NRG; PAM sequence: GAG
aaacttaaatctgtataaga

SEQ ID NO: 148016 - DNA, 20 bp, Artificial Sequence
  Description of Artificial Sequence: Synthetic oligonucleotide
  Target: ATXN1; (+) strand; PAM type: NRG; PAM sequence: CAG
cttaaatctgtataagagag

SEQ ID NO: 148017 - DNA, 20 bp, Artificial Sequence
  Description of Artificial Sequence: Synthetic oligonucleotide
  Target: ATXN1; (+) strand; PAM type: NRG; PAM sequence: AGG
ttaaatctgtataagagagc

SEQ ID NO: 148018 - DNA, 20 bp, Artificial Sequence
  Description of Artificial Sequence: Synthetic oligonucleotide
  Target: ATXN1; (+) strand; PAM type: NRG; PAM sequence: TGG
agagcaggcaaaacacgtca

SEQ ID NO: 148019 - DNA, 20 bp, Artificial Sequence
  Description of Artificial Sequence: Synthetic oligonucleotide
  Target: ATXN1; (+) strand; PAM type: NRG; PAM sequence: GAG
agcaggcaaaacacgtcatg

SEQ ID NO: 148020 - DNA, 20 bp, Artificial Sequence
  Description of Artificial Sequence: Synthetic oligonucleotide
  Target: ATXN1; (+) strand; PAM type: NRG; PAM sequence: TGG
cccacactgtacgaatgttt

SEQ ID NO: 148021 - DNA, 20 bp, Artificial Sequence
  Description of Artificial Sequence: Synthetic oligonucleotide
  Target: ATXN1; (+) strand; PAM type: NRG; PAM sequence: GAG
cacactgtacgaatgttttg

SEQ ID NO: 148022 - DNA, 20 bp, Artificial Sequence
  Description of Artificial Sequence: Synthetic oligonucleotide
  Target: ATXN1; (+) strand; PAM type: NRG; PAM sequence: AGG
acactgtacgaatgttttgg

SEQ ID NO: 148023 - DNA, 20 bp, Artificial Sequence
  Description of Artificial Sequence: Synthetic oligonucleotide
  Target: ATXN1; (+) strand; PAM type: NRG; PAM sequence: GAG
atgttttggaggtgcgcact

SEQ ID NO: 148024 - DNA, 20 bp, Artificial Sequence
  Description of Artificial Sequence: Synthetic oligonucleotide
  Target: ATXN1; (+) strand; PAM type: NRG; PAM sequence: TGG
tgagttaaaaataaaaaaca

SEQ ID NO: 148025 - DNA, 20 bp, Artificial Sequence
  Description of Artificial Sequence: Synthetic oligonucleotide
  Target: ATXN1; (+) strand; PAM type: NRG; PAM sequence: TGG
ttttcatttcctatctaatt

SEQ ID NO: 148026 - DNA, 20 bp, Artificial Sequence
  Description of Artificial Sequence: Synthetic oligonucleotide
  Target: ATXN1; (+) strand; PAM type: NRG; PAM sequence: CAG
ttcctatctaatttggtctc

SEQ ID NO: 148027 - DNA, 20 bp, Artificial Sequence
  Description of Artificial Sequence: Synthetic oligonucleotide
  Target: ATXN1; (+) strand; PAM type: NRG; PAM sequence: GAG
cctatctaatttggtctcca

SEQ ID NO: 148028 - DNA, 20 bp, Artificial Sequence
  Description of Artificial Sequence: Synthetic oligonucleotide
  Target: ATXN1; (+) strand; PAM type: NRG; PAM sequence: AAG
tttggtctccagagcctgct

SEQ ID NO: 148029 - DNA, 20 bp, Artificial Sequence
  Description of Artificial Sequence: Synthetic oligonucleotide
  Target: ATXN1; (+) strand; PAM type: NRG; PAM sequence: CAG
tctccagagcctgctaagta

SEQ ID NO: 148030 - DNA, 20 bp, Artificial Sequence
  Description of Artificial Sequence: Synthetic oligonucleotide
  Target: ATXN1; (+) strand; PAM type: NRG; PAM sequence: CGG
gtacagtttccatttctact

SEQ ID NO: 148031 - DNA, 20 bp, Artificial Sequence
  Description of Artificial Sequence: Synthetic oligonucleotide
  Target: ATXN1; (+) strand; PAM type: NRG; PAM sequence: GGG
tacagtttccatttctactc

SEQ ID NO: 148032 - DNA, 20 bp, Artificial Sequence
  Description of Artificial Sequence: Synthetic oligonucleotide
  Target: ATXN1; (+) strand; PAM type: NRG; PAM sequence: AAG
ttccatttctactcgggtgc

SEQ ID NO: 148033 - DNA, 20 bp, Artificial Sequence
  Description of Artificial Sequence: Synthetic oligonucleotide
  Target: ATXN1; (+) strand; PAM type: NRG; PAM sequence: GAG
ccatttctactcgggtgcaa

SEQ ID NO: 148034 - DNA, 20 bp, Artificial Sequence
  Description of Artificial Sequence: Synthetic oligonucleotide
  Target: ATXN1; (+) strand; PAM type: NRG; PAM sequence: TGG
ctactcgggtgcaagagcaa

SEQ ID NO: 148035 - DNA, 20 bp, Artificial Sequence
  Description of Artificial Sequence: Synthetic oligonucleotide
  Target: ATXN1; (+) strand; PAM type: NRG; PAM sequence: CGG
atggcttatttgctgtttta

SEQ ID NO: 148036 - DNA, 20 bp, Artificial Sequence
  Description of Artificial Sequence: Synthetic oligonucleotide
  Target: ATXN1; (+) strand; PAM type: NRG; PAM sequence: GAG
ggcttatttgctgttttacg

SEQ ID NO: 148037 - DNA, 20 bp, Artificial Sequence
  Description of Artificial Sequence: Synthetic oligonucleotide
  Target: ATXN1; (+) strand; PAM type: NRG; PAM sequence: CAG
ttatttgctgttttacggag

SEQ ID NO: 148038 - DNA, 20 bp, Artificial Sequence
  Description of Artificial Sequence: Synthetic oligonucleotide
  Target: ATXN1; (+) strand; PAM type: NRG; PAM sequence: AAG
tctgaaccccctttcccccc

SEQ ID NO: 148039 - DNA, 20 bp, Artificial Sequence
  Description of Artificial Sequence: Synthetic oligonucleotide
  Target: ATXN1; (+) strand; PAM type: NRG; PAM sequence: CGG
ttccccccaagattgactgt

SEQ ID NO: 148040 - DNA, 20 bp, Artificial Sequence
  Description of Artificial Sequence: Synthetic oligonucleotide
  Target: ATXN1; (+) strand; PAM type: NRG; PAM sequence: CAG
caagattgactgtcggtcta

SEQ ID NO: 148041 - DNA, 20 bp, Artificial Sequence
  Description of Artificial Sequence: Synthetic oligonucleotide
  Target: ATXN1; (+) strand; PAM type: NRG; PAM sequence: CAG
tgactgtcggtctacagaat

SEQ ID NO: 148042 - DNA, 20 bp, Artificial Sequence
  Description of Artificial Sequence: Synthetic oligonucleotide
  Target: ATXN1; (+) strand; PAM type: NRG; PAM sequence: AAG
gtcggtctacagaatcagtt

SEQ ID NO: 148043 - DNA, 20 bp, Artificial Sequence
  Description of Artificial Sequence: Synthetic oligonucleotide
  Target: ATXN1; (+) strand; PAM type: NRG; PAM sequence: CAG
gtgctacaaatcactactaa

SEQ ID NO: 148044 - DNA, 20 bp, Artificial Sequence
  Description of Artificial Sequence: Synthetic oligonucleotide
  Target: ATXN1; (+) strand; PAM type: NRG; PAM sequence: GAG
tcactactaacagctcctgc

SEQ ID NO: 148045 - DNA, 20 bp, Artificial Sequence
  Description of Artificial Sequence: Synthetic oligonucleotide
  Target: ATXN1; (+) strand; PAM type: NRG; PAM sequence: AGG
cactactaacagctcctgcg

SEQ ID NO: 148046 - DNA, 20 bp, Artificial Sequence
  Description of Artificial Sequence: Synthetic oligonucleotide
  Target: ATXN1; (+) strand; PAM type: NRG; PAM sequence: AAG
tcctgcgaggcgctccctct

SEQ ID NO: 148047 - DNA, 20 bp, Artificial Sequence
  Description of Artificial Sequence: Synthetic oligonucleotide
  Target: ATXN1; (+) strand; PAM type: NRG; PAM sequence: CAG
gctccctctaagaatctgta

SEQ ID NO: 148048 - DNA, 20 bp, Artificial Sequence
  Description of Artificial Sequence: Synthetic oligonucleotide
  Target: ATXN1; (+) strand; PAM type: NRG; PAM sequence: AAG
tctgtacagatcaaaatctc

SEQ ID NO: 148049 - DNA, 20 bp, Artificial Sequence
  Description of Artificial Sequence: Synthetic oligonucleotide
  Target: ATXN1; (+) strand; PAM type: NRG; PAM sequence: CAG
atctcaagtgcttacttgcc

SEQ ID NO: 148050 - DNA, 20 bp, Artificial Sequence
  Description of Artificial Sequence: Synthetic oligonucleotide
  Target: ATXN1; (+) strand; PAM type: NRG; PAM sequence: AGG
tctcaagtgcttacttgccc

SEQ ID NO: 148051 - DNA, 20 bp, Artificial Sequence
  Description of Artificial Sequence: Synthetic oligonucleotide
  Target: ATXN1; (+) strand; PAM type: NRG; PAM sequence: GGG
ctcaagtgcttacttgccca

SEQ ID NO: 148052 - DNA, 20 bp, Artificial Sequence
  Description of Artificial Sequence: Synthetic oligonucleotide
  Target: ATXN1; (+) strand; PAM type: NRG; PAM sequence: GAG
cccagggactgccataattt

SEQ ID NO: 148053 - DNA, 20 bp, Artificial Sequence
  Description of Artificial Sequence: Synthetic oligonucleotide
  Target: ATXN1; (+) strand; PAM type: NRG; PAM sequence: AGG
ccagggactgccataatttg

SEQ ID NO: 148054 - DNA, 20 bp, Artificial Sequence
  Description of Artificial Sequence: Synthetic oligonucleotide
  Target: ATXN1; (+) strand; PAM type: NRG; PAM sequence: AAG
tgaggtgttgcttcttttta

SEQ ID NO: 148055 - DNA, 20 bp, Artificial Sequence
  Description of Artificial Sequence: Synthetic oligonucleotide
  Target: ATXN1; (+) strand; PAM type: NRG; PAM sequence: CAG
tctttttaaagtataaaaaa

SEQ ID NO: 148056 - DNA, 20 bp, Artificial Sequence
  Description of Artificial Sequence: Synthetic oligonucleotide
  Target: ATXN1; (+) strand; PAM type: NRG; PAM sequence: AAG
gtataaaaaacagatgctct

SEQ ID NO: 148057 - DNA, 20 bp, Artificial Sequence
  Description of Artificial Sequence: Synthetic oligonucleotide
  Target: ATXN1; (+) strand; PAM type: NRG; PAM sequence: AAG
cagatgctctaagctgatga

SEQ ID NO: 148058 - DNA, 20 bp, Artificial Sequence
  Description of Artificial Sequence: Synthetic oligonucleotide
  Target: ATXN1; (+) strand; PAM type: NRG; PAM sequence: CAG
ctttcaacacatctcttccc

SEQ ID NO: 148059 - DNA, 20 bp, Artificial Sequence
  Description of Artificial Sequence: Synthetic oligonucleotide
  Target: ATXN1; (+) strand; PAM type: NRG; PAM sequence: AAG
cacttgaaaatcttaccaac

SEQ ID NO: 148060 - DNA, 20 bp, Artificial Sequence
  Description of Artificial Sequence: Synthetic oligonucleotide
  Target: ATXN1; (+) strand; PAM type: NRG; PAM sequence: AAG
ttgaaaatcttaccaacaag

SEQ ID NO: 148061 - DNA, 20 bp, Artificial Sequence
  Description of Artificial Sequence: Synthetic oligonucleotide
  Target: ATXN1; (+) strand; PAM type: NRG; PAM sequence: CGG
aagaagtacttcccacactc

SEQ ID NO: 148062 - DNA, 20 bp, Artificial Sequence
  Description of Artificial Sequence: Synthetic oligonucleotide
  Target: ATXN1; (+) strand; PAM type: NRG; PAM sequence: CGG
agtacttcccacactccggt

SEQ ID NO: 148063 - DNA, 20 bp, Artificial Sequence
  Description of Artificial Sequence: Synthetic oligonucleotide
  Target: ATXN1; (+) strand; PAM type: NRG; PAM sequence: AAG
acttttttacttttcctttg

SEQ ID NO: 148064 - DNA, 20 bp, Artificial Sequence
  Description of Artificial Sequence: Synthetic oligonucleotide
  Target: ATXN1; (+) strand; PAM type: NRG; PAM sequence: CAG
ttacttttcctttgaagccg

SEQ ID NO: 148065 - DNA, 20 bp, Artificial Sequence
  Description of Artificial Sequence: Synthetic oligonucleotide
  Target: ATXN1; (+) strand; PAM type: NRG; PAM sequence: CGG
gtgcaatgtgattctacacc

SEQ ID NO: 148066 - DNA, 20 bp, Artificial Sequence
  Description of Artificial Sequence: Synthetic oligonucleotide
  Target: ATXN1; (+) strand; PAM type: NRG; PAM sequence: GGG
tgcaatgtgattctacaccc

SEQ ID NO: 148067 - DNA, 20 bp, Artificial Sequence
  Description of Artificial Sequence: Synthetic oligonucleotide
  Target: ATXN1; (+) strand; PAM type: NRG; PAM sequence: GGG
gcaatgtgattctacacccg

SEQ ID NO: 148068 - DNA, 20 bp, Artificial Sequence
  Description of Artificial Sequence: Synthetic oligonucleotide
  Target: ATXN1; (+) strand; PAM type: NRG; PAM sequence: CGG
cggggtgaaacaattcctta

SEQ ID NO: 148069 - DNA, 20 bp, Artificial Sequence
  Description of Artificial Sequence: Synthetic oligonucleotide
  Target: ATXN1; (+) strand; PAM type: NRG; PAM sequence: GGG
ggggtgaaacaattccttac

SEQ ID NO: 148070 - DNA, 20 bp, Artificial Sequence
  Description of Artificial Sequence: Synthetic oligonucleotide
  Target: ATXN1; (+) strand; PAM type: NRG; PAM sequence: GGG
gggtgaaacaattccttacg

SEQ ID NO: 148071 - DNA, 20 bp, Artificial Sequence
  Description of Artificial Sequence: Synthetic oligonucleotide
  Target: ATXN1; (+) strand; PAM type: NRG; PAM sequence: GAG
gtgaaacaattccttacggg

SEQ ID NO: 148072 - DNA, 20 bp, Artificial Sequence
  Description of Artificial Sequence: Synthetic oligonucleotide
  Target: ATXN1; (+) strand; PAM type: NRG; PAM sequence: TGG
aattccttacggggagcctt

SEQ ID NO: 148073 - DNA, 20 bp, Artificial Sequence
  Description of Artificial Sequence: Synthetic oligonucleotide
  Target: ATXN1; (+) strand; PAM type: NRG; PAM sequence: GAG
ttccttacggggagcctttg

SEQ ID NO: 148074 - DNA, 20 bp, Artificial Sequence
  Description of Artificial Sequence: Synthetic oligonucleotide
  Target: ATXN1; (+) strand; PAM type: NRG; PAM sequence: GAG
ccttacggggagcctttgga

SEQ ID NO: 148075 - DNA, 20 bp, Artificial Sequence
  Description of Artificial Sequence: Synthetic oligonucleotide
  Target: ATXN1; (+) strand; PAM type: NRG; PAM sequence: AAG
ctttggagagcaccccaaac

SEQ ID NO: 148076 - DNA, 20 bp, Artificial Sequence
  Description of Artificial Sequence: Synthetic oligonucleotide
  Target: ATXN1; (+) strand; PAM type: NRG; PAM sequence: AGG
tttggagagcaccccaaaca

SEQ ID NO: 148077 - DNA, 20 bp, Artificial Sequence
  Description of Artificial Sequence: Synthetic oligonucleotide
  Target: ATXN1; (+) strand; PAM type: NRG; PAM sequence: GGG
ttggagagcaccccaaacaa

SEQ ID NO: 148078 - DNA, 20 bp, Artificial Sequence
  Description of Artificial Sequence: Synthetic oligonucleotide
  Target: ATXN1; (+) strand; PAM type: NRG; PAM sequence: GGG
tggagagcaccccaaacaag

SEQ ID NO: 148079 - DNA, 20 bp, Artificial Sequence
  Description of Artificial Sequence: Synthetic oligonucleotide
  Target: ATXN1; (+) strand; PAM type: NRG; PAM sequence: GGG
ggagagcaccccaaacaagg

SEQ ID NO: 148080 - DNA, 20 bp, Artificial Sequence
  Description of Artificial Sequence: Synthetic oligonucleotide
  Target: ATXN1; (+) strand; PAM type: NRG; PAM sequence: TGG
accccaaacaagggggctgc

SEQ ID NO: 148081 - DNA, 20 bp, Artificial Sequence
  Description of Artificial Sequence: Synthetic oligonucleotide
  Target: ATXN1; (+) strand; PAM type: NRG; PAM sequence: AAG
caagggggctgctggaatgc

SEQ ID NO: 148082 - DNA, 20 bp, Artificial Sequence
  Description of Artificial Sequence: Synthetic oligonucleotide
  Target: ATXN1; (+) strand; PAM type: NRG; PAM sequence: AAG
ggaatgcaagtgtgatgccc

SEQ ID NO: 148083 - DNA, 20 bp, Artificial Sequence
  Description of Artificial Sequence: Synthetic oligonucleotide
  Target: ATXN1; (+) strand; PAM type: NRG; PAM sequence: AGG
gaatgcaagtgtgatgccca

SEQ ID NO: 148084 - DNA, 20 bp, Artificial Sequence
  Description of Artificial Sequence: Synthetic oligonucleotide
  Target: ATXN1; (+) strand; PAM type: NRG; PAM sequence: GAG
atgcaagtgtgatgcccaag

SEQ ID NO: 148085 - DNA, 20 bp, Artificial Sequence
  Description of Artificial Sequence: Synthetic oligonucleotide
  Target: ATXN1; (+) strand; PAM type: NRG; PAM sequence: CAG
aggagactgtctccctacct

SEQ ID NO: 148086 - DNA, 20 bp, Artificial Sequence
  Description of Artificial Sequence: Synthetic oligonucleotide
  Target: ATXN1; (+) strand; PAM type: NRG; PAM sequence: GAG
gagactgtctccctacctca

SEQ ID NO: 148087 - DNA, 20 bp, Artificial Sequence
  Description of Artificial Sequence: Synthetic oligonucleotide
  Target: ATXN1; (+) strand; PAM type: NRG; PAM sequence: AAG
gtctccctacctcagagctg

SEQ ID NO: 148088 - DNA, 20 bp, Artificial Sequence
  Description of Artificial Sequence: Synthetic oligonucleotide
  Target: ATXN1; (+) strand; PAM type: NRG; PAM sequence: GAG
tgcttcttgacaaccttcac

SEQ ID NO: 148089 - DNA, 20 bp, Artificial Sequence
  Description of Artificial Sequence: Synthetic oligonucleotide
  Target: ATXN1; (+) strand; PAM type: NRG; PAM sequence: AAG
ttcttgacaaccttcacgag

SEQ ID NO: 148090 - DNA, 20 bp, Artificial Sequence
  Description of Artificial Sequence: Synthetic oligonucleotide
  Target: ATXN1; (+) strand; PAM type: NRG; PAM sequence: AAG
aaccttcacgagaagtctca

SEQ ID NO: 148091 - DNA, 20 bp, Artificial Sequence
  Description of Artificial Sequence: Synthetic oligonucleotide
  Target: ATXN1; (+) strand; PAM type: NRG; PAM sequence: CAG
aagtctcaaagttacacaca

SEQ ID NO: 148092 - DNA, 20 bp, Artificial Sequence
  Description of Artificial Sequence: Synthetic oligonucleotide
  Target: ATXN1; (+) strand; PAM type: NRG; PAM sequence: AGG
agtctcaaagttacacacac

SEQ ID NO: 148093 - DNA, 20 bp, Artificial Sequence
  Description of Artificial Sequence: Synthetic oligonucleotide
  Target: ATXN1; (+) strand; PAM type: NRG; PAM sequence: TAG
caaagttacacacacaggct

SEQ ID NO: 148094 - DNA, 20 bp, Artificial Sequence
  Description of Artificial Sequence: Synthetic oligonucleotide
  Target: ATXN1; (+) strand; PAM type: NRG; PAM sequence: CAG
caaacgtctgcaccaatgtg

SEQ ID NO: 148095 - DNA, 20 bp, Artificial Sequence
  Description of Artificial Sequence: Synthetic oligonucleotide
  Target: ATXN1; (+) strand; PAM type: NRG; PAM sequence: AAG
cttttcctgccctgctctct

SEQ ID NO: 148096 - DNA, 20 bp, Artificial Sequence
  Description of Artificial Sequence: Synthetic oligonucleotide
  Target: ATXN1; (+) strand; PAM type: NRG; PAM sequence: CAG
tgccctgctctctaagcact

SEQ ID NO: 148097 - DNA, 20 bp, Artificial Sequence
  Description of Artificial Sequence: Synthetic oligonucleotide
  Target: ATXN1; (+) strand; PAM type: NRG; PAM sequence: GAG
ctgctctctaagcactcagc

SEQ ID NO: 148098 - DNA, 20 bp, Artificial Sequence
  Description of Artificial Sequence: Synthetic oligonucleotide
  Target: ATXN1; (+) strand; PAM type: NRG; PAM sequence: AGG
tgctctctaagcactcagcg

SEQ ID NO: 148099 - DNA, 20 bp, Artificial Sequence
  Description of Artificial Sequence: Synthetic oligonucleotide
  Target: ATXN1; (+) strand; PAM type: NRG; PAM sequence: GGG
gctctctaagcactcagcga

SEQ ID NO: 148100 - DNA, 20 bp, Artificial Sequence
  Description of Artificial Sequence: Synthetic oligonucleotide
  Target: ATXN1; (+) strand; PAM type: NRG; PAM sequence: GGG
ctctctaagcactcagcgag

SEQ ID NO: 148101 - DNA, 20 bp, Artificial Sequence
  Description of Artificial Sequence: Synthetic oligonucleotide
  Target: ATXN1; (+) strand; PAM type: NRG; PAM sequence: GGG
tctctaagcactcagcgagg

SEQ ID NO: 148102 - DNA, 20 bp, Artificial Sequence
  Description of Artificial Sequence: Synthetic oligonucleotide
  Target: ATXN1; (+) strand; PAM type: NRG; PAM sequence: GAG
tctaagcactcagcgagggg

SEQ ID NO: 148103 - DNA, 20 bp, Artificial Sequence
  Description of Artificial Sequence: Synthetic oligonucleotide
  Target: ATXN1; (+) strand; PAM type: NRG; PAM sequence: AGG
ctaagcactcagcgaggggg

SEQ ID NO: 148104 - DNA, 20 bp, Artificial Sequence
  Description of Artificial Sequence: Synthetic oligonucleotide
  Target: ATXN1; (+) strand; PAM type: NRG; PAM sequence: GGG
taagcactcagcgaggggga

SEQ ID NO: 148105 - DNA, 20 bp, Artificial Sequence
  Description of Artificial Sequence: Synthetic oligonucleotide
  Target: ATXN1; (+) strand; PAM type: NRG; PAM sequence: GGG
aagcactcagcgagggggag

SEQ ID NO: 148106 - DNA, 20 bp, Artificial Sequence
  Description of Artificial Sequence: Synthetic oligonucleotide
  Target: ATXN1; (+) strand; PAM type: NRG; PAM sequence: GGG
agcactcagcgagggggagg

SEQ ID NO: 148107 - DNA, 20 bp, Artificial Sequence
  Description of Artificial Sequence: Synthetic oligonucleotide
  Target: ATXN1; (+) strand; PAM type: NRG; PAM sequence: CAG
tcagcgagggggagggggca

SEQ ID NO: 148108 - DNA, 20 bp, Artificial Sequence
  Description of Artificial Sequence: Synthetic oligonucleotide
  Target: ATXN1; (+) strand; PAM type: NRG; PAM sequence: CAG
ggagggggcacagtgcaaaa

SEQ ID NO: 148109 - DNA, 20 bp, Artificial Sequence
  Description of Artificial Sequence: Synthetic oligonucleotide
  Target: ATXN1; (+) strand; PAM type: NRG; PAM sequence: CAG
gggcacagtgcaaaacagac

SEQ ID NO: 148110 - DNA, 20 bp, Artificial Sequence
  Description of Artificial Sequence: Synthetic oligonucleotide
  Target: ATXN1; (+) strand; PAM type: NRG; PAM sequence: AAG
gcaaaacagaccagtgaatc

SEQ ID NO: 148111 - DNA, 20 bp, Artificial Sequence
  Description of Artificial Sequence: Synthetic oligonucleotide
  Target: ATXN1; (+) strand; PAM type: NRG; PAM sequence: TAG
tgaatcaagcgaccacactg

SEQ ID NO: 148112 - DNA, 20 bp, Artificial Sequence
  Description of Artificial Sequence: Synthetic oligonucleotide
  Target: ATXN1; (+) strand; PAM type: NRG; PAM sequence: CAG
accacactgtagccctacac

SEQ ID NO: 148113 - DNA, 20 bp, Artificial Sequence
  Description of Artificial Sequence: Synthetic oligonucleotide
  Target: ATXN1; (+) strand; PAM type: NRG; PAM sequence: CAG
agccctacaccagtgctctg

SEQ ID NO: 148114 - DNA, 20 bp, Artificial Sequence
  Description of Artificial Sequence: Synthetic oligonucleotide
  Target: ATXN1; (+) strand; PAM type: NRG; PAM sequence: AGG
gccctacaccagtgctctgc

SEQ ID NO: 148115 - DNA, 20 bp, Artificial Sequence
  Description of Artificial Sequence: Synthetic oligonucleotide
  Target: ATXN1; (+) strand; PAM type: NRG; PAM sequence: CAG
tgcaggcccccttgcctcct

SEQ ID NO: 148116 - DNA, 20 bp, Artificial Sequence
  Description of Artificial Sequence: Synthetic oligonucleotide
  Target: ATXN1; (+) strand; PAM type: NRG; PAM sequence: AGG
gcaggcccccttgcctcctc

SEQ ID NO: 148117 - DNA, 20 bp, Artificial Sequence
  Description of Artificial Sequence: Synthetic oligonucleotide
  Target: ATXN1; (+) strand; PAM type: NRG; PAM sequence: CAG
acctctctcatctgtaattg

SEQ ID NO: 148118 - DNA, 20 bp, Artificial Sequence
  Description of Artificial Sequence: Synthetic oligonucleotide
  Target: ATXN1; (+) strand; PAM type: NRG; PAM sequence: GAG
ctctctcatctgtaattgca

SEQ ID NO: 148119 - DNA, 20 bp, Artificial Sequence
  Description of Artificial Sequence: Synthetic oligonucleotide
  Target: ATXN1; (+) strand; PAM type: NRG; PAM sequence: TGG
tcatctgtaattgcagagat

SEQ ID NO: 148120 - DNA, 20 bp, Artificial Sequence
  Description of Artificial Sequence: Synthetic oligonucleotide
  Target: ATXN1; (+) strand; PAM type: NRG; PAM sequence: CAG
gtaattgcagagattggacc

SEQ ID NO: 148121 - DNA, 20 bp, Artificial Sequence
  Description of Artificial Sequence: Synthetic oligonucleotide
  Target: ATXN1; (+) strand; PAM type: NRG; PAM sequence: TGG
atcctaaaatccctacccgc

SEQ ID NO: 148122 - DNA, 20 bp, Artificial Sequence
  Description of Artificial Sequence: Synthetic oligonucleotide
  Target: ATXN1; (+) strand; PAM type: NRG; PAM sequence: GAG
cctaaaatccctacccgctg

SEQ ID NO: 148123 - DNA, 20 bp, Artificial Sequence
  Description of Artificial Sequence: Synthetic oligonucleotide
  Target: ATXN1; (+) strand; PAM type: NRG; PAM sequence: TAG
ccctacccgctggagcatcc

SEQ ID NO: 148124 - DNA, 20 bp, Artificial Sequence
  Description of Artificial Sequence: Synthetic oligonucleotide
  Target: ATXN1; (+) strand; PAM type: NRG; PAM sequence: GAG
ctacccgctggagcatccta

SEQ ID NO: 148125 - DNA, 20 bp, Artificial Sequence
  Description of Artificial Sequence: Synthetic oligonucleotide
  Target: ATXN1; (+) strand; PAM type: NRG; PAM sequence: CAG
gcatcctagagtctctgtga

SEQ ID NO: 148126 - DNA, 20 bp, Artificial Sequence
  Description of Artificial Sequence: Synthetic oligonucleotide
  Target: ATXN1; (+) strand; PAM type: NRG; PAM sequence: AGG
catcctagagtctctgtgac

SEQ ID NO: 148127 - DNA, 20 bp, Artificial Sequence
  Description of Artificial Sequence: Synthetic oligonucleotide
  Target: ATXN1; (+) strand; PAM type: NRG; PAM sequence: CAG
gaatatgacacgattgccca

SEQ ID NO: 148128 - DNA, 20 bp, Artificial Sequence
  Description of Artificial Sequence: Synthetic oligonucleotide
  Target: ATXN1; (+) strand; PAM type: NRG; PAM sequence: CAG
tatgacacgattgcccacag

SEQ ID NO: 148129 - DNA, 20 bp, Artificial Sequence
  Description of Artificial Sequence: Synthetic oligonucleotide
  Target: ATXN1; (+) strand; PAM type: NRG; PAM sequence: CAG
attgcccacagcagttcaca

SEQ ID NO: 148130 - DNA, 20 bp, Artificial Sequence
  Description of Artificial Sequence: Synthetic oligonucleotide
  Target: ATXN1; (+) strand; PAM type: NRG; PAM sequence: AAG
gcccacagcagttcacacag

SEQ ID NO: 148131 - DNA, 20 bp, Artificial Sequence
  Description of Artificial Sequence: Synthetic oligonucleotide
  Target: ATXN1; (+) strand; PAM type: NRG; PAM sequence: CAG
ttcacacagaagccaaaatc

SEQ ID NO: 148132 - DNA, 20 bp, Artificial Sequence
  Description of Artificial Sequence: Synthetic oligonucleotide
  Target: ATXN1; (+) strand; PAM type: NRG; PAM sequence: AGG
tcacacagaagccaaaatcc

SEQ ID NO: 148133 - DNA, 20 bp, Artificial Sequence
  Description of Artificial Sequence: Synthetic oligonucleotide
  Target: ATXN1; (+) strand; PAM type: NRG; PAM sequence: TAG
cacagaagccaaaatccagg

SEQ ID NO: 148134 - DNA, 20 bp, Artificial Sequence
  Description of Artificial Sequence: Synthetic oligonucleotide
  Target: ATXN1; (+) strand; PAM type: NRG; PAM sequence: GAG
gaagccaaaatccaggtagt

SEQ ID NO: 148135 - DNA, 20 bp, Artificial Sequence
  Description of Artificial Sequence: Synthetic oligonucleotide
  Target: ATXN1; (+) strand; PAM type: NRG; PAM sequence: TGG
tccaggtagtgagcctatgc

SEQ ID NO: 148136 - DNA, 20 bp, Artificial Sequence
  Description of Artificial Sequence: Synthetic oligonucleotide
  Target: ATXN1; (+) strand; PAM type: NRG; PAM sequence: GGG
ccaggtagtgagcctatgct

SEQ ID NO: 148137 - DNA, 20 bp, Artificial Sequence
  Description of Artificial Sequence: Synthetic oligonucleotide
  Target: ATXN1; (+) strand; PAM type: NRG; PAM sequence: TGG
agtgagcctatgctgggact

SEQ ID NO: 148138 - DNA, 20 bp, Artificial Sequence
  Description of Artificial Sequence: Synthetic oligonucleotide
  Target: ATXN1; (+) strand; PAM type: NRG; PAM sequence: GGG
gtgagcctatgctgggactt

SEQ ID NO: 148139 - DNA, 20 bp, Artificial Sequence
  Description of Artificial Sequence: Synthetic oligonucleotide
  Target: ATXN1; (+) strand; PAM type: NRG; PAM sequence: GGG
tgagcctatgctgggacttg

SEQ ID NO: 148140 - DNA, 20 bp, Artificial Sequence
  Description of Artificial Sequence: Synthetic oligonucleotide
  Target: ATXN1; (+) strand; PAM type: NRG; PAM sequence: GGG
gagcctatgctgggacttgg

SEQ ID NO: 148141 - DNA, 20 bp, Artificial Sequence
  Description of Artificial Sequence: Synthetic oligonucleotide
  Target: ATXN1; (+) strand; PAM type: NRG; PAM sequence: GAG
gcctatgctgggacttgggg

SEQ ID NO: 148142 - DNA, 20 bp, Artificial Sequence
  Description of Artificial Sequence: Synthetic oligonucleotide
  Target: ATXN1; (+) strand; PAM type: NRG; PAM sequence: AGG
cctatgctgggacttggggg

SEQ ID NO: 148143 - DNA, 20 bp, Artificial Sequence
  Description of Artificial Sequence: Synthetic oligonucleotide
  Target: ATXN1; (+) strand; PAM type: NRG; PAM sequence: GGG
ctatgctgggacttggggga

SEQ ID NO: 148144 - DNA, 20 bp, Artificial Sequence
  Description of Artificial Sequence: Synthetic oligonucleotide
  Target: ATXN1; (+) strand; PAM type: NRG; PAM sequence: AAG
tgggacttgggggagggcta

SEQ ID NO: 148145 - DNA, 20 bp, Artificial Sequence
  Description of Artificial Sequence: Synthetic oligonucleotide
  Target: ATXN1; (+) strand; PAM type: NRG; PAM sequence: AAG
cttgggggagggctaaagtg

SEQ ID NO: 148146 - DNA, 20 bp, Artificial Sequence
  Description of Artificial Sequence: Synthetic oligonucleotide
  Target: ATXN1; (+) strand; PAM type: NRG; PAM sequence: AGG
ttgggggagggctaaagtga

SEQ ID NO: 148147 - DNA, 20 bp, Artificial Sequence
  Description of Artificial Sequence: Synthetic oligonucleotide
  Target: ATXN1; (+) strand; PAM type: NRG; PAM sequence: CAG
ggggagggctaaagtgaagg

SEQ ID NO: 148148 - DNA, 20 bp, Artificial Sequence
  Description of Artificial Sequence: Synthetic oligonucleotide
  Target: ATXN1; (+) strand; PAM type: NRG; PAM sequence: AGG
gggagggctaaagtgaaggc

SEQ ID NO: 148149 - DNA, 20 bp, Artificial Sequence
  Description of Artificial Sequence: Synthetic oligonucleotide
  Target: ATXN1; (+) strand; PAM type: NRG; PAM sequence: GGG
ggagggctaaagtgaaggca

SEQ ID NO: 148150 - DNA, 20 bp, Artificial Sequence
  Description of Artificial Sequence: Synthetic oligonucleotide
  Target: ATXN1; (+) strand; PAM type: NRG; PAM sequence: CAG
gctaaagtgaaggcagggat

SEQ ID NO: 148151 - DNA, 20 bp, Artificial Sequence
  Description of Artificial Sequence: Synthetic oligonucleotide
  Target: ATXN1; (+) strand; PAM type: NRG; PAM sequence: GAG
taaagtgaaggcagggatca

SEQ ID NO: 148152 - DNA, 20 bp, Artificial Sequence
  Description of Artificial Sequence: Synthetic oligonucleotide
  Target: ATXN1; (+) strand; PAM type: NRG; PAM sequence: AGG
aaagtgaaggcagggatcag

SEQ ID NO: 148153 - DNA, 20 bp, Artificial Sequence
  Description of Artificial Sequence: Synthetic oligonucleotide
  Target: ATXN1; (+) strand; PAM type: NRG; PAM sequence: GGG
aagtgaaggcagggatcaga

SEQ ID NO: 148154 - DNA, 20 bp, Artificial Sequence
  Description of Artificial Sequence: Synthetic oligonucleotide
  Target: ATXN1; (+) strand; PAM type: NRG; PAM sequence: GAG
gaaggcagggatcagagggt

SEQ ID NO: 148155 - DNA, 20 bp, Artificial Sequence
  Description of Artificial Sequence: Synthetic oligonucleotide
  Target: ATXN1; (+) strand; PAM type: NRG; PAM sequence: AAG
cagggatcagagggtgagca

SEQ ID NO: 148156 - DNA, 20 bp, Artificial Sequence
  Description of Artificial Sequence: Synthetic oligonucleotide
  Target: ATXN1; (+) strand; PAM type: NRG; PAM sequence: CAG
gagcaaagaaattaatgata

SEQ ID NO: 148157 - DNA, 20 bp, Artificial Sequence
  Description of Artificial Sequence: Synthetic oligonucleotide
  Target: ATXN1; (+) strand; PAM type: NRG; PAM sequence: CAG
aaattaatgatacagaattc

SEQ ID NO: 148158 - DNA, 20 bp, Artificial Sequence
  Description of Artificial Sequence: Synthetic oligonucleotide
  Target: ATXN1; (+) strand; PAM type: NRG; PAM sequence: TAG
tccagacctacttcaaacaa

SEQ ID NO: 148159 - DNA, 20 bp, Artificial Sequence
  Description of Artificial Sequence: Synthetic oligonucleotide
  Target: ATXN1; (+) strand; PAM type: NRG; PAM sequence: TAG
ctgttttgctcaccccacac

SEQ ID NO: 148160 - DNA, 20 bp, Artificial Sequence
  Description of Artificial Sequence: Synthetic oligonucleotide
  Target: ATXN1; (+) strand; PAM type: NRG; PAM sequence: AGG
tgttttgctcaccccacact

SEQ ID NO: 148161 - DNA, 20 bp, Artificial Sequence
  Description of Artificial Sequence: Synthetic oligonucleotide
  Target: ATXN1; (+) strand; PAM type: NRG; PAM sequence: TAG
gctcaccccacactaggttt

SEQ ID NO: 148162 - DNA, 20 bp, Artificial Sequence
  Description of Artificial Sequence: Synthetic oligonucleotide
  Target: ATXN1; (+) strand; PAM type: NRG; PAM sequence: AGG
ctcaccccacactaggtttt

SEQ ID NO: 148163 - DNA, 20 bp, Artificial Sequence
  Description of Artificial Sequence: Synthetic oligonucleotide
  Target: ATXN1; (+) strand; PAM type: NRG; PAM sequence: GGG
tcaccccacactaggtttta

SEQ ID NO: 148164 - DNA, 20 bp, Artificial Sequence
  Description of Artificial Sequence: Synthetic oligonucleotide
  Target: ATXN1; (+) strand; PAM type: NRG; PAM sequence: AAG
cccacactaggttttaggga

SEQ ID NO: 148165 - DNA, 20 bp, Artificial Sequence
  Description of Artificial Sequence: Synthetic oligonucleotide
  Target: ATXN1; (+) strand; PAM type: NRG; PAM sequence: GAG
cacactaggttttagggaaa

SEQ ID NO: 148166 - DNA, 20 bp, Artificial Sequence
  Description of Artificial Sequence: Synthetic oligonucleotide
  Target: ATXN1; (+) strand; PAM type: NRG; PAM sequence: AAG
ggttttagggaaagagatat

SEQ ID NO: 148167 - DNA, 20 bp, Artificial Sequence
  Description of Artificial Sequence: Synthetic oligonucleotide
  Target: ATXN1; (+) strand; PAM type: NRG; PAM sequence: AGG
gttttagggaaagagatata

SEQ ID NO: 148168 - DNA, 20 bp, Artificial Sequence
  Description of Artificial Sequence: Synthetic oligonucleotide
  Target: ATXN1; (+) strand; PAM type: NRG; PAM sequence: GAG
aaggatacctcgtcctctgt

SEQ ID NO: 148169 - DNA, 20 bp, Artificial Sequence
  Description of Artificial Sequence: Synthetic oligonucleotide
  Target: ATXN1; (+) strand; PAM type: NRG; PAM sequence: AGG
aggatacctcgtcctctgtg

SEQ ID NO: 148170 - DNA, 20 bp, Artificial Sequence
  Description of Artificial Sequence: Synthetic oligonucleotide
  Target: ATXN1; (+) strand; PAM type: NRG; PAM sequence: CAG
tcctctgtgaggtgactcaa

SEQ ID NO: 148171 - DNA, 20 bp, Artificial Sequence
  Description of Artificial Sequence: Synthetic oligonucleotide
  Target: ATXN1; (+) strand; PAM type: NRG; PAM sequence: CAG
gtgaggtgactcaacagtca

SEQ ID NO: 148172 - DNA, 20 bp, Artificial Sequence
  Description of Artificial Sequence: Synthetic oligonucleotide
  Target: ATXN1; (+) strand; PAM type: NRG; PAM sequence: TGG
cacagacccaaactgaatga

SEQ ID NO: 148173 - DNA, 20 bp, Artificial Sequence
  Description of Artificial Sequence: Synthetic oligonucleotide
  Target: ATXN1; (+) strand; PAM type: NRG; PAM sequence: GAG
cagacccaaactgaatgatg

SEQ ID NO: 148174 - DNA, 20 bp, Artificial Sequence
  Description of Artificial Sequence: Synthetic oligonucleotide
  Target: ATXN1; (+) strand; PAM type: NRG; PAM sequence: CAG
acccaaactgaatgatggag

SEQ ID NO: 148175 - DNA, 20 bp, Artificial Sequence
  Description of Artificial Sequence: Synthetic oligonucleotide
  Target: ATXN1; (+) strand; PAM type: NRG; PAM sequence: AAG
tgatggagcagaataaaatc

SEQ ID NO: 148176 - DNA, 20 bp, Artificial Sequence
  Description of Artificial Sequence: Synthetic oligonucleotide
  Target: ATXN1; (+) strand; PAM type: NRG; PAM sequence: TAG
aagtaacgtaaacatccaca

SEQ ID NO: 148177 - DNA, 20 bp, Artificial Sequence
  Description of Artificial Sequence: Synthetic oligonucleotide
  Target: ATXN1; (+) strand; PAM type: NRG; PAM sequence: CAG
gtccaattctttccctgatc

SEQ ID NO: 148178 - DNA, 20 bp, Artificial Sequence
  Description of Artificial Sequence: Synthetic oligonucleotide
  Target: ATXN1; (+) strand; PAM type: NRG; PAM sequence: AAG
aattctttccctgatccagt

SEQ ID NO: 148179 - DNA, 20 bp, Artificial Sequence
  Description of Artificial Sequence: Synthetic oligonucleotide
  Target: ATXN1; (+) strand; PAM type: NRG; PAM sequence: CGG
ttccctgatccagtaagtca

SEQ ID NO: 148180 - DNA, 20 bp, Artificial Sequence
  Description of Artificial Sequence: Synthetic oligonucleotide
  Target: ATXN1; (+) strand; PAM type: NRG; PAM sequence: GAG
ccctgatccagtaagtcacg

SEQ ID NO: 148181 - DNA, 20 bp, Artificial Sequence
  Description of Artificial Sequence: Synthetic oligonucleotide
  Target: ATXN1; (+) strand; PAM type: NRG; PAM sequence: AGG
cctgatccagtaagtcacgg

SEQ ID NO: 148182 - DNA, 20 bp, Artificial Sequence
  Description of Artificial Sequence: Synthetic oligonucleotide
  Target: ATXN1; (+) strand; PAM type: NRG; PAM sequence: GAG
aagtcacggaggccgttcct

SEQ ID NO: 148183 - DNA, 20 bp, Artificial Sequence
  Description of Artificial Sequence: Synthetic oligonucleotide
  Target: ATXN1; (+) strand; PAM type: NRG; PAM sequence: CAG
cggaggccgttcctgagatc

SEQ ID NO: 148184 - DNA, 20 bp, Artificial Sequence
  Description of Artificial Sequence: Synthetic oligonucleotide
  Target: ATXN1; (+) strand; PAM type: NRG; PAM sequence: AAG
agatccagacctatttatac

SEQ ID NO: 148185 - DNA, 20 bp, Artificial Sequence
  Description of Artificial Sequence: Synthetic oligonucleotide
  Target: ATXN1; (+) strand; PAM type: NRG; PAM sequence: CAG
cagacctatttatacaagtg

SEQ ID NO: 148186 - DNA, 20 bp, Artificial Sequence
  Description of Artificial Sequence: Synthetic oligonucleotide
  Target: ATXN1; (+) strand; PAM type: NRG; PAM sequence: AGG
agacctatttatacaagtgc

SEQ ID NO: 148187 - DNA, 20 bp, Artificial Sequence
  Description of Artificial Sequence: Synthetic oligonucleotide
  Target: ATXN1; (+) strand; PAM type: NRG; PAM sequence: TGG
ctatttatacaagtgcaggc

SEQ ID NO: 148188 - DNA, 20 bp, Artificial Sequence
  Description of Artificial Sequence: Synthetic oligonucleotide
  Target: ATXN1; (+) strand; PAM type: NRG; PAM sequence: GGG
tatttatacaagtgcaggct

SEQ ID NO: 148189 - DNA, 20 bp, Artificial Sequence
  Description of Artificial Sequence: Synthetic oligonucleotide
  Target: ATXN1; (+) strand; PAM type: NRG; PAM sequence: AAG
aggctgggcacctttccctg

SEQ ID NO: 148190 - DNA, 20 bp, Artificial Sequence
  Description of Artificial Sequence: Synthetic oligonucleotide
  Target: ATXN1; (+) strand; PAM type: NRG; PAM sequence: AGG
ggctgggcacctttccctga

SEQ ID NO: 148191 - DNA, 20 bp, Artificial Sequence
  Description of Artificial Sequence: Synthetic oligonucleotide
  Target: ATXN1; (+) strand; PAM type: NRG; PAM sequence: CAG
ctttccctgaaggtcccact

SEQ ID NO: 148192 - DNA, 20 bp, Artificial Sequence
  Description of Artificial Sequence: Synthetic oligonucleotide
  Target: ATXN1; (+) strand; PAM type: NRG; PAM sequence: TGG
gtcccactcagttattctct

SEQ ID NO: 148193 - DNA, 20 bp, Artificial Sequence
  Description of Artificial Sequence: Synthetic oligonucleotide
  Target: ATXN1; (+) strand; PAM type: NRG; PAM sequence: CAG
ttctcttggttccccaatca

SEQ ID NO: 148194 - DNA, 20 bp, Artificial Sequence
  Description of Artificial Sequence: Synthetic oligonucleotide
  Target: ATXN1; (+) strand; PAM type: NRG; PAM sequence: GAG
cttggttccccaatcacagt

SEQ ID NO: 148195 - DNA, 20 bp, Artificial Sequence
  Description of Artificial Sequence: Synthetic oligonucleotide
  Target: ATXN1; (+) strand; PAM type: NRG; PAM sequence: TGG
ggttccccaatcacagtgag

SEQ ID NO: 148196 - DNA, 20 bp, Artificial Sequence
  Description of Artificial Sequence: Synthetic oligonucleotide
  Target: ATXN1; (+) strand; PAM type: NRG; PAM sequence: CAG
gcccattcacttcctcaaac

SEQ ID NO: 148197 - DNA, 20 bp, Artificial Sequence
  Description of Artificial Sequence: Synthetic oligonucleotide
  Target: ATXN1; (+) strand; PAM type: NRG; PAM sequence: AAG
ccaatatctaattgctcatc

SEQ ID NO: 148198 - DNA, 20 bp, Artificial Sequence
  Description of Artificial Sequence: Synthetic oligonucleotide
  Target: ATXN1; (+) strand; PAM type: NRG; PAM sequence: GAG
attgccactccaaactccat

SEQ ID NO: 148199 - DNA, 20 bp, Artificial Sequence
  Description of Artificial Sequence: Synthetic oligonucleotide
  Target: ATXN1; (+) strand; PAM type: NRG; PAM sequence: AAG
actccaaactccatgagaac

SEQ ID NO: 148200 - DNA, 20 bp, Artificial Sequence
  Description of Artificial Sequence: Synthetic oligonucleotide
  Target: ATXN1; (+) strand; PAM type: NRG; PAM sequence: AGG
ctccaaactccatgagaaca

SEQ ID NO: 148201 - DNA, 20 bp, Artificial Sequence
  Description of Artificial Sequence: Synthetic oligonucleotide
  Target: ATXN1; (+) strand; PAM type: NRG; PAM sequence: GGG
tccaaactccatgagaacaa

SEQ ID NO: 148202 - DNA, 20 bp, Artificial Sequence
  Description of Artificial Sequence: Synthetic oligonucleotide
  Target: ATXN1; (+) strand; PAM type: NRG; PAM sequence: GGG
ccaaactccatgagaacaag

SEQ ID NO: 148203 - DNA, 20 bp, Artificial Sequence
  Description of Artificial Sequence: Synthetic oligonucleotide
  Target: ATXN1; (+) strand; PAM type: NRG; PAM sequence: TGG
aacaaggggcctgtctgtcc

SEQ ID NO: 148204 - DNA, 20 bp, Artificial Sequence
  Description of Artificial Sequence: Synthetic oligonucleotide
  Target: ATXN1; (+) strand; PAM type: NRG; PAM sequence: CAG
cctgtctgtcctggtccctg

SEQ ID NO: 148205 - DNA, 20 bp, Artificial Sequence
  Description of Artificial Sequence: Synthetic oligonucleotide
  Target: ATXN1; (+) strand; PAM type: NRG; PAM sequence: AAG
gtctgtcctggtccctgcag

SEQ ID NO: 148206 - DNA, 20 bp, Artificial Sequence
  Description of Artificial Sequence: Synthetic oligonucleotide
  Target: ATXN1; (+) strand; PAM type: NRG; PAM sequence: CAG
cctggtccctgcagaagccg

SEQ ID NO: 148207 - DNA, 20 bp, Artificial Sequence
  Description of Artificial Sequence: Synthetic oligonucleotide
  Target: ATXN1; (+) strand; PAM type: NRG; PAM sequence: CAG
cctgcagaagccgcagcaca

SEQ ID NO: 148208 - DNA, 20 bp, Artificial Sequence
  Description of Artificial Sequence: Synthetic oligonucleotide
  Target: ATXN1; (+) strand; PAM type: NRG; PAM sequence: TAG
gcagcacacagacctgtgat

SEQ ID NO: 148209 - DNA, 20 bp, Artificial Sequence
  Description of Artificial Sequence: Synthetic oligonucleotide
  Target: ATXN1; (+) strand; PAM type: NRG; PAM sequence: AAG
acagacctgtgattagcatg

SEQ ID NO: 148210 - DNA, 20 bp, Artificial Sequence
  Description of Artificial Sequence: Synthetic oligonucleotide
  Target: ATXN1; (+) strand; PAM type: NRG; PAM sequence: CAG
gacctgtgattagcatgaag

SEQ ID NO: 148211 - DNA, 20 bp, Artificial Sequence
  Description of Artificial Sequence: Synthetic oligonucleotide
  Target: ATXN1; (+) strand; PAM type: NRG; PAM sequence: AGG
acctgtgattagcatgaagc

SEQ ID NO: 148212 - DNA, 20 bp, Artificial Sequence
  Description of Artificial Sequence: Synthetic oligonucleotide
  Target: ATXN1; (+) strand; PAM type: NRG; PAM sequence: TGG
agcatgaagcaggtgctctg

SEQ ID NO: 148213 - DNA, 20 bp, Artificial Sequence
  Description of Artificial Sequence: Synthetic oligonucleotide
  Target: ATXN1; (+) strand; PAM type: NRG; PAM sequence: TGG
aagcaggtgctctgtggttc

SEQ ID NO: 148214 - DNA, 20 bp, Artificial Sequence
  Description of Artificial Sequence: Synthetic oligonucleotide
  Target: ATXN1; (+) strand; PAM type: NRG; PAM sequence: TGG
ttcaacattcctctgtcacc

SEQ ID NO: 148215 - DNA, 20 bp, Artificial Sequence
  Description of Artificial Sequence: Synthetic oligonucleotide
  Target: ATXN1; (+) strand; PAM type: NRG; PAM sequence: TGG
ttctacaactgcttcctctc

SEQ ID NO: 148216 - DNA, 20 bp, Artificial Sequence
  Description of Artificial Sequence: Synthetic oligonucleotide
  Target: ATXN1; (+) strand; PAM type: NRG; PAM sequence: TGG
tggtctccttgcccaccacc

SEQ ID NO: 148217 - DNA, 20 bp, Artificial Sequence
  Description of Artificial Sequence: Synthetic oligonucleotide
  Target: ATXN1; (+) strand; PAM type: NRG; PAM sequence: TAG
cccttatcatgccaaatgca

SEQ ID NO: 148218 - DNA, 20 bp, Artificial Sequence
  Description of Artificial Sequence: Synthetic oligonucleotide
  Target: ATXN1; (+) strand; PAM type: NRG; PAM sequence: CAG
tgccaaatgcatagcactaa

SEQ ID NO: 148219 - DNA, 20 bp, Artificial Sequence
  Description of Artificial Sequence: Synthetic oligonucleotide
  Target: ATXN1; (+) strand; PAM type: NRG; PAM sequence: CAG
cctgacttttcacatcccta

SEQ ID NO: 148220 - DNA, 20 bp, Artificial Sequence
  Description of Artificial Sequence: Synthetic oligonucleotide
  Target: ATXN1; (+) strand; PAM type: NRG; PAM sequence: TGG
acatccctacagtccttgaa

SEQ ID NO: 148221 - DNA, 20 bp, Artificial Sequence
  Description of Artificial Sequence: Synthetic oligonucleotide
  Target: ATXN1; (+) strand; PAM type: NRG; PAM sequence: GGG
catccctacagtccttgaat

SEQ ID NO: 148222 - DNA, 20 bp, Artificial Sequence
  Description of Artificial Sequence: Synthetic oligonucleotide
  Target: ATXN1; (+) strand; PAM type: NRG; PAM sequence: AAG
aatgggtctacattgcatcc

SEQ ID NO: 148223 - DNA, 20 bp, Artificial Sequence
  Description of Artificial Sequence: Synthetic oligonucleotide
  Target: ATXN1; (+) strand; PAM type: NRG; PAM sequence: AAG
ttgcatccaagataaaatcc

SEQ ID NO: 148224 - DNA, 20 bp, Artificial Sequence
  Description of Artificial Sequence: Synthetic oligonucleotide
  Target: ATXN1; (+) strand; PAM type: NRG; PAM sequence: TGG
taaaatccaagatctctgct

SEQ ID NO: 148225 - DNA, 20 bp, Artificial Sequence
  Description of Artificial Sequence: Synthetic oligonucleotide
  Target: ATXN1; (+) strand; PAM type: NRG; PAM sequence: AAG
aagatctctgcttggctcac

SEQ ID NO: 148226 - DNA, 20 bp, Artificial Sequence
  Description of Artificial Sequence: Synthetic oligonucleotide
  Target: ATXN1; (+) strand; PAM type: NRG; PAM sequence: AGG
agatctctgcttggctcaca

SEQ ID NO: 148227 - DNA, 20 bp, Artificial Sequence
  Description of Artificial Sequence: Synthetic oligonucleotide
  Target: ATXN1; (+) strand; PAM type: NRG; PAM sequence: GGG
gatctctgcttggctcacaa

SEQ ID NO: 148228 - DNA, 20 bp, Artificial Sequence
  Description of Artificial Sequence: Synthetic oligonucleotide
  Target: ATXN1; (+) strand; PAM type: NRG; PAM sequence: GAG
cacaagggcccttcctgatc

SEQ ID NO: 148229 - DNA, 20 bp, Artificial Sequence
  Description of Artificial Sequence: Synthetic oligonucleotide
  Target: ATXN1; (+) strand; PAM type: NRG; PAM sequence: GAG
cccttcctgatcgagaccct

SEQ ID NO: 148230 - DNA, 20 bp, Artificial Sequence
  Description of Artificial Sequence: Synthetic oligonucleotide
  Target: ATXN1; (+) strand; PAM type: NRG; PAM sequence: TAG
atcgagaccctgagcccctc

SEQ ID NO: 148231 - DNA, 20 bp, Artificial Sequence
  Description of Artificial Sequence: Synthetic oligonucleotide
  Target: ATXN1; (+) strand; PAM type: NRG; PAM sequence: CGG
gagaccctgagcccctctag

SEQ ID NO: 148232 - DNA, 20 bp, Artificial Sequence
  Description of Artificial Sequence: Synthetic oligonucleotide
  Target: ATXN1; (+) strand; PAM type: NRG; PAM sequence: CAG
ctgagcccctctagcggtgt

SEQ ID NO: 148233 - DNA, 20 bp, Artificial Sequence
  Description of Artificial Sequence: Synthetic oligonucleotide
  Target: ATXN1; (+) strand; PAM type: NRG; PAM sequence: AGG
tgagcccctctagcggtgtc

SEQ ID NO: 148234 - DNA, 20 bp, Artificial Sequence
  Description of Artificial Sequence: Synthetic oligonucleotide
  Target: ATXN1; (+) strand; PAM type: NRG; PAM sequence: TGG
gtgtcaggcctgcctcacta

SEQ ID NO: 148235 - DNA, 20 bp, Artificial Sequence
  Description of Artificial Sequence: Synthetic oligonucleotide
  Target: ATXN1; (+) strand; PAM type: NRG; PAM sequence: CAG
caaactgcttattgctcctt

SEQ ID NO: 148236 - DNA, 20 bp, Artificial Sequence
  Description of Artificial Sequence: Synthetic oligonucleotide
  Target: ATXN1; (+) strand; PAM type: NRG; PAM sequence: AAG
tcttttgtctttctttgccc

SEQ ID NO: 148237 - DNA, 20 bp, Artificial Sequence
  Description of Artificial Sequence: Synthetic oligonucleotide
  Target: ATXN1; (+) strand; PAM type: NRG; PAM sequence: AAG
gaacaactcctcattctgaa

SEQ ID NO: 148238 - DNA, 20 bp, Artificial Sequence
  Description of Artificial Sequence: Synthetic oligonucleotide
  Target: ATXN1; (+) strand; PAM type: NRG; PAM sequence: TGG
actcctcattctgaaaagct

SEQ ID NO: 148239 - DNA, 20 bp, Artificial Sequence
  Description of Artificial Sequence: Synthetic oligonucleotide
  Target: ATXN1; (+) strand; PAM type: NRG; PAM sequence: AAG
attctgaaaagcttggactg

SEQ ID NO: 148240 - DNA, 20 bp, Artificial Sequence
  Description of Artificial Sequence: Synthetic oligonucleotide
  Target: ATXN1; (+) strand; PAM type: NRG; PAM sequence: AGG
ttctgaaaagcttggactga

SEQ ID NO: 148241 - DNA, 20 bp, Artificial Sequence
  Description of Artificial Sequence: Synthetic oligonucleotide
  Target: ATXN1; (+) strand; PAM type: NRG; PAM sequence: CAG
ggactgaaggacgtgctctg

SEQ ID NO: 148242 - DNA, 20 bp, Artificial Sequence
  Description of Artificial Sequence: Synthetic oligonucleotide
  Target: ATXN1; (+) strand; PAM type: NRG; PAM sequence: AGG
gactgaaggacgtgctctgc

SEQ ID NO: 148243 - DNA, 20 bp, Artificial Sequence
  Description of Artificial Sequence: Synthetic oligonucleotide
  Target: ATXN1; (+) strand; PAM type: NRG; PAM sequence: CAG
acgtgctctgcaggccttct

SEQ ID NO: 148244 - DNA, 20 bp, Artificial Sequence
  Description of Artificial Sequence: Synthetic oligonucleotide
  Target: ATXN1; (+) strand; PAM type: NRG; PAM sequence: CAG
cttctcagcaccctttcctc

SEQ ID NO: 148245 - DNA, 20 bp, Artificial Sequence
  Description of Artificial Sequence: Synthetic oligonucleotide
  Target: ATXN1; (+) strand; PAM type: NRG; PAM sequence: CAG
ttcctccagtcaacctgact

SEQ ID NO: 148246 - DNA, 20 bp, Artificial Sequence
  Description of Artificial Sequence: Synthetic oligonucleotide
  Target: ATXN1; (+) strand; PAM type: NRG; PAM sequence: AGG
tcctccagtcaacctgactc

SEQ ID NO: 148247 - DNA, 20 bp, Artificial Sequence
  Description of Artificial Sequence: Synthetic oligonucleotide
  Target: ATXN1; (+) strand; PAM type: NRG; PAM sequence: CAG
taccctaccataatgcttaa

SEQ ID NO: 148248 - DNA, 20 bp, Artificial Sequence
  Description of Artificial Sequence: Synthetic oligonucleotide
  Target: ATXN1; (+) strand; PAM type: NRG; PAM sequence: GAG
ccctaccataatgcttaaca

SEQ ID NO: 148249 - DNA, 20 bp, Artificial Sequence
  Description of Artificial Sequence: Synthetic oligonucleotide
  Target: ATXN1; (+) strand; PAM type: NRG; PAM sequence: GAG
ctaccataatgcttaacaga

SEQ ID NO: 148250 - DNA, 20 bp, Artificial Sequence
  Description of Artificial Sequence: Synthetic oligonucleotide
  Target: ATXN1; (+) strand; PAM type: NRG; PAM sequence: CAG
attaatctgttgcctgctcc

SEQ ID NO: 148251 - DNA, 20 bp, Artificial Sequence
  Description of Artificial Sequence: Synthetic oligonucleotide
  Target: ATXN1; (+) strand; PAM type: NRG; PAM sequence: TAG
ctgttgcctgctcccagtac

SEQ ID NO: 148252 - DNA, 20 bp, Artificial Sequence
  Description of Artificial Sequence: Synthetic oligonucleotide
  Target: ATXN1; (+) strand; PAM type: NRG; PAM sequence: GAG
gttgcctgctcccagtacta

SEQ ID NO: 148253 - DNA, 20 bp, Artificial Sequence
  Description of Artificial Sequence: Synthetic oligonucleotide
  Target: ATXN1; (+) strand; PAM type: NRG; PAM sequence: AGG
ttgcctgctcccagtactag

SEQ ID NO: 148254 - DNA, 20 bp, Artificial Sequence
  Description of Artificial Sequence: Synthetic oligonucleotide
  Target: ATXN1; (+) strand; PAM type: NRG; PAM sequence: AAG
gctcccagtactagaggtca

SEQ ID NO: 148255 - DNA, 20 bp, Artificial Sequence
  Description of Artificial Sequence: Synthetic oligonucleotide
  Target: ATXN1; (+) strand; PAM type: NRG; PAM sequence: TAG
ccacatcctatcttatgctt

SEQ ID NO: 148256 - DNA, 20 bp, Artificial Sequence
  Description of Artificial Sequence: Synthetic oligonucleotide
  Target: ATXN1; (+) strand; PAM type: NRG; PAM sequence: TAG
tatgctttagcctcaatacc

SEQ ID NO: 148257 - DNA, 20 bp, Artificial Sequence
  Description of Artificial Sequence: Synthetic oligonucleotide
  Target: ATXN1; (+) strand; PAM type: NRG; PAM sequence: GAG
tgctttagcctcaataccta

SEQ ID NO: 148258 - DNA, 20 bp, Artificial Sequence
  Description of Artificial Sequence: Synthetic oligonucleotide
  Target: ATXN1; (+) strand; PAM type: NRG; PAM sequence: CAG
tttagcctcaatacctagag

SEQ ID NO: 148259 - DNA, 20 bp, Artificial Sequence
  Description of Artificial Sequence: Synthetic oligonucleotide
  Target: ATXN1; (+) strand; PAM type: NRG; PAM sequence: TGG
tcaatacctagagcagaatt

SEQ ID NO: 148260 - DNA, 20 bp, Artificial Sequence
  Description of Artificial Sequence: Synthetic oligonucleotide
  Target: ATXN1; (+) strand; PAM type: NRG; PAM sequence: AAG
ttggcgcccaatacgtatgc

SEQ ID NO: 148261 - DNA, 20 bp, Artificial Sequence
  Description of Artificial Sequence: Synthetic oligonucleotide
  Target: ATXN1; (+) strand; PAM type: NRG; PAM sequence: AAG
aaatctttgttgaattaatg

SEQ ID NO: 148262 - DNA, 20 bp, Artificial Sequence
  Description of Artificial Sequence: Synthetic oligonucleotide
  Target: ATXN1; (+) strand; PAM type: NRG; PAM sequence: TGG
tttgttgaattaatgaagaa

SEQ ID NO: 148263 - DNA, 20 bp, Artificial Sequence
  Description of Artificial Sequence: Synthetic oligonucleotide
  Target: ATXN1; (+) strand; PAM type: NRG; PAM sequence: GAG
tgttgaattaatgaagaatg

SEQ ID NO: 148264 - DNA, 20 bp, Artificial Sequence
  Description of Artificial Sequence: Synthetic oligonucleotide
  Target: ATXN1; (+) strand; PAM type: NRG; PAM sequence: AAG
gaattaatgaagaatggaga

SEQ ID NO: 148265 - DNA, 20 bp, Artificial Sequence
  Description of Artificial Sequence: Synthetic oligonucleotide
  Target: ATXN1; (+) strand; PAM type: NRG; PAM sequence: GAG
attaatgaagaatggagaaa

SEQ ID NO: 148266 - DNA, 20 bp, Artificial Sequence
  Description of Artificial Sequence: Synthetic oligonucleotide
  Target: ATXN1; (+) strand; PAM type: NRG; PAM sequence: GAG
gaagaatggagaaagagaac

SEQ ID NO: 148267 - DNA, 20 bp, Artificial Sequence
  Description of Artificial Sequence: Synthetic oligonucleotide
  Target: ATXN1; (+) strand; PAM type: NRG; PAM sequence: GAG
agaatggagaaagagaacga

SEQ ID NO: 148268 - DNA, 20 bp, Artificial Sequence
  Description of Artificial Sequence: Synthetic oligonucleotide
  Target: ATXN1; (+) strand; PAM type: NRG; PAM sequence: AGG
gaatggagaaagagaacgag

SEQ ID NO: 148269 - DNA, 20 bp, Artificial Sequence
  Description of Artificial Sequence: Synthetic oligonucleotide
  Target: ATXN1; (+) strand; PAM type: NRG; PAM sequence: CAG
tggagaaagagaacgagagg

SEQ ID NO: 148270 - DNA, 20 bp, Artificial Sequence
  Description of Artificial Sequence: Synthetic oligonucleotide
  Target: ATXN1; (+) strand; PAM type: NRG; PAM sequence: GAG
gagaaagagaacgagaggca

SEQ ID NO: 148271 - DNA, 20 bp, Artificial Sequence
  Description of Artificial Sequence: Synthetic oligonucleotide
  Target: ATXN1; (+) strand; PAM type: NRG; PAM sequence: GAG
gaaagagaacgagaggcaga

SEQ ID NO: 148272 - DNA, 20 bp, Artificial Sequence
  Description of Artificial Sequence: Synthetic oligonucleotide
  Target: ATXN1; (+) strand; PAM type: NRG; PAM sequence: AAG
gagaacgagaggcagagaga

SEQ ID NO: 148273 - DNA, 20 bp, Artificial Sequence
  Description of Artificial Sequence: Synthetic oligonucleotide
  Target: ATXN1; (+) strand; PAM type: NRG; PAM sequence: AAG
acgagaggcagagagaaaga

SEQ ID NO: 148274 - DNA, 20 bp, Artificial Sequence
  Description of Artificial Sequence: Synthetic oligonucleotide
  Target: ATXN1; (+) strand; PAM type: NRG; PAM sequence: GAG
gagaggcagagagaaagaaa

SEQ ID NO: 148275 - DNA, 20 bp, Artificial Sequence
  Description of Artificial Sequence: Synthetic oligonucleotide
  Target: ATXN1; (+) strand; PAM type: NRG; PAM sequence: AAG
agagaaagaaagagatctta

SEQ ID NO: 148276 - DNA, 20 bp, Artificial Sequence
  Description of Artificial Sequence: Synthetic oligonucleotide
  Target: ATXN1; (+) strand; PAM type: NRG; PAM sequence: AGG
gagaaagaaagagatcttaa

SEQ ID NO: 148277 - DNA, 20 bp, Artificial Sequence
  Description of Artificial Sequence: Synthetic oligonucleotide
  Target: ATXN1; (+) strand; PAM type: NRG; PAM sequence: AAG
aaagaaagagatcttaaagg

SEQ ID NO: 148278 - DNA, 20 bp, Artificial Sequence
  Description of Artificial Sequence: Synthetic oligonucleotide
  Target: ATXN1; (+) strand; PAM type: NRG; PAM sequence: GAG
agaaagagatcttaaaggaa

SEQ ID NO: 148279 - DNA, 20 bp, Artificial Sequence
  Description of Artificial Sequence: Synthetic oligonucleotide
  Target: ATXN1; (+) strand; PAM type: NRG; PAM sequence: GAG
aaagagatcttaaaggaaga

SEQ ID NO: 148280 - DNA, 20 bp, Artificial Sequence
  Description of Artificial Sequence: Synthetic oligonucleotide
  Target: ATXN1; (+) strand; PAM type: NRG; PAM sequence: AGG
aagagatcttaaaggaagag

SEQ ID NO: 148281 - DNA, 20 bp, Artificial Sequence
  Description of Artificial Sequence: Synthetic oligonucleotide
  Target: ATXN1; (+) strand; PAM type: NRG; PAM sequence: GGG
agagatcttaaaggaagaga

SEQ ID NO: 148282 - DNA, 20 bp, Artificial Sequence
  Description of Artificial Sequence: Synthetic oligonucleotide
  Target: ATXN1; (+) strand; PAM type: NRG; PAM sequence: CGG
atcttaaaggaagagagggc

SEQ ID NO: 148283 - DNA, 20 bp, Artificial Sequence
  Description of Artificial Sequence: Synthetic oligonucleotide
  Target: ATXN1; (+) strand; PAM type: NRG; PAM sequence: GGG
tcttaaaggaagagagggcc

SEQ ID NO: 148284 - DNA, 20 bp, Artificial Sequence
  Description of Artificial Sequence: Synthetic oligonucleotide
  Target: ATXN1; (+) strand; PAM type: NRG; PAM sequence: CAG
aaggaagagagggccgggca

SEQ ID NO: 148285 - DNA, 20 bp, Artificial Sequence
  Description of Artificial Sequence: Synthetic oligonucleotide
  Target: ATXN1; (+) strand; PAM type: NRG; PAM sequence: TGG
gaagagagggccgggcacag

SEQ ID NO: 148286 - DNA, 20 bp, Artificial Sequence
  Description of Artificial Sequence: Synthetic oligonucleotide
  Target: ATXN1; (+) strand; PAM type: NRG; PAM sequence: CAG
gtggcttatgcctgtaatcc

SEQ ID NO: 148287 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 148288 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 148289 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 148290 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 148291 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 148292 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 148293 - DNA, 20 bp, Artificial Sequence
  Description of Artificial Sequence: Synthetic oligonucleotide
  Target: ATXN1; (+) strand; PAM type: NRG; PAM sequence: AAG
gcactttgggaggccgaggc

SEQ ID NO: 148294 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccgaggcaag

SEQ ID NO: 148295 - DNA, 20 bp, Artificial Sequence
  Description of Artificial Sequence: Synthetic oligonucleotide
  Target: ATXN1; (+) strand; PAM type: NRG; PAM sequence: GAG
ggccgaggcaagtggatcac

SEQ ID NO: 148296 - DNA, 20 bp, Artificial Sequence
  Description of Artificial Sequence: Synthetic oligonucleotide
  Target: ATXN1; (+) strand; PAM type: NRG; PAM sequence: AGG
gccgaggcaagtggatcacg

SEQ ID NO: 148297 - DNA, 20 bp, Artificial Sequence
  Description of Artificial Sequence: Synthetic oligonucleotide
  Target: ATXN1; (+) strand; PAM type: NRG; PAM sequence: CAG
aggcaagtggatcacgaggt

SEQ ID NO: 148298 - DNA, 20 bp, Artificial Sequence
  Description of Artificial Sequence: Synthetic oligonucleotide
  Target: ATXN1; (+) strand; PAM type: NRG; PAM sequence: AGG
ggcaagtggatcacgaggtc

SEQ ID NO: 148299 - DNA, 20 bp, Artificial Sequence
  Description of Artificial Sequence: Synthetic oligonucleotide
  Target: ATXN1; (+) strand; PAM type: NRG; PAM sequence: GAG
caagtggatcacgaggtcag

SEQ ID NO: 148300 - DNA, 20 bp, Artificial Sequence
  Description of Artificial Sequence: Synthetic oligonucleotide
  Target: ATXN1; (+) strand; PAM type: NRG; PAM sequence: AAG
gatcacgaggtcaggagttc

SEQ ID NO: 148301 - DNA, 20 bp, Artificial Sequence
  Description of Artificial Sequence: Synthetic oligonucleotide
  Target: ATXN1; (+) strand; PAM type: NRG; PAM sequence: AAG
tcaagaccatcctgaccaac

SEQ ID NO: 148302 - DNA, 20 bp, Artificial Sequence
  Description of Artificial Sequence: Synthetic oligonucleotide
  Target: ATXN1; (+) strand; PAM type: NRG; PAM sequence: AGG
caagaccatcctgaccaaca

SEQ ID NO: 148303 - DNA, 20 bp, Artificial Sequence
  Description of Artificial Sequence: Synthetic oligonucleotide
  Target: ATXN1; (+) strand; PAM type: NRG; PAM sequence: TGG
ctactaaaaacacaaaaaaa

SEQ ID NO: 148304 - DNA, 20 bp, Artificial Sequence
  Description of Artificial Sequence: Synthetic oligonucleotide
  Target: ATXN1; (+) strand; PAM type: NRG; PAM sequence: TGG
acaaaaaaatggtccgtgcg

SEQ ID NO: 148305 - DNA, 20 bp, Artificial Sequence
  Description of Artificial Sequence: Synthetic oligonucleotide
  Target: ATXN1; (+) strand; PAM type: NRG; PAM sequence: TAG
aaaaaatggtccgtgcgtgg

SEQ ID NO: 148306 - DNA, 20 bp, Artificial Sequence
  Description of Artificial Sequence: Synthetic oligonucleotide
  Target: ATXN1; (+) strand; PAM type: NRG; PAM sequence: TAG
gtagtgcacacttgtaatcc

SEQ ID NO: 148307 - DNA, 20 bp, Artificial Sequence
  Description of Artificial Sequence: Synthetic oligonucleotide
  Target: ATXN1; (+) strand; PAM type: NRG; PAM sequence: CAG
cacttgtaatcctagctact

SEQ ID NO: 148308 - DNA, 20 bp, Artificial Sequence
  Description of Artificial Sequence: Synthetic oligonucleotide
  Target: ATXN1; (+) strand; PAM type: NRG; PAM sequence: AGG
acttgtaatcctagctactc

SEQ ID NO: 148309 - DNA, 20 bp, Artificial Sequence
  Description of Artificial Sequence: Synthetic oligonucleotide
  Target: ATXN1; (+) strand; PAM type: NRG; PAM sequence: GAG
ttgtaatcctagctactcag

SEQ ID NO: 148310 - DNA, 20 bp, Artificial Sequence
  Description of Artificial Sequence: Synthetic oligonucleotide
  Target: ATXN1; (+) strand; PAM type: NRG; PAM sequence: GAG
tcctagctactcaggagact

SEQ ID NO: 148311 - DNA, 20 bp, Artificial Sequence
  Description of Artificial Sequence: Synthetic oligonucleotide
  Target: ATXN1; (+) strand; PAM type: NRG; PAM sequence: AGG
cctagctactcaggagactg

SEQ ID NO: 148312 - DNA, 20 bp, Artificial Sequence
  Description of Artificial Sequence: Synthetic oligonucleotide
  Target: ATXN1; (+) strand; PAM type: NRG; PAM sequence: CAG
agctactcaggagactgagg

SEQ ID NO: 148313 - DNA, 20 bp, Artificial Sequence
  Description of Artificial Sequence: Synthetic oligonucleotide
  Target: ATXN1; (+) strand; PAM type: NRG; PAM sequence: AGG
gctactcaggagactgaggc

SEQ ID NO: 148314 - DNA, 20 bp, Artificial Sequence
  Description of Artificial Sequence: Synthetic oligonucleotide
  Target: ATXN1; (+) strand; PAM type: NRG; PAM sequence: GAG
tactcaggagactgaggcag

SEQ ID NO: 148315 - DNA, 20 bp, Artificial Sequence
  Description of Artificial Sequence: Synthetic oligonucleotide
  Target: ATXN1; (+) strand; PAM type: NRG; PAM sequence: CAG
gcaggagaattgcttgaacc

SEQ ID NO: 148316 - DNA, 20 bp, Artificial Sequence
  Description of Artificial Sequence: Synthetic oligonucleotide
  Target: ATXN1; (+) strand; PAM type: NRG; PAM sequence: GAG
aggagaattgcttgaaccca

SEQ ID NO: 148317 - DNA, 20 bp, Artificial Sequence
  Description of Artificial Sequence: Synthetic oligonucleotide
  Target: ATXN1; (+) strand; PAM type: NRG; PAM sequence: AGG
ggagaattgcttgaacccag

SEQ ID NO: 148318 - DNA, 20 bp, Artificial Sequence
  Description of Artificial Sequence: Synthetic oligonucleotide
  Target: ATXN1; (+) strand; PAM type: NRG; PAM sequence: CGG
gaattgcttgaacccagagg

SEQ ID NO: 148319 - DNA, 20 bp, Artificial Sequence
  Description of Artificial Sequence: Synthetic oligonucleotide
  Target: ATXN1; (+) strand; PAM type: NRG; PAM sequence: AAG
ttgcttgaacccagaggcgg

SEQ ID NO: 148320 - DNA, 20 bp, Artificial Sequence
  Description of Artificial Sequence: Synthetic oligonucleotide
  Target: ATXN1; (+) strand; PAM type: NRG; PAM sequence: CAG
gaacccagaggcggaagttg

SEQ ID NO: 148321 - DNA, 20 bp, Artificial Sequence
  Description of Artificial Sequence: Synthetic oligonucleotide
  Target: ATXN1; (+) strand; PAM type: NRG; PAM sequence: AGG
aacccagaggcggaagttgc

SEQ ID NO: 148322 - DNA, 20 bp, Artificial Sequence
  Description of Artificial Sequence: Synthetic oligonucleotide
  Target: ATXN1; (+) strand; PAM type: NRG; PAM sequence: GGG
acccagaggcggaagttgca

SEQ ID NO: 148323 - DNA, 20 bp, Artificial Sequence
  Description of Artificial Sequence: Synthetic oligonucleotide
  Target: ATXN1; (+) strand; PAM type: NRG; PAM sequence: GAG
ccagaggcggaagttgcagg

SEQ ID NO: 148324 - DNA, 20 bp, Artificial Sequence
  Description of Artificial Sequence: Synthetic oligonucleotide
  Target: ATXN1; (+) strand; PAM type: NRG; PAM sequence: GAG
ggcggaagttgcagggagcc

SEQ ID NO: 148325 - DNA, 20 bp, Artificial Sequence
  Description of Artificial Sequence: Synthetic oligonucleotide
  Target: ATXN1; (+) strand; PAM type: NRG; PAM sequence: CAG
gagattgcaccattgcgctc

SEQ ID NO: 148326 - DNA, 20 bp, Artificial Sequence
  Description of Artificial Sequence: Synthetic oligonucleotide
  Target: ATXN1; (+) strand; PAM type: NRG; PAM sequence: TGG
tgcaccattgcgctccagcc

SEQ ID NO: 148327 - DNA, 20 bp, Artificial Sequence
  Description of Artificial Sequence: Synthetic oligonucleotide
  Target: ATXN1; (+) strand; PAM type: NRG; PAM sequence: GGG
gcaccattgcgctccagcct

SEQ ID NO: 148328 - DNA, 20 bp, Artificial Sequence
  Description of Artificial Sequence: Synthetic oligonucleotide
  Target: ATXN1; (+) strand; PAM type: NRG; PAM sequence: CAG
ttgcgctccagcctgggcga

SEQ ID NO: 148329 - DNA, 20 bp, Artificial Sequence
  Description of Artificial Sequence: Synthetic oligonucleotide
  Target: ATXN1; (+) strand; PAM type: NRG; PAM sequence: GAG
gcgctccagcctgggcgaca

SEQ ID NO: 148330 - DNA, 20 bp, Artificial Sequence
  Description of Artificial Sequence: Synthetic oligonucleotide
  Target: ATXN1; (+) strand; PAM type: NRG; PAM sequence: AAG
tccagcctgggcgacagagc

SEQ ID NO: 148331 - DNA, 20 bp, Artificial Sequence
  Description of Artificial Sequence: Synthetic oligonucleotide
  Target: ATXN1; (+) strand; PAM type: NRG; PAM sequence: AAG
atctcaaaaaaaaaaaaaaa

SEQ ID NO: 148332 - DNA, 20 bp, Artificial Sequence
  Description of Artificial Sequence: Synthetic oligonucleotide
  Target: ATXN1; (+) strand; PAM type: NRG; PAM sequence: AGG
tctcaaaaaaaaaaaaaaaa

SEQ ID NO: 148333 - DNA, 20 bp, Artificial Sequence
  Description of Artificial Sequence: Synthetic oligonucleotide
  Target: ATXN1; (+) strand; PAM type: NRG; PAM sequence: AAG
caaaaaaaaaaaaaaaaagg

SEQ ID NO: 148334 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaaaggaaga

SEQ ID NO: 148335 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaggaagaaaga

SEQ ID NO: 148336 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaggaagaaagaaa

SEQ ID NO: 148337 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaggaagaaagaaag

SEQ ID NO: 148338 - DNA, 20 bp, Artificial Sequence
  Description of Artificial Sequence: Synthetic oligonucleotide
  Target: ATXN1; (+) strand; PAM type: NRG; PAM sequence: GAG
gaagaaagaaagaggaccct

SEQ ID NO: 148339 - DNA, 20 bp, Artificial Sequence
  Description of Artificial Sequence: Synthetic oligonucleotide
  Target: ATXN1; (+) strand; PAM type: NRG; PAM sequence: GAG
agaaagaaagaggaccctga

SEQ ID NO: 148340 - DNA, 20 bp, Artificial Sequence
  Description of Artificial Sequence: Synthetic oligonucleotide
  Target: ATXN1; (+) strand; PAM type: NRG; PAM sequence: AGG
gaaagaaagaggaccctgag

SEQ ID NO: 148341 - DNA, 20 bp, Artificial Sequence
  Description of Artificial Sequence: Synthetic oligonucleotide
  Target: ATXN1; (+) strand; PAM type: NRG; PAM sequence: GGG
aaagaaagaggaccctgaga

SEQ ID NO: 148342 - DNA, 20 bp, Artificial Sequence
  Description of Artificial Sequence: Synthetic oligonucleotide
  Target: ATXN1; (+) strand; PAM type: NRG; PAM sequence: AAG
aagaggaccctgagagggtt

SEQ ID NO: 148343 - DNA, 20 bp, Artificial Sequence
  Description of Artificial Sequence: Synthetic oligonucleotide
  Target: ATXN1; (+) strand; PAM type: NRG; PAM sequence: CAG
agagggttaagtgctttatt

SEQ ID NO: 148344 - DNA, 20 bp, Artificial Sequence
  Description of Artificial Sequence: Synthetic oligonucleotide
  Target: ATXN1; (+) strand; PAM type: NRG; PAM sequence: AGG
gagggttaagtgctttattc

SEQ ID NO: 148345 - DNA, 20 bp, Artificial Sequence
  Description of Artificial Sequence: Synthetic oligonucleotide
  Target: ATXN1; (+) strand; PAM type: NRG; PAM sequence: GGG
agggttaagtgctttattca

SEQ ID NO: 148346 - DNA, 20 bp, Artificial Sequence
  Description of Artificial Sequence: Synthetic oligonucleotide
  Target: ATXN1; (+) strand; PAM type: NRG; PAM sequence: CAG
ttattcagggctaaataaac

SEQ ID NO: 148347 - DNA, 20 bp, Artificial Sequence
  Description of Artificial Sequence: Synthetic oligonucleotide
  Target: ATXN1; (+) strand; PAM type: NRG; PAM sequence: TGG
cagggctaaataaaccagac

SEQ ID NO: 148348 - DNA, 20 bp, Artificial Sequence
  Description of Artificial Sequence: Synthetic oligonucleotide
  Target: ATXN1; (+) strand; PAM type: NRG; PAM sequence: GGG
agggctaaataaaccagact

SEQ ID NO: 148349 - DNA, 20 bp, Artificial Sequence
  Description of Artificial Sequence: Synthetic oligonucleotide
  Target: ATXN1; (+) strand; PAM type: NRG; PAM sequence: AAG
taaataaaccagactgggac

SEQ ID NO: 148350 - DNA, 20 bp, Artificial Sequence
  Description of Artificial Sequence: Synthetic oligonucleotide
  Target: ATXN1; (+) strand; PAM type: NRG; PAM sequence: CAG
accagactgggacaagaatt

SEQ ID NO: 148351 - DNA, 20 bp, Artificial Sequence
  Description of Artificial Sequence: Synthetic oligonucleotide
  Target: ATXN1; (+) strand; PAM type: NRG; PAM sequence: AGG
ccagactgggacaagaattc

SEQ ID NO: 148352 - DNA, 20 bp, Artificial Sequence
  Description of Artificial Sequence: Synthetic oligonucleotide
  Target: ATXN1; (+) strand; PAM type: NRG; PAM sequence: TGG
ggcctcctaactttctctga

SEQ ID NO: 148353 - DNA, 20 bp, Artificial Sequence
  Description of Artificial Sequence: Synthetic oligonucleotide
  Target: ATXN1; (+) strand; PAM type: NRG; PAM sequence: TAG
ttcactttatcacctcccgc

SEQ ID NO: 148354 - DNA, 20 bp, Artificial Sequence
  Description of Artificial Sequence: Synthetic oligonucleotide
  Target: ATXN1; (+) strand; PAM type: NRG; PAM sequence: GAG
tttatcacctcccgctagac

SEQ ID NO: 148355 - DNA, 20 bp, Artificial Sequence
  Description of Artificial Sequence: Synthetic oligonucleotide
  Target: ATXN1; (+) strand; PAM type: NRG; PAM sequence: CAG
tcccgctagacgagcttcta

SEQ ID NO: 148356 - DNA, 20 bp, Artificial Sequence
  Description of Artificial Sequence: Synthetic oligonucleotide
  Target: ATXN1; (+) strand; PAM type: NRG; PAM sequence: CAG
agcttctacagttttcctaa

SEQ ID NO: 148357 - DNA, 20 bp, Artificial Sequence
  Description of Artificial Sequence: Synthetic oligonucleotide
  Target: ATXN1; (+) strand; PAM type: NRG; PAM sequence: TAG
ctatcatctcttttcaatcc

SEQ ID NO: 148358 - DNA, 20 bp, Artificial Sequence
  Description of Artificial Sequence: Synthetic oligonucleotide
  Target: ATXN1; (+) strand; PAM type: NRG; PAM sequence: TAG
tctcttttcaatcctagact

SEQ ID NO: 148359 - DNA, 20 bp, Artificial Sequence
  Description of Artificial Sequence: Synthetic oligonucleotide
  Target: ATXN1; (+) strand; PAM type: NRG; PAM sequence: TGG
ctgtcacctaaatgtctcat

SEQ ID NO: 148360 - DNA, 20 bp, Artificial Sequence
  Description of Artificial Sequence: Synthetic oligonucleotide
  Target: ATXN1; (+) strand; PAM type: NRG; PAM sequence: CAG
tcacctaaatgtctcattgg

SEQ ID NO: 148361 - DNA, 20 bp, Artificial Sequence
  Description of Artificial Sequence: Synthetic oligonucleotide
  Target: ATXN1; (+) strand; PAM type: NRG; PAM sequence: AAG
cattggcagctcaaattcaa

SEQ ID NO: 148362 - DNA, 20 bp, Artificial Sequence
  Description of Artificial Sequence: Synthetic oligonucleotide
  Target: ATXN1; (+) strand; PAM type: NRG; PAM sequence: AAG
cagctcaaattcaaaagatg

SEQ ID NO: 148363 - DNA, 20 bp, Artificial Sequence
  Description of Artificial Sequence: Synthetic oligonucleotide
  Target: ATXN1; (+) strand; PAM type: NRG; PAM sequence: AAG
tttctaaccaccctgccacc

SEQ ID NO: 148364 - DNA, 20 bp, Artificial Sequence
  Description of Artificial Sequence: Synthetic oligonucleotide
  Target: ATXN1; (+) strand; PAM type: NRG; PAM sequence: AAG
accaccctgccaccaagaaa

SEQ ID NO: 148365 - DNA, 20 bp, Artificial Sequence
  Description of Artificial Sequence: Synthetic oligonucleotide
  Target: ATXN1; (+) strand; PAM type: NRG; PAM sequence: AAG
accctgccaccaagaaaaag

SEQ ID NO: 148366 - DNA, 20 bp, Artificial Sequence
  Description of Artificial Sequence: Synthetic oligonucleotide
  Target: ATXN1; (+) strand; PAM type: NRG; PAM sequence: CAG
aaaaagaagttgttcctcct

SEQ ID NO: 148367 - DNA, 20 bp, Artificial Sequence
  Description of Artificial Sequence: Synthetic oligonucleotide
  Target: ATXN1; (+) strand; PAM type: NRG; PAM sequence: AGG
aaaagaagttgttcctcctc

SEQ ID NO: 148368 - DNA, 20 bp, Artificial Sequence
  Description of Artificial Sequence: Synthetic oligonucleotide
  Target: ATXN1; (+) strand; PAM type: NRG; PAM sequence: TAG
tgttcctcctcaggaatctg

SEQ ID NO: 148369 - DNA, 20 bp, Artificial Sequence
  Description of Artificial Sequence: Synthetic oligonucleotide
  Target: ATXN1; (+) strand; PAM type: NRG; PAM sequence: AGG
gttcctcctcaggaatctgt

SEQ ID NO: 148370 - DNA, 20 bp, Artificial Sequence
  Description of Artificial Sequence: Synthetic oligonucleotide
  Target: ATXN1; (+) strand; PAM type: NRG; PAM sequence: CAG
gctcctcctccccattcata

SEQ ID NO: 148371 - DNA, 20 bp, Artificial Sequence
  Description of Artificial Sequence: Synthetic oligonucleotide
  Target: ATXN1; (+) strand; PAM type: NRG; PAM sequence: CAG
ctcctccccattcatacagt

SEQ ID NO: 148372 - DNA, 20 bp, Artificial Sequence
  Description of Artificial Sequence: Synthetic oligonucleotide
  Target: ATXN1; (+) strand; PAM type: NRG; PAM sequence: GAG
cattcatacagtcagcactt

SEQ ID NO: 148373 - DNA, 20 bp, Artificial Sequence
  Description of Artificial Sequence: Synthetic oligonucleotide
  Target: ATXN1; (+) strand; PAM type: NRG; PAM sequence: CAG
catacagtcagcacttgaga

SEQ ID NO: 148374 - DNA, 20 bp, Artificial Sequence
  Description of Artificial Sequence: Synthetic oligonucleotide
  Target: ATXN1; (+) strand; PAM type: NRG; PAM sequence: TGG
cagcacttgagacagaaatg

SEQ ID NO: 148375 - DNA, 20 bp, Artificial Sequence
  Description of Artificial Sequence: Synthetic oligonucleotide
  Target: ATXN1; (+) strand; PAM type: NRG; PAM sequence: AAG
cacttgagacagaaatgtgg

SEQ ID NO: 148376 - DNA, 20 bp, Artificial Sequence
  Description of Artificial Sequence: Synthetic oligonucleotide
  Target: ATXN1; (+) strand; PAM type: NRG; PAM sequence: TAG
tgagacagaaatgtggaagc

SEQ ID NO: 148377 - DNA, 20 bp, Artificial Sequence
  Description of Artificial Sequence: Synthetic oligonucleotide
  Target: ATXN1; (+) strand; PAM type: NRG; PAM sequence: TAG
tttaattactatttctatac

SEQ ID NO: 148378 - DNA, 20 bp, Artificial Sequence
  Description of Artificial Sequence: Synthetic oligonucleotide
  Target: ATXN1; (+) strand; PAM type: NRG; PAM sequence: AGG
ttaattactatttctatact

SEQ ID NO: 148379 - DNA, 20 bp, Artificial Sequence
  Description of Artificial Sequence: Synthetic oligonucleotide
  Target: ATXN1; (+) strand; PAM type: NRG; PAM sequence: TGG
atgtcttatttcatttaaaa

SEQ ID NO: 148380 - DNA, 20 bp, Artificial Sequence
  Description of Artificial Sequence: Synthetic oligonucleotide
  Target: ATXN1; (+) strand; PAM type: NRG; PAM sequence: CAG
tcttatttcatttaaaatgg

SEQ ID NO: 148381 - DNA, 20 bp, Artificial Sequence
  Description of Artificial Sequence: Synthetic oligonucleotide
  Target: ATXN1; (+) strand; PAM type: NRG; PAM sequence: TGG
aaaatggcagaaccaaacct

SEQ ID NO: 148382 - DNA, 20 bp, Artificial Sequence
  Description of Artificial Sequence: Synthetic oligonucleotide
  Target: ATXN1; (+) strand; PAM type: NRG; PAM sequence: AAG
tggcagaaccaaaccttggt

SEQ ID NO: 148383 - DNA, 20 bp, Artificial Sequence
  Description of Artificial Sequence: Synthetic oligonucleotide
  Target: ATXN1; (+) strand; PAM type: NRG; PAM sequence: AAG
cagaaccaaaccttggtaag

SEQ ID NO: 148384 - DNA, 20 bp, Artificial Sequence
  Description of Artificial Sequence: Synthetic oligonucleotide
  Target: ATXN1; (+) strand; PAM type: NRG; PAM sequence: TGG
ttggtaagaagtcatgcaaa

SEQ ID NO: 148385 - DNA, 20 bp, Artificial Sequence
  Description of Artificial Sequence: Synthetic oligonucleotide
  Target: ATXN1; (+) strand; PAM type: NRG; PAM sequence: TGG
gaagtcatgcaaatggaatt

SEQ ID NO: 148386 - DNA, 20 bp, Artificial Sequence
  Description of Artificial Sequence: Synthetic oligonucleotide
  Target: ATXN1; (+) strand; PAM type: NRG; PAM sequence: GGG
aagtcatgcaaatggaattt

SEQ ID NO: 148387 - DNA, 20 bp, Artificial Sequence
  Description of Artificial Sequence: Synthetic oligonucleotide
  Target: ATXN1; (+) strand; PAM type: NRG; PAM sequence: GAG
gtcatgcaaatggaatttgg

SEQ ID NO: 148388 - DNA, 20 bp, Artificial Sequence
  Description of Artificial Sequence: Synthetic oligonucleotide
  Target: ATXN1; (+) strand; PAM type: NRG; PAM sequence: AGG
tcatgcaaatggaatttggg

SEQ ID NO: 148389 - DNA, 20 bp, Artificial Sequence
  Description of Artificial Sequence: Synthetic oligonucleotide
  Target: ATXN1; (+) strand; PAM type: NRG; PAM sequence: GGG
catgcaaatggaatttggga

SEQ ID NO: 148390 - DNA, 20 bp, Artificial Sequence
  Description of Artificial Sequence: Synthetic oligonucleotide
  Target: ATXN1; (+) strand; PAM type: NRG; PAM sequence: AAG
gcaaatggaatttgggaggg

SEQ ID NO: 148391 - DNA, 20 bp, Artificial Sequence
  Description of Artificial Sequence: Synthetic oligonucleotide
  Target: ATXN1; (+) strand; PAM type: NRG; PAM sequence: GAG
aaatggaatttgggagggaa

SEQ ID NO: 148392 - DNA, 20 bp, Artificial Sequence
  Description of Artificial Sequence: Synthetic oligonucleotide
  Target: ATXN1; (+) strand; PAM type: NRG; PAM sequence: TAG
gaatttgggagggaagagaa

SEQ ID NO: 148393 - DNA, 20 bp, Artificial Sequence
  Description of Artificial Sequence: Synthetic oligonucleotide
  Target: ATXN1; (+) strand; PAM type: NRG; PAM sequence: AGG
aatttgggagggaagagaat

SEQ ID NO: 148394 - DNA, 20 bp, Artificial Sequence
  Description of Artificial Sequence: Synthetic oligonucleotide
  Target: ATXN1; (+) strand; PAM type: NRG; PAM sequence: GGG
atttgggagggaagagaata

SEQ ID NO: 148395 - DNA, 20 bp, Artificial Sequence
  Description of Artificial Sequence: Synthetic oligonucleotide
  Target: ATXN1; (+) strand; PAM type: NRG; PAM sequence: TAG
tgggagggaagagaataggg

SEQ ID NO: 148396 - DNA, 20 bp, Artificial Sequence
  Description of Artificial Sequence: Synthetic oligonucleotide
  Target: ATXN1; (+) strand; PAM type: NRG; PAM sequence: AGG
gggagggaagagaatagggt

SEQ ID NO: 148397 - DNA, 20 bp, Artificial Sequence
  Description of Artificial Sequence: Synthetic oligonucleotide
  Target: ATXN1; (+) strand; PAM type: NRG; PAM sequence: AAG
aatagggtaggaaaaaataa

SEQ ID NO: 148398 - DNA, 20 bp, Artificial Sequence
  Description of Artificial Sequence: Synthetic oligonucleotide
  Target: ATXN1; (+) strand; PAM type: NRG; PAM sequence: TGG
tgatatttgccactcatact

SEQ ID NO: 148399 - DNA, 20 bp, Artificial Sequence
  Description of Artificial Sequence: Synthetic oligonucleotide
  Target: ATXN1; (+) strand; PAM type: NRG; PAM sequence: CGG
aatacaacaccaaatcctcc

SEQ ID NO: 148400 - DNA, 20 bp, Artificial Sequence
  Description of Artificial Sequence: Synthetic oligonucleotide
  Target: ATXN1; (+) strand; PAM type: NRG; PAM sequence: CAG
aatcctcccggttgttccac

SEQ ID NO: 148401 - DNA, 20 bp, Artificial Sequence
  Description of Artificial Sequence: Synthetic oligonucleotide
  Target: ATXN1; (+) strand; PAM type: NRG; PAM sequence: TGG
ctactgccactactctaacc

SEQ ID NO: 148402 - DNA, 20 bp, Artificial Sequence
  Description of Artificial Sequence: Synthetic oligonucleotide
  Target: ATXN1; (+) strand; PAM type: NRG; PAM sequence: AAG
ctctaacctggaccctccta

SEQ ID NO: 148403 - DNA, 20 bp, Artificial Sequence
  Description of Artificial Sequence: Synthetic oligonucleotide
  Target: ATXN1; (+) strand; PAM type: NRG; PAM sequence: TGG
tggaccctcctaaagtctcc

SEQ ID NO: 148404 - DNA, 20 bp, Artificial Sequence
  Description of Artificial Sequence: Synthetic oligonucleotide
  Target: ATXN1; (+) strand; PAM type: NRG; PAM sequence: AAG
aaagtctcctggacttcttc

SEQ ID NO: 148405 - DNA, 20 bp, Artificial Sequence
  Description of Artificial Sequence: Synthetic oligonucleotide
  Target: ATXN1; (+) strand; PAM type: NRG; PAM sequence: GAG
agtctcctggacttcttcaa

SEQ ID NO: 148406 - DNA, 20 bp, Artificial Sequence
  Description of Artificial Sequence: Synthetic oligonucleotide
  Target: ATXN1; (+) strand; PAM type: NRG; PAM sequence: TAG
tggacttcttcaagagtacc

SEQ ID NO: 148407 - DNA, 20 bp, Artificial Sequence
  Description of Artificial Sequence: Synthetic oligonucleotide
  Target: ATXN1; (+) strand; PAM type: NRG; PAM sequence: TGG
cttcttcaagagtacctaga

SEQ ID NO: 148408 - DNA, 20 bp, Artificial Sequence
  Description of Artificial Sequence: Synthetic oligonucleotide
  Target: ATXN1; (+) strand; PAM type: NRG; PAM sequence: CAG
attctatcttctactctgcc

SEQ ID NO: 148409 - DNA, 20 bp, Artificial Sequence
  Description of Artificial Sequence: Synthetic oligonucleotide
  Target: ATXN1; (+) strand; PAM type: NRG; PAM sequence: GAG
tctatcttctactctgccca

SEQ ID NO: 148410 - DNA, 20 bp, Artificial Sequence
  Description of Artificial Sequence: Synthetic oligonucleotide
  Target: ATXN1; (+) strand; PAM type: NRG; PAM sequence: AAG
ccagagaatgaactttctaa

SEQ ID NO: 148411 - DNA, 20 bp, Artificial Sequence
  Description of Artificial Sequence: Synthetic oligonucleotide
  Target: ATXN1; (+) strand; PAM type: NRG; PAM sequence: TAG
gagaatgaactttctaaaag

SEQ ID NO: 148412 - DNA, 20 bp, Artificial Sequence
  Description of Artificial Sequence: Synthetic oligonucleotide
  Target: ATXN1; (+) strand; PAM type: NRG; PAM sequence: AAG
aatgaactttctaaaagtag

SEQ ID NO: 148413 - DNA, 20 bp, Artificial Sequence
  Description of Artificial Sequence: Synthetic oligonucleotide
  Target: ATXN1; (+) strand; PAM type: NRG; PAM sequence: CGG
ctaaaagtagaagtcatttc

SEQ ID NO: 148414 - DNA, 20 bp, Artificial Sequence
  Description of Artificial Sequence: Synthetic oligonucleotide
  Target: ATXN1; (+) strand; PAM type: NRG; PAM sequence: AAG
tagaagtcatttccggttcc

SEQ ID NO: 148415 - DNA, 20 bp, Artificial Sequence
  Description of Artificial Sequence: Synthetic oligonucleotide
  Target: ATXN1; (+) strand; PAM type: NRG; PAM sequence: AAG
agtcatttccggttccaagc

SEQ ID NO: 148416 - DNA, 20 bp, Artificial Sequence
  Description of Artificial Sequence: Synthetic oligonucleotide
  Target: ATXN1; (+) strand; PAM type: NRG; PAM sequence: AGG
gtcatttccggttccaagca

SEQ ID NO: 148417 - DNA, 20 bp, Artificial Sequence
  Description of Artificial Sequence: Synthetic oligonucleotide
  Target: ATXN1; (+) strand; PAM type: NRG; PAM sequence: TGG
atttccggttccaagcaagg

SEQ ID NO: 148418 - DNA, 20 bp, Artificial Sequence
  Description of Artificial Sequence: Synthetic oligonucleotide
  Target: ATXN1; (+) strand; PAM type: NRG; PAM sequence: GGG
tttccggttccaagcaaggt

SEQ ID NO: 148419 - DNA, 20 bp, Artificial Sequence
  Description of Artificial Sequence: Synthetic oligonucleotide
  Target: ATXN1; (+) strand; PAM type: NRG; PAM sequence: GGG
ttccggttccaagcaaggtg

SEQ ID NO: 148420 - DNA, 20 bp, Artificial Sequence
  Description of Artificial Sequence: Synthetic oligonucleotide
  Target: ATXN1; (+) strand; PAM type: NRG; PAM sequence: AAG
cggttccaagcaaggtgggg

SEQ ID NO: 148421 - DNA, 20 bp, Artificial Sequence
  Description of Artificial Sequence: Synthetic oligonucleotide
  Target: ATXN1; (+) strand; PAM type: NRG; PAM sequence: CAG
agcaaggtggggaagttgca

SEQ ID NO: 148422 - DNA, 20 bp, Artificial Sequence
  Description of Artificial Sequence: Synthetic oligonucleotide
  Target: ATXN1; (+) strand; PAM type: NRG; PAM sequence: AGG
gcaaggtggggaagttgcac

SEQ ID NO: 148423 - DNA, 20 bp, Artificial Sequence
  Description of Artificial Sequence: Synthetic oligonucleotide
  Target: ATXN1; (+) strand; PAM type: NRG; PAM sequence: TAG
ggtggggaagttgcacaggc

SEQ ID NO: 148424 - DNA, 20 bp, Artificial Sequence
  Description of Artificial Sequence: Synthetic oligonucleotide
  Target: ATXN1; (+) strand; PAM type: NRG; PAM sequence: GAG
tggggaagttgcacaggcta

SEQ ID NO: 148425 - DNA, 20 bp, Artificial Sequence
  Description of Artificial Sequence: Synthetic oligonucleotide
  Target: ATXN1; (+) strand; PAM type: NRG; PAM sequence: AGG
ggggaagttgcacaggctag

SEQ ID NO: 148426 - DNA, 20 bp, Artificial Sequence
  Description of Artificial Sequence: Synthetic oligonucleotide
  Target: ATXN1; (+) strand; PAM type: NRG; PAM sequence: CAG
gcacaggctagaggttgatg

SEQ ID NO: 148427 - DNA, 20 bp, Artificial Sequence
  Description of Artificial Sequence: Synthetic oligonucleotide
  Target: ATXN1; (+) strand; PAM type: NRG; PAM sequence: GAG
ggctagaggttgatgcagct

SEQ ID NO: 148428 - DNA, 20 bp, Artificial Sequence
  Description of Artificial Sequence: Synthetic oligonucleotide
  Target: ATXN1; (+) strand; PAM type: NRG; PAM sequence: GAG
ctagaggttgatgcagctga

SEQ ID NO: 148429 - DNA, 20 bp, Artificial Sequence
  Description of Artificial Sequence: Synthetic oligonucleotide
  Target: ATXN1; (+) strand; PAM type: NRG; PAM sequence: TGG
gagagttattttccatgtga

SEQ ID NO: 148430 - DNA, 20 bp, Artificial Sequence
  Description of Artificial Sequence: Synthetic oligonucleotide
  Target: ATXN1; (+) strand; PAM type: NRG; PAM sequence: GGG
agagttattttccatgtgat

SEQ ID NO: 148431 - DNA, 20 bp, Artificial Sequence
  Description of Artificial Sequence: Synthetic oligonucleotide
  Target: ATXN1; (+) strand; PAM type: NRG; PAM sequence: GGG
gagttattttccatgtgatg

SEQ ID NO: 148432 - DNA, 20 bp, Artificial Sequence
  Description of Artificial Sequence: Synthetic oligonucleotide
  Target: ATXN1; (+) strand; PAM type: NRG; PAM sequence: CAG
catgtgatggggaattcttg

SEQ ID NO: 148433 - DNA, 20 bp, Artificial Sequence
  Description of Artificial Sequence: Synthetic oligonucleotide
  Target: ATXN1; (+) strand; PAM type: NRG; PAM sequence: AGG
atgtgatggggaattcttgc

SEQ ID NO: 148434 - DNA, 20 bp, Artificial Sequence
  Description of Artificial Sequence: Synthetic oligonucleotide
  Target: ATXN1; (+) strand; PAM type: NRG; PAM sequence: AAG
gatggggaattcttgcagga

SEQ ID NO: 148435 - DNA, 20 bp, Artificial Sequence
  Description of Artificial Sequence: Synthetic oligonucleotide
  Target: ATXN1; (+) strand; PAM type: NRG; PAM sequence: AAG
ggggaattcttgcaggaaag

SEQ ID NO: 148436 - DNA, 20 bp, Artificial Sequence
  Description of Artificial Sequence: Synthetic oligonucleotide
  Target: ATXN1; (+) strand; PAM type: NRG; PAM sequence: AGG
gggaattcttgcaggaaaga

SEQ ID NO: 148437 - DNA, 20 bp, Artificial Sequence
  Description of Artificial Sequence: Synthetic oligonucleotide
  Target: ATXN1; (+) strand; PAM type: NRG; PAM sequence: TGG
aattcttgcaggaaagaagg

SEQ ID NO: 148438 - DNA, 20 bp, Artificial Sequence
  Description of Artificial Sequence: Synthetic oligonucleotide
  Target: ATXN1; (+) strand; PAM type: NRG; PAM sequence: AAG
ttgcaggaaagaaggtggtt

SEQ ID NO: 148439 - DNA, 20 bp, Artificial Sequence
  Description of Artificial Sequence: Synthetic oligonucleotide
  Target: ATXN1; (+) strand; PAM type: NRG; PAM sequence: CAG
gaaagaaggtggttaagtct

SEQ ID NO: 148440 - DNA, 20 bp, Artificial Sequence
  Description of Artificial Sequence: Synthetic oligonucleotide
  Target: ATXN1; (+) strand; PAM type: NRG; PAM sequence: TAG
agaaggtggttaagtctcag

SEQ ID NO: 148441 - DNA, 20 bp, Artificial Sequence
  Description of Artificial Sequence: Synthetic oligonucleotide
  Target: ATXN1; (+) strand; PAM type: NRG; PAM sequence: GAG
aaggtggttaagtctcagta

SEQ ID NO: 148442 - DNA, 20 bp, Artificial Sequence
  Description of Artificial Sequence: Synthetic oligonucleotide
  Target: ATXN1; (+) strand; PAM type: NRG; PAM sequence: AGG
aggtggttaagtctcagtag

SEQ ID NO: 148443 - DNA, 20 bp, Artificial Sequence
  Description of Artificial Sequence: Synthetic oligonucleotide
  Target: ATXN1; (+) strand; PAM type: NRG; PAM sequence: GGG
ggtggttaagtctcagtaga

SEQ ID NO: 148444 - DNA, 20 bp, Artificial Sequence
  Description of Artificial Sequence: Synthetic oligonucleotide
  Target: ATXN1; (+) strand; PAM type: NRG; PAM sequence: TGG
agtctcagtagagggaacac

SEQ ID NO: 148445 - DNA, 20 bp, Artificial Sequence
  Description of Artificial Sequence: Synthetic oligonucleotide
  Target: ATXN1; (+) strand; PAM type: NRG; PAM sequence: GGG
gtctcagtagagggaacact

SEQ ID NO: 148446 - DNA, 20 bp, Artificial Sequence
  Description of Artificial Sequence: Synthetic oligonucleotide
  Target: ATXN1; (+) strand; PAM type: NRG; PAM sequence: GGG
tctcagtagagggaacactg

SEQ ID NO: 148447 - DNA, 20 bp, Artificial Sequence
  Description of Artificial Sequence: Synthetic oligonucleotide
  Target: ATXN1; (+) strand; PAM type: NRG; PAM sequence: TAG
agagggaacactggggaaaa

SEQ ID NO: 148448 - DNA, 20 bp, Artificial Sequence
  Description of Artificial Sequence: Synthetic oligonucleotide
  Target: ATXN1; (+) strand; PAM type: NRG; PAM sequence: CAG
gggaacactggggaaaatag

SEQ ID NO: 148449 - DNA, 20 bp, Artificial Sequence
  Description of Artificial Sequence: Synthetic oligonucleotide
  Target: ATXN1; (+) strand; PAM type: NRG; PAM sequence: GAG
actggggaaaatagcagact

SEQ ID NO: 148450 - DNA, 20 bp, Artificial Sequence
  Description of Artificial Sequence: Synthetic oligonucleotide
  Target: ATXN1; (+) strand; PAM type: NRG; PAM sequence: GAG
tggggaaaatagcagactga

SEQ ID NO: 148451 - DNA, 20 bp, Artificial Sequence
  Description of Artificial Sequence: Synthetic oligonucleotide
  Target: ATXN1; (+) strand; PAM type: NRG; PAM sequence: GAG
gggaaaatagcagactgaga

SEQ ID NO: 148452 - DNA, 20 bp, Artificial Sequence
  Description of Artificial Sequence: Synthetic oligonucleotide
  Target: ATXN1; (+) strand; PAM type: NRG; PAM sequence: AAG
aaaatagcagactgagagag

SEQ ID NO: 148453 - DNA, 20 bp, Artificial Sequence
  Description of Artificial Sequence: Synthetic oligonucleotide
  Target: ATXN1; (+) strand; PAM type: NRG; PAM sequence: GAG
aatagcagactgagagagaa

SEQ ID NO: 148454 - DNA, 20 bp, Artificial Sequence
  Description of Artificial Sequence: Synthetic oligonucleotide
  Target: ATXN1; (+) strand; PAM type: NRG; PAM sequence: AGG
atagcagactgagagagaag

SEQ ID NO: 148455 - DNA, 20 bp, Artificial Sequence
  Description of Artificial Sequence: Synthetic oligonucleotide
  Target: ATXN1; (+) strand; PAM type: NRG; PAM sequence: TGG
ctgagagagaagaggtccaa

SEQ ID NO: 148456 - DNA, 20 bp, Artificial Sequence
  Description of Artificial Sequence: Synthetic oligonucleotide
  Target: ATXN1; (+) strand; PAM type: NRG; PAM sequence: GAG
agaagaggtccaatggttat

SEQ ID NO: 148457 - DNA, 20 bp, Artificial Sequence
  Description of Artificial Sequence: Synthetic oligonucleotide
  Target: ATXN1; (+) strand; PAM type: NRG; PAM sequence: TGG
agaggtccaatggttatgag

SEQ ID NO: 148458 - DNA, 20 bp, Artificial Sequence
  Description of Artificial Sequence: Synthetic oligonucleotide
  Target: ATXN1; (+) strand; PAM type: NRG; PAM sequence: GGG
gaggtccaatggttatgagt

SEQ ID NO: 148459 - DNA, 20 bp, Artificial Sequence
  Description of Artificial Sequence: Synthetic oligonucleotide
  Target: ATXN1; (+) strand; PAM type: NRG; PAM sequence: GGG
aggtccaatggttatgagtg

SEQ ID NO: 148460 - DNA, 20 bp, Artificial Sequence
  Description of Artificial Sequence: Synthetic oligonucleotide
  Target: ATXN1; (+) strand; PAM type: NRG; PAM sequence: GGG
ggtccaatggttatgagtgg

SEQ ID NO: 148461 - DNA, 20 bp, Artificial Sequence
  Description of Artificial Sequence: Synthetic oligonucleotide
  Target: ATXN1; (+) strand; PAM type: NRG; PAM sequence: GAG
tccaatggttatgagtgggg

SEQ ID NO: 148462 - DNA, 20 bp, Artificial Sequence
  Description of Artificial Sequence: Synthetic oligonucleotide
  Target: ATXN1; (+) strand; PAM type: NRG; PAM sequence: TGG
ttatgagtgggggagtcatt

SEQ ID NO: 148463 - DNA, 20 bp, Artificial Sequence
  Description of Artificial Sequence: Synthetic oligonucleotide
  Target: ATXN1; (+) strand; PAM type: NRG; PAM sequence: GGG
tatgagtgggggagtcattt

SEQ ID NO: 148464 - DNA, 20 bp, Artificial Sequence
  Description of Artificial Sequence: Synthetic oligonucleotide
  Target: ATXN1; (+) strand; PAM type: NRG; PAM sequence: GGG
atgagtgggggagtcatttg

SEQ ID NO: 148465 - DNA, 20 bp, Artificial Sequence
  Description of Artificial Sequence: Synthetic oligonucleotide
  Target: ATXN1; (+) strand; PAM type: NRG; PAM sequence: TAG
taaaaattactgataatttt

SEQ ID NO: 148466 - DNA, 20 bp, Artificial Sequence
  Description of Artificial Sequence: Synthetic oligonucleotide
  Target: ATXN1; (+) strand; PAM type: NRG; PAM sequence: AAG
actgataatttttagacata

SEQ ID NO: 148467 - DNA, 20 bp, Artificial Sequence
  Description of Artificial Sequence: Synthetic oligonucleotide
  Target: ATXN1; (+) strand; PAM type: NRG; PAM sequence: AGG
ctgataatttttagacataa

SEQ ID NO: 148468 - DNA, 20 bp, Artificial Sequence
  Description of Artificial Sequence: Synthetic oligonucleotide
  Target: ATXN1; (+) strand; PAM type: NRG; PAM sequence: AAG
aggaaactatgtttatacct

SEQ ID NO: 148469 - DNA, 20 bp, Artificial Sequence
  Description of Artificial Sequence: Synthetic oligonucleotide
  Target: ATXN1; (+) strand; PAM type: NRG; PAM sequence: AAG
cctaagtttatgtttaaata

SEQ ID NO: 148470 - DNA, 20 bp, Artificial Sequence
  Description of Artificial Sequence: Synthetic oligonucleotide
  Target: ATXN1; (+) strand; PAM type: NRG; PAM sequence: AGG
ctaagtttatgtttaaataa

SEQ ID NO: 148471 - DNA, 20 bp, Artificial Sequence
  Description of Artificial Sequence: Synthetic oligonucleotide
  Target: ATXN1; (+) strand; PAM type: NRG; PAM sequence: AAG
aataaaggtataaatgctac

SEQ ID NO: 148472 - DNA, 20 bp, Artificial Sequence
  Description of Artificial Sequence: Synthetic oligonucleotide
  Target: ATXN1; (+) strand; PAM type: NRG; PAM sequence: CGG
agaataaaataaaatgtgtt

SEQ ID NO: 148473 - DNA, 20 bp, Artificial Sequence
  Description of Artificial Sequence: Synthetic oligonucleotide
  Target: ATXN1; (+) strand; PAM type: NRG; PAM sequence: GGG
gaataaaataaaatgtgttc

SEQ ID NO: 148474 - DNA, 20 bp, Artificial Sequence
  Description of Artificial Sequence: Synthetic oligonucleotide
  Target: ATXN1; (+) strand; PAM type: NRG; PAM sequence: AAG
aaaaaaatccgatctatcca

SEQ ID NO: 148475 - DNA, 20 bp, Artificial Sequence
  Description of Artificial Sequence: Synthetic oligonucleotide
  Target: ATXN1; (+) strand; PAM type: NRG; PAM sequence: AGG
aaaaaatccgatctatccaa

SEQ ID NO: 148476 - DNA, 20 bp, Artificial Sequence
  Description of Artificial Sequence: Synthetic oligonucleotide
  Target: ATXN1; (+) strand; PAM type: NRG; PAM sequence: AAG
aaatccgatctatccaaagg

SEQ ID NO: 148477 - DNA, 20 bp, Artificial Sequence
  Description of Artificial Sequence: Synthetic oligonucleotide
  Target: ATXN1; (+) strand; PAM type: NRG; PAM sequence: AAG
ccgatctatccaaaggaaga

SEQ ID NO: 148478 - DNA, 20 bp, Artificial Sequence
  Description of Artificial Sequence: Synthetic oligonucleotide
  Target: ATXN1; (+) strand; PAM type: NRG; PAM sequence: AAG
gcaaaacaaaacaaaacaaa

SEQ ID NO: 148479 - DNA, 20 bp, Artificial Sequence
  Description of Artificial Sequence: Synthetic oligonucleotide
  Target: ATXN1; (+) strand; PAM type: NRG; PAM sequence: AAG
acaaaacaaaacaaaaagta

SEQ ID NO: 148480 - DNA, 20 bp, Artificial Sequence
  Description of Artificial Sequence: Synthetic oligonucleotide
  Target: ATXN1; (+) strand; PAM type: NRG; PAM sequence: AAG
acaaaacaaaaagtaaagcc

SEQ ID NO: 148481 - DNA, 20 bp, Artificial Sequence
  Description of Artificial Sequence: Synthetic oligonucleotide
  Target: ATXN1; (+) strand; PAM type: NRG; PAM sequence: TAG
aaacaaaaagtaaagccaag

SEQ ID NO: 148482 - DNA, 20 bp, Artificial Sequence
  Description of Artificial Sequence: Synthetic oligonucleotide
  Target: ATXN1; (+) strand; PAM type: NRG; PAM sequence: AAG
caagtagaaaacattaaatg

SEQ ID NO: 148483 - DNA, 20 bp, Artificial Sequence
  Description of Artificial Sequence: Synthetic oligonucleotide
  Target: ATXN1; (+) strand; PAM type: NRG; PAM sequence: CAG
aatcttaataaaaatgatta

SEQ ID NO: 148484 - DNA, 20 bp, Artificial Sequence
  Description of Artificial Sequence: Synthetic oligonucleotide
  Target: ATXN1; (+) strand; PAM type: NRG; PAM sequence: AAG
ttaataaaaatgattacagt

SEQ ID NO: 148485 - DNA, 20 bp, Artificial Sequence
  Description of Artificial Sequence: Synthetic oligonucleotide
  Target: ATXN1; (+) strand; PAM type: NRG; PAM sequence: AGG
taataaaaatgattacagta

SEQ ID NO: 148486 - DNA, 20 bp, Artificial Sequence
  Description of Artificial Sequence: Synthetic oligonucleotide
  Target: ATXN1; (+) strand; PAM type: NRG; PAM sequence: TGG
atgattacagtaaggataac

SEQ ID NO: 148487 - DNA, 20 bp, Artificial Sequence
  Description of Artificial Sequence: Synthetic oligonucleotide
  Target: ATXN1; (+) strand; PAM type: NRG; PAM sequence: GGG
tgattacagtaaggataact

SEQ ID NO: 148488 - DNA, 20 bp, Artificial Sequence
  Description of Artificial Sequence: Synthetic oligonucleotide
  Target: ATXN1; (+) strand; PAM type: NRG; PAM sequence: AAG
agtaaggataactgggtata

SEQ ID NO: 148489 - DNA, 20 bp, Artificial Sequence
  Description of Artificial Sequence: Synthetic oligonucleotide
  Target: ATXN1; (+) strand; PAM type: NRG; PAM sequence: CAG
taaagtcactaatcaaataa

SEQ ID NO: 148490 - DNA, 20 bp, Artificial Sequence
  Description of Artificial Sequence: Synthetic oligonucleotide
  Target: ATXN1; (+) strand; PAM type: NRG; PAM sequence: GAG
aagtcactaatcaaataaca

SEQ ID NO: 148491 - DNA, 20 bp, Artificial Sequence
  Description of Artificial Sequence: Synthetic oligonucleotide
  Target: ATXN1; (+) strand; PAM type: NRG; PAM sequence: AAG
actaatcaaataacagagac

SEQ ID NO: 148492 - DNA, 20 bp, Artificial Sequence
  Description of Artificial Sequence: Synthetic oligonucleotide
  Target: ATXN1; (+) strand; PAM type: NRG; PAM sequence: CAG
tcaaataacagagacaagta

SEQ ID NO: 148493 - DNA, 20 bp, Artificial Sequence
  Description of Artificial Sequence: Synthetic oligonucleotide
  Target: ATXN1; (+) strand; PAM type: NRG; PAM sequence: GAG
aaataacagagacaagtaca

SEQ ID NO: 148494 - DNA, 20 bp, Artificial Sequence
  Description of Artificial Sequence: Synthetic oligonucleotide
  Target: ATXN1; (+) strand; PAM type: NRG; PAM sequence: TGG
acagagctatgcacaatatg

SEQ ID NO: 148495 - DNA, 20 bp, Artificial Sequence
  Description of Artificial Sequence: Synthetic oligonucleotide
  Target: ATXN1; (+) strand; PAM type: NRG; PAM sequence: TGG
gagctatgcacaatatgtgg

SEQ ID NO: 148496 - DNA, 20 bp, Artificial Sequence
  Description of Artificial Sequence: Synthetic oligonucleotide
  Target: ATXN1; (+) strand; PAM type: NRG; PAM sequence: GGG
agctatgcacaatatgtggt

SEQ ID NO: 148497 - DNA, 20 bp, Artificial Sequence
  Description of Artificial Sequence: Synthetic oligonucleotide
  Target: ATXN1; (+) strand; PAM type: NRG; PAM sequence: GGG
gctatgcacaatatgtggtg

SEQ ID NO: 148498 - DNA, 20 bp, Artificial Sequence
  Description of Artificial Sequence: Synthetic oligonucleotide
  Target: ATXN1; (+) strand; PAM type: NRG; PAM sequence: GGG
ctatgcacaatatgtggtgg

SEQ ID NO: 148499 - DNA, 20 bp, Artificial Sequence
  Description of Artificial Sequence: Synthetic oligonucleotide
  Target: ATXN1; (+) strand; PAM type: NRG; PAM sequence: GGG
tatgcacaatatgtggtggg

SEQ ID NO: 148500 - DNA, 20 bp, Artificial Sequence
  Description of Artificial Sequence: Synthetic oligonucleotide
  Target: ATXN1; (+) strand; PAM type: NRG; PAM sequence: GGG
atgcacaatatgtggtgggg

SEQ ID NO: 148501 - DNA, 20 bp, Artificial Sequence
  Description of Artificial Sequence: Synthetic oligonucleotide
  Target: ATXN1; (+) strand; PAM type: NRG; PAM sequence: AAG
cacaatatgtggtggggggg

SEQ ID NO: 148502 - DNA, 20 bp, Artificial Sequence
  Description of Artificial Sequence: Synthetic oligonucleotide
  Target: ATXN1; (+) strand; PAM type: NRG; PAM sequence: AAG
tacaatgacattaaaactaa

SEQ ID NO: 148503 - DNA, 20 bp, Artificial Sequence
  Description of Artificial Sequence: Synthetic oligonucleotide
  Target: ATXN1; (+) strand; PAM type: NRG; PAM sequence: AAG
aaactaaaagatttttaaaa

SEQ ID NO: 148504 - DNA, 20 bp, Artificial Sequence
  Description of Artificial Sequence: Synthetic oligonucleotide
  Target: ATXN1; (+) strand; PAM type: NRG; PAM sequence: AAG
atttttaaaaaagaaaatat

SEQ ID NO: 148505 - DNA, 20 bp, Artificial Sequence
  Description of Artificial Sequence: Synthetic oligonucleotide
  Target: ATXN1; (+) strand; PAM type: NRG; PAM sequence: CAG
gcaaaactaaaaacaaaaac

SEQ ID NO: 148506 - DNA, 20 bp, Artificial Sequence
  Description of Artificial Sequence: Synthetic oligonucleotide
  Target: ATXN1; (+) strand; PAM type: NRG; PAM sequence: AGG
caaaactaaaaacaaaaacc

SEQ ID NO: 148507 - DNA, 20 bp, Artificial Sequence
  Description of Artificial Sequence: Synthetic oligonucleotide
  Target: ATXN1; (+) strand; PAM type: NRG; PAM sequence: TAG
actaaaaacaaaaaccagga

SEQ ID NO: 148508 - DNA, 20 bp, Artificial Sequence
  Description of Artificial Sequence: Synthetic oligonucleotide
  Target: ATXN1; (+) strand; PAM type: NRG; PAM sequence: CAG
caggatagcactctgaatat

SEQ ID NO: 148509 - DNA, 20 bp, Artificial Sequence
  Description of Artificial Sequence: Synthetic oligonucleotide
  Target: ATXN1; (+) strand; PAM type: NRG; PAM sequence: TGG
actctgaatatcagacaaaa

SEQ ID NO: 148510 - DNA, 20 bp, Artificial Sequence
  Description of Artificial Sequence: Synthetic oligonucleotide
  Target: ATXN1; (+) strand; PAM type: NRG; PAM sequence: AAG
tatcagacaaaatggaatgt

SEQ ID NO: 148511 - DNA, 20 bp, Artificial Sequence
  Description of Artificial Sequence: Synthetic oligonucleotide
  Target: ATXN1; (+) strand; PAM type: NRG; PAM sequence: AGG
atcagacaaaatggaatgta

SEQ ID NO: 148512 - DNA, 20 bp, Artificial Sequence
  Description of Artificial Sequence: Synthetic oligonucleotide
  Target: ATXN1; (+) strand; PAM type: NRG; PAM sequence: AAG
aaaatggaatgtaaggttaa

SEQ ID NO: 148513 - DNA, 20 bp, Artificial Sequence
  Description of Artificial Sequence: Synthetic oligonucleotide
  Target: ATXN1; (+) strand; PAM type: NRG; PAM sequence: TGG
gttaaaagcattataaatga

SEQ ID NO: 148514 - DNA, 20 bp, Artificial Sequence
  Description of Artificial Sequence: Synthetic oligonucleotide
  Target: ATXN1; (+) strand; PAM type: NRG; PAM sequence: GAG
aaagcattataaatgatggt

SEQ ID NO: 148515 - DNA, 20 bp, Artificial Sequence
  Description of Artificial Sequence: Synthetic oligonucleotide
  Target: ATXN1; (+) strand; PAM type: NRG; PAM sequence: AGG
aagcattataaatgatggtg

SEQ ID NO: 148516 - DNA, 20 bp, Artificial Sequence
  Description of Artificial Sequence: Synthetic oligonucleotide
  Target: ATXN1; (+) strand; PAM type: NRG; PAM sequence: GGG
agcattataaatgatggtga

SEQ ID NO: 148517 - DNA, 20 bp, Artificial Sequence
  Description of Artificial Sequence: Synthetic oligonucleotide
  Target: ATXN1; (+) strand; PAM type: NRG; PAM sequence: TAG
aatgatggtgagggacatcc

SEQ ID NO: 148518 - DNA, 20 bp, Artificial Sequence
  Description of Artificial Sequence: Synthetic oligonucleotide
  Target: ATXN1; (+) strand; PAM type: NRG; PAM sequence: AGG
atgatggtgagggacatcct

SEQ ID NO: 148519 - DNA, 20 bp, Artificial Sequence
  Description of Artificial Sequence: Synthetic oligonucleotide
  Target: ATXN1; (+) strand; PAM type: NRG; PAM sequence: TGG
tggtgagggacatcctaggc

SEQ ID NO: 148520 - DNA, 20 bp, Artificial Sequence
  Description of Artificial Sequence: Synthetic oligonucleotide
  Target: ATXN1; (+) strand; PAM type: NRG; PAM sequence: AAG
gggacatcctaggctggcaa

SEQ ID NO: 148521 - DNA, 20 bp, Artificial Sequence
  Description of Artificial Sequence: Synthetic oligonucleotide
  Target: ATXN1; (+) strand; PAM type: NRG; PAM sequence: AGG
ggacatcctaggctggcaaa

SEQ ID NO: 148522 - DNA, 20 bp, Artificial Sequence
  Description of Artificial Sequence: Synthetic oligonucleotide
  Target: ATXN1; (+) strand; PAM type: NRG; PAM sequence: AAG
ggcaaaaggaacaaccaata

SEQ ID NO: 148523 - DNA, 20 bp, Artificial Sequence
  Description of Artificial Sequence: Synthetic oligonucleotide
  Target: ATXN1; (+) strand; PAM type: NRG; PAM sequence: TGG
catacatgcatctaacaaaa

SEQ ID NO: 148524 - DNA, 20 bp, Artificial Sequence
  Description of Artificial Sequence: Synthetic oligonucleotide
  Target: ATXN1; (+) strand; PAM type: NRG; PAM sequence: CAG
atgcatctaacaaaatggca

SEQ ID NO: 148525 - DNA, 20 bp, Artificial Sequence
  Description of Artificial Sequence: Synthetic oligonucleotide
  Target: ATXN1; (+) strand; PAM type: NRG; PAM sequence: GAG
gcatctaacaaaatggcaca

SEQ ID NO: 148526 - DNA, 20 bp, Artificial Sequence
  Description of Artificial Sequence: Synthetic oligonucleotide
  Target: ATXN1; (+) strand; PAM type: NRG; PAM sequence: AAG
aaatggcacagagatattta

SEQ ID NO: 148527 - DNA, 20 bp, Artificial Sequence
  Description of Artificial Sequence: Synthetic oligonucleotide
  Target: ATXN1; (+) strand; PAM type: NRG; PAM sequence: AAG
tatttaaagcaacaactatg

SEQ ID NO: 148528 - DNA, 20 bp, Artificial Sequence
  Description of Artificial Sequence: Synthetic oligonucleotide
  Target: ATXN1; (+) strand; PAM type: NRG; PAM sequence: GAG
tttaaagcaacaactatgaa

SEQ ID NO: 148529 - DNA, 20 bp, Artificial Sequence
  Description of Artificial Sequence: Synthetic oligonucleotide
  Target: ATXN1; (+) strand; PAM type: NRG; PAM sequence: TAG
taaataaataaaaatgtaat

SEQ ID NO: 148530 - DNA, 20 bp, Artificial Sequence
  Description of Artificial Sequence: Synthetic oligonucleotide
  Target: ATXN1; (+) strand; PAM type: NRG; PAM sequence: AAG
taaaaatgtaattagcaatt

SEQ ID NO: 148531 - DNA, 20 bp, Artificial Sequence
  Description of Artificial Sequence: Synthetic oligonucleotide
  Target: ATXN1; (+) strand; PAM type: NRG; PAM sequence: AGG
aaaaatgtaattagcaatta

SEQ ID NO: 148532 - DNA, 20 bp, Artificial Sequence
  Description of Artificial Sequence: Synthetic oligonucleotide
  Target: ATXN1; (+) strand; PAM type: NRG; PAM sequence: AAG
taattagcaattaaggaaaa

SEQ ID NO: 148533 - DNA, 20 bp, Artificial Sequence
  Description of Artificial Sequence: Synthetic oligonucleotide
  Target: ATXN1; (+) strand; PAM type: NRG; PAM sequence: AGG
aattagcaattaaggaaaaa

SEQ ID NO: 148534 - DNA, 20 bp, Artificial Sequence
  Description of Artificial Sequence: Synthetic oligonucleotide
  Target: ATXN1; (+) strand; PAM type: NRG; PAM sequence: GGG
attagcaattaaggaaaaaa

SEQ ID NO: 148535 - DNA, 20 bp, Artificial Sequence
  Description of Artificial Sequence: Synthetic oligonucleotide
  Target: ATXN1; (+) strand; PAM type: NRG; PAM sequence: AAG
agcaattaaggaaaaaaggg

SEQ ID NO: 148536 - DNA, 20 bp, Artificial Sequence
  Description of Artificial Sequence: Synthetic oligonucleotide
  Target: ATXN1; (+) strand; PAM type: NRG; PAM sequence: TAG
tgaattaaaatgtttactac

SEQ ID NO: 148537 - DNA, 20 bp, Artificial Sequence
  Description of Artificial Sequence: Synthetic oligonucleotide
  Target: ATXN1; (+) strand; PAM type: NRG; PAM sequence: CAG
gtttactactagacaattcc

SEQ ID NO: 148538 - DNA, 20 bp, Artificial Sequence
  Description of Artificial Sequence: Synthetic oligonucleotide
  Target: ATXN1; (+) strand; PAM type: NRG; PAM sequence: GAG
ttactactagacaattccca

SEQ ID NO: 148539 - DNA, 20 bp, Artificial Sequence
  Description of Artificial Sequence: Synthetic oligonucleotide
  Target: ATXN1; (+) strand; PAM type: NRG; PAM sequence: AGG
tactactagacaattcccag

SEQ ID NO: 148540 - DNA, 20 bp, Artificial Sequence
  Description of Artificial Sequence: Synthetic oligonucleotide
  Target: ATXN1; (+) strand; PAM type: NRG; PAM sequence: TGG
aattcccagaggaaataaaa

SEQ ID NO: 148541 - DNA, 20 bp, Artificial Sequence
  Description of Artificial Sequence: Synthetic oligonucleotide
  Target: ATXN1; (+) strand; PAM type: NRG; PAM sequence: GAG
aaatggaaatacaaaatact

SEQ ID NO: 148542 - DNA, 20 bp, Artificial Sequence
  Description of Artificial Sequence: Synthetic oligonucleotide
  Target: ATXN1; (+) strand; PAM type: NRG; PAM sequence: AAG
gaaatacaaaatactgagtt

SEQ ID NO: 148543 - DNA, 20 bp, Artificial Sequence
  Description of Artificial Sequence: Synthetic oligonucleotide
  Target: ATXN1; (+) strand; PAM type: NRG; PAM sequence: AAG
actgagttaagtgacaataa

SEQ ID NO: 148544 - DNA, 20 bp, Artificial Sequence
  Description of Artificial Sequence: Synthetic oligonucleotide
  Target: ATXN1; (+) strand; PAM type: NRG; PAM sequence: AAG
gtacaatgcaattaaaacat

SEQ ID NO: 148545 - DNA, 20 bp, Artificial Sequence
  Description of Artificial Sequence: Synthetic oligonucleotide
  Target: ATXN1; (+) strand; PAM type: NRG; PAM sequence: AGG
tacaatgcaattaaaacata

SEQ ID NO: 148546 - DNA, 20 bp, Artificial Sequence
  Description of Artificial Sequence: Synthetic oligonucleotide
  Target: ATXN1; (+) strand; PAM type: NRG; PAM sequence: GGG
acaatgcaattaaaacataa

SEQ ID NO: 148547 - DNA, 20 bp, Artificial Sequence
  Description of Artificial Sequence: Synthetic oligonucleotide
  Target: ATXN1; (+) strand; PAM type: NRG; PAM sequence: AAG
aaaacataagggctcattgc

SEQ ID NO: 148548 - DNA, 20 bp, Artificial Sequence
  Description of Artificial Sequence: Synthetic oligonucleotide
  Target: ATXN1; (+) strand; PAM type: NRG; PAM sequence: CGG
aagggctcattgcaagacct

SEQ ID NO: 148549 - DNA, 20 bp, Artificial Sequence
  Description of Artificial Sequence: Synthetic oligonucleotide
  Target: ATXN1; (+) strand; PAM type: NRG; PAM sequence: AAG
tcattgcaagacctcggctg

SEQ ID NO: 148550 - DNA, 20 bp, Artificial Sequence
  Description of Artificial Sequence: Synthetic oligonucleotide
  Target: ATXN1; (+) strand; PAM type: NRG; PAM sequence: CAG
gacctcggctgaagtctgaa

SEQ ID NO: 148551 - DNA, 20 bp, Artificial Sequence
  Description of Artificial Sequence: Synthetic oligonucleotide
  Target: ATXN1; (+) strand; PAM type: NRG; PAM sequence: CAG
gctgaagtctgaacagcctg

SEQ ID NO: 148552 - DNA, 20 bp, Artificial Sequence
  Description of Artificial Sequence: Synthetic oligonucleotide
  Target: ATXN1; (+) strand; PAM type: NRG; PAM sequence: TAG
tgaacagcctgcagctcttg

SEQ ID NO: 148553 - DNA, 20 bp, Artificial Sequence
  Description of Artificial Sequence: Synthetic oligonucleotide
  Target: ATXN1; (+) strand; PAM type: NRG; PAM sequence: CAG
gcagctcttgtagccatatt

SEQ ID NO: 148554 - DNA, 20 bp, Artificial Sequence
  Description of Artificial Sequence: Synthetic oligonucleotide
  Target: ATXN1; (+) strand; PAM type: NRG; PAM sequence: CAG
tcttgtagccatattcagat

SEQ ID NO: 148555 - DNA, 20 bp, Artificial Sequence
  Description of Artificial Sequence: Synthetic oligonucleotide
  Target: ATXN1; (+) strand; PAM type: NRG; PAM sequence: TAG
tgtagccatattcagatcag

SEQ ID NO: 148556 - DNA, 20 bp, Artificial Sequence
  Description of Artificial Sequence: Synthetic oligonucleotide
  Target: ATXN1; (+) strand; PAM type: NRG; PAM sequence: TAG
tattcagatcagtagatttc

SEQ ID NO: 148557 - DNA, 20 bp, Artificial Sequence
  Description of Artificial Sequence: Synthetic oligonucleotide
  Target: ATXN1; (+) strand; PAM type: NRG; PAM sequence: AAG
agatcagtagatttctagac

SEQ ID NO: 148558 - DNA, 20 bp, Artificial Sequence
  Description of Artificial Sequence: Synthetic oligonucleotide
  Target: ATXN1; (+) strand; PAM type: NRG; PAM sequence: AGG
gatcagtagatttctagaca

SEQ ID NO: 148559 - DNA, 20 bp, Artificial Sequence
  Description of Artificial Sequence: Synthetic oligonucleotide
  Target: ATXN1; (+) strand; PAM type: NRG; PAM sequence: GAG
tcagtagatttctagacaag

SEQ ID NO: 148560 - DNA, 20 bp, Artificial Sequence
  Description of Artificial Sequence: Synthetic oligonucleotide
  Target: ATXN1; (+) strand; PAM type: NRG; PAM sequence: CAG
ttctagacaaggagaattgc

SEQ ID NO: 148561 - DNA, 20 bp, Artificial Sequence
  Description of Artificial Sequence: Synthetic oligonucleotide
  Target: ATXN1; (+) strand; PAM type: NRG; PAM sequence: GAG
ctagacaaggagaattgcca

SEQ ID NO: 148562 - DNA, 20 bp, Artificial Sequence
  Description of Artificial Sequence: Synthetic oligonucleotide
  Target: ATXN1; (+) strand; PAM type: NRG; PAM sequence: AAG
aaggagaattgccagagtta

SEQ ID NO: 148563 - DNA, 20 bp, Artificial Sequence
  Description of Artificial Sequence: Synthetic oligonucleotide
  Target: ATXN1; (+) strand; PAM type: NRG; PAM sequence: AGG
aggagaattgccagagttaa

SEQ ID NO: 148564 - DNA, 20 bp, Artificial Sequence
  Description of Artificial Sequence: Synthetic oligonucleotide
  Target: ATXN1; (+) strand; PAM type: NRG; PAM sequence: GGG
ggagaattgccagagttaaa

SEQ ID NO: 148565 - DNA, 20 bp, Artificial Sequence
  Description of Artificial Sequence: Synthetic oligonucleotide
  Target: ATXN1; (+) strand; PAM type: NRG; PAM sequence: AAG
gggtcatttcataataatta

SEQ ID NO: 148566 - DNA, 20 bp, Artificial Sequence
  Description of Artificial Sequence: Synthetic oligonucleotide
  Target: ATXN1; (+) strand; PAM type: NRG; PAM sequence: AGG
ggtcatttcataataattaa

SEQ ID NO: 148567 - DNA, 20 bp, Artificial Sequence
  Description of Artificial Sequence: Synthetic oligonucleotide
  Target: ATXN1; (+) strand; PAM type: NRG; PAM sequence: GGG
gtcatttcataataattaaa

SEQ ID NO: 148568 - DNA, 20 bp, Artificial Sequence
  Description of Artificial Sequence: Synthetic oligonucleotide
  Target: ATXN1; (+) strand; PAM type: NRG; PAM sequence: TAG
taattaaagggtgtacttat

SEQ ID NO: 148569 - DNA, 20 bp, Artificial Sequence
  Description of Artificial Sequence: Synthetic oligonucleotide
  Target: ATXN1; (+) strand; PAM type: NRG; PAM sequence: AGG
aattaaagggtgtacttatt

SEQ ID NO: 148570 - DNA, 20 bp, Artificial Sequence
  Description of Artificial Sequence: Synthetic oligonucleotide
  Target: ATXN1; (+) strand; PAM type: NRG; PAM sequence: AAG
taaagggtgtacttattagg

SEQ ID NO: 148571 - DNA, 20 bp, Artificial Sequence
  Description of Artificial Sequence: Synthetic oligonucleotide
  Target: ATXN1; (+) strand; PAM type: NRG; PAM sequence: AAG
ggaagatacatcaatcttaa

SEQ ID NO: 148572 - DNA, 20 bp, Artificial Sequence
  Description of Artificial Sequence: Synthetic oligonucleotide
  Target: ATXN1; (+) strand; PAM type: NRG; PAM sequence: TAG
atcttaaaagtgtgtgtacc

SEQ ID NO: 148573 - DNA, 20 bp, Artificial Sequence
  Description of Artificial Sequence: Synthetic oligonucleotide
  Target: ATXN1; (+) strand; PAM type: NRG; PAM sequence: AGG
tcttaaaagtgtgtgtacct

SEQ ID NO: 148574 - DNA, 20 bp, Artificial Sequence
  Description of Artificial Sequence: Synthetic oligonucleotide
  Target: ATXN1; (+) strand; PAM type: NRG; PAM sequence: CAG
aaagtgtgtgtacctaggaa

SEQ ID NO: 148575 - DNA, 20 bp, Artificial Sequence
  Description of Artificial Sequence: Synthetic oligonucleotide
  Target: ATXN1; (+) strand; PAM type: NRG; PAM sequence: AAG
tacctaggaacagaaaaaaa

SEQ ID NO: 148576 - DNA, 20 bp, Artificial Sequence
  Description of Artificial Sequence: Synthetic oligonucleotide
  Target: ATXN1; (+) strand; PAM type: NRG; PAM sequence: AAG
ctaggaacagaaaaaaaaag

SEQ ID NO: 148577 - DNA, 20 bp, Artificial Sequence
  Description of Artificial Sequence: Synthetic oligonucleotide
  Target: ATXN1; (+) strand; PAM type: NRG; PAM sequence: CAG
aaaaaagaagacgttcaaat

SEQ ID NO: 148578 - DNA, 20 bp, Artificial Sequence
  Description of Artificial Sequence: Synthetic oligonucleotide
  Target: ATXN1; (+) strand; PAM type: NRG; PAM sequence: TAG
agacgttcaaatcagtgata

SEQ ID NO: 148579 - DNA, 20 bp, Artificial Sequence
  Description of Artificial Sequence: Synthetic oligonucleotide
  Target: ATXN1; (+) strand; PAM type: NRG; PAM sequence: GAG
acgttcaaatcagtgatata

SEQ ID NO: 148580 - DNA, 20 bp, Artificial Sequence
  Description of Artificial Sequence: Synthetic oligonucleotide
  Target: ATXN1; (+) strand; PAM type: NRG; PAM sequence: AAG
tcaaatcagtgatatagaga

SEQ ID NO: 148581 - DNA, 20 bp, Artificial Sequence
  Description of Artificial Sequence: Synthetic oligonucleotide
  Target: ATXN1; (+) strand; PAM type: NRG; PAM sequence: AGG
caaatcagtgatatagagaa

SEQ ID NO: 148582 - DNA, 20 bp, Artificial Sequence
  Description of Artificial Sequence: Synthetic oligonucleotide
  Target: ATXN1; (+) strand; PAM type: NRG; PAM sequence: AAG
tcagtgatatagagaaagga

SEQ ID NO: 148583 - DNA, 20 bp, Artificial Sequence
  Description of Artificial Sequence: Synthetic oligonucleotide
  Target: ATXN1; (+) strand; PAM type: NRG; PAM sequence: AAG
tgatatagagaaaggaaagc

SEQ ID NO: 148584 - DNA, 20 bp, Artificial Sequence
  Description of Artificial Sequence: Synthetic oligonucleotide
  Target: ATXN1; (+) strand; PAM type: NRG; PAM sequence: CAG
atagagaaaggaaagcaagc

SEQ ID NO: 148585 - DNA, 20 bp, Artificial Sequence
  Description of Artificial Sequence: Synthetic oligonucleotide
  Target: ATXN1; (+) strand; PAM type: NRG; PAM sequence: AGG
tagagaaaggaaagcaagcc

SEQ ID NO: 148586 - DNA, 20 bp, Artificial Sequence
  Description of Artificial Sequence: Synthetic oligonucleotide
  Target: ATXN1; (+) strand; PAM type: NRG; PAM sequence: CGG
aaaggaaagcaagccaggca

SEQ ID NO: 148587 - DNA, 20 bp, Artificial Sequence
  Description of Artificial Sequence: Synthetic oligonucleotide
  Target: ATXN1; (+) strand; PAM type: NRG; PAM sequence: TAG
gtgtctcatgcctataatcc

SEQ ID NO: 148588 - DNA, 20 bp, Artificial Sequence
  Description of Artificial Sequence: Synthetic oligonucleotide
  Target: ATXN1; (+) strand; PAM type: NRG; PAM sequence: TGG
tgcctataatcctagcactt

SEQ ID NO: 148589 - DNA, 20 bp, Artificial Sequence
  Description of Artificial Sequence: Synthetic oligonucleotide
  Target: ATXN1; (+) strand; PAM type: NRG; PAM sequence: GGG
gcctataatcctagcacttt

SEQ ID NO: 148590 - DNA, 20 bp, Artificial Sequence
  Description of Artificial Sequence: Synthetic oligonucleotide
  Target: ATXN1; (+) strand; PAM type: NRG; PAM sequence: GAG
ctataatcctagcactttgg

SEQ ID NO: 148591 - DNA, 20 bp, Artificial Sequence
  Description of Artificial Sequence: Synthetic oligonucleotide
  Target: ATXN1; (+) strand; PAM type: NRG; PAM sequence: AGG
tataatcctagcactttggg

SEQ ID NO: 148592 - DNA, 20 bp, Artificial Sequence
  Description of Artificial Sequence: Synthetic oligonucleotide
  Target: ATXN1; (+) strand; PAM type: NRG; PAM sequence: AAG
tcctagcactttgggaggcc

SEQ ID NO: 148593 - DNA, 20 bp, Artificial Sequence
  Description of Artificial Sequence: Synthetic oligonucleotide
  Target: ATXN1; (+) strand; PAM type: NRG; PAM sequence: AGG
cctagcactttgggaggcca

SEQ ID NO: 148594 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggccaagg

SEQ ID NO: 148595 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggccaaggc

SEQ ID NO: 148596 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccaaggcagg

SEQ ID NO: 148597 - DNA, 20 bp, Artificial Sequence
  Description of Artificial Sequence: Synthetic oligonucleotide
  Target: ATXN1; (+) strand; PAM type: NRG; PAM sequence: GAG
ccaaggcaggtggaacacct

SEQ ID NO: 148598 - DNA, 20 bp, Artificial Sequence
  Description of Artificial Sequence: Synthetic oligonucleotide
  Target: ATXN1; (+) strand; PAM type: NRG; PAM sequence: AGG
caaggcaggtggaacacctg

SEQ ID NO: 148599 - DNA, 20 bp, Artificial Sequence
  Description of Artificial Sequence: Synthetic oligonucleotide
  Target: ATXN1; (+) strand; PAM type: NRG; PAM sequence: CAG
gcaggtggaacacctgaggt

SEQ ID NO: 148600 - DNA, 20 bp, Artificial Sequence
  Description of Artificial Sequence: Synthetic oligonucleotide
  Target: ATXN1; (+) strand; PAM type: NRG; PAM sequence: AGG
caggtggaacacctgaggtc

SEQ ID NO: 148601 - DNA, 20 bp, Artificial Sequence
  Description of Artificial Sequence: Synthetic oligonucleotide
  Target: ATXN1; (+) strand; PAM type: NRG; PAM sequence: GAG
ggtggaacacctgaggtcag

SEQ ID NO: 148602 - DNA, 20 bp, Artificial Sequence
  Description of Artificial Sequence: Synthetic oligonucleotide
  Target: ATXN1; (+) strand; PAM type: NRG; PAM sequence: AAG
acacctgaggtcaggagttc

SEQ ID NO: 148603 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcaagac

SEQ ID NO: 148604 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcaagaccagcc

SEQ ID NO: 148605 - DNA, 20 bp, Artificial Sequence
  Description of Artificial Sequence: Synthetic oligonucleotide
  Target: ATXN1; (+) strand; PAM type: NRG; PAM sequence: TGG
caagaccagcctggccaacg

SEQ ID NO: 148606 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 148607 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaaattagc

SEQ ID NO: 148608 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattagct

SEQ ID NO: 148609 - DNA, 20 bp, Artificial Sequence
  Description of Artificial Sequence: Synthetic oligonucleotide
  Target: ATXN1; (+) strand; PAM type: NRG; PAM sequence: CGG
atacaaaaattagctgggca

SEQ ID NO: 148610 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgggcacgg

SEQ ID NO: 148611 - DNA, 20 bp, Artificial Sequence
  Description of Artificial Sequence: Synthetic oligonucleotide
  Target: ATXN1; (+) strand; PAM type: NRG; PAM sequence: CAG
gtggtgcatgcctgtaatcc

SEQ ID NO: 148612 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagctact

SEQ ID NO: 148613 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagctactt

SEQ ID NO: 148614 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctacttgg

SEQ ID NO: 148615 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctacttggg

SEQ ID NO: 148616 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 148617 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggctg

SEQ ID NO: 148618 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgagg

SEQ ID NO: 148619 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggctgaggc

SEQ ID NO: 148620 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctgaggcag

SEQ ID NO: 148621 - DNA, 20 bp, Artificial Sequence
  Description of Artificial Sequence: Synthetic oligonucleotide
  Target: ATXN1; (+) strand; PAM type: NRG; PAM sequence: CAG
gcaggagaatcacttgaacc

SEQ ID NO: 148622 - DNA, 20 bp, Artificial Sequence
  Description of Artificial Sequence: Synthetic oligonucleotide
  Target: ATXN1; (+) strand; PAM type: NRG; PAM sequence: AGG
caggagaatcacttgaaccc

SEQ ID NO: 148623 - DNA, 20 bp, Artificial Sequence
  Description of Artificial Sequence: Synthetic oligonucleotide
  Target: ATXN1; (+) strand; PAM type: NRG; PAM sequence: GGG
aggagaatcacttgaaccca

SEQ ID NO: 148624 - DNA, 20 bp, Artificial Sequence
  Description of Artificial Sequence: Synthetic oligonucleotide
  Target: ATXN1; (+) strand; PAM type: NRG; PAM sequence: CAG
aatcacttgaacccagggaa

SEQ ID NO: 148625 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacccagggaaca

SEQ ID NO: 148626 - DNA, 20 bp, Artificial Sequence
  Description of Artificial Sequence: Synthetic oligonucleotide
  Target: ATXN1; (+) strand; PAM type: NRG; PAM sequence: CAG
aacccagggaacagagtttg

SEQ ID NO: 148627 - DNA, 20 bp, Artificial Sequence
  Description of Artificial Sequence: Synthetic oligonucleotide
  Target: ATXN1; (+) strand; PAM type: NRG; PAM sequence: GAG
cagggaacagagtttgcagt

SEQ ID NO: 148628 - DNA, 20 bp, Artificial Sequence
  Description of Artificial Sequence: Synthetic oligonucleotide
  Target: ATXN1; (+) strand; PAM type: NRG; PAM sequence: AAG
aacagagtttgcagtgagcc

SEQ ID NO: 148629 - DNA, 20 bp, Artificial Sequence
  Description of Artificial Sequence: Synthetic oligonucleotide
  Target: ATXN1; (+) strand; PAM type: NRG; PAM sequence: CAG
aagattgtgccactgaactc

SEQ ID NO: 148630 - DNA, 20 bp, Artificial Sequence
  Description of Artificial Sequence: Synthetic oligonucleotide
  Target: ATXN1; (+) strand; PAM type: NRG; PAM sequence: TGG
tgtgccactgaactccagcc

SEQ ID NO: 148631 - DNA, 20 bp, Artificial Sequence
  Description of Artificial Sequence: Synthetic oligonucleotide
  Target: ATXN1; (+) strand; PAM type: NRG; PAM sequence: GGG
gtgccactgaactccagcct

SEQ ID NO: 148632 - DNA, 20 bp, Artificial Sequence
  Description of Artificial Sequence: Synthetic oligonucleotide
  Target: ATXN1; (+) strand; PAM type: NRG; PAM sequence: AAG
ctgaactccagcctgggtga

SEQ ID NO: 148633 - DNA, 20 bp, Artificial Sequence
  Description of Artificial Sequence: Synthetic oligonucleotide
  Target: ATXN1; (+) strand; PAM type: NRG; PAM sequence: GAG
gaactccagcctgggtgaaa

SEQ ID NO: 148634 - DNA, 20 bp, Artificial Sequence
  Description of Artificial Sequence: Synthetic oligonucleotide
  Target: ATXN1; (+) strand; PAM type: NRG; PAM sequence: AAG
ctctgtctcaaaaaaaaaaa

SEQ ID NO: 148635 - DNA, 20 bp, Artificial Sequence
  Description of Artificial Sequence: Synthetic oligonucleotide
  Target: ATXN1; (+) strand; PAM type: NRG; PAM sequence: AAG
tctcaaaaaaaaaaaaagaa

SEQ ID NO: 148636 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaagaaaagaa

SEQ ID NO: 148637 - DNA, 20 bp, Artificial Sequence
  Description of Artificial Sequence: Synthetic oligonucleotide
  Target: ATXN1; (+) strand; PAM type: NRG; PAM sequence: AAG
aaaaaagaaaagaaaagaaa

SEQ ID NO: 148638 - DNA, 20 bp, Artificial Sequence
  Description of Artificial Sequence: Synthetic oligonucleotide
  Target: ATXN1; (+) strand; PAM type: NRG; PAM sequence: GAG
aaaagaaaagaaaagaaaaa

SEQ ID NO: 148639 - DNA, 20 bp, Artificial Sequence
  Description of Artificial Sequence: Synthetic oligonucleotide
  Target: ATXN1; (+) strand; PAM type: NRG; PAM sequence: AAG
gaaaagaaaagaaaaagaga

SEQ ID NO: 148640 - DNA, 20 bp, Artificial Sequence
  Description of Artificial Sequence: Synthetic oligonucleotide
  Target: ATXN1; (+) strand; PAM type: NRG; PAM sequence: AGG
aaaagaaaagaaaaagagaa

SEQ ID NO: 148641 - DNA, 20 bp, Artificial Sequence
  Description of Artificial Sequence: Synthetic oligonucleotide
  Target: ATXN1; (+) strand; PAM type: NRG; PAM sequence: AAG
agaaaagaaaaagagaaagg

SEQ ID NO: 148642 - DNA, 20 bp, Artificial Sequence
  Description of Artificial Sequence: Synthetic oligonucleotide
  Target: ATXN1; (+) strand; PAM type: NRG; PAM sequence: AGG
gaaaagaaaaagagaaagga

SEQ ID NO: 148643 - DNA, 20 bp, Artificial Sequence
  Description of Artificial Sequence: Synthetic oligonucleotide
  Target: ATXN1; (+) strand; PAM type: NRG; PAM sequence: GAG
aaagaaaaagagaaaggaag

SEQ ID NO: 148644 - DNA, 20 bp, Artificial Sequence
  Description of Artificial Sequence: Synthetic oligonucleotide
  Target: ATXN1; (+) strand; PAM type: NRG; PAM sequence: AGG
aagaaaaagagaaaggaagg

SEQ ID NO: 148645 - DNA, 20 bp, Artificial Sequence
  Description of Artificial Sequence: Synthetic oligonucleotide
  Target: ATXN1; (+) strand; PAM type: NRG; PAM sequence: AAG
aaaaagagaaaggaaggagg

SEQ ID NO: 148646 - DNA, 20 bp, Artificial Sequence
  Description of Artificial Sequence: Synthetic oligonucleotide
  Target: ATXN1; (+) strand; PAM type: NRG; PAM sequence: AGG
aaaagagaaaggaaggagga

SEQ ID NO: 148647 - DNA, 20 bp, Artificial Sequence
  Description of Artificial Sequence: Synthetic oligonucleotide
  Target: ATXN1; (+) strand; PAM type: NRG; PAM sequence: AAG
aggaaggaaaattaaatcca

SEQ ID NO: 148648 - DNA, 20 bp, Artificial Sequence
  Description of Artificial Sequence: Synthetic oligonucleotide
  Target: ATXN1; (+) strand; PAM type: NRG; PAM sequence: TAG
aaggaaaattaaatccaaag

SEQ ID NO: 148649 - DNA, 20 bp, Artificial Sequence
  Description of Artificial Sequence: Synthetic oligonucleotide
  Target: ATXN1; (+) strand; PAM type: NRG; PAM sequence: AGG
aggaaaattaaatccaaagt

SEQ ID NO: 148650 - DNA, 20 bp, Artificial Sequence
  Description of Artificial Sequence: Synthetic oligonucleotide
  Target: ATXN1; (+) strand; PAM type: NRG; PAM sequence: GGG
ggaaaattaaatccaaagta

SEQ ID NO: 148651 - DNA, 20 bp, Artificial Sequence
  Description of Artificial Sequence: Synthetic oligonucleotide
  Target: ATXN1; (+) strand; PAM type: NRG; PAM sequence: AAG
ttaaatccaaagtagggaaa

SEQ ID NO: 148652 - DNA, 20 bp, Artificial Sequence
  Description of Artificial Sequence: Synthetic oligonucleotide
  Target: ATXN1; (+) strand; PAM type: NRG; PAM sequence: AAG
aatccaaagtagggaaaaag

SEQ ID NO: 148653 - DNA, 20 bp, Artificial Sequence
  Description of Artificial Sequence: Synthetic oligonucleotide
  Target: ATXN1; (+) strand; PAM type: NRG; PAM sequence: AGG
atccaaagtagggaaaaaga

SEQ ID NO: 148654 - DNA, 20 bp, Artificial Sequence
  Description of Artificial Sequence: Synthetic oligonucleotide
  Target: ATXN1; (+) strand; PAM type: NRG; PAM sequence: GAG
gggaaaaagaaggaaataat

SEQ ID NO: 148655 - DNA, 20 bp, Artificial Sequence
  Description of Artificial Sequence: Synthetic oligonucleotide
  Target: ATXN1; (+) strand; PAM type: NRG; PAM sequence: AAG
aaaaagaaggaaataatgag

SEQ ID NO: 148656 - DNA, 20 bp, Artificial Sequence
  Description of Artificial Sequence: Synthetic oligonucleotide
  Target: ATXN1; (+) strand; PAM type: NRG; PAM sequence: CAG
gaaggaaataatgagaagaa

SEQ ID NO: 148657 - DNA, 20 bp, Artificial Sequence
  Description of Artificial Sequence: Synthetic oligonucleotide
  Target: ATXN1; (+) strand; PAM type: NRG; PAM sequence: AAG
gaaataatgagaagaacaga

SEQ ID NO: 148658 - DNA, 20 bp, Artificial Sequence
  Description of Artificial Sequence: Synthetic oligonucleotide
  Target: ATXN1; (+) strand; PAM type: NRG; PAM sequence: CAG
tgagaagaacagaaagcaaa

SEQ ID NO: 148659 - DNA, 20 bp, Artificial Sequence
  Description of Artificial Sequence: Synthetic oligonucleotide
  Target: ATXN1; (+) strand; PAM type: NRG; PAM sequence: TAG
gaagaacagaaagcaaacag

SEQ ID NO: 148660 - DNA, 20 bp, Artificial Sequence
  Description of Artificial Sequence: Synthetic oligonucleotide
  Target: ATXN1; (+) strand; PAM type: NRG; PAM sequence: AAG
aaacagtagttcattctttg

SEQ ID NO: 148661 - DNA, 20 bp, Artificial Sequence
  Description of Artificial Sequence: Synthetic oligonucleotide
  Target: ATXN1; (+) strand; PAM type: NRG; PAM sequence: GAG
acagtagttcattctttgaa

SEQ ID NO: 148662 - DNA, 20 bp, Artificial Sequence
  Description of Artificial Sequence: Synthetic oligonucleotide
  Target: ATXN1; (+) strand; PAM type: NRG; PAM sequence: TAG
taataaaattaattaacatc

SEQ ID NO: 148663 - DNA, 20 bp, Artificial Sequence
  Description of Artificial Sequence: Synthetic oligonucleotide
  Target: ATXN1; (+) strand; PAM type: NRG; PAM sequence: AAG
gcaaaactaatcacaaaaat

SEQ ID NO: 148664 - DNA, 20 bp, Artificial Sequence
  Description of Artificial Sequence: Synthetic oligonucleotide
  Target: ATXN1; (+) strand; PAM type: NRG; PAM sequence: TGG
aatgaaaacatcattaaaaa

SEQ ID NO: 148665 - DNA, 20 bp, Artificial Sequence
  Description of Artificial Sequence: Synthetic oligonucleotide
  Target: ATXN1; (+) strand; PAM type: NRG; PAM sequence: AAG
aaacatcattaaaaatggaa

SEQ ID NO: 148666 - DNA, 20 bp, Artificial Sequence
  Description of Artificial Sequence: Synthetic oligonucleotide
  Target: ATXN1; (+) strand; PAM type: NRG; PAM sequence: AGG
aacatcattaaaaatggaaa

SEQ ID NO: 148667 - DNA, 20 bp, Artificial Sequence
  Description of Artificial Sequence: Synthetic oligonucleotide
  Target: ATXN1; (+) strand; PAM type: NRG; PAM sequence: GGG
acatcattaaaaatggaaaa

SEQ ID NO: 148668 - DNA, 20 bp, Artificial Sequence
  Description of Artificial Sequence: Synthetic oligonucleotide
  Target: ATXN1; (+) strand; PAM type: NRG; PAM sequence: GGG
catcattaaaaatggaaaag

SEQ ID NO: 148669 - DNA, 20 bp, Artificial Sequence
  Description of Artificial Sequence: Synthetic oligonucleotide
  Target: ATXN1; (+) strand; PAM type: NRG; PAM sequence: CAG
ggatatcactataaatccta

SEQ ID NO: 148670 - DNA, 20 bp, Artificial Sequence
  Description of Artificial Sequence: Synthetic oligonucleotide
  Target: ATXN1; (+) strand; PAM type: NRG; PAM sequence: TAG
taaatcctacagacactaaa

SEQ ID NO: 148671 - DNA, 20 bp, Artificial Sequence
  Description of Artificial Sequence: Synthetic oligonucleotide
  Target: ATXN1; (+) strand; PAM type: NRG; PAM sequence: AAG
cctacagacactaaatagat

SEQ ID NO: 148672 - DNA, 20 bp, Artificial Sequence
  Description of Artificial Sequence: Synthetic oligonucleotide
  Target: ATXN1; (+) strand; PAM type: NRG; PAM sequence: AAG
acagacactaaatagataag

SEQ ID NO: 148673 - DNA, 20 bp, Artificial Sequence
  Description of Artificial Sequence: Synthetic oligonucleotide
  Target: ATXN1; (+) strand; PAM type: NRG; PAM sequence: AAG
acactaaatagataagaaga

SEQ ID NO: 148674 - DNA, 20 bp, Artificial Sequence
  Description of Artificial Sequence: Synthetic oligonucleotide
  Target: ATXN1; (+) strand; PAM type: NRG; PAM sequence: TGG
tgtcaataaatctcacaact

SEQ ID NO: 148675 - DNA, 20 bp, Artificial Sequence
  Description of Artificial Sequence: Synthetic oligonucleotide
  Target: ATXN1; (+) strand; PAM type: NRG; PAM sequence: TAG
ataaaaaacttcttgaaaaa

SEQ ID NO: 148676 - DNA, 20 bp, Artificial Sequence
  Description of Artificial Sequence: Synthetic oligonucleotide
  Target: ATXN1; (+) strand; PAM type: NRG; PAM sequence: AAG
aaaacttcttgaaaaataga

SEQ ID NO: 148677 - DNA, 20 bp, Artificial Sequence
  Description of Artificial Sequence: Synthetic oligonucleotide
  Target: ATXN1; (+) strand; PAM type: NRG; PAM sequence: TAG
tagaaagcataacttaccaa

SEQ ID NO: 148678 - DNA, 20 bp, Artificial Sequence
  Description of Artificial Sequence: Synthetic oligonucleotide
  Target: ATXN1; (+) strand; PAM type: NRG; PAM sequence: AAG
aagcataacttaccaatagc

SEQ ID NO: 148679 - DNA, 20 bp, Artificial Sequence
  Description of Artificial Sequence: Synthetic oligonucleotide
  Target: ATXN1; (+) strand; PAM type: NRG; PAM sequence: CAG
ttaccaatagcaagaataaa

SEQ ID NO: 148680 - DNA, 20 bp, Artificial Sequence
  Description of Artificial Sequence: Synthetic oligonucleotide
  Target: ATXN1; (+) strand; PAM type: NRG; PAM sequence: AAG
aagaataaacagaaaatctg

SEQ ID NO: 148681 - DNA, 20 bp, Artificial Sequence
  Description of Artificial Sequence: Synthetic oligonucleotide
  Target: ATXN1; (+) strand; PAM type: NRG; PAM sequence: GAG
gaataaacagaaaatctgaa

SEQ ID NO: 148682 - DNA, 20 bp, Artificial Sequence
  Description of Artificial Sequence: Synthetic oligonucleotide
  Target: ATXN1; (+) strand; PAM type: NRG; PAM sequence: TGG
aaacagaaaatctgaagagt

SEQ ID NO: 148683 - DNA, 20 bp, Artificial Sequence
  Description of Artificial Sequence: Synthetic oligonucleotide
  Target: ATXN1; (+) strand; PAM type: NRG; PAM sequence: AAG
tgaagagttggctatatgtt

SEQ ID NO: 148684 - DNA, 20 bp, Artificial Sequence
  Description of Artificial Sequence: Synthetic oligonucleotide
  Target: ATXN1; (+) strand; PAM type: NRG; PAM sequence: CAG
atatgttaagaaattgaatt

SEQ ID NO: 148685 - DNA, 20 bp, Artificial Sequence
  Description of Artificial Sequence: Synthetic oligonucleotide
  Target: ATXN1; (+) strand; PAM type: NRG; PAM sequence: TGG
gaattcagtatcaaaatcct

SEQ ID NO: 148686 - DNA, 20 bp, Artificial Sequence
  Description of Artificial Sequence: Synthetic oligonucleotide
  Target: ATXN1; (+) strand; PAM type: NRG; PAM sequence: TGG
actgttctgtatcctgattg

SEQ ID NO: 148687 - DNA, 20 bp, Artificial Sequence
  Description of Artificial Sequence: Synthetic oligonucleotide
  Target: ATXN1; (+) strand; PAM type: NRG; PAM sequence: TGG
gttctgtatcctgattgtgg

SEQ ID NO: 148688 - DNA, 20 bp, Artificial Sequence
  Description of Artificial Sequence: Synthetic oligonucleotide
  Target: ATXN1; (+) strand; PAM type: NRG; PAM sequence: TAG
ctgtatcctgattgtggtgg

SEQ ID NO: 148689 - DNA, 20 bp, Artificial Sequence
  Description of Artificial Sequence: Synthetic oligonucleotide
  Target: ATXN1; (+) strand; PAM type: NRG; PAM sequence: TAG
tctacacatgttaaaatgca

SEQ ID NO: 148690 - DNA, 20 bp, Artificial Sequence
  Description of Artificial Sequence: Synthetic oligonucleotide
  Target: ATXN1; (+) strand; PAM type: NRG; PAM sequence: AAG
catagaattgtacatcaaaa

SEQ ID NO: 148691 - DNA, 20 bp, Artificial Sequence
  Description of Artificial Sequence: Synthetic oligonucleotide
  Target: ATXN1; (+) strand; PAM type: NRG; PAM sequence: AGG
atagaattgtacatcaaaaa

SEQ ID NO: 148692 - DNA, 20 bp, Artificial Sequence
  Description of Artificial Sequence: Synthetic oligonucleotide
  Target: ATXN1; (+) strand; PAM type: NRG; PAM sequence: GGG
tagaattgtacatcaaaaaa

SEQ ID NO: 148693 - DNA, 20 bp, Artificial Sequence
  Description of Artificial Sequence: Synthetic oligonucleotide
  Target: ATXN1; (+) strand; PAM type: NRG; PAM sequence: TAG
taaattaaattttaaaaact

SEQ ID NO: 148694 - DNA, 20 bp, Artificial Sequence
  Description of Artificial Sequence: Synthetic oligonucleotide
  Target: ATXN1; (+) strand; PAM type: NRG; PAM sequence: AAG
aaacttagaaccttcacaca

SEQ ID NO: 148695 - DNA, 20 bp, Artificial Sequence
  Description of Artificial Sequence: Synthetic oligonucleotide
  Target: ATXN1; (+) strand; PAM type: NRG; PAM sequence: GAG
acttagaaccttcacacaaa

SEQ ID NO: 148696 - DNA, 20 bp, Artificial Sequence
  Description of Artificial Sequence: Synthetic oligonucleotide
  Target: ATXN1; (+) strand; PAM type: NRG; PAM sequence: AAG
cttcacacaaagagaactcc

SEQ ID NO: 148697 - DNA, 20 bp, Artificial Sequence
  Description of Artificial Sequence: Synthetic oligonucleotide
  Target: ATXN1; (+) strand; PAM type: NRG; PAM sequence: AAG
caaagagaactccaagccca

SEQ ID NO: 148698 - DNA, 20 bp, Artificial Sequence
  Description of Artificial Sequence: Synthetic oligonucleotide
  Target: ATXN1; (+) strand; PAM type: NRG; PAM sequence: TGG
caagcccaaagatttcactg

SEQ ID NO: 148699 - DNA, 20 bp, Artificial Sequence
  Description of Artificial Sequence: Synthetic oligonucleotide
  Target: ATXN1; (+) strand; PAM type: NRG; PAM sequence: AAG
tgtggaatttcatcaatttt

SEQ ID NO: 148700 - DNA, 20 bp, Artificial Sequence
  Description of Artificial Sequence: Synthetic oligonucleotide
  Target: ATXN1; (+) strand; PAM type: NRG; PAM sequence: GAG
tggaatttcatcaattttaa

SEQ ID NO: 148701 - DNA, 20 bp, Artificial Sequence
  Description of Artificial Sequence: Synthetic oligonucleotide
  Target: ATXN1; (+) strand; PAM type: NRG; PAM sequence: AGG
ggaatttcatcaattttaag

SEQ ID NO: 148702 - DNA, 20 bp, Artificial Sequence
  Description of Artificial Sequence: Synthetic oligonucleotide
  Target: ATXN1; (+) strand; PAM type: NRG; PAM sequence: AAG
tttcatcaattttaagagga

SEQ ID NO: 148703 - DNA, 20 bp, Artificial Sequence
  Description of Artificial Sequence: Synthetic oligonucleotide
  Target: ATXN1; (+) strand; PAM type: NRG; PAM sequence: CAG
aaatcttacataaattcttt

SEQ ID NO: 148704 - DNA, 20 bp, Artificial Sequence
  Description of Artificial Sequence: Synthetic oligonucleotide
  Target: ATXN1; (+) strand; PAM type: NRG; PAM sequence: TAG
acataaattctttcagaaaa

SEQ ID NO: 148705 - DNA, 20 bp, Artificial Sequence
  Description of Artificial Sequence: Synthetic oligonucleotide
  Target: ATXN1; (+) strand; PAM type: NRG; PAM sequence: CAG
tttcagaaaatagtaaaaaa

SEQ ID NO: 148706 - DNA, 20 bp, Artificial Sequence
  Description of Artificial Sequence: Synthetic oligonucleotide
  Target: ATXN1; (+) strand; PAM type: NRG; PAM sequence: AGG
ttcagaaaatagtaaaaaac

SEQ ID NO: 148707 - DNA, 20 bp, Artificial Sequence
  Description of Artificial Sequence: Synthetic oligonucleotide
  Target: ATXN1; (+) strand; PAM type: NRG; PAM sequence: GAG
cagaaaatagtaaaaaacag

SEQ ID NO: 148708 - DNA, 20 bp, Artificial Sequence
  Description of Artificial Sequence: Synthetic oligonucleotide
  Target: ATXN1; (+) strand; PAM type: NRG; PAM sequence: AGG
agaaaatagtaaaaaacagg

SEQ ID NO: 148709 - DNA, 20 bp, Artificial Sequence
  Description of Artificial Sequence: Synthetic oligonucleotide
  Target: ATXN1; (+) strand; PAM type: NRG; PAM sequence: CAG
acgaatacattttatataat

SEQ ID NO: 148710 - DNA, 20 bp, Artificial Sequence
  Description of Artificial Sequence: Synthetic oligonucleotide
  Target: ATXN1; (+) strand; PAM type: NRG; PAM sequence: TAG
ctaacactaacactaaaccc

SEQ ID NO: 148711 - DNA, 20 bp, Artificial Sequence
  Description of Artificial Sequence: Synthetic oligonucleotide
  Target: ATXN1; (+) strand; PAM type: NRG; PAM sequence: AAG
accctagtaaatattatata

SEQ ID NO: 148712 - DNA, 20 bp, Artificial Sequence
  Description of Artificial Sequence: Synthetic oligonucleotide
  Target: ATXN1; (+) strand; PAM type: NRG; PAM sequence: CAG
tatataaagaaacaaaatta

SEQ ID NO: 148713 - DNA, 20 bp, Artificial Sequence
  Description of Artificial Sequence: Synthetic oligonucleotide
  Target: ATXN1; (+) strand; PAM type: NRG; PAM sequence: TAG
accaatgttcttaataaaca

SEQ ID NO: 148714 - DNA, 20 bp, Artificial Sequence
  Description of Artificial Sequence: Synthetic oligonucleotide
  Target: ATXN1; (+) strand; PAM type: NRG; PAM sequence: TAG
aaaaatacttaataaaatgt

SEQ ID NO: 148715 - DNA, 20 bp, Artificial Sequence
  Description of Artificial Sequence: Synthetic oligonucleotide
  Target: ATXN1; (+) strand; PAM type: NRG; PAM sequence: CAG
aaaatgttagccaaaatatc

SEQ ID NO: 148716 - DNA, 20 bp, Artificial Sequence
  Description of Artificial Sequence: Synthetic oligonucleotide
  Target: ATXN1; (+) strand; PAM type: NRG; PAM sequence: TAG
ttagccaaaatatccagcaa

SEQ ID NO: 148717 - DNA, 20 bp, Artificial Sequence
  Description of Artificial Sequence: Synthetic oligonucleotide
  Target: ATXN1; (+) strand; PAM type: NRG; PAM sequence: AGG
tagccaaaatatccagcaat

SEQ ID NO: 148718 - DNA, 20 bp, Artificial Sequence
  Description of Artificial Sequence: Synthetic oligonucleotide
  Target: ATXN1; (+) strand; PAM type: NRG; PAM sequence: TGG
aaataacacataattataac

SEQ ID NO: 148719 - DNA, 20 bp, Artificial Sequence
  Description of Artificial Sequence: Synthetic oligonucleotide
  Target: ATXN1; (+) strand; PAM type: NRG; PAM sequence: CAG
attataactggttcttatcc

SEQ ID NO: 148720 - DNA, 20 bp, Artificial Sequence
  Description of Artificial Sequence: Synthetic oligonucleotide
  Target: ATXN1; (+) strand; PAM type: NRG; PAM sequence: AGG
ttataactggttcttatccc

SEQ ID NO: 148721 - DNA, 20 bp, Artificial Sequence
  Description of Artificial Sequence: Synthetic oligonucleotide
  Target: ATXN1; (+) strand; PAM type: NRG; PAM sequence: AAG
ggttcttatcccaggaactc

SEQ ID NO: 148722 - DNA, 20 bp, Artificial Sequence
  Description of Artificial Sequence: Synthetic oligonucleotide
  Target: ATXN1; (+) strand; PAM type: NRG; PAM sequence: TGG
ttatcccaggaactcaagtt

SEQ ID NO: 148723 - DNA, 20 bp, Artificial Sequence
  Description of Artificial Sequence: Synthetic oligonucleotide
  Target: ATXN1; (+) strand; PAM type: NRG; PAM sequence: AAG
tcaatataattcaccacata

SEQ ID NO: 148724 - DNA, 20 bp, Artificial Sequence
  Description of Artificial Sequence: Synthetic oligonucleotide
  Target: ATXN1; (+) strand; PAM type: NRG; PAM sequence: CGG
atataattcaccacataaag

SEQ ID NO: 148725 - DNA, 20 bp, Artificial Sequence
  Description of Artificial Sequence: Synthetic oligonucleotide
  Target: ATXN1; (+) strand; PAM type: NRG; PAM sequence: CAG
aaaaccatatgacatctcaa

SEQ ID NO: 148726 - DNA, 20 bp, Artificial Sequence
  Description of Artificial Sequence: Synthetic oligonucleotide
  Target: ATXN1; (+) strand; PAM type: NRG; PAM sequence: GAG
aaccatatgacatctcaaca

SEQ ID NO: 148727 - DNA, 20 bp, Artificial Sequence
  Description of Artificial Sequence: Synthetic oligonucleotide
  Target: ATXN1; (+) strand; PAM type: NRG; PAM sequence: AGG
accatatgacatctcaacag

SEQ ID NO: 148728 - DNA, 20 bp, Artificial Sequence
  Description of Artificial Sequence: Synthetic oligonucleotide
  Target: ATXN1; (+) strand; PAM type: NRG; PAM sequence: TAG
aacaaacaaacacaaattct

SEQ ID NO: 148729 - DNA, 20 bp, Artificial Sequence
  Description of Artificial Sequence: Synthetic oligonucleotide
  Target: ATXN1; (+) strand; PAM type: NRG; PAM sequence: AAG
aaacacaaattcttagaaaa

SEQ ID NO: 148730 - DNA, 20 bp, Artificial Sequence
  Description of Artificial Sequence: Synthetic oligonucleotide
  Target: ATXN1; (+) strand; PAM type: NRG; PAM sequence: GAG
acacaaattcttagaaaaaa

SEQ ID NO: 148731 - DNA, 20 bp, Artificial Sequence
  Description of Artificial Sequence: Synthetic oligonucleotide
  Target: ATXN1; (+) strand; PAM type: NRG; PAM sequence: TAG
aattcttagaaaaaagagaa

SEQ ID NO: 148732 - DNA, 20 bp, Artificial Sequence
  Description of Artificial Sequence: Synthetic oligonucleotide
  Target: ATXN1; (+) strand; PAM type: NRG; PAM sequence: AAG
tcttagaaaaaagagaatag

SEQ ID NO: 148733 - DNA, 20 bp, Artificial Sequence
  Description of Artificial Sequence: Synthetic oligonucleotide
  Target: ATXN1; (+) strand; PAM type: NRG; PAM sequence: AGG
cttagaaaaaagagaataga

SEQ ID NO: 148734 - DNA, 20 bp, Artificial Sequence
  Description of Artificial Sequence: Synthetic oligonucleotide
  Target: ATXN1; (+) strand; PAM type: NRG; PAM sequence: AAG
aaacttcgtcaatccaataa

SEQ ID NO: 148735 - DNA, 20 bp, Artificial Sequence
  Description of Artificial Sequence: Synthetic oligonucleotide
  Target: ATXN1; (+) strand; PAM type: NRG; PAM sequence: AGG
aacttcgtcaatccaataaa

SEQ ID NO: 148736 - DNA, 20 bp, Artificial Sequence
  Description of Artificial Sequence: Synthetic oligonucleotide
  Target: ATXN1; (+) strand; PAM type: NRG; PAM sequence: CAG
aaaggcaaatgaaaaaccta

SEQ ID NO: 148737 - DNA, 20 bp, Artificial Sequence
  Description of Artificial Sequence: Synthetic oligonucleotide
  Target: ATXN1; (+) strand; PAM type: NRG; PAM sequence: TAG
cagctaacatcatgatgaaa

SEQ ID NO: 148738 - DNA, 20 bp, Artificial Sequence
  Description of Artificial Sequence: Synthetic oligonucleotide
  Target: ATXN1; (+) strand; PAM type: NRG; PAM sequence: TGG
ctaacatcatgatgaaatag

SEQ ID NO: 148739 - DNA, 20 bp, Artificial Sequence
  Description of Artificial Sequence: Synthetic oligonucleotide
  Target: ATXN1; (+) strand; PAM type: NRG; PAM sequence: TAG
atgatgaaatagtggtgaaa

SEQ ID NO: 148740 - DNA, 20 bp, Artificial Sequence
  Description of Artificial Sequence: Synthetic oligonucleotide
  Target: ATXN1; (+) strand; PAM type: NRG; PAM sequence: CAG
taatactttccctgtacgat

SEQ ID NO: 148741 - DNA, 20 bp, Artificial Sequence
  Description of Artificial Sequence: Synthetic oligonucleotide
  Target: ATXN1; (+) strand; PAM type: NRG; PAM sequence: AAG
tccctgtacgatcagaaaaa

SEQ ID NO: 148742 - DNA, 20 bp, Artificial Sequence
  Description of Artificial Sequence: Synthetic oligonucleotide
  Target: ATXN1; (+) strand; PAM type: NRG; PAM sequence: TGG
tacgatcagaaaaaaagtcc

SEQ ID NO: 148743 - DNA, 20 bp, Artificial Sequence
  Description of Artificial Sequence: Synthetic oligonucleotide
  Target: ATXN1; (+) strand; PAM type: NRG; PAM sequence: AAG
ggttatataaataatttgaa

SEQ ID NO: 148744 - DNA, 20 bp, Artificial Sequence
  Description of Artificial Sequence: Synthetic oligonucleotide
  Target: ATXN1; (+) strand; PAM type: NRG; PAM sequence: AGG
gttatataaataatttgaaa

SEQ ID NO: 148745 - DNA, 20 bp, Artificial Sequence
  Description of Artificial Sequence: Synthetic oligonucleotide
  Target: ATXN1; (+) strand; PAM type: NRG; PAM sequence: AAG
attacatgtattatatcgaa

SEQ ID NO: 148746 - DNA, 20 bp, Artificial Sequence
  Description of Artificial Sequence: Synthetic oligonucleotide
  Target: ATXN1; (+) strand; PAM type: NRG; PAM sequence: AAG
gtattatatcgaaaagcata

SEQ ID NO: 148747 - DNA, 20 bp, Artificial Sequence
  Description of Artificial Sequence: Synthetic oligonucleotide
  Target: ATXN1; (+) strand; PAM type: NRG; PAM sequence: AAG
agtacaattaaattttacca

SEQ ID NO: 148748 - DNA, 20 bp, Artificial Sequence
  Description of Artificial Sequence: Synthetic oligonucleotide
  Target: ATXN1; (+) strand; PAM type: NRG; PAM sequence: CAG
aaagatatgcaatgtctctg

SEQ ID NO: 148749 - DNA, 20 bp, Artificial Sequence
  Description of Artificial Sequence: Synthetic oligonucleotide
  Target: ATXN1; (+) strand; PAM type: NRG; PAM sequence: AGG
aagatatgcaatgtctctgc

SEQ ID NO: 148750 - DNA, 20 bp, Artificial Sequence
  Description of Artificial Sequence: Synthetic oligonucleotide
  Target: ATXN1; (+) strand; PAM type: NRG; PAM sequence: CAG
caatgtctctgcaggaaaaa

SEQ ID NO: 148751 - DNA, 20 bp, Artificial Sequence
  Description of Artificial Sequence: Synthetic oligonucleotide
  Target: ATXN1; (+) strand; PAM type: NRG; PAM sequence: AGG
aatgtctctgcaggaaaaac

SEQ ID NO: 148752 - DNA, 20 bp, Artificial Sequence
  Description of Artificial Sequence: Synthetic oligonucleotide
  Target: ATXN1; (+) strand; PAM type: NRG; PAM sequence: GGG
atgtctctgcaggaaaaaca

SEQ ID NO: 148753 - DNA, 20 bp, Artificial Sequence
  Description of Artificial Sequence: Synthetic oligonucleotide
  Target: ATXN1; (+) strand; PAM type: NRG; PAM sequence: TGG
gaaaaacagggaaacattcc

SEQ ID NO: 148754 - DNA, 20 bp, Artificial Sequence
  Description of Artificial Sequence: Synthetic oligonucleotide
  Target: ATXN1; (+) strand; PAM type: NRG; PAM sequence: CAG
aaacagggaaacattcctgg

SEQ ID NO: 148755 - DNA, 20 bp, Artificial Sequence
  Description of Artificial Sequence: Synthetic oligonucleotide
  Target: ATXN1; (+) strand; PAM type: NRG; PAM sequence: AAG
cctggcagaaattcattaaa

SEQ ID NO: 148756 - DNA, 20 bp, Artificial Sequence
  Description of Artificial Sequence: Synthetic oligonucleotide
  Target: ATXN1; (+) strand; PAM type: NRG; PAM sequence: AGG
ctggcagaaattcattaaaa

SEQ ID NO: 148757 - DNA, 20 bp, Artificial Sequence
  Description of Artificial Sequence: Synthetic oligonucleotide
  Target: ATXN1; (+) strand; PAM type: NRG; PAM sequence: CAG
gcagaaattcattaaaaagg

SEQ ID NO: 148758 - DNA, 20 bp, Artificial Sequence
  Description of Artificial Sequence: Synthetic oligonucleotide
  Target: ATXN1; (+) strand; PAM type: NRG; PAM sequence: GAG
agaaattcattaaaaaggca

SEQ ID NO: 148759 - DNA, 20 bp, Artificial Sequence
  Description of Artificial Sequence: Synthetic oligonucleotide
  Target: ATXN1; (+) strand; PAM type: NRG; PAM sequence: AAG
attcattaaaaaggcagaga

SEQ ID NO: 148760 - DNA, 20 bp, Artificial Sequence
  Description of Artificial Sequence: Synthetic oligonucleotide
  Target: ATXN1; (+) strand; PAM type: NRG; PAM sequence: AAG
tataccgtgtttttgaattg

SEQ ID NO: 148761 - DNA, 20 bp, Artificial Sequence
  Description of Artificial Sequence: Synthetic oligonucleotide
  Target: ATXN1; (+) strand; PAM type: NRG; PAM sequence: AAG
attgaagtttcaatattgtt

SEQ ID NO: 148762 - DNA, 20 bp, Artificial Sequence
  Description of Artificial Sequence: Synthetic oligonucleotide
  Target: ATXN1; (+) strand; PAM type: NRG; PAM sequence: AGG
ttgaagtttcaatattgtta

SEQ ID NO: 148763 - DNA, 20 bp, Artificial Sequence
  Description of Artificial Sequence: Synthetic oligonucleotide
  Target: ATXN1; (+) strand; PAM type: NRG; PAM sequence: CAG
taaatttctctcttatgatt

SEQ ID NO: 148764 - DNA, 20 bp, Artificial Sequence
  Description of Artificial Sequence: Synthetic oligonucleotide
  Target: ATXN1; (+) strand; PAM type: NRG; PAM sequence: CAG
caatctgaactaacttctaa

SEQ ID NO: 148765 - DNA, 20 bp, Artificial Sequence
  Description of Artificial Sequence: Synthetic oligonucleotide
  Target: ATXN1; (+) strand; PAM type: NRG; PAM sequence: AGG
aatctgaactaacttctaac

SEQ ID NO: 148766 - DNA, 20 bp, Artificial Sequence
  Description of Artificial Sequence: Synthetic oligonucleotide
  Target: ATXN1; (+) strand; PAM type: NRG; PAM sequence: TGG
taacttctaacaggcttttt

SEQ ID NO: 148767 - DNA, 20 bp, Artificial Sequence
  Description of Artificial Sequence: Synthetic oligonucleotide
  Target: ATXN1; (+) strand; PAM type: NRG; PAM sequence: GGG
aacttctaacaggctttttt

SEQ ID NO: 148768 - DNA, 20 bp, Artificial Sequence
  Description of Artificial Sequence: Synthetic oligonucleotide
  Target: ATXN1; (+) strand; PAM type: NRG; PAM sequence: GGG
acttctaacaggcttttttg

SEQ ID NO: 148769 - DNA, 20 bp, Artificial Sequence
  Description of Artificial Sequence: Synthetic oligonucleotide
  Target: ATXN1; (+) strand; PAM type: NRG; PAM sequence: GGG
cttctaacaggcttttttgg

SEQ ID NO: 148770 - DNA, 20 bp, Artificial Sequence
  Description of Artificial Sequence: Synthetic oligonucleotide
  Target: ATXN1; (+) strand; PAM type: NRG; PAM sequence: GGG
ttctaacaggcttttttggg

SEQ ID NO: 148771 - DNA, 20 bp, Artificial Sequence
  Description of Artificial Sequence: Synthetic oligonucleotide
  Target: ATXN1; (+) strand; PAM type: NRG; PAM sequence: TAG
taacaggcttttttgggggg

SEQ ID NO: 148772 - DNA, 20 bp, Artificial Sequence
  Description of Artificial Sequence: Synthetic oligonucleotide
  Target: ATXN1; (+) strand; PAM type: NRG; PAM sequence: AGG
aacaggcttttttggggggt

SEQ ID NO: 148773 - DNA, 20 bp, Artificial Sequence
  Description of Artificial Sequence: Synthetic oligonucleotide
  Target: ATXN1; (+) strand; PAM type: NRG; PAM sequence: GGG
acaggcttttttggggggta

SEQ ID NO: 148774 - DNA, 20 bp, Artificial Sequence
  Description of Artificial Sequence: Synthetic oligonucleotide
  Target: ATXN1; (+) strand; PAM type: NRG; PAM sequence: GGG
caggcttttttggggggtag

SEQ ID NO: 148775 - DNA, 20 bp, Artificial Sequence
  Description of Artificial Sequence: Synthetic oligonucleotide
  Target: ATXN1; (+) strand; PAM type: NRG; PAM sequence: GGG
aggcttttttggggggtagg

SEQ ID NO: 148776 - DNA, 20 bp, Artificial Sequence
  Description of Artificial Sequence: Synthetic oligonucleotide
  Target: ATXN1; (+) strand; PAM type: NRG; PAM sequence: TGG
ggggggtagggggatttata

SEQ ID NO: 148777 - DNA, 20 bp, Artificial Sequence
  Description of Artificial Sequence: Synthetic oligonucleotide
  Target: ATXN1; (+) strand; PAM type: NRG; PAM sequence: AAG
gggatttatatggaactctg

SEQ ID NO: 148778 - DNA, 20 bp, Artificial Sequence
  Description of Artificial Sequence: Synthetic oligonucleotide
  Target: ATXN1; (+) strand; PAM type: NRG; PAM sequence: AGG
ggatttatatggaactctga

SEQ ID NO: 148779 - DNA, 20 bp, Artificial Sequence
  Description of Artificial Sequence: Synthetic oligonucleotide
  Target: ATXN1; (+) strand; PAM type: NRG; PAM sequence: GAG
atttatatggaactctgaag

SEQ ID NO: 148780 - DNA, 20 bp, Artificial Sequence
  Description of Artificial Sequence: Synthetic oligonucleotide
  Target: ATXN1; (+) strand; PAM type: NRG; PAM sequence: TAG
atatggaactctgaaggaga

SEQ ID NO: 148781 - DNA, 20 bp, Artificial Sequence
  Description of Artificial Sequence: Synthetic oligonucleotide
  Target: ATXN1; (+) strand; PAM type: NRG; PAM sequence: GAG
aacaccaccaaaataatctt

SEQ ID NO: 148782 - DNA, 20 bp, Artificial Sequence
  Description of Artificial Sequence: Synthetic oligonucleotide
  Target: ATXN1; (+) strand; PAM type: NRG; PAM sequence: AGG
acaccaccaaaataatcttg

SEQ ID NO: 148783 - DNA, 20 bp, Artificial Sequence
  Description of Artificial Sequence: Synthetic oligonucleotide
  Target: ATXN1; (+) strand; PAM type: NRG; PAM sequence: GGG
caccaccaaaataatcttga

SEQ ID NO: 148784 - DNA, 20 bp, Artificial Sequence
  Description of Artificial Sequence: Synthetic oligonucleotide
  Target: ATXN1; (+) strand; PAM type: NRG; PAM sequence: AAG
ataatcttgagggaaaaaac

SEQ ID NO: 148785 - DNA, 20 bp, Artificial Sequence
  Description of Artificial Sequence: Synthetic oligonucleotide
  Target: ATXN1; (+) strand; PAM type: NRG; PAM sequence: CAG
tcttgagggaaaaaacaaga

SEQ ID NO: 148786 - DNA, 20 bp, Artificial Sequence
  Description of Artificial Sequence: Synthetic oligonucleotide
  Target: ATXN1; (+) strand; PAM type: NRG; PAM sequence: GAG
ttgagggaaaaaacaagaca

SEQ ID NO: 148787 - DNA, 20 bp, Artificial Sequence
  Description of Artificial Sequence: Synthetic oligonucleotide
  Target: ATXN1; (+) strand; PAM type: NRG; PAM sequence: GAG
gagggaaaaaacaagacaga

SEQ ID NO: 148788 - DNA, 20 bp, Artificial Sequence
  Description of Artificial Sequence: Synthetic oligonucleotide
  Target: ATXN1; (+) strand; PAM type: NRG; PAM sequence: AGG
agggaaaaaacaagacagag

SEQ ID NO: 148789 - DNA, 20 bp, Artificial Sequence
  Description of Artificial Sequence: Synthetic oligonucleotide
  Target: ATXN1; (+) strand; PAM type: NRG; PAM sequence: AAG
gactcacgctatctgttttc

SEQ ID NO: 148790 - DNA, 20 bp, Artificial Sequence
  Description of Artificial Sequence: Synthetic oligonucleotide
  Target: ATXN1; (+) strand; PAM type: NRG; PAM sequence: AAG
tgttttcaagatttaccata

SEQ ID NO: 148791 - DNA, 20 bp, Artificial Sequence
  Description of Artificial Sequence: Synthetic oligonucleotide
  Target: ATXN1; (+) strand; PAM type: NRG; PAM sequence: TAG
agatttaccataaagctatt

SEQ ID NO: 148792 - DNA, 20 bp, Artificial Sequence
  Description of Artificial Sequence: Synthetic oligonucleotide
  Target: ATXN1; (+) strand; PAM type: NRG; PAM sequence: GAG
attttattgttattattttt

SEQ ID NO: 148793 - DNA, 20 bp, Artificial Sequence
  Description of Artificial Sequence: Synthetic oligonucleotide
  Target: ATXN1; (+) strand; PAM type: NRG; PAM sequence: CAG
tattgttattatttttgaga

SEQ ID NO: 148794 - DNA, 20 bp, Artificial Sequence
  Description of Artificial Sequence: Synthetic oligonucleotide
  Target: ATXN1; (+) strand; PAM type: NRG; PAM sequence: AGG
attgttattatttttgagac

SEQ ID NO: 148795 - DNA, 20 bp, Artificial Sequence
  Description of Artificial Sequence: Synthetic oligonucleotide
  Target: ATXN1; (+) strand; PAM type: NRG; PAM sequence: GGG
ttgttattatttttgagaca

SEQ ID NO: 148796 - DNA, 20 bp, Artificial Sequence
  Description of Artificial Sequence: Synthetic oligonucleotide
  Target: ATXN1; (+) strand; PAM type: NRG; PAM sequence: CAG
attatttttgagacagggtc

SEQ ID NO: 148797 - DNA, 20 bp, Artificial Sequence
  Description of Artificial Sequence: Synthetic oligonucleotide
  Target: ATXN1; (+) strand; PAM type: NRG; PAM sequence: CAG
ttttgagacagggtccagct

SEQ ID NO: 148798 - DNA, 20 bp, Artificial Sequence
  Description of Artificial Sequence: Synthetic oligonucleotide
  Target: ATXN1; (+) strand; PAM type: NRG; PAM sequence: CAG
cagggtccagctcagtcacc

SEQ ID NO: 148799 - DNA, 20 bp, Artificial Sequence
  Description of Artificial Sequence: Synthetic oligonucleotide
  Target: ATXN1; (+) strand; PAM type: NRG; PAM sequence: AGG
agggtccagctcagtcaccc

SEQ ID NO: 148800 - DNA, 20 bp, Artificial Sequence
  Description of Artificial Sequence: Synthetic oligonucleotide
  Target: ATXN1; (+) strand; PAM type: NRG; PAM sequence: CGG
tccagctcagtcacccaggc

SEQ ID NO: 148801 - DNA, 20 bp, Artificial Sequence
  Description of Artificial Sequence: Synthetic oligonucleotide
  Target: ATXN1; (+) strand; PAM type: NRG; PAM sequence: GAG
cagctcagtcacccaggccg

SEQ ID NO: 148802 - DNA, 20 bp, Artificial Sequence
  Description of Artificial Sequence: Synthetic oligonucleotide
  Target: ATXN1; (+) strand; PAM type: NRG; PAM sequence: CAG
cagtcacccaggccggagtg

SEQ ID NO: 148803 - DNA, 20 bp, Artificial Sequence
  Description of Artificial Sequence: Synthetic oligonucleotide
  Target: ATXN1; (+) strand; PAM type: NRG; PAM sequence: TGG
tcacccaggccggagtgcag

SEQ ID NO: 148804 - DNA, 20 bp, Artificial Sequence
  Description of Artificial Sequence: Synthetic oligonucleotide
  Target: ATXN1; (+) strand; PAM type: NRG; PAM sequence: CAG
ggagtgcagtggcatgatca

SEQ ID NO: 148805 - DNA, 20 bp, Artificial Sequence
  Description of Artificial Sequence: Synthetic oligonucleotide
  Target: ATXN1; (+) strand; PAM type: NRG; PAM sequence: TAG
ggcatgatcacagctcactg

SEQ ID NO: 148806 - DNA, 20 bp, Artificial Sequence
  Description of Artificial Sequence: Synthetic oligonucleotide
  Target: ATXN1; (+) strand; PAM type: NRG; PAM sequence: TGG
tcactgtagcctcaacctcc

SEQ ID NO: 148807 - DNA, 20 bp, Artificial Sequence
  Description of Artificial Sequence: Synthetic oligonucleotide
  Target: ATXN1; (+) strand; PAM type: NRG; PAM sequence: GGG
cactgtagcctcaacctcct

SEQ ID NO: 148808 - DNA, 20 bp, Artificial Sequence
  Description of Artificial Sequence: Synthetic oligonucleotide
  Target: ATXN1; (+) strand; PAM type: NRG; PAM sequence: AAG
agcctcaacctcctgggctc

SEQ ID NO: 148809 - DNA, 20 bp, Artificial Sequence
  Description of Artificial Sequence: Synthetic oligonucleotide
  Target: ATXN1; (+) strand; PAM type: NRG; PAM sequence: CAG
ctcaagcgatcctcccacct

SEQ ID NO: 148810 - DNA, 20 bp, Artificial Sequence
  Description of Artificial Sequence: Synthetic oligonucleotide
  Target: ATXN1; (+) strand; PAM type: NRG; PAM sequence: CAG
tcctcccacctcagcctcac

SEQ ID NO: 148811 - DNA, 20 bp, Artificial Sequence
  Description of Artificial Sequence: Synthetic oligonucleotide
  Target: ATXN1; (+) strand; PAM type: NRG; PAM sequence: TAG
tcccacctcagcctcaccag

SEQ ID NO: 148812 - DNA, 20 bp, Artificial Sequence
  Description of Artificial Sequence: Synthetic oligonucleotide
  Target: ATXN1; (+) strand; PAM type: NRG; PAM sequence: TGG
acctcagcctcaccagtaga

SEQ ID NO: 148813 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcaccagtagat

SEQ ID NO: 148814 - DNA, 20 bp, Artificial Sequence
  Description of Artificial Sequence: Synthetic oligonucleotide
  Target: ATXN1; (+) strand; PAM type: NRG; PAM sequence: CAG
ctcaccagtagatgggacta

SEQ ID NO: 148815 - DNA, 20 bp, Artificial Sequence
  Description of Artificial Sequence: Synthetic oligonucleotide
  Target: ATXN1; (+) strand; PAM type: NRG; PAM sequence: AGG
tcaccagtagatgggactac

SEQ ID NO: 148816 - DNA, 20 bp, Artificial Sequence
  Description of Artificial Sequence: Synthetic oligonucleotide
  Target: ATXN1; (+) strand; PAM type: NRG; PAM sequence: CAG
caggcacatgccacctcacc

SEQ ID NO: 148817 - DNA, 20 bp, Artificial Sequence
  Description of Artificial Sequence: Synthetic oligonucleotide
  Target: ATXN1; (+) strand; PAM type: NRG; PAM sequence: TAG
ccagctgatttttgtatttt

SEQ ID NO: 148818 - DNA, 20 bp, Artificial Sequence
  Description of Artificial Sequence: Synthetic oligonucleotide
  Target: ATXN1; (+) strand; PAM type: NRG; PAM sequence: TAG
gctgatttttgtatttttag

SEQ ID NO: 148819 - DNA, 20 bp, Artificial Sequence
  Description of Artificial Sequence: Synthetic oligonucleotide
  Target: ATXN1; (+) strand; PAM type: NRG; PAM sequence: GAG
tgatttttgtatttttagta

SEQ ID NO: 148820 - DNA, 20 bp, Artificial Sequence
  Description of Artificial Sequence: Synthetic oligonucleotide
  Target: ATXN1; (+) strand; PAM type: NRG; PAM sequence: TGG
ttttgtatttttagtagaga

SEQ ID NO: 148821 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagat

SEQ ID NO: 148822 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagatg

SEQ ID NO: 148823 - DNA, 20 bp, Artificial Sequence
  Description of Artificial Sequence: Synthetic oligonucleotide
  Target: ATXN1; (+) strand; PAM type: NRG; PAM sequence: CAG
tggggttttgctatgctgcc

SEQ ID NO: 148824 - DNA, 20 bp, Artificial Sequence
  Description of Artificial Sequence: Synthetic oligonucleotide
  Target: ATXN1; (+) strand; PAM type: NRG; PAM sequence: AGG
ggggttttgctatgctgccc

SEQ ID NO: 148825 - DNA, 20 bp, Artificial Sequence
  Description of Artificial Sequence: Synthetic oligonucleotide
  Target: ATXN1; (+) strand; PAM type: NRG; PAM sequence: TGG
ttttgctatgctgcccaggc

SEQ ID NO: 148826 - DNA, 20 bp, Artificial Sequence
  Description of Artificial Sequence: Synthetic oligonucleotide
  Target: ATXN1; (+) strand; PAM type: NRG; PAM sequence: GAG
caggctggtctcaaactcct

SEQ ID NO: 148827 - DNA, 20 bp, Artificial Sequence
  Description of Artificial Sequence: Synthetic oligonucleotide
  Target: ATXN1; (+) strand; PAM type: NRG; PAM sequence: AAG
ggtctcaaactcctgagctc

SEQ ID NO: 148828 - DNA, 20 bp, Artificial Sequence
  Description of Artificial Sequence: Synthetic oligonucleotide
  Target: ATXN1; (+) strand; PAM type: NRG; PAM sequence: CGG
ctcaagcaatctttctgcct

SEQ ID NO: 148829 - DNA, 20 bp, Artificial Sequence
  Description of Artificial Sequence: Synthetic oligonucleotide
  Target: ATXN1; (+) strand; PAM type: NRG; PAM sequence: AAG
ctttctgcctcggcctccca

SEQ ID NO: 148830 - DNA, 20 bp, Artificial Sequence
  Description of Artificial Sequence: Synthetic oligonucleotide
  Target: ATXN1; (+) strand; PAM type: NRG; PAM sequence: TGG
gcctcggcctcccaaagtac

SEQ ID NO: 148831 - DNA, 20 bp, Artificial Sequence
  Description of Artificial Sequence: Synthetic oligonucleotide
  Target: ATXN1; (+) strand; PAM type: NRG; PAM sequence: GGG
cctcggcctcccaaagtact

SEQ ID NO: 148832 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtactgggatta

SEQ ID NO: 148833 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtactgggattac

SEQ ID NO: 148834 - DNA, 20 bp, Artificial Sequence
  Description of Artificial Sequence: Synthetic oligonucleotide
  Target: ATXN1; (+) strand; PAM type: NRG; PAM sequence: GAG
agtactgggattacaggcat

SEQ ID NO: 148835 - DNA, 20 bp, Artificial Sequence
  Description of Artificial Sequence: Synthetic oligonucleotide
  Target: ATXN1; (+) strand; PAM type: NRG; PAM sequence: CAG
caggcatgagccaccacacc

SEQ ID NO: 148836 - DNA, 20 bp, Artificial Sequence
  Description of Artificial Sequence: Synthetic oligonucleotide
  Target: ATXN1; (+) strand; PAM type: NRG; PAM sequence: TAG
cctattattattatttttaa

SEQ ID NO: 148837 - DNA, 20 bp, Artificial Sequence
  Description of Artificial Sequence: Synthetic oligonucleotide
  Target: ATXN1; (+) strand; PAM type: NRG; PAM sequence: GAG
tattattattatttttaata

SEQ ID NO: 148838 - DNA, 20 bp, Artificial Sequence
  Description of Artificial Sequence: Synthetic oligonucleotide
  Target: ATXN1; (+) strand; PAM type: NRG; PAM sequence: CGG
tattatttttaatagagaca

SEQ ID NO: 148839 - DNA, 20 bp, Artificial Sequence
  Description of Artificial Sequence: Synthetic oligonucleotide
  Target: ATXN1; (+) strand; PAM type: NRG; PAM sequence: CAG
cacggtctcactctgctgcc

SEQ ID NO: 148840 - DNA, 20 bp, Artificial Sequence
  Description of Artificial Sequence: Synthetic oligonucleotide
  Target: ATXN1; (+) strand; PAM type: NRG; PAM sequence: AGG
acggtctcactctgctgccc

SEQ ID NO: 148841 - DNA, 20 bp, Artificial Sequence
  Description of Artificial Sequence: Synthetic oligonucleotide
  Target: ATXN1; (+) strand; PAM type: NRG; PAM sequence: TGG
tctcactctgctgcccagga

SEQ ID NO: 148842 - DNA, 20 bp, Artificial Sequence
  Description of Artificial Sequence: Synthetic oligonucleotide
  Target: ATXN1; (+) strand; PAM type: NRG; PAM sequence: CAG
caggatggaatgcaatgctg

SEQ ID NO: 148843 - DNA, 20 bp, Artificial Sequence
  Description of Artificial Sequence: Synthetic oligonucleotide
  Target: ATXN1; (+) strand; PAM type: NRG; PAM sequence: TAG
atgcaatgctgcagtcactg

SEQ ID NO: 148844 - DNA, 20 bp, Artificial Sequence
  Description of Artificial Sequence: Synthetic oligonucleotide
  Target: ATXN1; (+) strand; PAM type: NRG; PAM sequence: TGG
tcactgtagcctcaaactcc

SEQ ID NO: 148845 - DNA, 20 bp, Artificial Sequence
  Description of Artificial Sequence: Synthetic oligonucleotide
  Target: ATXN1; (+) strand; PAM type: NRG; PAM sequence: GGG
cactgtagcctcaaactcct

SEQ ID NO: 148846 - DNA, 20 bp, Artificial Sequence
  Description of Artificial Sequence: Synthetic oligonucleotide
  Target: ATXN1; (+) strand; PAM type: NRG; PAM sequence: AAG
agcctcaaactcctgggccc

SEQ ID NO: 148847 - DNA, 20 bp, Artificial Sequence
  Description of Artificial Sequence: Synthetic oligonucleotide
  Target: ATXN1; (+) strand; PAM type: NRG; PAM sequence: CAG
cccaagcgatcctcccacct

SEQ ID NO: 148848 - DNA, 20 bp, Artificial Sequence
  Description of Artificial Sequence: Synthetic oligonucleotide
  Target: ATXN1; (+) strand; PAM type: NRG; PAM sequence: AAG
tcctcccacctcagcctccc

SEQ ID NO: 148849 - DNA, 20 bp, Artificial Sequence
  Description of Artificial Sequence: Synthetic oligonucleotide
  Target: ATXN1; (+) strand; PAM type: NRG; PAM sequence: AGG
cctcccacctcagcctccca

SEQ ID NO: 148850 - DNA, 20 bp, Artificial Sequence
  Description of Artificial Sequence: Synthetic oligonucleotide
  Target: ATXN1; (+) strand; PAM type: NRG; PAM sequence: TGG
acctcagcctcccaaggtgc

SEQ ID NO: 148851 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaaggtgct

SEQ ID NO: 148852 - DNA, 20 bp, Artificial Sequence
  Description of Artificial Sequence: Synthetic oligonucleotide
  Target: ATXN1; (+) strand; PAM type: NRG; PAM sequence: CAG
ctcccaaggtgctgggatta

SEQ ID NO: 148853 - DNA, 20 bp, Artificial Sequence
  Description of Artificial Sequence: Synthetic oligonucleotide
  Target: ATXN1; (+) strand; PAM type: NRG; PAM sequence: AGG
tcccaaggtgctgggattac

SEQ ID NO: 148854 - DNA, 20 bp, Artificial Sequence
  Description of Artificial Sequence: Synthetic oligonucleotide
  Target: ATXN1; (+) strand; PAM type: NRG; PAM sequence: AAG
aaggtgctgggattacaggc

SEQ ID NO: 148855 - DNA, 20 bp, Artificial Sequence
  Description of Artificial Sequence: Synthetic oligonucleotide
  Target: ATXN1; (+) strand; PAM type: NRG; PAM sequence: GAG
ggtgctgggattacaggcaa

SEQ ID NO: 148856 - DNA, 20 bp, Artificial Sequence
  Description of Artificial Sequence: Synthetic oligonucleotide
  Target: ATXN1; (+) strand; PAM type: NRG; PAM sequence: TAG
gggattacaggcaagagcca

SEQ ID NO: 148857 - DNA, 20 bp, Artificial Sequence
  Description of Artificial Sequence: Synthetic oligonucleotide
  Target: ATXN1; (+) strand; PAM type: NRG; PAM sequence: GAG
gattacaggcaagagccata

SEQ ID NO: 148858 - DNA, 20 bp, Artificial Sequence
  Description of Artificial Sequence: Synthetic oligonucleotide
  Target: ATXN1; (+) strand; PAM type: NRG; PAM sequence: CAG
caggcaagagccatagagcc

SEQ ID NO: 148859 - DNA, 20 bp, Artificial Sequence
  Description of Artificial Sequence: Synthetic oligonucleotide
  Target: ATXN1; (+) strand; PAM type: NRG; PAM sequence: CAG
ccatagagcccagcccatga

SEQ ID NO: 148860 - DNA, 20 bp, Artificial Sequence
  Description of Artificial Sequence: Synthetic oligonucleotide
  Target: ATXN1; (+) strand; PAM type: NRG; PAM sequence: AAG
cccatgacagtattttaatc

SEQ ID NO: 148861 - DNA, 20 bp, Artificial Sequence
  Description of Artificial Sequence: Synthetic oligonucleotide
  Target: ATXN1; (+) strand; PAM type: NRG; PAM sequence: TAG
gtattttaatcaagacaata

SEQ ID NO: 148862 - DNA, 20 bp, Artificial Sequence
  Description of Artificial Sequence: Synthetic oligonucleotide
  Target: ATXN1; (+) strand; PAM type: NRG; PAM sequence: AAG
agacaatatagtattgacct

SEQ ID NO: 148863 - DNA, 20 bp, Artificial Sequence
  Description of Artificial Sequence: Synthetic oligonucleotide
  Target: ATXN1; (+) strand; PAM type: NRG; PAM sequence: CAG
atatagtattgacctaagta

SEQ ID NO: 148864 - DNA, 20 bp, Artificial Sequence
  Description of Artificial Sequence: Synthetic oligonucleotide
  Target: ATXN1; (+) strand; PAM type: NRG; PAM sequence: CAG
attgacctaagtacagactg

SEQ ID NO: 148865 - DNA, 20 bp, Artificial Sequence
  Description of Artificial Sequence: Synthetic oligonucleotide
  Target: ATXN1; (+) strand; PAM type: NRG; PAM sequence: CAG
cctaagtacagactgcagat

SEQ ID NO: 148866 - DNA, 20 bp, Artificial Sequence
  Description of Artificial Sequence: Synthetic oligonucleotide
  Target: ATXN1; (+) strand; PAM type: NRG; PAM sequence: TGG
aagtacagactgcagatcag

SEQ ID NO: 148867 - DNA, 20 bp, Artificial Sequence
  Description of Artificial Sequence: Synthetic oligonucleotide
  Target: ATXN1; (+) strand; PAM type: NRG; PAM sequence: CAG
cagactgcagatcagtggaa

SEQ ID NO: 148868 - DNA, 20 bp, Artificial Sequence
  Description of Artificial Sequence: Synthetic oligonucleotide
  Target: ATXN1; (+) strand; PAM type: NRG; PAM sequence: GAG
gactgcagatcagtggaaca

SEQ ID NO: 148869 - DNA, 20 bp, Artificial Sequence
  Description of Artificial Sequence: Synthetic oligonucleotide
  Target: ATXN1; (+) strand; PAM type: NRG; PAM sequence: GAG
ctgcagatcagtggaacaga

SEQ ID NO: 148870 - DNA, 20 bp, Artificial Sequence
  Description of Artificial Sequence: Synthetic oligonucleotide
  Target: ATXN1; (+) strand; PAM type: NRG; PAM sequence: AAG
aaaccaaatgatttttgaca

SEQ ID NO: 148871 - DNA, 20 bp, Artificial Sequence
  Description of Artificial Sequence: Synthetic oligonucleotide
  Target: ATXN1; (+) strand; PAM type: NRG; PAM sequence: AGG
aaccaaatgatttttgacaa

SEQ ID NO: 148872 - DNA, 20 bp, Artificial Sequence
  Description of Artificial Sequence: Synthetic oligonucleotide
  Target: ATXN1; (+) strand; PAM type: NRG; PAM sequence: TGG
gatttttgacaaaggtgtga

SEQ ID NO: 148873 - DNA, 20 bp, Artificial Sequence
  Description of Artificial Sequence: Synthetic oligonucleotide
  Target: ATXN1; (+) strand; PAM type: NRG; PAM sequence: AAG
aggtgtgatggcaatttcat

SEQ ID NO: 148874 - DNA, 20 bp, Artificial Sequence
  Description of Artificial Sequence: Synthetic oligonucleotide
  Target: ATXN1; (+) strand; PAM type: NRG; PAM sequence: AGG
ggtgtgatggcaatttcata

SEQ ID NO: 148875 - DNA, 20 bp, Artificial Sequence
  Description of Artificial Sequence: Synthetic oligonucleotide
  Target: ATXN1; (+) strand; PAM type: NRG; PAM sequence: TGG
cctcatatcttaatttgaaa

SEQ ID NO: 148876 - DNA, 20 bp, Artificial Sequence
  Description of Artificial Sequence: Synthetic oligonucleotide
  Target: ATXN1; (+) strand; PAM type: NRG; PAM sequence: AAG
ggctcatatacttaaatgtt

SEQ ID NO: 148877 - DNA, 20 bp, Artificial Sequence
  Description of Artificial Sequence: Synthetic oligonucleotide
  Target: ATXN1; (+) strand; PAM type: NRG; PAM sequence: AGG
gctcatatacttaaatgtta

SEQ ID NO: 148878 - DNA, 20 bp, Artificial Sequence
  Description of Artificial Sequence: Synthetic oligonucleotide
  Target: ATXN1; (+) strand; PAM type: NRG; PAM sequence: TAG
cttaaatgttaaggctaaac

SEQ ID NO: 148879 - DNA, 20 bp, Artificial Sequence
  Description of Artificial Sequence: Synthetic oligonucleotide
  Target: ATXN1; (+) strand; PAM type: NRG; PAM sequence: CAG
aggctaaactagaaatcttc

SEQ ID NO: 148880 - DNA, 20 bp, Artificial Sequence
  Description of Artificial Sequence: Synthetic oligonucleotide
  Target: ATXN1; (+) strand; PAM type: NRG; PAM sequence: AGG
ggctaaactagaaatcttcc

SEQ ID NO: 148881 - DNA, 20 bp, Artificial Sequence
  Description of Artificial Sequence: Synthetic oligonucleotide
  Target: ATXN1; (+) strand; PAM type: NRG; PAM sequence: GAG
ctaaactagaaatcttccag

SEQ ID NO: 148882 - DNA, 20 bp, Artificial Sequence
  Description of Artificial Sequence: Synthetic oligonucleotide
  Target: ATXN1; (+) strand; PAM type: NRG; PAM sequence: CAG
agaaatcttccaggagaaaa

SEQ ID NO: 148883 - DNA, 20 bp, Artificial Sequence
  Description of Artificial Sequence: Synthetic oligonucleotide
  Target: ATXN1; (+) strand; PAM type: NRG; PAM sequence: AGG
gaaatcttccaggagaaaac

SEQ ID NO: 148884 - DNA, 20 bp, Artificial Sequence
  Description of Artificial Sequence: Synthetic oligonucleotide
  Target: ATXN1; (+) strand; PAM type: NRG; PAM sequence: GAG
aatcttccaggagaaaacag

SEQ ID NO: 148885 - DNA, 20 bp, Artificial Sequence
  Description of Artificial Sequence: Synthetic oligonucleotide
  Target: ATXN1; (+) strand; PAM type: NRG; PAM sequence: AGG
atcttccaggagaaaacagg

SEQ ID NO: 148886 - DNA, 20 bp, Artificial Sequence
  Description of Artificial Sequence: Synthetic oligonucleotide
  Target: ATXN1; (+) strand; PAM type: NRG; PAM sequence: TAG
aaaacaggaggataacatct

SEQ ID NO: 148887 - DNA, 20 bp, Artificial Sequence
  Description of Artificial Sequence: Synthetic oligonucleotide
  Target: ATXN1; (+) strand; PAM type: NRG; PAM sequence: CAG
ggataacatcttagcaacca

SEQ ID NO: 148888 - DNA, 20 bp, Artificial Sequence
  Description of Artificial Sequence: Synthetic oligonucleotide
  Target: ATXN1; (+) strand; PAM type: NRG; PAM sequence: AGG
gataacatcttagcaaccac

SEQ ID NO: 148889 - DNA, 20 bp, Artificial Sequence
  Description of Artificial Sequence: Synthetic oligonucleotide
  Target: ATXN1; (+) strand; PAM type: NRG; PAM sequence: GGG
ataacatcttagcaaccaca

SEQ ID NO: 148890 - DNA, 20 bp, Artificial Sequence
  Description of Artificial Sequence: Synthetic oligonucleotide
  Target: ATXN1; (+) strand; PAM type: NRG; PAM sequence: AAG
catcttagcaaccacagggt

SEQ ID NO: 148891 - DNA, 20 bp, Artificial Sequence
  Description of Artificial Sequence: Synthetic oligonucleotide
  Target: ATXN1; (+) strand; PAM type: NRG; PAM sequence: AAG
gggtaagcaaaaatgttata

SEQ ID NO: 148892 - DNA, 20 bp, Artificial Sequence
  Description of Artificial Sequence: Synthetic oligonucleotide
  Target: ATXN1; (+) strand; PAM type: NRG; PAM sequence: AAG
aaatgttataaagacacaaa

SEQ ID NO: 148893 - DNA, 20 bp, Artificial Sequence
  Description of Artificial Sequence: Synthetic oligonucleotide
  Target: ATXN1; (+) strand; PAM type: NRG; PAM sequence: TAG
tatcttaaaaaatgataaat

SEQ ID NO: 148894 - DNA, 20 bp, Artificial Sequence
  Description of Artificial Sequence: Synthetic oligonucleotide
  Target: ATXN1; (+) strand; PAM type: NRG; PAM sequence: AAG
ttagacttcattaaaattta

SEQ ID NO: 148895 - DNA, 20 bp, Artificial Sequence
  Description of Artificial Sequence: Synthetic oligonucleotide
  Target: ATXN1; (+) strand; PAM type: NRG; PAM sequence: AGG
tagacttcattaaaatttaa

SEQ ID NO: 148896 - DNA, 20 bp, Artificial Sequence
  Description of Artificial Sequence: Synthetic oligonucleotide
  Target: ATXN1; (+) strand; PAM type: NRG; PAM sequence: GGG
agacttcattaaaatttaaa

SEQ ID NO: 148897 - DNA, 20 bp, Artificial Sequence
  Description of Artificial Sequence: Synthetic oligonucleotide
  Target: ATXN1; (+) strand; PAM type: NRG; PAM sequence: GGG
gacttcattaaaatttaaag

SEQ ID NO: 148898 - DNA, 20 bp, Artificial Sequence
  Description of Artificial Sequence: Synthetic oligonucleotide
  Target: ATXN1; (+) strand; PAM type: NRG; PAM sequence: CAG
ttaaaggggctcatcaaaca

SEQ ID NO: 148899 - DNA, 20 bp, Artificial Sequence
  Description of Artificial Sequence: Synthetic oligonucleotide
  Target: ATXN1; (+) strand; PAM type: NRG; PAM sequence: AAG
acacagtttaaaaaatgaaa

SEQ ID NO: 148900 - DNA, 20 bp, Artificial Sequence
  Description of Artificial Sequence: Synthetic oligonucleotide
  Target: ATXN1; (+) strand; PAM type: NRG; PAM sequence: AGG
cacagtttaaaaaatgaaaa

SEQ ID NO: 148901 - DNA, 20 bp, Artificial Sequence
  Description of Artificial Sequence: Synthetic oligonucleotide
  Target: ATXN1; (+) strand; PAM type: NRG; PAM sequence: AAG
gtttaaaaaatgaaaaaggt

SEQ ID NO: 148902 - DNA, 20 bp, Artificial Sequence
  Description of Artificial Sequence: Synthetic oligonucleotide
  Target: ATXN1; (+) strand; PAM type: NRG; PAM sequence: GAG
aaaaaggtaagccaaacact

SEQ ID NO: 148903 - DNA, 20 bp, Artificial Sequence
  Description of Artificial Sequence: Synthetic oligonucleotide
  Target: ATXN1; (+) strand; PAM type: NRG; PAM sequence: CAG
tctgataaatgacttaaatc

SEQ ID NO: 148904 - DNA, 20 bp, Artificial Sequence
  Description of Artificial Sequence: Synthetic oligonucleotide
  Target: ATXN1; (+) strand; PAM type: NRG; PAM sequence: AAG
acttaaatccagactatata

SEQ ID NO: 148905 - DNA, 20 bp, Artificial Sequence
  Description of Artificial Sequence: Synthetic oligonucleotide
  Target: ATXN1; (+) strand; PAM type: NRG; PAM sequence: AAG
atatatacacacatatatgt

SEQ ID NO: 148906 - DNA, 20 bp, Artificial Sequence
  Description of Artificial Sequence: Synthetic oligonucleotide
  Target: ATXN1; (+) strand; PAM type: NRG; PAM sequence: TAG
aaaaaccatctatatctata

SEQ ID NO: 148907 - DNA, 20 bp, Artificial Sequence
  Description of Artificial Sequence: Synthetic oligonucleotide
  Target: ATXN1; (+) strand; PAM type: NRG; PAM sequence: TAG
catctatatctatatagata

SEQ ID NO: 148908 - DNA, 20 bp, Artificial Sequence
  Description of Artificial Sequence: Synthetic oligonucleotide
  Target: ATXN1; (+) strand; PAM type: NRG; PAM sequence: CAG
cgacacatcattctgttgcc

SEQ ID NO: 148909 - DNA, 20 bp, Artificial Sequence
  Description of Artificial Sequence: Synthetic oligonucleotide
  Target: ATXN1; (+) strand; PAM type: NRG; PAM sequence: AGG
gacacatcattctgttgccc

SEQ ID NO: 148910 - DNA, 20 bp, Artificial Sequence
  Description of Artificial Sequence: Synthetic oligonucleotide
  Target: ATXN1; (+) strand; PAM type: NRG; PAM sequence: TGG
catcattctgttgcccaggc

SEQ ID NO: 148911 - DNA, 20 bp, Artificial Sequence
  Description of Artificial Sequence: Synthetic oligonucleotide
  Target: ATXN1; (+) strand; PAM type: NRG; PAM sequence: AAG
cattctgttgcccaggctgg

SEQ ID NO: 148912 - DNA, 20 bp, Artificial Sequence
  Description of Artificial Sequence: Synthetic oligonucleotide
  Target: ATXN1; (+) strand; PAM type: NRG; PAM sequence: CAG
tgttgcccaggctggaagtg

SEQ ID NO: 148913 - DNA, 20 bp, Artificial Sequence
  Description of Artificial Sequence: Synthetic oligonucleotide
  Target: ATXN1; (+) strand; PAM type: NRG; PAM sequence: TGG
tgcccaggctggaagtgcag

SEQ ID NO: 148914 - DNA, 20 bp, Artificial Sequence
  Description of Artificial Sequence: Synthetic oligonucleotide
  Target: ATXN1; (+) strand; PAM type: NRG; PAM sequence: CAG
ggcaccatcatgactcactg

SEQ ID NO: 148915 - DNA, 20 bp, Artificial Sequence
  Description of Artificial Sequence: Synthetic oligonucleotide
  Target: ATXN1; (+) strand; PAM type: NRG; PAM sequence: AGG
gcaccatcatgactcactgc

SEQ ID NO: 148916 - DNA, 20 bp, Artificial Sequence
  Description of Artificial Sequence: Synthetic oligonucleotide
  Target: ATXN1; (+) strand; PAM type: NRG; PAM sequence: CAG
actgcaggcttgacccctcc

SEQ ID NO: 148917 - DNA, 20 bp, Artificial Sequence
  Description of Artificial Sequence: Synthetic oligonucleotide
  Target: ATXN1; (+) strand; PAM type: NRG; PAM sequence: AGG
ctgcaggcttgacccctccc

SEQ ID NO: 148918 - DNA, 20 bp, Artificial Sequence
  Description of Artificial Sequence: Synthetic oligonucleotide
  Target: ATXN1; (+) strand; PAM type: NRG; PAM sequence: AAG
gcttgacccctcccaggctc

SEQ ID NO: 148919 - DNA, 20 bp, Artificial Sequence
  Description of Artificial Sequence: Synthetic oligonucleotide
  Target: ATXN1; (+) strand; PAM type: NRG; PAM sequence: CAG
ctcaagtgatcctcccacct

SEQ ID NO: 148920 - DNA, 20 bp, Artificial Sequence
  Description of Artificial Sequence: Synthetic oligonucleotide
  Target: ATXN1; (+) strand; PAM type: NRG; PAM sequence: GAG
tcctcccacctcagcctcct

SEQ ID NO: 148921 - DNA, 20 bp, Artificial Sequence
  Description of Artificial Sequence: Synthetic oligonucleotide
  Target: ATXN1; (+) strand; PAM type: NRG; PAM sequence: TGG
acctcagcctcctgagtatc

SEQ ID NO: 148922 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcctgagtatct

SEQ ID NO: 148923 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtatctgggatta

SEQ ID NO: 148924 - DNA, 20 bp, Artificial Sequence
  Description of Artificial Sequence: Synthetic oligonucleotide
  Target: ATXN1; (+) strand; PAM type: NRG; PAM sequence: AGG
tcctgagtatctgggattac

SEQ ID NO: 148925 - DNA, 20 bp, Artificial Sequence
  Description of Artificial Sequence: Synthetic oligonucleotide
  Target: ATXN1; (+) strand; PAM type: NRG; PAM sequence: TAG
tgcgtgccactgctgccgcc

SEQ ID NO: 148926 - DNA, 20 bp, Artificial Sequence
  Description of Artificial Sequence: Synthetic oligonucleotide
  Target: ATXN1; (+) strand; PAM type: NRG; PAM sequence: TAG
cctagtttttgtatttttaa

SEQ ID NO: 148927 - DNA, 20 bp, Artificial Sequence
  Description of Artificial Sequence: Synthetic oligonucleotide
  Target: ATXN1; (+) strand; PAM type: NRG; PAM sequence: GAG
tagtttttgtatttttaata

SEQ ID NO: 148928 - DNA, 20 bp, Artificial Sequence
  Description of Artificial Sequence: Synthetic oligonucleotide
  Target: ATXN1; (+) strand; PAM type: NRG; PAM sequence: CAG
ttttgtatttttaatagaga

SEQ ID NO: 148929 - DNA, 20 bp, Artificial Sequence
  Description of Artificial Sequence: Synthetic oligonucleotide
  Target: ATXN1; (+) strand; PAM type: NRG; PAM sequence: AGG
tttgtatttttaatagagac

SEQ ID NO: 148930 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttaatagagaca

SEQ ID NO: 148931 - DNA, 20 bp, Artificial Sequence
  Description of Artificial Sequence: Synthetic oligonucleotide
  Target: ATXN1; (+) strand; PAM type: NRG; PAM sequence: CAG
cagggtttcaccatgttgcc

SEQ ID NO: 148932 - DNA, 20 bp, Artificial Sequence
  Description of Artificial Sequence: Synthetic oligonucleotide
  Target: ATXN1; (+) strand; PAM type: NRG; PAM sequence: AGG
agggtttcaccatgttgccc

SEQ ID NO: 148933 - DNA, 20 bp, Artificial Sequence
  Description of Artificial Sequence: Synthetic oligonucleotide
  Target: ATXN1; (+) strand; PAM type: NRG; PAM sequence: TAG
ccaggctgatctcgaacttc

SEQ ID NO: 148934 - DNA, 20 bp, Artificial Sequence
  Description of Artificial Sequence: Synthetic oligonucleotide
  Target: ATXN1; (+) strand; PAM type: NRG; PAM sequence: AAG
gatctcgaacttctagactc

SEQ ID NO: 148935 - DNA, 20 bp, Artificial Sequence
  Description of Artificial Sequence: Synthetic oligonucleotide
  Target: ATXN1; (+) strand; PAM type: NRG; PAM sequence: TGG
ctcaagcaatatgcctgcct

SEQ ID NO: 148936 - DNA, 20 bp, Artificial Sequence
  Description of Artificial Sequence: Synthetic oligonucleotide
  Target: ATXN1; (+) strand; PAM type: NRG; PAM sequence: TGG
aatatgcctgccttggcctc

SEQ ID NO: 148937 - DNA, 20 bp, Artificial Sequence
  Description of Artificial Sequence: Synthetic oligonucleotide
  Target: ATXN1; (+) strand; PAM type: NRG; PAM sequence: TAG
tgcctgccttggcctctggc

SEQ ID NO: 148938 - DNA, 20 bp, Artificial Sequence
  Description of Artificial Sequence: Synthetic oligonucleotide
  Target: ATXN1; (+) strand; PAM type: NRG; PAM sequence: CAG
tgttgctacctgcaacaata

SEQ ID NO: 148939 - DNA, 20 bp, Artificial Sequence
  Description of Artificial Sequence: Synthetic oligonucleotide
  Target: ATXN1; (+) strand; PAM type: NRG; PAM sequence: AAG
aaaaatgatatgctgaacaa

SEQ ID NO: 148940 - DNA, 20 bp, Artificial Sequence
  Description of Artificial Sequence: Synthetic oligonucleotide
  Target: ATXN1; (+) strand; PAM type: NRG; PAM sequence: AAG
atgatatgctgaacaaaaga

SEQ ID NO: 148941 - DNA, 20 bp, Artificial Sequence
  Description of Artificial Sequence: Synthetic oligonucleotide
  Target: ATXN1; (+) strand; PAM type: NRG; PAM sequence: CAG
atatgctgaacaaaagaaag

SEQ ID NO: 148942 - DNA, 20 bp, Artificial Sequence
  Description of Artificial Sequence: Synthetic oligonucleotide
  Target: ATXN1; (+) strand; PAM type: NRG; PAM sequence: AAG
aaaagaaagcagatacgaaa

SEQ ID NO: 148943 - DNA, 20 bp, Artificial Sequence
  Description of Artificial Sequence: Synthetic oligonucleotide
  Target: ATXN1; (+) strand; PAM type: NRG; PAM sequence: AAG
tgactgattccatttgtatg

SEQ ID NO: 148944 - DNA, 20 bp, Artificial Sequence
  Description of Artificial Sequence: Synthetic oligonucleotide
  Target: ATXN1; (+) strand; PAM type: NRG; PAM sequence: AAG
attccatttgtatgaagctc

SEQ ID NO: 148945 - DNA, 20 bp, Artificial Sequence
  Description of Artificial Sequence: Synthetic oligonucleotide
  Target: ATXN1; (+) strand; PAM type: NRG; PAM sequence: CAG
gaacaaacaaaattcaatta

SEQ ID NO: 148946 - DNA, 20 bp, Artificial Sequence
  Description of Artificial Sequence: Synthetic oligonucleotide
  Target: ATXN1; (+) strand; PAM type: NRG; PAM sequence: CAG
acaaaattcaattacagtga

SEQ ID NO: 148947 - DNA, 20 bp, Artificial Sequence
  Description of Artificial Sequence: Synthetic oligonucleotide
  Target: ATXN1; (+) strand; PAM type: NRG; PAM sequence: AAG
aattacagtgacagaaatca

SEQ ID NO: 148948 - DNA, 20 bp, Artificial Sequence
  Description of Artificial Sequence: Synthetic oligonucleotide
  Target: ATXN1; (+) strand; PAM type: NRG; PAM sequence: CAG
tacagtgacagaaatcaaag

SEQ ID NO: 148949 - DNA, 20 bp, Artificial Sequence
  Description of Artificial Sequence: Synthetic oligonucleotide
  Target: ATXN1; (+) strand; PAM type: NRG; PAM sequence: TGG
agtgacagaaatcaaagcag

SEQ ID NO: 148950 - DNA, 20 bp, Artificial Sequence
  Description of Artificial Sequence: Synthetic oligonucleotide
  Target: ATXN1; (+) strand; PAM type: NRG; PAM sequence: CGG
atcaaagcagtggttgatga

SEQ ID NO: 148951 - DNA, 20 bp, Artificial Sequence
  Description of Artificial Sequence: Synthetic oligonucleotide
  Target: ATXN1; (+) strand; PAM type: NRG; PAM sequence: GGG
tcaaagcagtggttgatgac

SEQ ID NO: 148952 - DNA, 20 bp, Artificial Sequence
  Description of Artificial Sequence: Synthetic oligonucleotide
  Target: ATXN1; (+) strand; PAM type: NRG; PAM sequence: GGG
caaagcagtggttgatgacg

SEQ ID NO: 148953 - DNA, 20 bp, Artificial Sequence
  Description of Artificial Sequence: Synthetic oligonucleotide
  Target: ATXN1; (+) strand; PAM type: NRG; PAM sequence: GAG
aagcagtggttgatgacggg

SEQ ID NO: 148954 - DNA, 20 bp, Artificial Sequence
  Description of Artificial Sequence: Synthetic oligonucleotide
  Target: ATXN1; (+) strand; PAM type: NRG; PAM sequence: AGG
agcagtggttgatgacgggg

SEQ ID NO: 148955 - DNA, 20 bp, Artificial Sequence
  Description of Artificial Sequence: Synthetic oligonucleotide
  Target: ATXN1; (+) strand; PAM type: NRG; PAM sequence: TGG
agtggttgatgacggggagg

SEQ ID NO: 148956 - DNA, 20 bp, Artificial Sequence
  Description of Artificial Sequence: Synthetic oligonucleotide
  Target: ATXN1; (+) strand; PAM type: NRG; PAM sequence: AAG
gttgatgacggggaggtgga

SEQ ID NO: 148957 - DNA, 20 bp, Artificial Sequence
  Description of Artificial Sequence: Synthetic oligonucleotide
  Target: ATXN1; (+) strand; PAM type: NRG; PAM sequence: CAG
acggggaggtggaaagttga

SEQ ID NO: 148958 - DNA, 20 bp, Artificial Sequence
  Description of Artificial Sequence: Synthetic oligonucleotide
  Target: ATXN1; (+) strand; PAM type: NRG; PAM sequence: AGG
cggggaggtggaaagttgac

SEQ ID NO: 148959 - DNA, 20 bp, Artificial Sequence
  Description of Artificial Sequence: Synthetic oligonucleotide
  Target: ATXN1; (+) strand; PAM type: NRG; PAM sequence: AAG
ggaggtggaaagttgacagg

SEQ ID NO: 148960 - DNA, 20 bp, Artificial Sequence
  Description of Artificial Sequence: Synthetic oligonucleotide
  Target: ATXN1; (+) strand; PAM type: NRG; PAM sequence: AGG
gaggtggaaagttgacagga

SEQ ID NO: 148961 - DNA, 20 bp, Artificial Sequence
  Description of Artificial Sequence: Synthetic oligonucleotide
  Target: ATXN1; (+) strand; PAM type: NRG; PAM sequence: GGG
aggtggaaagttgacaggaa

SEQ ID NO: 148962 - DNA, 20 bp, Artificial Sequence
  Description of Artificial Sequence: Synthetic oligonucleotide
  Target: ATXN1; (+) strand; PAM type: NRG; PAM sequence: GGG
ggtggaaagttgacaggaag

SEQ ID NO: 148963 - DNA, 20 bp, Artificial Sequence
  Description of Artificial Sequence: Synthetic oligonucleotide
  Target: ATXN1; (+) strand; PAM type: NRG; PAM sequence: GGG
gtggaaagttgacaggaagg

SEQ ID NO: 148964 - DNA, 20 bp, Artificial Sequence
  Description of Artificial Sequence: Synthetic oligonucleotide
  Target: ATXN1; (+) strand; PAM type: NRG; PAM sequence: CAG
gaaagttgacaggaaggggg

SEQ ID NO: 148965 - DNA, 20 bp, Artificial Sequence
  Description of Artificial Sequence: Synthetic oligonucleotide
  Target: ATXN1; (+) strand; PAM type: NRG; PAM sequence: GAG
aagttgacaggaagggggca

SEQ ID NO: 148966 - DNA, 20 bp, Artificial Sequence
  Description of Artificial Sequence: Synthetic oligonucleotide
  Target: ATXN1; (+) strand; PAM type: NRG; PAM sequence: AGG
agttgacaggaagggggcag

SEQ ID NO: 148967 - DNA, 20 bp, Artificial Sequence
  Description of Artificial Sequence: Synthetic oligonucleotide
  Target: ATXN1; (+) strand; PAM type: NRG; PAM sequence: GGG
gttgacaggaagggggcaga

SEQ ID NO: 148968 - DNA, 20 bp, Artificial Sequence
  Description of Artificial Sequence: Synthetic oligonucleotide
  Target: ATXN1; (+) strand; PAM type: NRG; PAM sequence: GGG
ttgacaggaagggggcagag

SEQ ID NO: 148969 - DNA, 20 bp, Artificial Sequence
  Description of Artificial Sequence: Synthetic oligonucleotide
  Target: ATXN1; (+) strand; PAM type: NRG; PAM sequence: TGG
ggaagggggcagaggggctc

SEQ ID NO: 148970 - DNA, 20 bp, Artificial Sequence
  Description of Artificial Sequence: Synthetic oligonucleotide
  Target: ATXN1; (+) strand; PAM type: NRG; PAM sequence: GGG
gaagggggcagaggggctct

SEQ ID NO: 148971 - DNA, 20 bp, Artificial Sequence
  Description of Artificial Sequence: Synthetic oligonucleotide
  Target: ATXN1; (+) strand; PAM type: NRG; PAM sequence: GGG
aagggggcagaggggctctg

SEQ ID NO: 148972 - DNA, 20 bp, Artificial Sequence
  Description of Artificial Sequence: Synthetic oligonucleotide
  Target: ATXN1; (+) strand; PAM type: NRG; PAM sequence: TGG
gcagaggggctctggggtga

SEQ ID NO: 148973 - DNA, 20 bp, Artificial Sequence
  Description of Artificial Sequence: Synthetic oligonucleotide
  Target: ATXN1; (+) strand; PAM type: NRG; PAM sequence: TAG
gaaatgtcccatatcttgat

SEQ ID NO: 148974 - DNA, 20 bp, Artificial Sequence
  Description of Artificial Sequence: Synthetic oligonucleotide
  Target: ATXN1; (+) strand; PAM type: NRG; PAM sequence: AGG
aaatgtcccatatcttgatt

SEQ ID NO: 148975 - DNA, 20 bp, Artificial Sequence
  Description of Artificial Sequence: Synthetic oligonucleotide
  Target: ATXN1; (+) strand; PAM type: NRG; PAM sequence: TGG
tgattaggatgctgattatg

SEQ ID NO: 148976 - DNA, 20 bp, Artificial Sequence
  Description of Artificial Sequence: Synthetic oligonucleotide
  Target: ATXN1; (+) strand; PAM type: NRG; PAM sequence: AAG
actcattgcgctgtacgctt

SEQ ID NO: 148977 - DNA, 20 bp, Artificial Sequence
  Description of Artificial Sequence: Synthetic oligonucleotide
  Target: ATXN1; (+) strand; PAM type: NRG; PAM sequence: TAG
cactgtatgttctccctaaa

SEQ ID NO: 148978 - DNA, 20 bp, Artificial Sequence
  Description of Artificial Sequence: Synthetic oligonucleotide
  Target: ATXN1; (+) strand; PAM type: NRG; PAM sequence: TAG
ctaaatagaaactaatttat

SEQ ID NO: 148979 - DNA, 20 bp, Artificial Sequence
  Description of Artificial Sequence: Synthetic oligonucleotide
  Target: ATXN1; (+) strand; PAM type: NRG; PAM sequence: AAG
gaaactaatttattagtgaa

SEQ ID NO: 148980 - DNA, 20 bp, Artificial Sequence
  Description of Artificial Sequence: Synthetic oligonucleotide
  Target: ATXN1; (+) strand; PAM type: NRG; PAM sequence: AAG
ctaatttattagtgaaaaga

SEQ ID NO: 148981 - DNA, 20 bp, Artificial Sequence
  Description of Artificial Sequence: Synthetic oligonucleotide
  Target: ATXN1; (+) strand; PAM type: NRG; PAM sequence: TAG
ttaataataaactaatttat

SEQ ID NO: 148982 - DNA, 20 bp, Artificial Sequence
  Description of Artificial Sequence: Synthetic oligonucleotide
  Target: ATXN1; (+) strand; PAM type: NRG; PAM sequence: AAG
taaactaatttattagtgaa

SEQ ID NO: 148983 - DNA, 20 bp, Artificial Sequence
  Description of Artificial Sequence: Synthetic oligonucleotide
  Target: ATXN1; (+) strand; PAM type: NRG; PAM sequence: AAG
ctaatttattagtgaaaaga

SEQ ID NO: 148984 - DNA, 20 bp, Artificial Sequence
  Description of Artificial Sequence: Synthetic oligonucleotide
  Target: ATXN1; (+) strand; PAM type: NRG; PAM sequence: TGG
agaaagatgtactttctacc

SEQ ID NO: 148985 - DNA, 20 bp, Artificial Sequence
  Description of Artificial Sequence: Synthetic oligonucleotide
  Target: ATXN1; (+) strand; PAM type: NRG; PAM sequence: GAG
aaagatgtactttctacctg

SEQ ID NO: 148986 - DNA, 20 bp, Artificial Sequence
  Description of Artificial Sequence: Synthetic oligonucleotide
  Target: ATXN1; (+) strand; PAM type: NRG; PAM sequence: AGG
aagatgtactttctacctgg

SEQ ID NO: 148987 - DNA, 20 bp, Artificial Sequence
  Description of Artificial Sequence: Synthetic oligonucleotide
  Target: ATXN1; (+) strand; PAM type: NRG; PAM sequence: GGG
agatgtactttctacctgga

SEQ ID NO: 148988 - DNA, 20 bp, Artificial Sequence
  Description of Artificial Sequence: Synthetic oligonucleotide
  Target: ATXN1; (+) strand; PAM type: NRG; PAM sequence: TGG
ctttctacctggagggtctg

SEQ ID NO: 148989 - DNA, 20 bp, Artificial Sequence
  Description of Artificial Sequence: Synthetic oligonucleotide
  Target: ATXN1; (+) strand; PAM type: NRG; PAM sequence: GGG
tttctacctggagggtctgt

SEQ ID NO: 148990 - DNA, 20 bp, Artificial Sequence
  Description of Artificial Sequence: Synthetic oligonucleotide
  Target: ATXN1; (+) strand; PAM type: NRG; PAM sequence: GGG
ttctacctggagggtctgtg

SEQ ID NO: 148991 - DNA, 20 bp, Artificial Sequence
  Description of Artificial Sequence: Synthetic oligonucleotide
  Target: ATXN1; (+) strand; PAM type: NRG; PAM sequence: AAG
gataacccctattccgtaca

SEQ ID NO: 148992 - DNA, 20 bp, Artificial Sequence
  Description of Artificial Sequence: Synthetic oligonucleotide
  Target: ATXN1; (+) strand; PAM type: NRG; PAM sequence: AGG
ataacccctattccgtacaa

SEQ ID NO: 148993 - DNA, 20 bp, Artificial Sequence
  Description of Artificial Sequence: Synthetic oligonucleotide
  Target: ATXN1; (+) strand; PAM type: NRG; PAM sequence: CAG
ccctattccgtacaaaggaa

SEQ ID NO: 148994 - DNA, 20 bp, Artificial Sequence
  Description of Artificial Sequence: Synthetic oligonucleotide
  Target: ATXN1; (+) strand; PAM type: NRG; PAM sequence: GAG
aaggaacagtgaacatgctt

SEQ ID NO: 148995 - DNA, 20 bp, Artificial Sequence
  Description of Artificial Sequence: Synthetic oligonucleotide
  Target: ATXN1; (+) strand; PAM type: NRG; PAM sequence: CAG
tgaacatgcttgagtgaaaa

SEQ ID NO: 148996 - DNA, 20 bp, Artificial Sequence
  Description of Artificial Sequence: Synthetic oligonucleotide
  Target: ATXN1; (+) strand; PAM type: NRG; PAM sequence: AAG
ttgagtgaaaacagccacgc

SEQ ID NO: 148997 - DNA, 20 bp, Artificial Sequence
  Description of Artificial Sequence: Synthetic oligonucleotide
  Target: ATXN1; (+) strand; PAM type: NRG; PAM sequence: AGG
tgagtgaaaacagccacgca

SEQ ID NO: 148998 - DNA, 20 bp, Artificial Sequence
  Description of Artificial Sequence: Synthetic oligonucleotide
  Target: ATXN1; (+) strand; PAM type: NRG; PAM sequence: CAG
gtgaaaacagccacgcaagg

SEQ ID NO: 148999 - DNA, 20 bp, Artificial Sequence
  Description of Artificial Sequence: Synthetic oligonucleotide
  Target: ATXN1; (+) strand; PAM type: NRG; PAM sequence: CAG
aaacagccacgcaaggcaga

SEQ ID NO: 149000 - DNA, 20 bp, Artificial Sequence
  Description of Artificial Sequence: Synthetic oligonucleotide
  Target: ATXN1; (+) strand; PAM type: NRG; PAM sequence: AAG
agccacgcaaggcagacagc

SEQ ID NO: 149001 - DNA, 20 bp, Artificial Sequence
  Description of Artificial Sequence: Synthetic oligonucleotide
  Target: ATXN1; (+) strand; PAM type: NRG; PAM sequence: GAG
acgcaaggcagacagcaagt

SEQ ID NO: 149002 - DNA, 20 bp, Artificial Sequence
  Description of Artificial Sequence: Synthetic oligonucleotide
  Target: ATXN1; (+) strand; PAM type: NRG; PAM sequence: AAG
acagcaagtgagaaacgcct

SEQ ID NO: 149003 - DNA, 20 bp, Artificial Sequence
  Description of Artificial Sequence: Synthetic oligonucleotide
  Target: ATXN1; (+) strand; PAM type: NRG; PAM sequence: AGG
cagcaagtgagaaacgccta

SEQ ID NO: 149004 - DNA, 20 bp, Artificial Sequence
  Description of Artificial Sequence: Synthetic oligonucleotide
  Target: ATXN1; (+) strand; PAM type: NRG; PAM sequence: CAG
caagtgagaaacgcctaagg

SEQ ID NO: 149005 - DNA, 20 bp, Artificial Sequence
  Description of Artificial Sequence: Synthetic oligonucleotide
  Target: ATXN1; (+) strand; PAM type: NRG; PAM sequence: AGG
aagtgagaaacgcctaaggc

SEQ ID NO: 149006 - DNA, 20 bp, Artificial Sequence
  Description of Artificial Sequence: Synthetic oligonucleotide
  Target: ATXN1; (+) strand; PAM type: NRG; PAM sequence: GGG
agtgagaaacgcctaaggca

SEQ ID NO: 149007 - DNA, 20 bp, Artificial Sequence
  Description of Artificial Sequence: Synthetic oligonucleotide
  Target: ATXN1; (+) strand; PAM type: NRG; PAM sequence: GGG
gtgagaaacgcctaaggcag

SEQ ID NO: 149008 - DNA, 20 bp, Artificial Sequence
  Description of Artificial Sequence: Synthetic oligonucleotide
  Target: ATXN1; (+) strand; PAM type: NRG; PAM sequence: AAG
agaaacgcctaaggcagggg

SEQ ID NO: 149009 - DNA, 20 bp, Artificial Sequence
  Description of Artificial Sequence: Synthetic oligonucleotide
  Target: ATXN1; (+) strand; PAM type: NRG; PAM sequence: CGG
cgcctaaggcaggggaagaa

SEQ ID NO: 149010 - DNA, 20 bp, Artificial Sequence
  Description of Artificial Sequence: Synthetic oligonucleotide
  Target: ATXN1; (+) strand; PAM type: NRG; PAM sequence: TGG
ctaaggcaggggaagaacgg

SEQ ID NO: 149011 - DNA, 20 bp, Artificial Sequence
  Description of Artificial Sequence: Synthetic oligonucleotide
  Target: ATXN1; (+) strand; PAM type: NRG; PAM sequence: CAG
ggaagaacggtggtctgcta

SEQ ID NO: 149012 - DNA, 20 bp, Artificial Sequence
  Description of Artificial Sequence: Synthetic oligonucleotide
  Target: ATXN1; (+) strand; PAM type: NRG; PAM sequence: GAG
gaacggtggtctgctacagt

SEQ ID NO: 149013 - DNA, 20 bp, Artificial Sequence
  Description of Artificial Sequence: Synthetic oligonucleotide
  Target: ATXN1; (+) strand; PAM type: NRG; PAM sequence: AAG
cggtggtctgctacagtgag

SEQ ID NO: 149014 - DNA, 20 bp, Artificial Sequence
  Description of Artificial Sequence: Synthetic oligonucleotide
  Target: ATXN1; (+) strand; PAM type: NRG; PAM sequence: GAG
gtggtctgctacagtgagaa

SEQ ID NO: 149015 - DNA, 20 bp, Artificial Sequence
  Description of Artificial Sequence: Synthetic oligonucleotide
  Target: ATXN1; (+) strand; PAM type: NRG; PAM sequence: TAG
tgctacagtgagaagagaaa

SEQ ID NO: 149016 - DNA, 20 bp, Artificial Sequence
  Description of Artificial Sequence: Synthetic oligonucleotide
  Target: ATXN1; (+) strand; PAM type: NRG; PAM sequence: GAG
ctacagtgagaagagaaata

SEQ ID NO: 149017 - DNA, 20 bp, Artificial Sequence
  Description of Artificial Sequence: Synthetic oligonucleotide
  Target: ATXN1; (+) strand; PAM type: NRG; PAM sequence: AAG
cagtgagaagagaaatagag

SEQ ID NO: 149018 - DNA, 20 bp, Artificial Sequence
  Description of Artificial Sequence: Synthetic oligonucleotide
  Target: ATXN1; (+) strand; PAM type: NRG; PAM sequence: GAG
gaagagaaatagagaagact

SEQ ID NO: 149019 - DNA, 20 bp, Artificial Sequence
  Description of Artificial Sequence: Synthetic oligonucleotide
  Target: ATXN1; (+) strand; PAM type: NRG; PAM sequence: CAG
agaaatagagaagactgagt

SEQ ID NO: 149020 - DNA, 20 bp, Artificial Sequence
  Description of Artificial Sequence: Synthetic oligonucleotide
  Target: ATXN1; (+) strand; PAM type: NRG; PAM sequence: AAG
aatagagaagactgagtcag

SEQ ID NO: 149021 - DNA, 20 bp, Artificial Sequence
  Description of Artificial Sequence: Synthetic oligonucleotide
  Target: ATXN1; (+) strand; PAM type: NRG; PAM sequence: AGG
atagagaagactgagtcaga

SEQ ID NO: 149022 - DNA, 20 bp, Artificial Sequence
  Description of Artificial Sequence: Synthetic oligonucleotide
  Target: ATXN1; (+) strand; PAM type: NRG; PAM sequence: GGG
tagagaagactgagtcagaa

SEQ ID NO: 149023 - DNA, 20 bp, Artificial Sequence
  Description of Artificial Sequence: Synthetic oligonucleotide
  Target: ATXN1; (+) strand; PAM type: NRG; PAM sequence: GGG
agagaagactgagtcagaag

SEQ ID NO: 149024 - DNA, 20 bp, Artificial Sequence
  Description of Artificial Sequence: Synthetic oligonucleotide
  Target: ATXN1; (+) strand; PAM type: NRG; PAM sequence: AAG
gaagactgagtcagaagggg

SEQ ID NO: 149025 - DNA, 20 bp, Artificial Sequence
  Description of Artificial Sequence: Synthetic oligonucleotide
  Target: ATXN1; (+) strand; PAM type: NRG; PAM sequence: AGG
aagactgagtcagaagggga

SEQ ID NO: 149026 - DNA, 20 bp, Artificial Sequence
  Description of Artificial Sequence: Synthetic oligonucleotide
  Target: ATXN1; (+) strand; PAM type: NRG; PAM sequence: CAG
aggggaaggtatacaccaaa

SEQ ID NO: 149027 - DNA, 20 bp, Artificial Sequence
  Description of Artificial Sequence: Synthetic oligonucleotide
  Target: ATXN1; (+) strand; PAM type: NRG; PAM sequence: AGG
ggggaaggtatacaccaaac

SEQ ID NO: 149028 - DNA, 20 bp, Artificial Sequence
  Description of Artificial Sequence: Synthetic oligonucleotide
  Target: ATXN1; (+) strand; PAM type: NRG; PAM sequence: AAG
gaaggtatacaccaaacagg

SEQ ID NO: 149029 - DNA, 20 bp, Artificial Sequence
  Description of Artificial Sequence: Synthetic oligonucleotide
  Target: ATXN1; (+) strand; PAM type: NRG; PAM sequence: GAG
tacaccaaacaggaagacac

SEQ ID NO: 149030 - DNA, 20 bp, Artificial Sequence
  Description of Artificial Sequence: Synthetic oligonucleotide
  Target: ATXN1; (+) strand; PAM type: NRG; PAM sequence: AAG
gacacgagtgaactgaacgc

SEQ ID NO: 149031 - DNA, 20 bp, Artificial Sequence
  Description of Artificial Sequence: Synthetic oligonucleotide
  Target: ATXN1; (+) strand; PAM type: NRG; PAM sequence: AAG
acgagtgaactgaacgcaag

SEQ ID NO: 149032 - DNA, 20 bp, Artificial Sequence
  Description of Artificial Sequence: Synthetic oligonucleotide
  Target: ATXN1; (+) strand; PAM type: NRG; PAM sequence: TAG
agtgaactgaacgcaagaag

SEQ ID NO: 149033 - DNA, 20 bp, Artificial Sequence
  Description of Artificial Sequence: Synthetic oligonucleotide
  Target: ATXN1; (+) strand; PAM type: NRG; PAM sequence: AAG
aactgaacgcaagaagtaga

SEQ ID NO: 149034 - DNA, 20 bp, Artificial Sequence
  Description of Artificial Sequence: Synthetic oligonucleotide
  Target: ATXN1; (+) strand; PAM type: NRG; PAM sequence: AAG
gaacgcaagaagtagaaagt

SEQ ID NO: 149035 - DNA, 20 bp, Artificial Sequence
  Description of Artificial Sequence: Synthetic oligonucleotide
  Target: ATXN1; (+) strand; PAM type: NRG; PAM sequence: GAG
acgcaagaagtagaaagtaa

SEQ ID NO: 149036 - DNA, 20 bp, Artificial Sequence
  Description of Artificial Sequence: Synthetic oligonucleotide
  Target: ATXN1; (+) strand; PAM type: NRG; PAM sequence: CAG
attcgtgtttccaaataatc

SEQ ID NO: 149037 - DNA, 20 bp, Artificial Sequence
  Description of Artificial Sequence: Synthetic oligonucleotide
  Target: ATXN1; (+) strand; PAM type: NRG; PAM sequence: AAG
taccacattacactcaaaaa

SEQ ID NO: 149038 - DNA, 20 bp, Artificial Sequence
  Description of Artificial Sequence: Synthetic oligonucleotide
  Target: ATXN1; (+) strand; PAM type: NRG; PAM sequence: AAG
tacactcaaaaaaagaacca

SEQ ID NO: 149039 - DNA, 20 bp, Artificial Sequence
  Description of Artificial Sequence: Synthetic oligonucleotide
  Target: ATXN1; (+) strand; PAM type: NRG; PAM sequence: AGG
acactcaaaaaaagaaccaa

SEQ ID NO: 149040 - DNA, 20 bp, Artificial Sequence
  Description of Artificial Sequence: Synthetic oligonucleotide
  Target: ATXN1; (+) strand; PAM type: NRG; PAM sequence: CAG
ctcaaaaaaagaaccaaagg

SEQ ID NO: 149041 - DNA, 20 bp, Artificial Sequence
  Description of Artificial Sequence: Synthetic oligonucleotide
  Target: ATXN1; (+) strand; PAM type: NRG; PAM sequence: TGG
gaaccaaaggcagttttatt

SEQ ID NO: 149042 - DNA, 20 bp, Artificial Sequence
  Description of Artificial Sequence: Synthetic oligonucleotide
  Target: ATXN1; (+) strand; PAM type: NRG; PAM sequence: TGG
gacacctctgttaatcaaat

SEQ ID NO: 149043 - DNA, 20 bp, Artificial Sequence
  Description of Artificial Sequence: Synthetic oligonucleotide
  Target: ATXN1; (+) strand; PAM type: NRG; PAM sequence: AAG
acctctgttaatcaaattgg

SEQ ID NO: 149044 - DNA, 20 bp, Artificial Sequence
  Description of Artificial Sequence: Synthetic oligonucleotide
  Target: ATXN1; (+) strand; PAM type: NRG; PAM sequence: TAG
ctgttaatcaaattggaagc

SEQ ID NO: 149045 - DNA, 20 bp, Artificial Sequence
  Description of Artificial Sequence: Synthetic oligonucleotide
  Target: ATXN1; (+) strand; PAM type: NRG; PAM sequence: AGG
tgttaatcaaattggaagct

SEQ ID NO: 149046 - DNA, 20 bp, Artificial Sequence
  Description of Artificial Sequence: Synthetic oligonucleotide
  Target: ATXN1; (+) strand; PAM type: NRG; PAM sequence: GGG
gttaatcaaattggaagcta

SEQ ID NO: 149047 - DNA, 20 bp, Artificial Sequence
  Description of Artificial Sequence: Synthetic oligonucleotide
  Target: ATXN1; (+) strand; PAM type: NRG; PAM sequence: GGG
ttaatcaaattggaagctag

SEQ ID NO: 149048 - DNA, 20 bp, Artificial Sequence
  Description of Artificial Sequence: Synthetic oligonucleotide
  Target: ATXN1; (+) strand; PAM type: NRG; PAM sequence: GAG
aatcaaattggaagctaggg

SEQ ID NO: 149049 - DNA, 20 bp, Artificial Sequence
  Description of Artificial Sequence: Synthetic oligonucleotide
  Target: ATXN1; (+) strand; PAM type: NRG; PAM sequence: AGG
atcaaattggaagctagggg

SEQ ID NO: 149050 - DNA, 20 bp, Artificial Sequence
  Description of Artificial Sequence: Synthetic oligonucleotide
  Target: ATXN1; (+) strand; PAM type: NRG; PAM sequence: GGG
tcaaattggaagctagggga

SEQ ID NO: 149051 - DNA, 20 bp, Artificial Sequence
  Description of Artificial Sequence: Synthetic oligonucleotide
  Target: ATXN1; (+) strand; PAM type: NRG; PAM sequence: GAG
ggaagctaggggagggaact

SEQ ID NO: 149052 - DNA, 20 bp, Artificial Sequence
  Description of Artificial Sequence: Synthetic oligonucleotide
  Target: ATXN1; (+) strand; PAM type: NRG; PAM sequence: AAG
ctaggggagggaactgagta

SEQ ID NO: 149053 - DNA, 20 bp, Artificial Sequence
  Description of Artificial Sequence: Synthetic oligonucleotide
  Target: ATXN1; (+) strand; PAM type: NRG; PAM sequence: AGG
taggggagggaactgagtaa

SEQ ID NO: 149054 - DNA, 20 bp, Artificial Sequence
  Description of Artificial Sequence: Synthetic oligonucleotide
  Target: ATXN1; (+) strand; PAM type: NRG; PAM sequence: CAG
gggagggaactgagtaaagg

SEQ ID NO: 149055 - DNA, 20 bp, Artificial Sequence
  Description of Artificial Sequence: Synthetic oligonucleotide
  Target: ATXN1; (+) strand; PAM type: NRG; PAM sequence: AGG
ggagggaactgagtaaaggc

SEQ ID NO: 149056 - DNA, 20 bp, Artificial Sequence
  Description of Artificial Sequence: Synthetic oligonucleotide
  Target: ATXN1; (+) strand; PAM type: NRG; PAM sequence: GGG
gagggaactgagtaaaggca

SEQ ID NO: 149057 - DNA, 20 bp, Artificial Sequence
  Description of Artificial Sequence: Synthetic oligonucleotide
  Target: ATXN1; (+) strand; PAM type: NRG; PAM sequence: CAG
tttttcttttgccccttaat

SEQ ID NO: 149058 - DNA, 20 bp, Artificial Sequence
  Description of Artificial Sequence: Synthetic oligonucleotide
  Target: ATXN1; (+) strand; PAM type: NRG; PAM sequence: CAG
ttaatcagccaccttcaaaa

SEQ ID NO: 149059 - DNA, 20 bp, Artificial Sequence
  Description of Artificial Sequence: Synthetic oligonucleotide
  Target: ATXN1; (+) strand; PAM type: NRG; PAM sequence: TAG
ccttcaaaacagtgcctttc

SEQ ID NO: 149060 - DNA, 20 bp, Artificial Sequence
  Description of Artificial Sequence: Synthetic oligonucleotide
  Target: ATXN1; (+) strand; PAM type: NRG; PAM sequence: AGG
cttcaaaacagtgcctttct

SEQ ID NO: 149061 - DNA, 20 bp, Artificial Sequence
  Description of Artificial Sequence: Synthetic oligonucleotide
  Target: ATXN1; (+) strand; PAM type: NRG; PAM sequence: GGG
ttcaaaacagtgcctttcta

SEQ ID NO: 149062 - DNA, 20 bp, Artificial Sequence
  Description of Artificial Sequence: Synthetic oligonucleotide
  Target: ATXN1; (+) strand; PAM type: NRG; PAM sequence: TGG
tagggctaacgtcctgcctg

SEQ ID NO: 149063 - DNA, 20 bp, Artificial Sequence
  Description of Artificial Sequence: Synthetic oligonucleotide
  Target: ATXN1; (+) strand; PAM type: NRG; PAM sequence: CAG
atctcatcactgataaacat

SEQ ID NO: 149064 - DNA, 20 bp, Artificial Sequence
  Description of Artificial Sequence: Synthetic oligonucleotide
  Target: ATXN1; (+) strand; PAM type: NRG; PAM sequence: AGG
tctcatcactgataaacatc

SEQ ID NO: 149065 - DNA, 20 bp, Artificial Sequence
  Description of Artificial Sequence: Synthetic oligonucleotide
  Target: ATXN1; (+) strand; PAM type: NRG; PAM sequence: AAG
catcactgataaacatcagg

SEQ ID NO: 149066 - DNA, 20 bp, Artificial Sequence
  Description of Artificial Sequence: Synthetic oligonucleotide
  Target: ATXN1; (+) strand; PAM type: NRG; PAM sequence: TAG
taactgccattcgccattta

SEQ ID NO: 149067 - DNA, 20 bp, Artificial Sequence
  Description of Artificial Sequence: Synthetic oligonucleotide
  Target: ATXN1; (+) strand; PAM type: NRG; PAM sequence: TAG
atagatttatatgtacctgc

SEQ ID NO: 149068 - DNA, 20 bp, Artificial Sequence
  Description of Artificial Sequence: Synthetic oligonucleotide
  Target: ATXN1; (+) strand; PAM type: NRG; PAM sequence: AGG
tagatttatatgtacctgct

SEQ ID NO: 149069 - DNA, 20 bp, Artificial Sequence
  Description of Artificial Sequence: Synthetic oligonucleotide
  Target: ATXN1; (+) strand; PAM type: NRG; PAM sequence: GAG
tatgtacctgctaggataat

SEQ ID NO: 149070 - DNA, 20 bp, Artificial Sequence
  Description of Artificial Sequence: Synthetic oligonucleotide
  Target: ATXN1; (+) strand; PAM type: NRG; PAM sequence: TAG
tcacaatctgttcattccct

SEQ ID NO: 149071 - DNA, 20 bp, Artificial Sequence
  Description of Artificial Sequence: Synthetic oligonucleotide
  Target: ATXN1; (+) strand; PAM type: NRG; PAM sequence: TGG
aactgaatgaaactcacaaa

SEQ ID NO: 149072 - DNA, 20 bp, Artificial Sequence
  Description of Artificial Sequence: Synthetic oligonucleotide
  Target: ATXN1; (+) strand; PAM type: NRG; PAM sequence: GAG
tgaaactcacaaatggctac

SEQ ID NO: 149073 - DNA, 20 bp, Artificial Sequence
  Description of Artificial Sequence: Synthetic oligonucleotide
  Target: ATXN1; (+) strand; PAM type: NRG; PAM sequence: AGG
gaaactcacaaatggctacg

SEQ ID NO: 149074 - DNA, 20 bp, Artificial Sequence
  Description of Artificial Sequence: Synthetic oligonucleotide
  Target: ATXN1; (+) strand; PAM type: NRG; PAM sequence: GGG
aaactcacaaatggctacga

SEQ ID NO: 149075 - DNA, 20 bp, Artificial Sequence
  Description of Artificial Sequence: Synthetic oligonucleotide
  Target: ATXN1; (+) strand; PAM type: NRG; PAM sequence: GAG
actcacaaatggctacgagg

SEQ ID NO: 149076 - DNA, 20 bp, Artificial Sequence
  Description of Artificial Sequence: Synthetic oligonucleotide
  Target: ATXN1; (+) strand; PAM type: NRG; PAM sequence: TAG
atggctacgagggagtatcc

SEQ ID NO: 149077 - DNA, 20 bp, Artificial Sequence
  Description of Artificial Sequence: Synthetic oligonucleotide
  Target: ATXN1; (+) strand; PAM type: NRG; PAM sequence: AAG
gggagtatcctagttcactg

SEQ ID NO: 149078 - DNA, 20 bp, Artificial Sequence
  Description of Artificial Sequence: Synthetic oligonucleotide
  Target: ATXN1; (+) strand; PAM type: NRG; PAM sequence: AAG
atcctagttcactgaagccc

SEQ ID NO: 149079 - DNA, 20 bp, Artificial Sequence
  Description of Artificial Sequence: Synthetic oligonucleotide
  Target: ATXN1; (+) strand; PAM type: NRG; PAM sequence: TGG
tagttcactgaagcccaagc

SEQ ID NO: 149080 - DNA, 20 bp, Artificial Sequence
  Description of Artificial Sequence: Synthetic oligonucleotide
  Target: ATXN1; (+) strand; PAM type: NRG; PAM sequence: CAG
actgaagcccaagctggcct

SEQ ID NO: 149081 - DNA, 20 bp, Artificial Sequence
  Description of Artificial Sequence: Synthetic oligonucleotide
  Target: ATXN1; (+) strand; PAM type: NRG; PAM sequence: AGG
ctgaagcccaagctggcctc

SEQ ID NO: 149082 - DNA, 20 bp, Artificial Sequence
  Description of Artificial Sequence: Synthetic oligonucleotide
  Target: ATXN1; (+) strand; PAM type: NRG; PAM sequence: CAG
cccaagctggcctcaggaac

SEQ ID NO: 149083 - DNA, 20 bp, Artificial Sequence
  Description of Artificial Sequence: Synthetic oligonucleotide
  Target: ATXN1; (+) strand; PAM type: NRG; PAM sequence: GAG
caagctggcctcaggaacca

SEQ ID NO: 149084 - DNA, 20 bp, Artificial Sequence
  Description of Artificial Sequence: Synthetic oligonucleotide
  Target: ATXN1; (+) strand; PAM type: NRG; PAM sequence: CAG
gataacatttctcctttttc

SEQ ID NO: 149085 - DNA, 20 bp, Artificial Sequence
  Description of Artificial Sequence: Synthetic oligonucleotide
  Target: ATXN1; (+) strand; PAM type: NRG; PAM sequence: AAG
ctttttccagctgaattact

SEQ ID NO: 149086 - DNA, 20 bp, Artificial Sequence
  Description of Artificial Sequence: Synthetic oligonucleotide
  Target: ATXN1; (+) strand; PAM type: NRG; PAM sequence: AAG
tccagctgaattactaagac

SEQ ID NO: 149087 - DNA, 20 bp, Artificial Sequence
  Description of Artificial Sequence: Synthetic oligonucleotide
  Target: ATXN1; (+) strand; PAM type: NRG; PAM sequence: AAG
gctgaattactaagacaagc

SEQ ID NO: 149088 - DNA, 20 bp, Artificial Sequence
  Description of Artificial Sequence: Synthetic oligonucleotide
  Target: ATXN1; (+) strand; PAM type: NRG; PAM sequence: GAG
tgaattactaagacaagcaa

SEQ ID NO: 149089 - DNA, 20 bp, Artificial Sequence
  Description of Artificial Sequence: Synthetic oligonucleotide
  Target: ATXN1; (+) strand; PAM type: NRG; PAM sequence: AAG
agcaagagatgactcataat

SEQ ID NO: 149090 - DNA, 20 bp, Artificial Sequence
  Description of Artificial Sequence: Synthetic oligonucleotide
  Target: ATXN1; (+) strand; PAM type: NRG; PAM sequence: TAG
gagatgactcataataagca

SEQ ID NO: 149091 - DNA, 20 bp, Artificial Sequence
  Description of Artificial Sequence: Synthetic oligonucleotide
  Target: ATXN1; (+) strand; PAM type: NRG; PAM sequence: AAG
cataataagcatagttgatg

SEQ ID NO: 149092 - DNA, 20 bp, Artificial Sequence
  Description of Artificial Sequence: Synthetic oligonucleotide
  Target: ATXN1; (+) strand; PAM type: NRG; PAM sequence: GAG
aatgccaactcttcctctct

SEQ ID NO: 149093 - DNA, 20 bp, Artificial Sequence
  Description of Artificial Sequence: Synthetic oligonucleotide
  Target: ATXN1; (+) strand; PAM type: NRG; PAM sequence: CAG
cctctctgagtcatcccttc

SEQ ID NO: 149094 - DNA, 20 bp, Artificial Sequence
  Description of Artificial Sequence: Synthetic oligonucleotide
  Target: ATXN1; (+) strand; PAM type: NRG; PAM sequence: AAG
tgagtcatcccttccagtga

SEQ ID NO: 149095 - DNA, 20 bp, Artificial Sequence
  Description of Artificial Sequence: Synthetic oligonucleotide
  Target: ATXN1; (+) strand; PAM type: NRG; PAM sequence: TAG
ccttccagtgaaagaatcgc

SEQ ID NO: 149096 - DNA, 20 bp, Artificial Sequence
  Description of Artificial Sequence: Synthetic oligonucleotide
  Target: ATXN1; (+) strand; PAM type: NRG; PAM sequence: AGG
cttccagtgaaagaatcgct

SEQ ID NO: 149097 - DNA, 20 bp, Artificial Sequence
  Description of Artificial Sequence: Synthetic oligonucleotide
  Target: ATXN1; (+) strand; PAM type: NRG; PAM sequence: GAG
tccagtgaaagaatcgctag

SEQ ID NO: 149098 - DNA, 20 bp, Artificial Sequence
  Description of Artificial Sequence: Synthetic oligonucleotide
  Target: ATXN1; (+) strand; PAM type: NRG; PAM sequence: TGG
atcgctaggagtattaaccc

SEQ ID NO: 149099 - DNA, 20 bp, Artificial Sequence
  Description of Artificial Sequence: Synthetic oligonucleotide
  Target: ATXN1; (+) strand; PAM type: NRG; PAM sequence: AAG
agtattaaccctggctgaaa

SEQ ID NO: 149100 - DNA, 20 bp, Artificial Sequence
  Description of Artificial Sequence: Synthetic oligonucleotide
  Target: ATXN1; (+) strand; PAM type: NRG; PAM sequence: TAG
attaaccctggctgaaaaag

SEQ ID NO: 149101 - DNA, 20 bp, Artificial Sequence
  Description of Artificial Sequence: Synthetic oligonucleotide
  Target: ATXN1; (+) strand; PAM type: NRG; PAM sequence: GAG
tgaaaaagtagatgccatgt

SEQ ID NO: 149102 - DNA, 20 bp, Artificial Sequence
  Description of Artificial Sequence: Synthetic oligonucleotide
  Target: ATXN1; (+) strand; PAM type: NRG; PAM sequence: TGG
cattaaactttaccaaacaa

SEQ ID NO: 149103 - DNA, 20 bp, Artificial Sequence
  Description of Artificial Sequence: Synthetic oligonucleotide
  Target: ATXN1; (+) strand; PAM type: NRG; PAM sequence: GAG
ttaaactttaccaaacaatg

SEQ ID NO: 149104 - DNA, 20 bp, Artificial Sequence
  Description of Artificial Sequence: Synthetic oligonucleotide
  Target: ATXN1; (+) strand; PAM type: NRG; PAM sequence: TGG
aactttaccaaacaatggag

SEQ ID NO: 149105 - DNA, 20 bp, Artificial Sequence
  Description of Artificial Sequence: Synthetic oligonucleotide
  Target: ATXN1; (+) strand; PAM type: NRG; PAM sequence: AAG
ttaccaaacaatggagtggt

SEQ ID NO: 149106 - DNA, 20 bp, Artificial Sequence
  Description of Artificial Sequence: Synthetic oligonucleotide
  Target: ATXN1; (+) strand; PAM type: NRG; PAM sequence: AGG
taccaaacaatggagtggta

SEQ ID NO: 149107 - DNA, 20 bp, Artificial Sequence
  Description of Artificial Sequence: Synthetic oligonucleotide
  Target: ATXN1; (+) strand; PAM type: NRG; PAM sequence: GGG
accaaacaatggagtggtaa

SEQ ID NO: 149108 - DNA, 20 bp, Artificial Sequence
  Description of Artificial Sequence: Synthetic oligonucleotide
  Target: ATXN1; (+) strand; PAM type: NRG; PAM sequence: AAG
aaacaatggagtggtaaggg

SEQ ID NO: 149109 - DNA, 20 bp, Artificial Sequence
  Description of Artificial Sequence: Synthetic oligonucleotide
  Target: ATXN1; (+) strand; PAM type: NRG; PAM sequence: GAG
acaatggagtggtaagggaa

SEQ ID NO: 149110 - DNA, 20 bp, Artificial Sequence
  Description of Artificial Sequence: Synthetic oligonucleotide
  Target: ATXN1; (+) strand; PAM type: NRG; PAM sequence: TGG
tggagtggtaagggaagagt

SEQ ID NO: 149111 - DNA, 20 bp, Artificial Sequence
  Description of Artificial Sequence: Synthetic oligonucleotide
  Target: ATXN1; (+) strand; PAM type: NRG; PAM sequence: GAG
gagtggtaagggaagagttg

SEQ ID NO: 149112 - DNA, 20 bp, Artificial Sequence
  Description of Artificial Sequence: Synthetic oligonucleotide
  Target: ATXN1; (+) strand; PAM type: NRG; PAM sequence: AGG
agtggtaagggaagagttgg

SEQ ID NO: 149113 - DNA, 20 bp, Artificial Sequence
  Description of Artificial Sequence: Synthetic oligonucleotide
  Target: ATXN1; (+) strand; PAM type: NRG; PAM sequence: GGG
gtggtaagggaagagttgga

SEQ ID NO: 149114 - DNA, 20 bp, Artificial Sequence
  Description of Artificial Sequence: Synthetic oligonucleotide
  Target: ATXN1; (+) strand; PAM type: NRG; PAM sequence: TAG
ctgtccaaactatctgaatc

SEQ ID NO: 149115 - DNA, 20 bp, Artificial Sequence
  Description of Artificial Sequence: Synthetic oligonucleotide
  Target: ATXN1; (+) strand; PAM type: NRG; PAM sequence: GAG
gtccaaactatctgaatcta

SEQ ID NO: 149116 - DNA, 20 bp, Artificial Sequence
  Description of Artificial Sequence: Synthetic oligonucleotide
  Target: ATXN1; (+) strand; PAM type: NRG; PAM sequence: AGG
tccaaactatctgaatctag

SEQ ID NO: 149117 - DNA, 20 bp, Artificial Sequence
  Description of Artificial Sequence: Synthetic oligonucleotide
  Target: ATXN1; (+) strand; PAM type: NRG; PAM sequence: GGG
ccaaactatctgaatctaga

SEQ ID NO: 149118 - DNA, 20 bp, Artificial Sequence
  Description of Artificial Sequence: Synthetic oligonucleotide
  Target: ATXN1; (+) strand; PAM type: NRG; PAM sequence: AAG
agagggaccgctccatgaat

SEQ ID NO: 149119 - DNA, 20 bp, Artificial Sequence
  Description of Artificial Sequence: Synthetic oligonucleotide
  Target: ATXN1; (+) strand; PAM type: NRG; PAM sequence: CGG
aataagtttcaatacaattg

SEQ ID NO: 149120 - DNA, 20 bp, Artificial Sequence
  Description of Artificial Sequence: Synthetic oligonucleotide
  Target: ATXN1; (+) strand; PAM type: NRG; PAM sequence: CAG
ttcaatacaattgcggtaat

SEQ ID NO: 149121 - DNA, 20 bp, Artificial Sequence
  Description of Artificial Sequence: Synthetic oligonucleotide
  Target: ATXN1; (+) strand; PAM type: NRG; PAM sequence: TGG
ctatttcaatttacaaacgc

SEQ ID NO: 149122 - DNA, 20 bp, Artificial Sequence
  Description of Artificial Sequence: Synthetic oligonucleotide
  Target: ATXN1; (+) strand; PAM type: NRG; PAM sequence: GGG
tatttcaatttacaaacgct

SEQ ID NO: 149123 - DNA, 20 bp, Artificial Sequence
  Description of Artificial Sequence: Synthetic oligonucleotide
  Target: ATXN1; (+) strand; PAM type: NRG; PAM sequence: CAG
atttacaaacgctgggttta

SEQ ID NO: 149124 - DNA, 20 bp, Artificial Sequence
  Description of Artificial Sequence: Synthetic oligonucleotide
  Target: ATXN1; (+) strand; PAM type: NRG; PAM sequence: AGG
tttacaaacgctgggtttac

SEQ ID NO: 149125 - DNA, 20 bp, Artificial Sequence
  Description of Artificial Sequence: Synthetic oligonucleotide
  Target: ATXN1; (+) strand; PAM type: NRG; PAM sequence: TAG
aaacgctgggtttacaggaa

SEQ ID NO: 149126 - DNA, 20 bp, Artificial Sequence
  Description of Artificial Sequence: Synthetic oligonucleotide
  Target: ATXN1; (+) strand; PAM type: NRG; PAM sequence: GAG
gtttacaggaatagctttct

SEQ ID NO: 149127 - DNA, 20 bp, Artificial Sequence
  Description of Artificial Sequence: Synthetic oligonucleotide
  Target: ATXN1; (+) strand; PAM type: NRG; PAM sequence: TAG
ctgagacattcctataaaat

SEQ ID NO: 149128 - DNA, 20 bp, Artificial Sequence
  Description of Artificial Sequence: Synthetic oligonucleotide
  Target: ATXN1; (+) strand; PAM type: NRG; PAM sequence: AAG
ttactcactgaatttttaaa

SEQ ID NO: 149129 - DNA, 20 bp, Artificial Sequence
  Description of Artificial Sequence: Synthetic oligonucleotide
  Target: ATXN1; (+) strand; PAM type: NRG; PAM sequence: AGG
tactcactgaatttttaaaa

SEQ ID NO: 149130 - DNA, 20 bp, Artificial Sequence
  Description of Artificial Sequence: Synthetic oligonucleotide
  Target: ATXN1; (+) strand; PAM type: NRG; PAM sequence: GAG
ctcactgaatttttaaaaag

SEQ ID NO: 149131 - DNA, 20 bp, Artificial Sequence
  Description of Artificial Sequence: Synthetic oligonucleotide
  Target: ATXN1; (+) strand; PAM type: NRG; PAM sequence: AAG
aatttttaaaaaggagaaca

SEQ ID NO: 149132 - DNA, 20 bp, Artificial Sequence
  Description of Artificial Sequence: Synthetic oligonucleotide
  Target: ATXN1; (+) strand; PAM type: NRG; PAM sequence: AAG
taaaaaggagaacaaagcca

SEQ ID NO: 149133 - DNA, 20 bp, Artificial Sequence
  Description of Artificial Sequence: Synthetic oligonucleotide
  Target: ATXN1; (+) strand; PAM type: NRG; PAM sequence: AGG
aaaaaggagaacaaagccaa

SEQ ID NO: 149134 - DNA, 20 bp, Artificial Sequence
  Description of Artificial Sequence: Synthetic oligonucleotide
  Target: ATXN1; (+) strand; PAM type: NRG; PAM sequence: TGG
acaaagccaaaggacgccat

SEQ ID NO: 149135 - DNA, 20 bp, Artificial Sequence
  Description of Artificial Sequence: Synthetic oligonucleotide
  Target: ATXN1; (+) strand; PAM type: NRG; PAM sequence: TGG
caaaggacgccattggcctc

SEQ ID NO: 149136 - DNA, 20 bp, Artificial Sequence
  Description of Artificial Sequence: Synthetic oligonucleotide
  Target: ATXN1; (+) strand; PAM type: NRG; PAM sequence: GGG
aaaggacgccattggcctct

SEQ ID NO: 149137 - DNA, 20 bp, Artificial Sequence
  Description of Artificial Sequence: Synthetic oligonucleotide
  Target: ATXN1; (+) strand; PAM type: NRG; PAM sequence: GGG
aaggacgccattggcctctg

SEQ ID NO: 149138 - DNA, 20 bp, Artificial Sequence
  Description of Artificial Sequence: Synthetic oligonucleotide
  Target: ATXN1; (+) strand; PAM type: NRG; PAM sequence: GGG
aggacgccattggcctctgg

SEQ ID NO: 149139 - DNA, 20 bp, Artificial Sequence
  Description of Artificial Sequence: Synthetic oligonucleotide
  Target: ATXN1; (+) strand; PAM type: NRG; PAM sequence: AAG
gggggcgtatgtgtgtgaac

SEQ ID NO: 149140 - DNA, 20 bp, Artificial Sequence
  Description of Artificial Sequence: Synthetic oligonucleotide
  Target: ATXN1; (+) strand; PAM type: NRG; PAM sequence: TAG
gtgaacaagctgatgctgtg

SEQ ID NO: 149141 - DNA, 20 bp, Artificial Sequence
  Description of Artificial Sequence: Synthetic oligonucleotide
  Target: ATXN1; (+) strand; PAM type: NRG; PAM sequence: TGG
aatgatgtgtcaatatcatt

SEQ ID NO: 149142 - DNA, 20 bp, Artificial Sequence
  Description of Artificial Sequence: Synthetic oligonucleotide
  Target: ATXN1; (+) strand; PAM type: NRG; PAM sequence: GGG
atgatgtgtcaatatcattt

SEQ ID NO: 149143 - DNA, 20 bp, Artificial Sequence
  Description of Artificial Sequence: Synthetic oligonucleotide
  Target: ATXN1; (+) strand; PAM type: NRG; PAM sequence: AAG
gtgtgaaaactgctcaatcc

SEQ ID NO: 149144 - DNA, 20 bp, Artificial Sequence
  Description of Artificial Sequence: Synthetic oligonucleotide
  Target: ATXN1; (+) strand; PAM type: NRG; PAM sequence: GAG
gtgaaaactgctcaatccaa

SEQ ID NO: 149145 - DNA, 20 bp, Artificial Sequence
  Description of Artificial Sequence: Synthetic oligonucleotide
  Target: ATXN1; (+) strand; PAM type: NRG; PAM sequence: AAG
gtttctactgactgaacatg

SEQ ID NO: 149146 - DNA, 20 bp, Artificial Sequence
  Description of Artificial Sequence: Synthetic oligonucleotide
  Target: ATXN1; (+) strand; PAM type: NRG; PAM sequence: GAG
ttctactgactgaacatgaa

SEQ ID NO: 149147 - DNA, 20 bp, Artificial Sequence
  Description of Artificial Sequence: Synthetic oligonucleotide
  Target: ATXN1; (+) strand; PAM type: NRG; PAM sequence: GAG
ctactgactgaacatgaaga

SEQ ID NO: 149148 - DNA, 20 bp, Artificial Sequence
  Description of Artificial Sequence: Synthetic oligonucleotide
  Target: ATXN1; (+) strand; PAM type: NRG; PAM sequence: CAG
gaagagagaaccaaatattc

SEQ ID NO: 149149 - DNA, 20 bp, Artificial Sequence
  Description of Artificial Sequence: Synthetic oligonucleotide
  Target: ATXN1; (+) strand; PAM type: NRG; PAM sequence: CAG
agagaaccaaatattccaga

SEQ ID NO: 149150 - DNA, 20 bp, Artificial Sequence
  Description of Artificial Sequence: Synthetic oligonucleotide
  Target: ATXN1; (+) strand; PAM type: NRG; PAM sequence: AGG
gagaaccaaatattccagac

SEQ ID NO: 149151 - DNA, 20 bp, Artificial Sequence
  Description of Artificial Sequence: Synthetic oligonucleotide
  Target: ATXN1; (+) strand; PAM type: NRG; PAM sequence: GGG
agaaccaaatattccagaca

SEQ ID NO: 149152 - DNA, 20 bp, Artificial Sequence
  Description of Artificial Sequence: Synthetic oligonucleotide
  Target: ATXN1; (+) strand; PAM type: NRG; PAM sequence: AAG
ccaaatattccagacaggga

SEQ ID NO: 149153 - DNA, 20 bp, Artificial Sequence
  Description of Artificial Sequence: Synthetic oligonucleotide
  Target: ATXN1; (+) strand; PAM type: NRG; PAM sequence: GAG
tccagacagggaaagaatct

SEQ ID NO: 149154 - DNA, 20 bp, Artificial Sequence
  Description of Artificial Sequence: Synthetic oligonucleotide
  Target: ATXN1; (+) strand; PAM type: NRG; PAM sequence: TAG
ggaaagaatctgagaaaaca

SEQ ID NO: 149155 - DNA, 20 bp, Artificial Sequence
  Description of Artificial Sequence: Synthetic oligonucleotide
  Target: ATXN1; (+) strand; PAM type: NRG; PAM sequence: GAG
aaagaatctgagaaaacata

SEQ ID NO: 149156 - DNA, 20 bp, Artificial Sequence
  Description of Artificial Sequence: Synthetic oligonucleotide
  Target: ATXN1; (+) strand; PAM type: NRG; PAM sequence: TGG
gaatctgagaaaacatagag

SEQ ID NO: 149157 - DNA, 20 bp, Artificial Sequence
  Description of Artificial Sequence: Synthetic oligonucleotide
  Target: ATXN1; (+) strand; PAM type: NRG; PAM sequence: GAG
atctgagaaaacatagagtg

SEQ ID NO: 149158 - DNA, 20 bp, Artificial Sequence
  Description of Artificial Sequence: Synthetic oligonucleotide
  Target: ATXN1; (+) strand; PAM type: NRG; PAM sequence: CAG
aacatagagtggagtgattt

SEQ ID NO: 149159 - DNA, 20 bp, Artificial Sequence
  Description of Artificial Sequence: Synthetic oligonucleotide
  Target: ATXN1; (+) strand; PAM type: NRG; PAM sequence: AAG
gatttcagtgtgtgtatatg

SEQ ID NO: 149160 - DNA, 20 bp, Artificial Sequence
  Description of Artificial Sequence: Synthetic oligonucleotide
  Target: ATXN1; (+) strand; PAM type: NRG; PAM sequence: AAG
ttcagtgtgtgtatatgaag

SEQ ID NO: 149161 - DNA, 20 bp, Artificial Sequence
  Description of Artificial Sequence: Synthetic oligonucleotide
  Target: ATXN1; (+) strand; PAM type: NRG; PAM sequence: AGG
tcagtgtgtgtatatgaaga

SEQ ID NO: 149162 - DNA, 20 bp, Artificial Sequence
  Description of Artificial Sequence: Synthetic oligonucleotide
  Target: ATXN1; (+) strand; PAM type: NRG; PAM sequence: GGG
cagtgtgtgtatatgaagaa

SEQ ID NO: 149163 - DNA, 20 bp, Artificial Sequence
  Description of Artificial Sequence: Synthetic oligonucleotide
  Target: ATXN1; (+) strand; PAM type: NRG; PAM sequence: GGG
agtgtgtgtatatgaagaag

SEQ ID NO: 149164 - DNA, 20 bp, Artificial Sequence
  Description of Artificial Sequence: Synthetic oligonucleotide
  Target: ATXN1; (+) strand; PAM type: NRG; PAM sequence: GGG
gtgtgtgtatatgaagaagg

SEQ ID NO: 149165 - DNA, 20 bp, Artificial Sequence
  Description of Artificial Sequence: Synthetic oligonucleotide
  Target: ATXN1; (+) strand; PAM type: NRG; PAM sequence: GAG
gtgtgtatatgaagaagggg

SEQ ID NO: 149166 - DNA, 20 bp, Artificial Sequence
  Description of Artificial Sequence: Synthetic oligonucleotide
  Target: ATXN1; (+) strand; PAM type: NRG; PAM sequence: TGG
gagcaaatataaaatccaac

SEQ ID NO: 149167 - DNA, 20 bp, Artificial Sequence
  Description of Artificial Sequence: Synthetic oligonucleotide
  Target: ATXN1; (+) strand; PAM type: NRG; PAM sequence: CAG
gatgcttttcatcctccatg

SEQ ID NO: 149168 - DNA, 20 bp, Artificial Sequence
  Description of Artificial Sequence: Synthetic oligonucleotide
  Target: ATXN1; (+) strand; PAM type: NRG; PAM sequence: AAG
cgcttactacccctcactta

SEQ ID NO: 149169 - DNA, 20 bp, Artificial Sequence
  Description of Artificial Sequence: Synthetic oligonucleotide
  Target: ATXN1; (+) strand; PAM type: NRG; PAM sequence: TGG
actacccctcacttaaagtg

SEQ ID NO: 149170 - DNA, 20 bp, Artificial Sequence
  Description of Artificial Sequence: Synthetic oligonucleotide
  Target: ATXN1; (+) strand; PAM type: NRG; PAM sequence: TGG
cctcacttaaagtgtggtcc

SEQ ID NO: 149171 - DNA, 20 bp, Artificial Sequence
  Description of Artificial Sequence: Synthetic oligonucleotide
  Target: ATXN1; (+) strand; PAM type: NRG; PAM sequence: GGG
ctcacttaaagtgtggtcct

SEQ ID NO: 149172 - DNA, 20 bp, Artificial Sequence
  Description of Artificial Sequence: Synthetic oligonucleotide
  Target: ATXN1; (+) strand; PAM type: NRG; PAM sequence: GGG
tcacttaaagtgtggtcctg

SEQ ID NO: 149173 - DNA, 20 bp, Artificial Sequence
  Description of Artificial Sequence: Synthetic oligonucleotide
  Target: ATXN1; (+) strand; PAM type: NRG; PAM sequence: CAG
ttaaagtgtggtcctggggc

SEQ ID NO: 149174 - DNA, 20 bp, Artificial Sequence
  Description of Artificial Sequence: Synthetic oligonucleotide
  Target: ATXN1; (+) strand; PAM type: NRG; PAM sequence: CAG
aagtgtggtcctggggccag

SEQ ID NO: 149175 - DNA, 20 bp, Artificial Sequence
  Description of Artificial Sequence: Synthetic oligonucleotide
  Target: ATXN1; (+) strand; PAM type: NRG; PAM sequence: CAG
ggtcctggggccagcagcat

SEQ ID NO: 149176 - DNA, 20 bp, Artificial Sequence
  Description of Artificial Sequence: Synthetic oligonucleotide
  Target: ATXN1; (+) strand; PAM type: NRG; PAM sequence: CGG
ggccagcagcatcagtttca

SEQ ID NO: 149177 - DNA, 20 bp, Artificial Sequence
  Description of Artificial Sequence: Synthetic oligonucleotide
  Target: ATXN1; (+) strand; PAM type: NRG; PAM sequence: GAG
ccagcagcatcagtttcacg

SEQ ID NO: 149178 - DNA, 20 bp, Artificial Sequence
  Description of Artificial Sequence: Synthetic oligonucleotide
  Target: ATXN1; (+) strand; PAM type: NRG; PAM sequence: AGG
cagcagcatcagtttcacgg

SEQ ID NO: 149179 - DNA, 20 bp, Artificial Sequence
  Description of Artificial Sequence: Synthetic oligonucleotide
  Target: ATXN1; (+) strand; PAM type: NRG; PAM sequence: GGG
agcagcatcagtttcacgga

SEQ ID NO: 149180 - DNA, 20 bp, Artificial Sequence
  Description of Artificial Sequence: Synthetic oligonucleotide
  Target: ATXN1; (+) strand; PAM type: NRG; PAM sequence: CAG
agtttcacggagggatttgt

SEQ ID NO: 149181 - DNA, 20 bp, Artificial Sequence
  Description of Artificial Sequence: Synthetic oligonucleotide
  Target: ATXN1; (+) strand; PAM type: NRG; PAM sequence: CAG
ttgtcagaaatacatattct

SEQ ID NO: 149182 - DNA, 20 bp, Artificial Sequence
  Description of Artificial Sequence: Synthetic oligonucleotide
  Target: ATXN1; (+) strand; PAM type: NRG; PAM sequence: AGG
tgtcagaaatacatattctc

SEQ ID NO: 149183 - DNA, 20 bp, Artificial Sequence
  Description of Artificial Sequence: Synthetic oligonucleotide
  Target: ATXN1; (+) strand; PAM type: NRG; PAM sequence: TAG
catattctcaggctccaccc

SEQ ID NO: 149184 - DNA, 20 bp, Artificial Sequence
  Description of Artificial Sequence: Synthetic oligonucleotide
  Target: ATXN1; (+) strand; PAM type: NRG; PAM sequence: CAG
ccaccctagaactattaaat

SEQ ID NO: 149185 - DNA, 20 bp, Artificial Sequence
  Description of Artificial Sequence: Synthetic oligonucleotide
  Target: ATXN1; (+) strand; PAM type: NRG; PAM sequence: TGG
aactattaaatcagaacccc

SEQ ID NO: 149186 - DNA, 20 bp, Artificial Sequence
  Description of Artificial Sequence: Synthetic oligonucleotide
  Target: ATXN1; (+) strand; PAM type: NRG; PAM sequence: GGG
actattaaatcagaacccct

SEQ ID NO: 149187 - DNA, 20 bp, Artificial Sequence
  Description of Artificial Sequence: Synthetic oligonucleotide
  Target: ATXN1; (+) strand; PAM type: NRG; PAM sequence: TGG
taaatcagaacccctgggcc

SEQ ID NO: 149188 - DNA, 20 bp, Artificial Sequence
  Description of Artificial Sequence: Synthetic oligonucleotide
  Target: ATXN1; (+) strand; PAM type: NRG; PAM sequence: CAG
gaacccctgggcctggcgcc

SEQ ID NO: 149189 - DNA, 20 bp, Artificial Sequence
  Description of Artificial Sequence: Synthetic oligonucleotide
  Target: ATXN1; (+) strand; PAM type: NRG; PAM sequence: TGG
gcctggcgcccagaaatctg

SEQ ID NO: 149190 - DNA, 20 bp, Artificial Sequence
  Description of Artificial Sequence: Synthetic oligonucleotide
  Target: ATXN1; (+) strand; PAM type: NRG; PAM sequence: AAG
cagaaatctgtggtctaaac

SEQ ID NO: 149191 - DNA, 20 bp, Artificial Sequence
  Description of Artificial Sequence: Synthetic oligonucleotide
  Target: ATXN1; (+) strand; PAM type: NRG; PAM sequence: CAG
tgtggtctaaacaagccttc

SEQ ID NO: 149192 - DNA, 20 bp, Artificial Sequence
  Description of Artificial Sequence: Synthetic oligonucleotide
  Target: ATXN1; (+) strand; PAM type: NRG; PAM sequence: AGG
gtggtctaaacaagccttcc

SEQ ID NO: 149193 - DNA, 20 bp, Artificial Sequence
  Description of Artificial Sequence: Synthetic oligonucleotide
  Target: ATXN1; (+) strand; PAM type: NRG; PAM sequence: TGG
tgtaatcgtcaaatcttaac

SEQ ID NO: 149194 - DNA, 20 bp, Artificial Sequence
  Description of Artificial Sequence: Synthetic oligonucleotide
  Target: ATXN1; (+) strand; PAM type: NRG; PAM sequence: TGG
gtcaaatcttaactggtccc

SEQ ID NO: 149195 - DNA, 20 bp, Artificial Sequence
  Description of Artificial Sequence: Synthetic oligonucleotide
  Target: ATXN1; (+) strand; PAM type: NRG; PAM sequence: TAG
aactggtccctggccgcgcg

SEQ ID NO: 149196 - DNA, 20 bp, Artificial Sequence
  Description of Artificial Sequence: Synthetic oligonucleotide
  Target: ATXN1; (+) strand; PAM type: NRG; PAM sequence: CAG
gtaactcatgcctataatcc

SEQ ID NO: 149197 - DNA, 20 bp, Artificial Sequence
  Description of Artificial Sequence: Synthetic oligonucleotide
  Target: ATXN1; (+) strand; PAM type: NRG; PAM sequence: TGG
tgcctataatcccagtactt

SEQ ID NO: 149198 - DNA, 20 bp, Artificial Sequence
  Description of Artificial Sequence: Synthetic oligonucleotide
  Target: ATXN1; (+) strand; PAM type: NRG; PAM sequence: GGG
gcctataatcccagtacttt

SEQ ID NO: 149199 - DNA, 20 bp, Artificial Sequence
  Description of Artificial Sequence: Synthetic oligonucleotide
  Target: ATXN1; (+) strand; PAM type: NRG; PAM sequence: GAG
ctataatcccagtactttgg

SEQ ID NO: 149200 - DNA, 20 bp, Artificial Sequence
  Description of Artificial Sequence: Synthetic oligonucleotide
  Target: ATXN1; (+) strand; PAM type: NRG; PAM sequence: AGG
tataatcccagtactttggg

SEQ ID NO: 149201 - DNA, 20 bp, Artificial Sequence
  Description of Artificial Sequence: Synthetic oligonucleotide
  Target: ATXN1; (+) strand; PAM type: NRG; PAM sequence: AAG
cccagtactttgggaggcca

SEQ ID NO: 149202 - DNA, 20 bp, Artificial Sequence
  Description of Artificial Sequence: Synthetic oligonucleotide
  Target: ATXN1; (+) strand; PAM type: NRG; PAM sequence: CGG
agtactttgggaggccaaag

SEQ ID NO: 149203 - DNA, 20 bp, Artificial Sequence
  Description of Artificial Sequence: Synthetic oligonucleotide
  Target: ATXN1; (+) strand; PAM type: NRG; PAM sequence: GGG
gtactttgggaggccaaagc

SEQ ID NO: 149204 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccaaagcggg

SEQ ID NO: 149205 - DNA, 20 bp, Artificial Sequence
  Description of Artificial Sequence: Synthetic oligonucleotide
  Target: ATXN1; (+) strand; PAM type: NRG; PAM sequence: GAG
ccaaagcgggtggatcacat

SEQ ID NO: 149206 - DNA, 20 bp, Artificial Sequence
  Description of Artificial Sequence: Synthetic oligonucleotide
  Target: ATXN1; (+) strand; PAM type: NRG; PAM sequence: AGG
caaagcgggtggatcacatg

SEQ ID NO: 149207 - DNA, 20 bp, Artificial Sequence
  Description of Artificial Sequence: Synthetic oligonucleotide
  Target: ATXN1; (+) strand; PAM type: NRG; PAM sequence: CAG
gcgggtggatcacatgaggc

SEQ ID NO: 149208 - DNA, 20 bp, Artificial Sequence
  Description of Artificial Sequence: Synthetic oligonucleotide
  Target: ATXN1; (+) strand; PAM type: NRG; PAM sequence: AAG
ggtggatcacatgaggccag

SEQ ID NO: 149209 - DNA, 20 bp, Artificial Sequence
  Description of Artificial Sequence: Synthetic oligonucleotide
  Target: ATXN1; (+) strand; PAM type: NRG; PAM sequence: GAG
tcacatgaggccagaagttt

SEQ ID NO: 149210 - DNA, 20 bp, Artificial Sequence
  Description of Artificial Sequence: Synthetic oligonucleotide
  Target: ATXN1; (+) strand; PAM type: NRG; PAM sequence: CAG
tgaggccagaagtttgagac

SEQ ID NO: 149211 - DNA, 20 bp, Artificial Sequence
  Description of Artificial Sequence: Synthetic oligonucleotide
  Target: ATXN1; (+) strand; PAM type: NRG; PAM sequence: TGG
ccagaagtttgagaccagcc

SEQ ID NO: 149212 - DNA, 20 bp, Artificial Sequence
  Description of Artificial Sequence: Synthetic oligonucleotide
  Target: ATXN1; (+) strand; PAM type: NRG; PAM sequence: TAG
ctttataaaaatacaaaaat

SEQ ID NO: 149213 - DNA, 20 bp, Artificial Sequence
  Description of Artificial Sequence: Synthetic oligonucleotide
  Target: ATXN1; (+) strand; PAM type: NRG; PAM sequence: CAG
ataaaaatacaaaaattagc

SEQ ID NO: 149214 - DNA, 20 bp, Artificial Sequence
  Description of Artificial Sequence: Synthetic oligonucleotide
  Target: ATXN1; (+) strand; PAM type: NRG; PAM sequence: AGG
taaaaatacaaaaattagcc

SEQ ID NO: 149215 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagccaggcg

SEQ ID NO: 149216 - DNA, 20 bp, Artificial Sequence
  Description of Artificial Sequence: Synthetic oligonucleotide
  Target: ATXN1; (+) strand; PAM type: NRG; PAM sequence: TGG
caaaaattagccaggcgtgg

SEQ ID NO: 149217 - DNA, 20 bp, Artificial Sequence
  Description of Artificial Sequence: Synthetic oligonucleotide
  Target: ATXN1; (+) strand; PAM type: NRG; PAM sequence: TAG
ggcgtggtggtgtgcacctc

SEQ ID NO: 149218 - DNA, 20 bp, Artificial Sequence
  Description of Artificial Sequence: Synthetic oligonucleotide
  Target: ATXN1; (+) strand; PAM type: NRG; PAM sequence: CAG
gtggtgtgcacctctagtcc

SEQ ID NO: 149219 - DNA, 20 bp, Artificial Sequence
  Description of Artificial Sequence: Synthetic oligonucleotide
  Target: ATXN1; (+) strand; PAM type: NRG; PAM sequence: TGG
cacctctagtcccagctact

SEQ ID NO: 149220 - DNA, 20 bp, Artificial Sequence
  Description of Artificial Sequence: Synthetic oligonucleotide
  Target: ATXN1; (+) strand; PAM type: NRG; PAM sequence: GGG
acctctagtcccagctactt

SEQ ID NO: 149221 - DNA, 20 bp, Artificial Sequence
  Description of Artificial Sequence: Synthetic oligonucleotide
  Target: ATXN1; (+) strand; PAM type: NRG; PAM sequence: GAG
ctctagtcccagctacttgg

SEQ ID NO: 149222 - DNA, 20 bp, Artificial Sequence
  Description of Artificial Sequence: Synthetic oligonucleotide
  Target: ATXN1; (+) strand; PAM type: NRG; PAM sequence: AGG
tctagtcccagctacttggg

SEQ ID NO: 149223 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggtt

SEQ ID NO: 149224 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggttg

SEQ ID NO: 149225 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggttgagg

SEQ ID NO: 149226 - DNA, 20 bp, Artificial Sequence
  Description of Artificial Sequence: Synthetic oligonucleotide
  Target: ATXN1; (+) strand; PAM type: NRG; PAM sequence: GAG
ctacttgggaggttgaggca

SEQ ID NO: 149227 - DNA, 20 bp, Artificial Sequence
  Description of Artificial Sequence: Synthetic oligonucleotide
  Target: ATXN1; (+) strand; PAM type: NRG; PAM sequence: CAG
ggcagagaatcacttgaacc

SEQ ID NO: 149228 - DNA, 20 bp, Artificial Sequence
  Description of Artificial Sequence: Synthetic oligonucleotide
  Target: ATXN1; (+) strand; PAM type: NRG; PAM sequence: AGG
gcagagaatcacttgaaccc

SEQ ID NO: 149229 - DNA, 20 bp, Artificial Sequence
  Description of Artificial Sequence: Synthetic oligonucleotide
  Target: ATXN1; (+) strand; PAM type: NRG; PAM sequence: GAG
agagaatcacttgaacccag

SEQ ID NO: 149230 - DNA, 20 bp, Artificial Sequence
  Description of Artificial Sequence: Synthetic oligonucleotide
  Target: ATXN1; (+) strand; PAM type: NRG; PAM sequence: AGG
gagaatcacttgaacccagg

SEQ ID NO: 149231 - DNA, 20 bp, Artificial Sequence
  Description of Artificial Sequence: Synthetic oligonucleotide
  Target: ATXN1; (+) strand; PAM type: NRG; PAM sequence: CGG
aatcacttgaacccaggagg

SEQ ID NO: 149232 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacccaggaggcg

SEQ ID NO: 149233 - DNA, 20 bp, Artificial Sequence
  Description of Artificial Sequence: Synthetic oligonucleotide
  Target: ATXN1; (+) strand; PAM type: NRG; PAM sequence: AGG
cacttgaacccaggaggcgg

SEQ ID NO: 149234 - DNA, 20 bp, Artificial Sequence
  Description of Artificial Sequence: Synthetic oligonucleotide
  Target: ATXN1; (+) strand; PAM type: NRG; PAM sequence: CAG
aacccaggaggcggaggttg

SEQ ID NO: 149235 - DNA, 20 bp, Artificial Sequence
  Description of Artificial Sequence: Synthetic oligonucleotide
  Target: ATXN1; (+) strand; PAM type: NRG; PAM sequence: GAG
caggaggcggaggttgcagt

SEQ ID NO: 149236 - DNA, 20 bp, Artificial Sequence
  Description of Artificial Sequence: Synthetic oligonucleotide
  Target: ATXN1; (+) strand; PAM type: NRG; PAM sequence: AAG
ggcggaggttgcagtgagcc

SEQ ID NO: 149237 - DNA, 20 bp, Artificial Sequence
  Description of Artificial Sequence: Synthetic oligonucleotide
  Target: ATXN1; (+) strand; PAM type: NRG; PAM sequence: CAG
aagatcacaccactccatgc

SEQ ID NO: 149238 - DNA, 20 bp, Artificial Sequence
  Description of Artificial Sequence: Synthetic oligonucleotide
  Target: ATXN1; (+) strand; PAM type: NRG; PAM sequence: TGG
cacaccactccatgccagcc

SEQ ID NO: 149239 - DNA, 20 bp, Artificial Sequence
  Description of Artificial Sequence: Synthetic oligonucleotide
  Target: ATXN1; (+) strand; PAM type: NRG; PAM sequence: GGG
acaccactccatgccagcct

SEQ ID NO: 149240 - DNA, 20 bp, Artificial Sequence
  Description of Artificial Sequence: Synthetic oligonucleotide
  Target: ATXN1; (+) strand; PAM type: NRG; PAM sequence: CAG
ctccatgccagcctgggcga

SEQ ID NO: 149241 - DNA, 20 bp, Artificial Sequence
  Description of Artificial Sequence: Synthetic oligonucleotide
  Target: ATXN1; (+) strand; PAM type: NRG; PAM sequence: GAG
ccatgccagcctgggcgaca

SEQ ID NO: 149242 - DNA, 20 bp, Artificial Sequence
  Description of Artificial Sequence: Synthetic oligonucleotide
  Target: ATXN1; (+) strand; PAM type: NRG; PAM sequence: AAG
gccagcctgggcgacagagt

SEQ ID NO: 149243 - DNA, 20 bp, Artificial Sequence
  Description of Artificial Sequence: Synthetic oligonucleotide
  Target: ATXN1; (+) strand; PAM type: NRG; PAM sequence: TAG
tgggcgacagagtaagactg

SEQ ID NO: 149244 - DNA, 20 bp, Artificial Sequence
  Description of Artificial Sequence: Synthetic oligonucleotide
  Target: ATXN1; (+) strand; PAM type: NRG; PAM sequence: AAG
agagtaagactgtagaaaaa

SEQ ID NO: 149245 - DNA, 20 bp, Artificial Sequence
  Description of Artificial Sequence: Synthetic oligonucleotide
  Target: ATXN1; (+) strand; PAM type: NRG; PAM sequence: AAG
taagactgtagaaaaaaaga

SEQ ID NO: 149246 - DNA, 20 bp, Artificial Sequence
  Description of Artificial Sequence: Synthetic oligonucleotide
  Target: ATXN1; (+) strand; PAM type: NRG; PAM sequence: TGG
cacacacacacaccaaaacc

SEQ ID NO: 149247 - DNA, 20 bp, Artificial Sequence
  Description of Artificial Sequence: Synthetic oligonucleotide
  Target: ATXN1; (+) strand; PAM type: NRG; PAM sequence: CGG
cctcactcccacccaccttt

SEQ ID NO: 149248 - DNA, 20 bp, Artificial Sequence
  Description of Artificial Sequence: Synthetic oligonucleotide
  Target: ATXN1; (+) strand; PAM type: NRG; PAM sequence: GAG
tcactcccacccacctttcg

SEQ ID NO: 149249 - DNA, 20 bp, Artificial Sequence
  Description of Artificial Sequence: Synthetic oligonucleotide
  Target: ATXN1; (+) strand; PAM type: NRG; PAM sequence: AGG
cactcccacccacctttcgg

SEQ ID NO: 149250 - DNA, 20 bp, Artificial Sequence
  Description of Artificial Sequence: Synthetic oligonucleotide
  Target: ATXN1; (+) strand; PAM type: NRG; PAM sequence: TAG
tcccacccacctttcggagg

SEQ ID NO: 149251 - DNA, 20 bp, Artificial Sequence
  Description of Artificial Sequence: Synthetic oligonucleotide
  Target: ATXN1; (+) strand; PAM type: NRG; PAM sequence: AGG
cccacccacctttcggaggt

SEQ ID NO: 149252 - DNA, 20 bp, Artificial Sequence
  Description of Artificial Sequence: Synthetic oligonucleotide
  Target: ATXN1; (+) strand; PAM type: NRG; PAM sequence: TAG
ggaggtaggccgcccatcac

SEQ ID NO: 149253 - DNA, 20 bp, Artificial Sequence
  Description of Artificial Sequence: Synthetic oligonucleotide
  Target: ATXN1; (+) strand; PAM type: NRG; PAM sequence: TAG
aggccgcccatcactagatt

SEQ ID NO: 149254 - DNA, 20 bp, Artificial Sequence
  Description of Artificial Sequence: Synthetic oligonucleotide
  Target: ATXN1; (+) strand; PAM type: NRG; PAM sequence: CAG
ccgcccatcactagatttag

SEQ ID NO: 149255 - DNA, 20 bp, Artificial Sequence
  Description of Artificial Sequence: Synthetic oligonucleotide
  Target: ATXN1; (+) strand; PAM type: NRG; PAM sequence: GAG
gcccatcactagatttagca

SEQ ID NO: 149256 - DNA, 20 bp, Artificial Sequence
  Description of Artificial Sequence: Synthetic oligonucleotide
  Target: ATXN1; (+) strand; PAM type: NRG; PAM sequence: GAG
gagcatccgctgactgaaat

SEQ ID NO: 149257 - DNA, 20 bp, Artificial Sequence
  Description of Artificial Sequence: Synthetic oligonucleotide
  Target: ATXN1; (+) strand; PAM type: NRG; PAM sequence: CAG
ccgctgactgaaatgagaca

SEQ ID NO: 149258 - DNA, 20 bp, Artificial Sequence
  Description of Artificial Sequence: Synthetic oligonucleotide
  Target: ATXN1; (+) strand; PAM type: NRG; PAM sequence: TGG
tgactgaaatgagacacagc

SEQ ID NO: 149259 - DNA, 20 bp, Artificial Sequence
  Description of Artificial Sequence: Synthetic oligonucleotide
  Target: ATXN1; (+) strand; PAM type: NRG; PAM sequence: GGG
gactgaaatgagacacagct

SEQ ID NO: 149260 - DNA, 20 bp, Artificial Sequence
  Description of Artificial Sequence: Synthetic oligonucleotide
  Target: ATXN1; (+) strand; PAM type: NRG; PAM sequence: GAG
ctgaaatgagacacagctgg

SEQ ID NO: 149261 - DNA, 20 bp, Artificial Sequence
  Description of Artificial Sequence: Synthetic oligonucleotide
  Target: ATXN1; (+) strand; PAM type: NRG; PAM sequence: AGG
tgaaatgagacacagctggg

SEQ ID NO: 149262 - DNA, 20 bp, Artificial Sequence
  Description of Artificial Sequence: Synthetic oligonucleotide
  Target: ATXN1; (+) strand; PAM type: NRG; PAM sequence: TAG
cccaccaccacccgcctttg

SEQ ID NO: 149263 - DNA, 20 bp, Artificial Sequence
  Description of Artificial Sequence: Synthetic oligonucleotide
  Target: ATXN1; (+) strand; PAM type: NRG; PAM sequence: CAG
caccacccgcctttgtagaa

SEQ ID NO: 149264 - DNA, 20 bp, Artificial Sequence
  Description of Artificial Sequence: Synthetic oligonucleotide
  Target: ATXN1; (+) strand; PAM type: NRG; PAM sequence: AAG
ttgtagaacagctacccaaa

SEQ ID NO: 149265 - DNA, 20 bp, Artificial Sequence
  Description of Artificial Sequence: Synthetic oligonucleotide
  Target: ATXN1; (+) strand; PAM type: NRG; PAM sequence: AAG
gaacagctacccaaaaagac

SEQ ID NO: 149266 - DNA, 20 bp, Artificial Sequence
  Description of Artificial Sequence: Synthetic oligonucleotide
  Target: ATXN1; (+) strand; PAM type: NRG; PAM sequence: AGG
aacagctacccaaaaagaca

SEQ ID NO: 149267 - DNA, 20 bp, Artificial Sequence
  Description of Artificial Sequence: Synthetic oligonucleotide
  Target: ATXN1; (+) strand; PAM type: NRG; PAM sequence: TAG
gctacccaaaaagacaagga

SEQ ID NO: 149268 - DNA, 20 bp, Artificial Sequence
  Description of Artificial Sequence: Synthetic oligonucleotide
  Target: ATXN1; (+) strand; PAM type: NRG; PAM sequence: AAG
cccaaaaagacaaggatagc

SEQ ID NO: 149269 - DNA, 20 bp, Artificial Sequence
  Description of Artificial Sequence: Synthetic oligonucleotide
  Target: ATXN1; (+) strand; PAM type: NRG; PAM sequence: AAG
caaggatagcaagtcccctg

SEQ ID NO: 149270 - DNA, 20 bp, Artificial Sequence
  Description of Artificial Sequence: Synthetic oligonucleotide
  Target: ATXN1; (+) strand; PAM type: NRG; PAM sequence: TAG
tgattgttttccttttgaaa

SEQ ID NO: 149271 - DNA, 20 bp, Artificial Sequence
  Description of Artificial Sequence: Synthetic oligonucleotide
  Target: ATXN1; (+) strand; PAM type: NRG; PAM sequence: CAG
catattcattttgaaaaata

SEQ ID NO: 149272 - DNA, 20 bp, Artificial Sequence
  Description of Artificial Sequence: Synthetic oligonucleotide
  Target: ATXN1; (+) strand; PAM type: NRG; PAM sequence: TGG
cattttgaaaaatacagaaa

SEQ ID NO: 149273 - DNA, 20 bp, Artificial Sequence
  Description of Artificial Sequence: Synthetic oligonucleotide
  Target: ATXN1; (+) strand; PAM type: NRG; PAM sequence: AAG
tgaaaaatacagaaatggca

SEQ ID NO: 149274 - DNA, 20 bp, Artificial Sequence
  Description of Artificial Sequence: Synthetic oligonucleotide
  Target: ATXN1; (+) strand; PAM type: NRG; PAM sequence: AAG
aaaatacagaaatggcaaag

SEQ ID NO: 149275 - DNA, 20 bp, Artificial Sequence
  Description of Artificial Sequence: Synthetic oligonucleotide
  Target: ATXN1; (+) strand; PAM type: NRG; PAM sequence: AAG
tacagaaatggcaaagaaga

SEQ ID NO: 149276 - DNA, 20 bp, Artificial Sequence
  Description of Artificial Sequence: Synthetic oligonucleotide
  Target: ATXN1; (+) strand; PAM type: NRG; PAM sequence: CAG
agaagaaagtaaaaacctcc

SEQ ID NO: 149277 - DNA, 20 bp, Artificial Sequence
  Description of Artificial Sequence: Synthetic oligonucleotide
  Target: ATXN1; (+) strand; PAM type: NRG; PAM sequence: AAG
catttgtcccatctttttct

SEQ ID NO: 149278 - DNA, 20 bp, Artificial Sequence
  Description of Artificial Sequence: Synthetic oligonucleotide
  Target: ATXN1; (+) strand; PAM type: NRG; PAM sequence: CAG
atcaatatataaatatttaa

SEQ ID NO: 149279 - DNA, 20 bp, Artificial Sequence
  Description of Artificial Sequence: Synthetic oligonucleotide
  Target: ATXN1; (+) strand; PAM type: NRG; PAM sequence: AAG
tcttgtatacattcctttga

SEQ ID NO: 149280 - DNA, 20 bp, Artificial Sequence
  Description of Artificial Sequence: Synthetic oligonucleotide
  Target: ATXN1; (+) strand; PAM type: NRG; PAM sequence: TGG
ttcctttgaaagctctgtga

SEQ ID NO: 149281 - DNA, 20 bp, Artificial Sequence
  Description of Artificial Sequence: Synthetic oligonucleotide
  Target: ATXN1; (+) strand; PAM type: NRG; PAM sequence: GGG
tcctttgaaagctctgtgat

SEQ ID NO: 149282 - DNA, 20 bp, Artificial Sequence
  Description of Artificial Sequence: Synthetic oligonucleotide
  Target: ATXN1; (+) strand; PAM type: NRG; PAM sequence: TAG
tgaaagctctgtgatgggtg

SEQ ID NO: 149283 - DNA, 20 bp, Artificial Sequence
  Description of Artificial Sequence: Synthetic oligonucleotide
  Target: ATXN1; (+) strand; PAM type: NRG; PAM sequence: AGG
gaaagctctgtgatgggtgt

SEQ ID NO: 149284 - DNA, 20 bp, Artificial Sequence
  Description of Artificial Sequence: Synthetic oligonucleotide
  Target: ATXN1; (+) strand; PAM type: NRG; PAM sequence: TGG
atgggtgtaggctgaactgc

SEQ ID NO: 149285 - DNA, 20 bp, Artificial Sequence
  Description of Artificial Sequence: Synthetic oligonucleotide
  Target: ATXN1; (+) strand; PAM type: NRG; PAM sequence: GGG
tgggtgtaggctgaactgct

SEQ ID NO: 149286 - DNA, 20 bp, Artificial Sequence
  Description of Artificial Sequence: Synthetic oligonucleotide
  Target: ATXN1; (+) strand; PAM type: NRG; PAM sequence: TAG
actgctgggctgtactgttt

SEQ ID NO: 149287 - DNA, 20 bp, Artificial Sequence
  Description of Artificial Sequence: Synthetic oligonucleotide
  Target: ATXN1; (+) strand; PAM type: NRG; PAM sequence: GAG
tgctgggctgtactgtttta

SEQ ID NO: 149288 - DNA, 20 bp, Artificial Sequence
  Description of Artificial Sequence: Synthetic oligonucleotide
  Target: ATXN1; (+) strand; PAM type: NRG; PAM sequence: AAG
gtactgttttagagcaaaaa

SEQ ID NO: 149289 - DNA, 20 bp, Artificial Sequence
  Description of Artificial Sequence: Synthetic oligonucleotide
  Target: ATXN1; (+) strand; PAM type: NRG; PAM sequence: AAG
tctaatttttctgtgtttca

SEQ ID NO: 149290 - DNA, 20 bp, Artificial Sequence
  Description of Artificial Sequence: Synthetic oligonucleotide
  Target: ATXN1; (+) strand; PAM type: NRG; PAM sequence: AGG
ctaatttttctgtgtttcaa

SEQ ID NO: 149291 - DNA, 20 bp, Artificial Sequence
  Description of Artificial Sequence: Synthetic oligonucleotide
  Target: ATXN1; (+) strand; PAM type: NRG; PAM sequence: GGG
taatttttctgtgtttcaaa

SEQ ID NO: 149292 - DNA, 20 bp, Artificial Sequence
  Description of Artificial Sequence: Synthetic oligonucleotide
  Target: ATXN1; (+) strand; PAM type: NRG; PAM sequence: GGG
aatttttctgtgtttcaaag

SEQ ID NO: 149293 - DNA, 20 bp, Artificial Sequence
  Description of Artificial Sequence: Synthetic oligonucleotide
  Target: ATXN1; (+) strand; PAM type: NRG; PAM sequence: GGG
atttttctgtgtttcaaagg

SEQ ID NO: 149294 - DNA, 20 bp, Artificial Sequence
  Description of Artificial Sequence: Synthetic oligonucleotide
  Target: ATXN1; (+) strand; PAM type: NRG; PAM sequence: GGG
tttttctgtgtttcaaaggg

SEQ ID NO: 149295 - DNA, 20 bp, Artificial Sequence
  Description of Artificial Sequence: Synthetic oligonucleotide
  Target: ATXN1; (+) strand; PAM type: NRG; PAM sequence: GGG
ttttctgtgtttcaaagggg

SEQ ID NO: 149296 - DNA, 20 bp, Artificial Sequence
  Description of Artificial Sequence: Synthetic oligonucleotide
  Target: ATXN1; (+) strand; PAM type: NRG; PAM sequence: AAG
ttaatttttaaaatttactc

SEQ ID NO: 149297 - DNA, 20 bp, Artificial Sequence
  Description of Artificial Sequence: Synthetic oligonucleotide
  Target: ATXN1; (+) strand; PAM type: NRG; PAM sequence: AGG
taatttttaaaatttactca

SEQ ID NO: 149298 - DNA, 20 bp, Artificial Sequence
  Description of Artificial Sequence: Synthetic oligonucleotide
  Target: ATXN1; (+) strand; PAM type: NRG; PAM sequence: CAG
actcaaggtgaattcttatc

SEQ ID NO: 149299 - DNA, 20 bp, Artificial Sequence
  Description of Artificial Sequence: Synthetic oligonucleotide
  Target: ATXN1; (+) strand; PAM type: NRG; PAM sequence: CAG
attcttatccagatcaattc

SEQ ID NO: 149300 - DNA, 20 bp, Artificial Sequence
  Description of Artificial Sequence: Synthetic oligonucleotide
  Target: ATXN1; (+) strand; PAM type: NRG; PAM sequence: AGG
ttcttatccagatcaattcc

SEQ ID NO: 149301 - DNA, 20 bp, Artificial Sequence
  Description of Artificial Sequence: Synthetic oligonucleotide
  Target: ATXN1; (+) strand; PAM type: NRG; PAM sequence: GAG
cttatccagatcaattccag

SEQ ID NO: 149302 - DNA, 20 bp, Artificial Sequence
  Description of Artificial Sequence: Synthetic oligonucleotide
  Target: ATXN1; (+) strand; PAM type: NRG; PAM sequence: CGG
cagatcaattccaggagtta

SEQ ID NO: 149303 - DNA, 20 bp, Artificial Sequence
  Description of Artificial Sequence: Synthetic oligonucleotide
  Target: ATXN1; (+) strand; PAM type: NRG; PAM sequence: GGG
agatcaattccaggagttac

SEQ ID NO: 149304 - DNA, 20 bp, Artificial Sequence
  Description of Artificial Sequence: Synthetic oligonucleotide
  Target: ATXN1; (+) strand; PAM type: NRG; PAM sequence: GGG
gatcaattccaggagttacg

SEQ ID NO: 149305 - DNA, 20 bp, Artificial Sequence
  Description of Artificial Sequence: Synthetic oligonucleotide
  Target: ATXN1; (+) strand; PAM type: NRG; PAM sequence: TGG
attccaggagttacggggcg

SEQ ID NO: 149306 - DNA, 20 bp, Artificial Sequence
  Description of Artificial Sequence: Synthetic oligonucleotide
  Target: ATXN1; (+) strand; PAM type: NRG; PAM sequence: CAG
ttacggggcgtggaatttgc

SEQ ID NO: 149307 - DNA, 20 bp, Artificial Sequence
  Description of Artificial Sequence: Synthetic oligonucleotide
  Target: ATXN1; (+) strand; PAM type: NRG; PAM sequence: AAG
gggcgtggaatttgccagat

SEQ ID NO: 149308 - DNA, 20 bp, Artificial Sequence
  Description of Artificial Sequence: Synthetic oligonucleotide
  Target: ATXN1; (+) strand; PAM type: NRG; PAM sequence: AAG
ccacaccattctatgccatc

SEQ ID NO: 149309 - DNA, 20 bp, Artificial Sequence
  Description of Artificial Sequence: Synthetic oligonucleotide
  Target: ATXN1; (+) strand; PAM type: NRG; PAM sequence: CAG
cattctatgccatcaagtca

SEQ ID NO: 149310 - DNA, 20 bp, Artificial Sequence
  Description of Artificial Sequence: Synthetic oligonucleotide
  Target: ATXN1; (+) strand; PAM type: NRG; PAM sequence: TGG
tgccatcaagtcacagaaac

SEQ ID NO: 149311 - DNA, 20 bp, Artificial Sequence
  Description of Artificial Sequence: Synthetic oligonucleotide
  Target: ATXN1; (+) strand; PAM type: NRG; PAM sequence: TGG
ttgtgccttgtctgttgctt

SEQ ID NO: 149312 - DNA, 20 bp, Artificial Sequence
  Description of Artificial Sequence: Synthetic oligonucleotide
  Target: ATXN1; (+) strand; PAM type: NRG; PAM sequence: GGG
tgtgccttgtctgttgcttt

SEQ ID NO: 149313 - DNA, 20 bp, Artificial Sequence
  Description of Artificial Sequence: Synthetic oligonucleotide
  Target: ATXN1; (+) strand; PAM type: NRG; PAM sequence: CAG
ctgttgctttgggcatgaaa

SEQ ID NO: 149314 - DNA, 20 bp, Artificial Sequence
  Description of Artificial Sequence: Synthetic oligonucleotide
  Target: ATXN1; (+) strand; PAM type: NRG; PAM sequence: TGG
tttgggcatgaaacagaatg

SEQ ID NO: 149315 - DNA, 20 bp, Artificial Sequence
  Description of Artificial Sequence: Synthetic oligonucleotide
  Target: ATXN1; (+) strand; PAM type: NRG; PAM sequence: AAG
atttctcacttcattaccta

SEQ ID NO: 149316 - DNA, 20 bp, Artificial Sequence
  Description of Artificial Sequence: Synthetic oligonucleotide
  Target: ATXN1; (+) strand; PAM type: NRG; PAM sequence: TGG
tctcacttcattacctaaag

SEQ ID NO: 149317 - DNA, 20 bp, Artificial Sequence
  Description of Artificial Sequence: Synthetic oligonucleotide
  Target: ATXN1; (+) strand; PAM type: NRG; PAM sequence: TGG
aacctatcccctgcccaccc

SEQ ID NO: 149318 - DNA, 20 bp, Artificial Sequence
  Description of Artificial Sequence: Synthetic oligonucleotide
  Target: ATXN1; (+) strand; PAM type: NRG; PAM sequence: TGG
tggccccattatttctcact

SEQ ID NO: 149319 - DNA, 20 bp, Artificial Sequence
  Description of Artificial Sequence: Synthetic oligonucleotide
  Target: ATXN1; (+) strand; PAM type: NRG; PAM sequence: CAG
attatttctcacttggataa

SEQ ID NO: 149320 - DNA, 20 bp, Artificial Sequence
  Description of Artificial Sequence: Synthetic oligonucleotide
  Target: ATXN1; (+) strand; PAM type: NRG; PAM sequence: AGG
ttatttctcacttggataac

SEQ ID NO: 149321 - DNA, 20 bp, Artificial Sequence
  Description of Artificial Sequence: Synthetic oligonucleotide
  Target: ATXN1; (+) strand; PAM type: NRG; PAM sequence: AAG
tttctcacttggataacagg

SEQ ID NO: 149322 - DNA, 20 bp, Artificial Sequence
  Description of Artificial Sequence: Synthetic oligonucleotide
  Target: ATXN1; (+) strand; PAM type: NRG; PAM sequence: AGG
ttctcacttggataacagga

SEQ ID NO: 149323 - DNA, 20 bp, Artificial Sequence
  Description of Artificial Sequence: Synthetic oligonucleotide
  Target: ATXN1; (+) strand; PAM type: NRG; PAM sequence: TGG
tttgaactcatcgtccacac

SEQ ID NO: 149324 - DNA, 20 bp, Artificial Sequence
  Description of Artificial Sequence: Synthetic oligonucleotide
  Target: ATXN1; (+) strand; PAM type: NRG; PAM sequence: GGG
ttgaactcatcgtccacact

SEQ ID NO: 149325 - DNA, 20 bp, Artificial Sequence
  Description of Artificial Sequence: Synthetic oligonucleotide
  Target: ATXN1; (+) strand; PAM type: NRG; PAM sequence: TAG
tccgctaaaaatcattacaa

SEQ ID NO: 149326 - DNA, 20 bp, Artificial Sequence
  Description of Artificial Sequence: Synthetic oligonucleotide
  Target: ATXN1; (+) strand; PAM type: NRG; PAM sequence: GAG
aatagcttctatttaaacat

SEQ ID NO: 149327 - DNA, 20 bp, Artificial Sequence
  Description of Artificial Sequence: Synthetic oligonucleotide
  Target: ATXN1; (+) strand; PAM type: NRG; PAM sequence: CAG
taaacatgagtatatcccat

SEQ ID NO: 149328 - DNA, 20 bp, Artificial Sequence
  Description of Artificial Sequence: Synthetic oligonucleotide
  Target: ATXN1; (+) strand; PAM type: NRG; PAM sequence: TGG
atgagtatatcccatcagcc

SEQ ID NO: 149329 - DNA, 20 bp, Artificial Sequence
  Description of Artificial Sequence: Synthetic oligonucleotide
  Target: ATXN1; (+) strand; PAM type: NRG; PAM sequence: CAG
ggccccatgctacatgcgtt

SEQ ID NO: 149330 - DNA, 20 bp, Artificial Sequence
  Description of Artificial Sequence: Synthetic oligonucleotide
  Target: ATXN1; (+) strand; PAM type: NRG; PAM sequence: AAG
catatctttataacaatctt

SEQ ID NO: 149331 - DNA, 20 bp, Artificial Sequence
  Description of Artificial Sequence: Synthetic oligonucleotide
  Target: ATXN1; (+) strand; PAM type: NRG; PAM sequence: GAG
tatctttataacaatcttaa

SEQ ID NO: 149332 - DNA, 20 bp, Artificial Sequence
  Description of Artificial Sequence: Synthetic oligonucleotide
  Target: ATXN1; (+) strand; PAM type: NRG; PAM sequence: CAG
tttataacaatcttaagaga

SEQ ID NO: 149333 - DNA, 20 bp, Artificial Sequence
  Description of Artificial Sequence: Synthetic oligonucleotide
  Target: ATXN1; (+) strand; PAM type: NRG; PAM sequence: GAG
tataacaatcttaagagaca

SEQ ID NO: 149334 - DNA, 20 bp, Artificial Sequence
  Description of Artificial Sequence: Synthetic oligonucleotide
  Target: ATXN1; (+) strand; PAM type: NRG; PAM sequence: AGG
ataacaatcttaagagacag

SEQ ID NO: 149335 - DNA, 20 bp, Artificial Sequence
  Description of Artificial Sequence: Synthetic oligonucleotide
  Target: ATXN1; (+) strand; PAM type: NRG; PAM sequence: TAG
agaggctattattttaacgt

SEQ ID NO: 149336 - DNA, 20 bp, Artificial Sequence
  Description of Artificial Sequence: Synthetic oligonucleotide
  Target: ATXN1; (+) strand; PAM type: NRG; PAM sequence: GAG
aggctattattttaacgtta

SEQ ID NO: 149337 - DNA, 20 bp, Artificial Sequence
  Description of Artificial Sequence: Synthetic oligonucleotide
  Target: ATXN1; (+) strand; PAM type: NRG; PAM sequence: AAG
ttattttaacgttagagata

SEQ ID NO: 149338 - DNA, 20 bp, Artificial Sequence
  Description of Artificial Sequence: Synthetic oligonucleotide
  Target: ATXN1; (+) strand; PAM type: NRG; PAM sequence: CAG
gttagagataaagactctta

SEQ ID NO: 149339 - DNA, 20 bp, Artificial Sequence
  Description of Artificial Sequence: Synthetic oligonucleotide
  Target: ATXN1; (+) strand; PAM type: NRG; PAM sequence: GAG
agataaagactcttacagct

SEQ ID NO: 149340 - DNA, 20 bp, Artificial Sequence
  Description of Artificial Sequence: Synthetic oligonucleotide
  Target: ATXN1; (+) strand; PAM type: NRG; PAM sequence: AGG
gataaagactcttacagctg

SEQ ID NO: 149341 - DNA, 20 bp, Artificial Sequence
  Description of Artificial Sequence: Synthetic oligonucleotide
  Target: ATXN1; (+) strand; PAM type: NRG; PAM sequence: AAG
tatgttaaataacttgctca

SEQ ID NO: 149342 - DNA, 20 bp, Artificial Sequence
  Description of Artificial Sequence: Synthetic oligonucleotide
  Target: ATXN1; (+) strand; PAM type: NRG; PAM sequence: AAG
ataacttgctcaaagtcaca

SEQ ID NO: 149343 - DNA, 20 bp, Artificial Sequence
  Description of Artificial Sequence: Synthetic oligonucleotide
  Target: ATXN1; (+) strand; PAM type: NRG; PAM sequence: TAG
cttgctcaaagtcacaaagc

SEQ ID NO: 149344 - DNA, 20 bp, Artificial Sequence
  Description of Artificial Sequence: Synthetic oligonucleotide
  Target: ATXN1; (+) strand; PAM type: NRG; PAM sequence: TAG
gtcacaaagctagtaaaatt

SEQ ID NO: 149345 - DNA, 20 bp, Artificial Sequence
  Description of Artificial Sequence: Synthetic oligonucleotide
  Target: ATXN1; (+) strand; PAM type: NRG; PAM sequence: AGG
tcacaaagctagtaaaattt

SEQ ID NO: 149346 - DNA, 20 bp, Artificial Sequence
  Description of Artificial Sequence: Synthetic oligonucleotide
  Target: ATXN1; (+) strand; PAM type: NRG; PAM sequence: GGG
cacaaagctagtaaaattta

SEQ ID NO: 149347 - DNA, 20 bp, Artificial Sequence
  Description of Artificial Sequence: Synthetic oligonucleotide
  Target: ATXN1; (+) strand; PAM type: NRG; PAM sequence: CAG
aaagctagtaaaatttaggg

SEQ ID NO: 149348 - DNA, 20 bp, Artificial Sequence
  Description of Artificial Sequence: Synthetic oligonucleotide
  Target: ATXN1; (+) strand; PAM type: NRG; PAM sequence: TGG
aaatttagggcagctgactc

SEQ ID NO: 149349 - DNA, 20 bp, Artificial Sequence
  Description of Artificial Sequence: Synthetic oligonucleotide
  Target: ATXN1; (+) strand; PAM type: NRG; PAM sequence: CGG
ttcatgactactgccatcaa

SEQ ID NO: 149350 - DNA, 20 bp, Artificial Sequence
  Description of Artificial Sequence: Synthetic oligonucleotide
  Target: ATXN1; (+) strand; PAM type: NRG; PAM sequence: CAG
atgactactgccatcaacgg

SEQ ID NO: 149351 - DNA, 20 bp, Artificial Sequence
  Description of Artificial Sequence: Synthetic oligonucleotide
  Target: ATXN1; (+) strand; PAM type: NRG; PAM sequence: TGG
actactgccatcaacggcag

SEQ ID NO: 149352 - DNA, 20 bp, Artificial Sequence
  Description of Artificial Sequence: Synthetic oligonucleotide
  Target: ATXN1; (+) strand; PAM type: NRG; PAM sequence: CAG
ttcttcaatcaaaaatgttg

SEQ ID NO: 149353 - DNA, 20 bp, Artificial Sequence
  Description of Artificial Sequence: Synthetic oligonucleotide
  Target: ATXN1; (+) strand; PAM type: NRG; PAM sequence: CAG
atcaaaaatgttgcagactt

SEQ ID NO: 149354 - DNA, 20 bp, Artificial Sequence
  Description of Artificial Sequence: Synthetic oligonucleotide
  Target: ATXN1; (+) strand; PAM type: NRG; PAM sequence: AGG
tcaaaaatgttgcagacttc

SEQ ID NO: 149355 - DNA, 20 bp, Artificial Sequence
  Description of Artificial Sequence: Synthetic oligonucleotide
  Target: ATXN1; (+) strand; PAM type: NRG; PAM sequence: TAG
atgttgcagacttcaggcac

SEQ ID NO: 149356 - DNA, 20 bp, Artificial Sequence
  Description of Artificial Sequence: Synthetic oligonucleotide
  Target: ATXN1; (+) strand; PAM type: NRG; PAM sequence: AAG
actcttaatatctgttgatc

SEQ ID NO: 149357 - DNA, 20 bp, Artificial Sequence
  Description of Artificial Sequence: Synthetic oligonucleotide
  Target: ATXN1; (+) strand; PAM type: NRG; PAM sequence: AAG
cttaatatctgttgatcaag

SEQ ID NO: 149358 - DNA, 20 bp, Artificial Sequence
  Description of Artificial Sequence: Synthetic oligonucleotide
  Target: ATXN1; (+) strand; PAM type: NRG; PAM sequence: TGG
ttgatcaagaagatgtacaa

SEQ ID NO: 149359 - DNA, 20 bp, Artificial Sequence
  Description of Artificial Sequence: Synthetic oligonucleotide
  Target: ATXN1; (+) strand; PAM type: NRG; PAM sequence: AAG
gaagatgtacaatggtcaaa

SEQ ID NO: 149360 - DNA, 20 bp, Artificial Sequence
  Description of Artificial Sequence: Synthetic oligonucleotide
  Target: ATXN1; (+) strand; PAM type: NRG; PAM sequence: TAG
tcaaaaagatactatgaact

SEQ ID NO: 149361 - DNA, 20 bp, Artificial Sequence
  Description of Artificial Sequence: Synthetic oligonucleotide
  Target: ATXN1; (+) strand; PAM type: NRG; PAM sequence: TGG
gtaacgctgtgaatgaattc

SEQ ID NO: 149362 - DNA, 20 bp, Artificial Sequence
  Description of Artificial Sequence: Synthetic oligonucleotide
  Target: ATXN1; (+) strand; PAM type: NRG; PAM sequence: CAG
tggctaatgacttacaatat

SEQ ID NO: 149363 - DNA, 20 bp, Artificial Sequence
  Description of Artificial Sequence: Synthetic oligonucleotide
  Target: ATXN1; (+) strand; PAM type: NRG; PAM sequence: CAG
taatgacttacaatatcagc

SEQ ID NO: 149364 - DNA, 20 bp, Artificial Sequence
  Description of Artificial Sequence: Synthetic oligonucleotide
  Target: ATXN1; (+) strand; PAM type: NRG; PAM sequence: TGG
atcagccagctacatatatt

SEQ ID NO: 149365 - DNA, 20 bp, Artificial Sequence
  Description of Artificial Sequence: Synthetic oligonucleotide
  Target: ATXN1; (+) strand; PAM type: NRG; PAM sequence: AAG
agccagctacatatatttgg

SEQ ID NO: 149366 - DNA, 20 bp, Artificial Sequence
  Description of Artificial Sequence: Synthetic oligonucleotide
  Target: ATXN1; (+) strand; PAM type: NRG; PAM sequence: AAG
agctacatatatttggaaga

SEQ ID NO: 149367 - DNA, 20 bp, Artificial Sequence
  Description of Artificial Sequence: Synthetic oligonucleotide
  Target: ATXN1; (+) strand; PAM type: NRG; PAM sequence: TAG
aagaaagctcctatttctgt

SEQ ID NO: 149368 - DNA, 20 bp, Artificial Sequence
  Description of Artificial Sequence: Synthetic oligonucleotide
  Target: ATXN1; (+) strand; PAM type: NRG; PAM sequence: CAG
gattctgatgaccaaatcta

SEQ ID NO: 149369 - DNA, 20 bp, Artificial Sequence
  Description of Artificial Sequence: Synthetic oligonucleotide
  Target: ATXN1; (+) strand; PAM type: NRG; PAM sequence: TGG
ctacagaccatgctttgtgt

SEQ ID NO: 149370 - DNA, 20 bp, Artificial Sequence
  Description of Artificial Sequence: Synthetic oligonucleotide
  Target: ATXN1; (+) strand; PAM type: NRG; PAM sequence: CAG
tttgtgttggtatgaatgtg

SEQ ID NO: 149371 - DNA, 20 bp, Artificial Sequence
  Description of Artificial Sequence: Synthetic oligonucleotide
  Target: ATXN1; (+) strand; PAM type: NRG; PAM sequence: AGG
ttgtgttggtatgaatgtgc

SEQ ID NO: 149372 - DNA, 20 bp, Artificial Sequence
  Description of Artificial Sequence: Synthetic oligonucleotide
  Target: ATXN1; (+) strand; PAM type: NRG; PAM sequence: AAG
atgtgcaggtcctcttttac

SEQ ID NO: 149373 - DNA, 20 bp, Artificial Sequence
  Description of Artificial Sequence: Synthetic oligonucleotide
  Target: ATXN1; (+) strand; PAM type: NRG; PAM sequence: TGG
gtcctcttttacaagaaatg

SEQ ID NO: 149374 - DNA, 20 bp, Artificial Sequence
  Description of Artificial Sequence: Synthetic oligonucleotide
  Target: ATXN1; (+) strand; PAM type: NRG; PAM sequence: TGG
atgtggtctcccatatgttt

SEQ ID NO: 149375 - DNA, 20 bp, Artificial Sequence
  Description of Artificial Sequence: Synthetic oligonucleotide
  Target: ATXN1; (+) strand; PAM type: NRG; PAM sequence: CAG
cccatatgttttggaatcta

SEQ ID NO: 149376 - DNA, 20 bp, Artificial Sequence
  Description of Artificial Sequence: Synthetic oligonucleotide
  Target: ATXN1; (+) strand; PAM type: NRG; PAM sequence: TAG
atgttttggaatctacagat

SEQ ID NO: 149377 - DNA, 20 bp, Artificial Sequence
  Description of Artificial Sequence: Synthetic oligonucleotide
  Target: ATXN1; (+) strand; PAM type: NRG; PAM sequence: TAG
tctacagattagaaaacccc

SEQ ID NO: 149378 - DNA, 20 bp, Artificial Sequence
  Description of Artificial Sequence: Synthetic oligonucleotide
  Target: ATXN1; (+) strand; PAM type: NRG; PAM sequence: AAG
ttagaaaacccctagaatat

SEQ ID NO: 149379 - DNA, 20 bp, Artificial Sequence
  Description of Artificial Sequence: Synthetic oligonucleotide
  Target: ATXN1; (+) strand; PAM type: NRG; PAM sequence: AAG
aacccctagaatataagcca

SEQ ID NO: 149380 - DNA, 20 bp, Artificial Sequence
  Description of Artificial Sequence: Synthetic oligonucleotide
  Target: ATXN1; (+) strand; PAM type: NRG; PAM sequence: TAG
aagccaaagtccatactcct

SEQ ID NO: 149381 - DNA, 20 bp, Artificial Sequence
  Description of Artificial Sequence: Synthetic oligonucleotide
  Target: ATXN1; (+) strand; PAM type: NRG; PAM sequence: AAG
cttagcatttgaaatgccgt

SEQ ID NO: 149382 - DNA, 20 bp, Artificial Sequence
  Description of Artificial Sequence: Synthetic oligonucleotide
  Target: ATXN1; (+) strand; PAM type: NRG; PAM sequence: CAG
ttgaaatgccgtaagtttcc

SEQ ID NO: 149383 - DNA, 20 bp, Artificial Sequence
  Description of Artificial Sequence: Synthetic oligonucleotide
  Target: ATXN1; (+) strand; PAM type: NRG; PAM sequence: TGG
atgccgtaagtttcccagtt

SEQ ID NO: 149384 - DNA, 20 bp, Artificial Sequence
  Description of Artificial Sequence: Synthetic oligonucleotide
  Target: ATXN1; (+) strand; PAM type: NRG; PAM sequence: TAG
ctccaacttacttttccaac

SEQ ID NO: 149385 - DNA, 20 bp, Artificial Sequence
  Description of Artificial Sequence: Synthetic oligonucleotide
  Target: ATXN1; (+) strand; PAM type: NRG; PAM sequence: AAG
aaccccataccacgtcccct

SEQ ID NO: 149386 - DNA, 20 bp, Artificial Sequence
  Description of Artificial Sequence: Synthetic oligonucleotide
  Target: ATXN1; (+) strand; PAM type: NRG; PAM sequence: TAG
cgtcccctaagccctacctc

SEQ ID NO: 149387 - DNA, 20 bp, Artificial Sequence
  Description of Artificial Sequence: Synthetic oligonucleotide
  Target: ATXN1; (+) strand; PAM type: NRG; PAM sequence: TAG
agccctacctctagttgtgt

SEQ ID NO: 149388 - DNA, 20 bp, Artificial Sequence
  Description of Artificial Sequence: Synthetic oligonucleotide
  Target: ATXN1; (+) strand; PAM type: NRG; PAM sequence: AAG
tacctctagttgtgttagac

SEQ ID NO: 149389 - DNA, 20 bp, Artificial Sequence
  Description of Artificial Sequence: Synthetic oligonucleotide
  Target: ATXN1; (+) strand; PAM type: NRG; PAM sequence: TGG
gacaagcattcccaaattac

SEQ ID NO: 149390 - DNA, 20 bp, Artificial Sequence
  Description of Artificial Sequence: Synthetic oligonucleotide
  Target: ATXN1; (+) strand; PAM type: NRG; PAM sequence: AAG
actggataccatgcacactc

SEQ ID NO: 149391 - DNA, 20 bp, Artificial Sequence
  Description of Artificial Sequence: Synthetic oligonucleotide
  Target: ATXN1; (+) strand; PAM type: NRG; PAM sequence: TAG
ataccatgcacactcaagcc

SEQ ID NO: 149392 - DNA, 20 bp, Artificial Sequence
  Description of Artificial Sequence: Synthetic oligonucleotide
  Target: ATXN1; (+) strand; PAM type: NRG; PAM sequence: GAG
accatgcacactcaagccta

SEQ ID NO: 149393 - DNA, 20 bp, Artificial Sequence
  Description of Artificial Sequence: Synthetic oligonucleotide
  Target: ATXN1; (+) strand; PAM type: NRG; PAM sequence: AGG
ccatgcacactcaagcctag

SEQ ID NO: 149394 - DNA, 20 bp, Artificial Sequence
  Description of Artificial Sequence: Synthetic oligonucleotide
  Target: ATXN1; (+) strand; PAM type: NRG; PAM sequence: CAG
cactcaagcctagaggacca

SEQ ID NO: 149395 - DNA, 20 bp, Artificial Sequence
  Description of Artificial Sequence: Synthetic oligonucleotide
  Target: ATXN1; (+) strand; PAM type: NRG; PAM sequence: AAG
ctgctgcaattctctacctg

SEQ ID NO: 149396 - DNA, 20 bp, Artificial Sequence
  Description of Artificial Sequence: Synthetic oligonucleotide
  Target: ATXN1; (+) strand; PAM type: NRG; PAM sequence: GAG
tgaagaactcaatctccttt

SEQ ID NO: 149397 - DNA, 20 bp, Artificial Sequence
  Description of Artificial Sequence: Synthetic oligonucleotide
  Target: ATXN1; (+) strand; PAM type: NRG; PAM sequence: CAG
gaactcaatctcctttgaga

SEQ ID NO: 149398 - DNA, 20 bp, Artificial Sequence
  Description of Artificial Sequence: Synthetic oligonucleotide
  Target: ATXN1; (+) strand; PAM type: NRG; PAM sequence: GAG
actcaatctcctttgagaca

SEQ ID NO: 149399 - DNA, 20 bp, Artificial Sequence
  Description of Artificial Sequence: Synthetic oligonucleotide
  Target: ATXN1; (+) strand; PAM type: NRG; PAM sequence: TGG
ctcaaacatctccaacccta

SEQ ID NO: 149400 - DNA, 20 bp, Artificial Sequence
  Description of Artificial Sequence: Synthetic oligonucleotide
  Target: ATXN1; (+) strand; PAM type: NRG; PAM sequence: GAG
caaacatctccaaccctatg

SEQ ID NO: 149401 - DNA, 20 bp, Artificial Sequence
  Description of Artificial Sequence: Synthetic oligonucleotide
  Target: ATXN1; (+) strand; PAM type: NRG; PAM sequence: AAG
gacaacacccccacccactc

SEQ ID NO: 149402 - DNA, 20 bp, Artificial Sequence
  Description of Artificial Sequence: Synthetic oligonucleotide
  Target: ATXN1; (+) strand; PAM type: NRG; PAM sequence: AGG
acaacacccccacccactca

SEQ ID NO: 149403 - DNA, 20 bp, Artificial Sequence
  Description of Artificial Sequence: Synthetic oligonucleotide
  Target: ATXN1; (+) strand; PAM type: NRG; PAM sequence: CAG
atccttcgtccatatgatca

SEQ ID NO: 149404 - DNA, 20 bp, Artificial Sequence
  Description of Artificial Sequence: Synthetic oligonucleotide
  Target: ATXN1; (+) strand; PAM type: NRG; PAM sequence: AAG
gatcacagtcctatgatgat

SEQ ID NO: 149405 - DNA, 20 bp, Artificial Sequence
  Description of Artificial Sequence: Synthetic oligonucleotide
  Target: ATXN1; (+) strand; PAM type: NRG; PAM sequence: CAG
tgatgataagtaacacacta

SEQ ID NO: 149406 - DNA, 20 bp, Artificial Sequence
  Description of Artificial Sequence: Synthetic oligonucleotide
  Target: ATXN1; (+) strand; PAM type: NRG; PAM sequence: TAG
atgacatgcatctctgtatc

SEQ ID NO: 149407 - DNA, 20 bp, Artificial Sequence
  Description of Artificial Sequence: Synthetic oligonucleotide
  Target: ATXN1; (+) strand; PAM type: NRG; PAM sequence: AAG
tcttctcatccaaacttccc

SEQ ID NO: 149408 - DNA, 20 bp, Artificial Sequence
  Description of Artificial Sequence: Synthetic oligonucleotide
  Target: ATXN1; (+) strand; PAM type: NRG; PAM sequence: AGG
cttctcatccaaacttccca

SEQ ID NO: 149409 - DNA, 20 bp, Artificial Sequence
  Description of Artificial Sequence: Synthetic oligonucleotide
  Target: ATXN1; (+) strand; PAM type: NRG; PAM sequence: GGG
ttctcatccaaacttcccaa

SEQ ID NO: 149410 - DNA, 20 bp, Artificial Sequence
  Description of Artificial Sequence: Synthetic oligonucleotide
  Target: ATXN1; (+) strand; PAM type: NRG; PAM sequence: CAG
tcatccaaacttcccaaggg

SEQ ID NO: 149411 - DNA, 20 bp, Artificial Sequence
  Description of Artificial Sequence: Synthetic oligonucleotide
  Target: ATXN1; (+) strand; PAM type: NRG; PAM sequence: AGG
catccaaacttcccaagggc

SEQ ID NO: 149412 - DNA, 20 bp, Artificial Sequence
  Description of Artificial Sequence: Synthetic oligonucleotide
  Target: ATXN1; (+) strand; PAM type: NRG; PAM sequence: GGG
atccaaacttcccaagggca

SEQ ID NO: 149413 - DNA, 20 bp, Artificial Sequence
  Description of Artificial Sequence: Synthetic oligonucleotide
  Target: ATXN1; (+) strand; PAM type: NRG; PAM sequence: CAG
cagggattgtgcttcttcat

SEQ ID NO: 149414 - DNA, 20 bp, Artificial Sequence
  Description of Artificial Sequence: Synthetic oligonucleotide
  Target: ATXN1; (+) strand; PAM type: NRG; PAM sequence: TAG
gtgcttcttcatcagtgtct

SEQ ID NO: 149415 - DNA, 20 bp, Artificial Sequence
  Description of Artificial Sequence: Synthetic oligonucleotide
  Target: ATXN1; (+) strand; PAM type: NRG; PAM sequence: CAG
cttcatcagtgtcttagccc

SEQ ID NO: 149416 - DNA, 20 bp, Artificial Sequence
  Description of Artificial Sequence: Synthetic oligonucleotide
  Target: ATXN1; (+) strand; PAM type: NRG; PAM sequence: TGG
ccagccccatccctgaaata

SEQ ID NO: 149417 - DNA, 20 bp, Artificial Sequence
  Description of Artificial Sequence: Synthetic oligonucleotide
  Target: ATXN1; (+) strand; PAM type: NRG; PAM sequence: TAG
gccccatccctgaaatatgg

SEQ ID NO: 149418 - DNA, 20 bp, Artificial Sequence
  Description of Artificial Sequence: Synthetic oligonucleotide
  Target: ATXN1; (+) strand; PAM type: NRG; PAM sequence: AGG
ccccatccctgaaatatggt

SEQ ID NO: 149419 - DNA, 20 bp, Artificial Sequence
  Description of Artificial Sequence: Synthetic oligonucleotide
  Target: ATXN1; (+) strand; PAM type: NRG; PAM sequence: AAG
atatggtaggtactgtttgt

SEQ ID NO: 149420 - DNA, 20 bp, Artificial Sequence
  Description of Artificial Sequence: Synthetic oligonucleotide
  Target: ATXN1; (+) strand; PAM type: NRG; PAM sequence: GAG
tgtttgtaagattaataaat

SEQ ID NO: 149421 - DNA, 20 bp, Artificial Sequence
  Description of Artificial Sequence: Synthetic oligonucleotide
  Target: ATXN1; (+) strand; PAM type: NRG; PAM sequence: AAG
aataaatgagtatcaatgcc

SEQ ID NO: 149422 - DNA, 20 bp, Artificial Sequence
  Description of Artificial Sequence: Synthetic oligonucleotide
  Target: ATXN1; (+) strand; PAM type: NRG; PAM sequence: TGG
aatgagtatcaatgccaagc

SEQ ID NO: 149423 - DNA, 20 bp, Artificial Sequence
  Description of Artificial Sequence: Synthetic oligonucleotide
  Target: ATXN1; (+) strand; PAM type: NRG; PAM sequence: TAG
agtatcaatgccaagctggc

SEQ ID NO: 149424 - DNA, 20 bp, Artificial Sequence
  Description of Artificial Sequence: Synthetic oligonucleotide
  Target: ATXN1; (+) strand; PAM type: NRG; PAM sequence: TGG
agctggctagtgattttgcc

SEQ ID NO: 149425 - DNA, 20 bp, Artificial Sequence
  Description of Artificial Sequence: Synthetic oligonucleotide
  Target: ATXN1; (+) strand; PAM type: NRG; PAM sequence: GGG
gctggctagtgattttgcct

SEQ ID NO: 149426 - DNA, 20 bp, Artificial Sequence
  Description of Artificial Sequence: Synthetic oligonucleotide
  Target: ATXN1; (+) strand; PAM type: NRG; PAM sequence: GGG
ctggctagtgattttgcctg

SEQ ID NO: 149427 - DNA, 20 bp, Artificial Sequence
  Description of Artificial Sequence: Synthetic oligonucleotide
  Target: ATXN1; (+) strand; PAM type: NRG; PAM sequence: AAG
gctagtgattttgcctgggg

SEQ ID NO: 149428 - DNA, 20 bp, Artificial Sequence
  Description of Artificial Sequence: Synthetic oligonucleotide
  Target: ATXN1; (+) strand; PAM type: NRG; PAM sequence: CAG
gtgattttgcctggggaagt

SEQ ID NO: 149429 - DNA, 20 bp, Artificial Sequence
  Description of Artificial Sequence: Synthetic oligonucleotide
  Target: ATXN1; (+) strand; PAM type: NRG; PAM sequence: TGG
tttgcctggggaagtcagtt

SEQ ID NO: 149430 - DNA, 20 bp, Artificial Sequence
  Description of Artificial Sequence: Synthetic oligonucleotide
  Target: ATXN1; (+) strand; PAM type: NRG; PAM sequence: TAG
ggggaagtcagtttggaaaa

SEQ ID NO: 149431 - DNA, 20 bp, Artificial Sequence
  Description of Artificial Sequence: Synthetic oligonucleotide
  Target: ATXN1; (+) strand; PAM type: NRG; PAM sequence: AAG
gaaaatagctctgaccacta

SEQ ID NO: 149432 - DNA, 20 bp, Artificial Sequence
  Description of Artificial Sequence: Synthetic oligonucleotide
  Target: ATXN1; (+) strand; PAM type: NRG; PAM sequence: AAG
aatagctctgaccactaaag

SEQ ID NO: 149433 - DNA, 20 bp, Artificial Sequence
  Description of Artificial Sequence: Synthetic oligonucleotide
  Target: ATXN1; (+) strand; PAM type: NRG; PAM sequence: CAG
ccactaaagaagctttcttt

SEQ ID NO: 149434 - DNA, 20 bp, Artificial Sequence
  Description of Artificial Sequence: Synthetic oligonucleotide
  Target: ATXN1; (+) strand; PAM type: NRG; PAM sequence: TGG
tttctttcagtatgttgtaa

SEQ ID NO: 149435 - DNA, 20 bp, Artificial Sequence
  Description of Artificial Sequence: Synthetic oligonucleotide
  Target: ATXN1; (+) strand; PAM type: NRG; PAM sequence: CAG
atggttaatcatctgtaaac

SEQ ID NO: 149436 - DNA, 20 bp, Artificial Sequence
  Description of Artificial Sequence: Synthetic oligonucleotide
  Target: ATXN1; (+) strand; PAM type: NRG; PAM sequence: AAG
aaactcacaacgtcctccaa

SEQ ID NO: 149437 - DNA, 20 bp, Artificial Sequence
  Description of Artificial Sequence: Synthetic oligonucleotide
  Target: ATXN1; (+) strand; PAM type: NRG; PAM sequence: TAG
ctcacaacgtcctccaaaag

SEQ ID NO: 149438 - DNA, 20 bp, Artificial Sequence
  Description of Artificial Sequence: Synthetic oligonucleotide
  Target: ATXN1; (+) strand; PAM type: NRG; PAM sequence: AAG
acaacgtcctccaaaagtag

SEQ ID NO: 149439 - DNA, 20 bp, Artificial Sequence
  Description of Artificial Sequence: Synthetic oligonucleotide
  Target: ATXN1; (+) strand; PAM type: NRG; PAM sequence: TAG
aaagtagaagacaaatacac

SEQ ID NO: 149440 - DNA, 20 bp, Artificial Sequence
  Description of Artificial Sequence: Synthetic oligonucleotide
  Target: ATXN1; (+) strand; PAM type: NRG; PAM sequence: AGG
aagtagaagacaaatacact

SEQ ID NO: 149441 - DNA, 20 bp, Artificial Sequence
  Description of Artificial Sequence: Synthetic oligonucleotide
  Target: ATXN1; (+) strand; PAM type: NRG; PAM sequence: TGG
aagacaaatacactaggaac

SEQ ID NO: 149442 - DNA, 20 bp, Artificial Sequence
  Description of Artificial Sequence: Synthetic oligonucleotide
  Target: ATXN1; (+) strand; PAM type: NRG; PAM sequence: AAG
acaaatacactaggaactgg

SEQ ID NO: 149443 - DNA, 20 bp, Artificial Sequence
  Description of Artificial Sequence: Synthetic oligonucleotide
  Target: ATXN1; (+) strand; PAM type: NRG; PAM sequence: GAG
cactaggaactggaagatct

SEQ ID NO: 149444 - DNA, 20 bp, Artificial Sequence
  Description of Artificial Sequence: Synthetic oligonucleotide
  Target: ATXN1; (+) strand; PAM type: NRG; PAM sequence: CAG
ggaactggaagatctgagct

SEQ ID NO: 149445 - DNA, 20 bp, Artificial Sequence
  Description of Artificial Sequence: Synthetic oligonucleotide
  Target: ATXN1; (+) strand; PAM type: NRG; PAM sequence: AGG
gaactggaagatctgagctc

SEQ ID NO: 149446 - DNA, 20 bp, Artificial Sequence
  Description of Artificial Sequence: Synthetic oligonucleotide
  Target: ATXN1; (+) strand; PAM type: NRG; PAM sequence: TGG
gaagatctgagctcaggtcc

SEQ ID NO: 149447 - DNA, 20 bp, Artificial Sequence
  Description of Artificial Sequence: Synthetic oligonucleotide
  Target: ATXN1; (+) strand; PAM type: NRG; PAM sequence: CAG
gtcctggctttcctatgaac

SEQ ID NO: 149448 - DNA, 20 bp, Artificial Sequence
  Description of Artificial Sequence: Synthetic oligonucleotide
  Target: ATXN1; (+) strand; PAM type: NRG; PAM sequence: TGG
atgaaccagctgtgtgactt

SEQ ID NO: 149449 - DNA, 20 bp, Artificial Sequence
  Description of Artificial Sequence: Synthetic oligonucleotide
  Target: ATXN1; (+) strand; PAM type: NRG; PAM sequence: AAG
ccagctgtgtgactttggtc

SEQ ID NO: 149450 - DNA, 20 bp, Artificial Sequence
  Description of Artificial Sequence: Synthetic oligonucleotide
  Target: ATXN1; (+) strand; PAM type: NRG; PAM sequence: TGG
tctgtttgttcactgaattg

SEQ ID NO: 149451 - DNA, 20 bp, Artificial Sequence
  Description of Artificial Sequence: Synthetic oligonucleotide
  Target: ATXN1; (+) strand; PAM type: NRG; PAM sequence: CAG
gtttgttcactgaattgtgg

SEQ ID NO: 149452 - DNA, 20 bp, Artificial Sequence
  Description of Artificial Sequence: Synthetic oligonucleotide
  Target: ATXN1; (+) strand; PAM type: NRG; PAM sequence: AGG
tttgttcactgaattgtggc

SEQ ID NO: 149453 - DNA, 20 bp, Artificial Sequence
  Description of Artificial Sequence: Synthetic oligonucleotide
  Target: ATXN1; (+) strand; PAM type: NRG; PAM sequence: GGG
ttgttcactgaattgtggca

SEQ ID NO: 149454 - DNA, 20 bp, Artificial Sequence
  Description of Artificial Sequence: Synthetic oligonucleotide
  Target: ATXN1; (+) strand; PAM type: NRG; PAM sequence: TGG
actgaattgtggcagggttg

SEQ ID NO: 149455 - DNA, 20 bp, Artificial Sequence
  Description of Artificial Sequence: Synthetic oligonucleotide
  Target: ATXN1; (+) strand; PAM type: NRG; PAM sequence: GGG
ctgaattgtggcagggttgt

SEQ ID NO: 149456 - DNA, 20 bp, Artificial Sequence
  Description of Artificial Sequence: Synthetic oligonucleotide
  Target: ATXN1; (+) strand; PAM type: NRG; PAM sequence: GGG
tgaattgtggcagggttgtg

SEQ ID NO: 149457 - DNA, 20 bp, Artificial Sequence
  Description of Artificial Sequence: Synthetic oligonucleotide
  Target: ATXN1; (+) strand; PAM type: NRG; PAM sequence: GGG
gaattgtggcagggttgtgg

SEQ ID NO: 149458 - DNA, 20 bp, Artificial Sequence
  Description of Artificial Sequence: Synthetic oligonucleotide
  Target: ATXN1; (+) strand; PAM type: NRG; PAM sequence: AAG
gcagggttgtgggggtgcaa

SEQ ID NO: 149459 - DNA, 20 bp, Artificial Sequence
  Description of Artificial Sequence: Synthetic oligonucleotide
  Target: ATXN1; (+) strand; PAM type: NRG; PAM sequence: AGG
cagggttgtgggggtgcaaa

SEQ ID NO: 149460 - DNA, 20 bp, Artificial Sequence
  Description of Artificial Sequence: Synthetic oligonucleotide
  Target: ATXN1; (+) strand; PAM type: NRG; PAM sequence: GAG
gggttgtgggggtgcaaaag

SEQ ID NO: 149461 - DNA, 20 bp, Artificial Sequence
  Description of Artificial Sequence: Synthetic oligonucleotide
  Target: ATXN1; (+) strand; PAM type: NRG; PAM sequence: AGG
ggttgtgggggtgcaaaagg

SEQ ID NO: 149462 - DNA, 20 bp, Artificial Sequence
  Description of Artificial Sequence: Synthetic oligonucleotide
  Target: ATXN1; (+) strand; PAM type: NRG; PAM sequence: GGG
gttgtgggggtgcaaaagga

SEQ ID NO: 149463 - DNA, 20 bp, Artificial Sequence
  Description of Artificial Sequence: Synthetic oligonucleotide
  Target: ATXN1; (+) strand; PAM type: NRG; PAM sequence: TAG
gggtgcaaaaggagggcttc

SEQ ID NO: 149464 - DNA, 20 bp, Artificial Sequence
  Description of Artificial Sequence: Synthetic oligonucleotide
  Target: ATXN1; (+) strand; PAM type: NRG; PAM sequence: AAG
atgcaattctctgacgtgca

SEQ ID NO: 149465 - DNA, 20 bp, Artificial Sequence
  Description of Artificial Sequence: Synthetic oligonucleotide
  Target: ATXN1; (+) strand; PAM type: NRG; PAM sequence: AGG
tgcaattctctgacgtgcaa

SEQ ID NO: 149466 - DNA, 20 bp, Artificial Sequence
  Description of Artificial Sequence: Synthetic oligonucleotide
  Target: ATXN1; (+) strand; PAM type: NRG; PAM sequence: TAG
ttctctgacgtgcaaaggta

SEQ ID NO: 149467 - DNA, 20 bp, Artificial Sequence
  Description of Artificial Sequence: Synthetic oligonucleotide
  Target: ATXN1; (+) strand; PAM type: NRG; PAM sequence: CAG
acgtgcaaaggtatagacta

SEQ ID NO: 149468 - DNA, 20 bp, Artificial Sequence
  Description of Artificial Sequence: Synthetic oligonucleotide
  Target: ATXN1; (+) strand; PAM type: NRG; PAM sequence: TGG
gcaaaggtatagactacagt

SEQ ID NO: 149469 - DNA, 20 bp, Artificial Sequence
  Description of Artificial Sequence: Synthetic oligonucleotide
  Target: ATXN1; (+) strand; PAM type: NRG; PAM sequence: GAG
gttggcaaacattttctgat

SEQ ID NO: 149470 - DNA, 20 bp, Artificial Sequence
  Description of Artificial Sequence: Synthetic oligonucleotide
  Target: ATXN1; (+) strand; PAM type: NRG; PAM sequence: AGG
ttggcaaacattttctgatg

SEQ ID NO: 149471 - DNA, 20 bp, Artificial Sequence
  Description of Artificial Sequence: Synthetic oligonucleotide
  Target: ATXN1; (+) strand; PAM type: NRG; PAM sequence: CAG
aaacattttctgatgaggat

SEQ ID NO: 149472 - DNA, 20 bp, Artificial Sequence
  Description of Artificial Sequence: Synthetic oligonucleotide
  Target: ATXN1; (+) strand; PAM type: NRG; PAM sequence: TAG
attttctgatgaggatcaga

SEQ ID NO: 149473 - DNA, 20 bp, Artificial Sequence
  Description of Artificial Sequence: Synthetic oligonucleotide
  Target: ATXN1; (+) strand; PAM type: NRG; PAM sequence: TAG
ttctgatgaggatcagatag

SEQ ID NO: 149474 - DNA, 20 bp, Artificial Sequence
  Description of Artificial Sequence: Synthetic oligonucleotide
  Target: ATXN1; (+) strand; PAM type: NRG; PAM sequence: CAG
ggatcagatagtagatattt

SEQ ID NO: 149475 - DNA, 20 bp, Artificial Sequence
  Description of Artificial Sequence: Synthetic oligonucleotide
  Target: ATXN1; (+) strand; PAM type: NRG; PAM sequence: AGG
gatcagatagtagatatttc

SEQ ID NO: 149476 - DNA, 20 bp, Artificial Sequence
  Description of Artificial Sequence: Synthetic oligonucleotide
  Target: ATXN1; (+) strand; PAM type: NRG; PAM sequence: TGG
gtagatatttcaggctttct

SEQ ID NO: 149477 - DNA, 20 bp, Artificial Sequence
  Description of Artificial Sequence: Synthetic oligonucleotide
  Target: ATXN1; (+) strand; PAM type: NRG; PAM sequence: TGG
tttcaggctttcttggacta

SEQ ID NO: 149478 - DNA, 20 bp, Artificial Sequence
  Description of Artificial Sequence: Synthetic oligonucleotide
  Target: ATXN1; (+) strand; PAM type: NRG; PAM sequence: CAG
tgactcaaatcaaattctgc

SEQ ID NO: 149479 - DNA, 20 bp, Artificial Sequence
  Description of Artificial Sequence: Synthetic oligonucleotide
  Target: ATXN1; (+) strand; PAM type: NRG; PAM sequence: TAG
caaatcaaattctgccagtg

SEQ ID NO: 149480 - DNA, 20 bp, Artificial Sequence
  Description of Artificial Sequence: Synthetic oligonucleotide
  Target: ATXN1; (+) strand; PAM type: NRG; PAM sequence: TAG
gtgtagtgcaaaaactgcta

SEQ ID NO: 149481 - DNA, 20 bp, Artificial Sequence
  Description of Artificial Sequence: Synthetic oligonucleotide
  Target: ATXN1; (+) strand; PAM type: NRG; PAM sequence: TAG
gcaaaaactgctatagacat

SEQ ID NO: 149482 - DNA, 20 bp, Artificial Sequence
  Description of Artificial Sequence: Synthetic oligonucleotide
  Target: ATXN1; (+) strand; PAM type: NRG; PAM sequence: TGG
atagacattagacaaattat

SEQ ID NO: 149483 - DNA, 20 bp, Artificial Sequence
  Description of Artificial Sequence: Synthetic oligonucleotide
  Target: ATXN1; (+) strand; PAM type: NRG; PAM sequence: TAG
attagacaaattattggatg

SEQ ID NO: 149484 - DNA, 20 bp, Artificial Sequence
  Description of Artificial Sequence: Synthetic oligonucleotide
  Target: ATXN1; (+) strand; PAM type: NRG; PAM sequence: AAG
gctaataaaactttatttac

SEQ ID NO: 149485 - DNA, 20 bp, Artificial Sequence
  Description of Artificial Sequence: Synthetic oligonucleotide
  Target: ATXN1; (+) strand; PAM type: NRG; PAM sequence: CAG
taaaactttatttacaagaa

SEQ ID NO: 149486 - DNA, 20 bp, Artificial Sequence
  Description of Artificial Sequence: Synthetic oligonucleotide
  Target: ATXN1; (+) strand; PAM type: NRG; PAM sequence: AGG
aaaactttatttacaagaac

SEQ ID NO: 149487 - DNA, 20 bp, Artificial Sequence
  Description of Artificial Sequence: Synthetic oligonucleotide
  Target: ATXN1; (+) strand; PAM type: NRG; PAM sequence: TGG
ctttatttacaagaacaggc

SEQ ID NO: 149488 - DNA, 20 bp, Artificial Sequence
  Description of Artificial Sequence: Synthetic oligonucleotide
  Target: ATXN1; (+) strand; PAM type: NRG; PAM sequence: TGG
ttacaagaacaggctggatt

SEQ ID NO: 149489 - DNA, 20 bp, Artificial Sequence
  Description of Artificial Sequence: Synthetic oligonucleotide
  Target: ATXN1; (+) strand; PAM type: NRG; PAM sequence: TGG
aacaggctggatttggccca

SEQ ID NO: 149490 - DNA, 20 bp, Artificial Sequence
  Description of Artificial Sequence: Synthetic oligonucleotide
  Target: ATXN1; (+) strand; PAM type: NRG; PAM sequence: TAG
tggatttggcccatggacca

SEQ ID NO: 149491 - DNA, 20 bp, Artificial Sequence
  Description of Artificial Sequence: Synthetic oligonucleotide
  Target: ATXN1; (+) strand; PAM type: NRG; PAM sequence: TGG
gaccatagtttgcctactcc

SEQ ID NO: 149492 - DNA, 20 bp, Artificial Sequence
  Description of Artificial Sequence: Synthetic oligonucleotide
  Target: ATXN1; (+) strand; PAM type: NRG; PAM sequence: TGG
tagtttgcctactcctggtc

SEQ ID NO: 149493 - DNA, 20 bp, Artificial Sequence
  Description of Artificial Sequence: Synthetic oligonucleotide
  Target: ATXN1; (+) strand; PAM type: NRG; PAM sequence: CAG
aatgcctccttgttgccatt

SEQ ID NO: 149494 - DNA, 20 bp, Artificial Sequence
  Description of Artificial Sequence: Synthetic oligonucleotide
  Target: ATXN1; (+) strand; PAM type: NRG; PAM sequence: CAG
ccttgttgccattcagttca

SEQ ID NO: 149495 - DNA, 20 bp, Artificial Sequence
  Description of Artificial Sequence: Synthetic oligonucleotide
  Target: ATXN1; (+) strand; PAM type: NRG; PAM sequence: GAG
ttgttgccattcagttcaca

SEQ ID NO: 149496 - DNA, 20 bp, Artificial Sequence
  Description of Artificial Sequence: Synthetic oligonucleotide
  Target: ATXN1; (+) strand; PAM type: NRG; PAM sequence: AAG
agttcacagagcttgatatg

SEQ ID NO: 149497 - DNA, 20 bp, Artificial Sequence
  Description of Artificial Sequence: Synthetic oligonucleotide
  Target: ATXN1; (+) strand; PAM type: NRG; PAM sequence: CAG
cagagcttgatatgaagata

SEQ ID NO: 149498 - DNA, 20 bp, Artificial Sequence
  Description of Artificial Sequence: Synthetic oligonucleotide
  Target: ATXN1; (+) strand; PAM type: NRG; PAM sequence: GAG
gatatgaagatacagttcac

SEQ ID NO: 149499 - DNA, 20 bp, Artificial Sequence
  Description of Artificial Sequence: Synthetic oligonucleotide
  Target: ATXN1; (+) strand; PAM type: NRG; PAM sequence: AAG
ttcacgagatgtccatccca

SEQ ID NO: 149500 - DNA, 20 bp, Artificial Sequence
  Description of Artificial Sequence: Synthetic oligonucleotide
  Target: ATXN1; (+) strand; PAM type: NRG; PAM sequence: AAG
caaagcctctatccattcca

SEQ ID NO: 149501 - DNA, 20 bp, Artificial Sequence
  Description of Artificial Sequence: Synthetic oligonucleotide
  Target: ATXN1; (+) strand; PAM type: NRG; PAM sequence: AGG
aaagcctctatccattccaa

SEQ ID NO: 149502 - DNA, 20 bp, Artificial Sequence
  Description of Artificial Sequence: Synthetic oligonucleotide
  Target: ATXN1; (+) strand; PAM type: NRG; PAM sequence: GGG
aagcctctatccattccaaa

SEQ ID NO: 149503 - DNA, 20 bp, Artificial Sequence
  Description of Artificial Sequence: Synthetic oligonucleotide
  Target: ATXN1; (+) strand; PAM type: NRG; PAM sequence: AAG
tccattccaaagggacttat

SEQ ID NO: 149504 - DNA, 20 bp, Artificial Sequence
  Description of Artificial Sequence: Synthetic oligonucleotide
  Target: ATXN1; (+) strand; PAM type: NRG; PAM sequence: AAG
attccaaagggacttataag

SEQ ID NO: 149505 - DNA, 20 bp, Artificial Sequence
  Description of Artificial Sequence: Synthetic oligonucleotide
  Target: ATXN1; (+) strand; PAM type: NRG; PAM sequence: AGG
ttccaaagggacttataaga

SEQ ID NO: 149506 - DNA, 20 bp, Artificial Sequence
  Description of Artificial Sequence: Synthetic oligonucleotide
  Target: ATXN1; (+) strand; PAM type: NRG; PAM sequence: AAG
gacttataagaaggacaata

SEQ ID NO: 149507 - DNA, 20 bp, Artificial Sequence
  Description of Artificial Sequence: Synthetic oligonucleotide
  Target: ATXN1; (+) strand; PAM type: NRG; PAM sequence: AAG
aagattaccattccccaacc

SEQ ID NO: 149508 - DNA, 20 bp, Artificial Sequence
  Description of Artificial Sequence: Synthetic oligonucleotide
  Target: ATXN1; (+) strand; PAM type: NRG; PAM sequence: CGG
cccaaccaagaacttgacaa

SEQ ID NO: 149509 - DNA, 20 bp, Artificial Sequence
  Description of Artificial Sequence: Synthetic oligonucleotide
  Target: ATXN1; (+) strand; PAM type: NRG; PAM sequence: GGG
ccaaccaagaacttgacaac

SEQ ID NO: 149510 - DNA, 20 bp, Artificial Sequence
  Description of Artificial Sequence: Synthetic oligonucleotide
  Target: ATXN1; (+) strand; PAM type: NRG; PAM sequence: GGG
caaccaagaacttgacaacg

SEQ ID NO: 149511 - DNA, 20 bp, Artificial Sequence
  Description of Artificial Sequence: Synthetic oligonucleotide
  Target: ATXN1; (+) strand; PAM type: NRG; PAM sequence: AAG
ccaagaacttgacaacgggg

SEQ ID NO: 149512 - DNA, 20 bp, Artificial Sequence
  Description of Artificial Sequence: Synthetic oligonucleotide
  Target: ATXN1; (+) strand; PAM type: NRG; PAM sequence: GAG
aagaacttgacaacggggaa

SEQ ID NO: 149513 - DNA, 20 bp, Artificial Sequence
  Description of Artificial Sequence: Synthetic oligonucleotide
  Target: ATXN1; (+) strand; PAM type: NRG; PAM sequence: TAG
acaacggggaagagattgcc

SEQ ID NO: 149514 - DNA, 20 bp, Artificial Sequence
  Description of Artificial Sequence: Synthetic oligonucleotide
  Target: ATXN1; (+) strand; PAM type: NRG; PAM sequence: TAG
cggggaagagattgcctagt

SEQ ID NO: 149515 - DNA, 20 bp, Artificial Sequence
  Description of Artificial Sequence: Synthetic oligonucleotide
  Target: ATXN1; (+) strand; PAM type: NRG; PAM sequence: CGG
ggaagagattgcctagttag

SEQ ID NO: 149516 - DNA, 20 bp, Artificial Sequence
  Description of Artificial Sequence: Synthetic oligonucleotide
  Target: ATXN1; (+) strand; PAM type: NRG; PAM sequence: TAG
attgcctagttagcggttta

SEQ ID NO: 149517 - DNA, 20 bp, Artificial Sequence
  Description of Artificial Sequence: Synthetic oligonucleotide
  Target: ATXN1; (+) strand; PAM type: NRG; PAM sequence: AAG
cctagttagcggtttatagt

SEQ ID NO: 149518 - DNA, 20 bp, Artificial Sequence
  Description of Artificial Sequence: Synthetic oligonucleotide
  Target: ATXN1; (+) strand; PAM type: NRG; PAM sequence: TAG
tttatagtaagaacaaaatt

SEQ ID NO: 149519 - DNA, 20 bp, Artificial Sequence
  Description of Artificial Sequence: Synthetic oligonucleotide
  Target: ATXN1; (+) strand; PAM type: NRG; PAM sequence: TGG
atagtaagaacaaaatttag

SEQ ID NO: 149520 - DNA, 20 bp, Artificial Sequence
  Description of Artificial Sequence: Synthetic oligonucleotide
  Target: ATXN1; (+) strand; PAM type: NRG; PAM sequence: GAG
aagaacaaaatttagtggat

SEQ ID NO: 149521 - DNA, 20 bp, Artificial Sequence
  Description of Artificial Sequence: Synthetic oligonucleotide
  Target: ATXN1; (+) strand; PAM type: NRG; PAM sequence: TGG
aaatttagtggatgagaaca

SEQ ID NO: 149522 - DNA, 20 bp, Artificial Sequence
  Description of Artificial Sequence: Synthetic oligonucleotide
  Target: ATXN1; (+) strand; PAM type: NRG; PAM sequence: AAG
gatgagaacatggacataca

SEQ ID NO: 149523 - DNA, 20 bp, Artificial Sequence
  Description of Artificial Sequence: Synthetic oligonucleotide
  Target: ATXN1; (+) strand; PAM type: NRG; PAM sequence: AAG
tggacatacaaagccaactg

SEQ ID NO: 149524 - DNA, 20 bp, Artificial Sequence
  Description of Artificial Sequence: Synthetic oligonucleotide
  Target: ATXN1; (+) strand; PAM type: NRG; PAM sequence: AAG
catacaaagccaactgaaga

SEQ ID NO: 149525 - DNA, 20 bp, Artificial Sequence
  Description of Artificial Sequence: Synthetic oligonucleotide
  Target: ATXN1; (+) strand; PAM type: NRG; PAM sequence: CAG
catcaccactacccctgccc

SEQ ID NO: 149526 - DNA, 20 bp, Artificial Sequence
  Description of Artificial Sequence: Synthetic oligonucleotide
  Target: ATXN1; (+) strand; PAM type: NRG; PAM sequence: CAG
accactacccctgccccagc

SEQ ID NO: 149527 - DNA, 20 bp, Artificial Sequence
  Description of Artificial Sequence: Synthetic oligonucleotide
  Target: ATXN1; (+) strand; PAM type: NRG; PAM sequence: TAG
agccagcacctgatgaaata

SEQ ID NO: 149528 - DNA, 20 bp, Artificial Sequence
  Description of Artificial Sequence: Synthetic oligonucleotide
  Target: ATXN1; (+) strand; PAM type: NRG; PAM sequence: AAG
tgaaatatagtcatgaattt

SEQ ID NO: 149529 - DNA, 20 bp, Artificial Sequence
  Description of Artificial Sequence: Synthetic oligonucleotide
  Target: ATXN1; (+) strand; PAM type: NRG; PAM sequence: AAG
tatagtcatgaatttaagaa

SEQ ID NO: 149530 - DNA, 20 bp, Artificial Sequence
  Description of Artificial Sequence: Synthetic oligonucleotide
  Target: ATXN1; (+) strand; PAM type: NRG; PAM sequence: AAG
agaaaagactgtgtcctcaa

SEQ ID NO: 149531 - DNA, 20 bp, Artificial Sequence
  Description of Artificial Sequence: Synthetic oligonucleotide
  Target: ATXN1; (+) strand; PAM type: NRG; PAM sequence: AGG
gaaaagactgtgtcctcaaa

SEQ ID NO: 149532 - DNA, 20 bp, Artificial Sequence
  Description of Artificial Sequence: Synthetic oligonucleotide
  Target: ATXN1; (+) strand; PAM type: NRG; PAM sequence: GGG
aaaagactgtgtcctcaaaa

SEQ ID NO: 149533 - DNA, 20 bp, Artificial Sequence
  Description of Artificial Sequence: Synthetic oligonucleotide
  Target: ATXN1; (+) strand; PAM type: NRG; PAM sequence: CAG
ctgtgtcctcaaaagggcgc

SEQ ID NO: 149534 - DNA, 20 bp, Artificial Sequence
  Description of Artificial Sequence: Synthetic oligonucleotide
  Target: ATXN1; (+) strand; PAM type: NRG; PAM sequence: AGG
tgtgtcctcaaaagggcgcc

SEQ ID NO: 149535 - DNA, 20 bp, Artificial Sequence
  Description of Artificial Sequence: Synthetic oligonucleotide
  Target: ATXN1; (+) strand; PAM type: NRG; PAM sequence: GGG
gtgtcctcaaaagggcgcca

SEQ ID NO: 149536 - DNA, 20 bp, Artificial Sequence
  Description of Artificial Sequence: Synthetic oligonucleotide
  Target: ATXN1; (+) strand; PAM type: NRG; PAM sequence: TGG
cctcaaaagggcgccagggc

SEQ ID NO: 149537 - DNA, 20 bp, Artificial Sequence
  Description of Artificial Sequence: Synthetic oligonucleotide
  Target: ATXN1; (+) strand; PAM type: NRG; PAM sequence: TAG
aaagggcgccagggctggct

SEQ ID NO: 149538 - DNA, 20 bp, Artificial Sequence
  Description of Artificial Sequence: Synthetic oligonucleotide
  Target: ATXN1; (+) strand; PAM type: NRG; PAM sequence: CAG
ggcgccagggctggcttagc

SEQ ID NO: 149539 - DNA, 20 bp, Artificial Sequence
  Description of Artificial Sequence: Synthetic oligonucleotide
  Target: ATXN1; (+) strand; PAM type: NRG; PAM sequence: AGG
gcgccagggctggcttagcc

SEQ ID NO: 149540 - DNA, 20 bp, Artificial Sequence
  Description of Artificial Sequence: Synthetic oligonucleotide
  Target: ATXN1; (+) strand; PAM type: NRG; PAM sequence: AAG
cagggctggcttagccagga

SEQ ID NO: 149541 - DNA, 20 bp, Artificial Sequence
  Description of Artificial Sequence: Synthetic oligonucleotide
  Target: ATXN1; (+) strand; PAM type: NRG; PAM sequence: CAG
ctggcttagccaggaaagta

SEQ ID NO: 149542 - DNA, 20 bp, Artificial Sequence
  Description of Artificial Sequence: Synthetic oligonucleotide
  Target: ATXN1; (+) strand; PAM type: NRG; PAM sequence: GAG
ggcttagccaggaaagtaca

SEQ ID NO: 149543 - DNA, 20 bp, Artificial Sequence
  Description of Artificial Sequence: Synthetic oligonucleotide
  Target: ATXN1; (+) strand; PAM type: NRG; PAM sequence: AAG
aggaaagtacagagtcacta

SEQ ID NO: 149544 - DNA, 20 bp, Artificial Sequence
  Description of Artificial Sequence: Synthetic oligonucleotide
  Target: ATXN1; (+) strand; PAM type: NRG; PAM sequence: TAG
cagagtcactaaagtctatg

SEQ ID NO: 149545 - DNA, 20 bp, Artificial Sequence
  Description of Artificial Sequence: Synthetic oligonucleotide
  Target: ATXN1; (+) strand; PAM type: NRG; PAM sequence: AGG
agagtcactaaagtctatgt

SEQ ID NO: 149546 - DNA, 20 bp, Artificial Sequence
  Description of Artificial Sequence: Synthetic oligonucleotide
  Target: ATXN1; (+) strand; PAM type: NRG; PAM sequence: AAG
aagtctatgtaggcaatgcc

SEQ ID NO: 149547 - DNA, 20 bp, Artificial Sequence
  Description of Artificial Sequence: Synthetic oligonucleotide
  Target: ATXN1; (+) strand; PAM type: NRG; PAM sequence: AGG
agtctatgtaggcaatgcca

SEQ ID NO: 149548 - DNA, 20 bp, Artificial Sequence
  Description of Artificial Sequence: Synthetic oligonucleotide
  Target: ATXN1; (+) strand; PAM type: NRG; PAM sequence: TGG
gtaggcaatgccaaggttgt

SEQ ID NO: 149549 - DNA, 20 bp, Artificial Sequence
  Description of Artificial Sequence: Synthetic oligonucleotide
  Target: ATXN1; (+) strand; PAM type: NRG; PAM sequence: GGG
taggcaatgccaaggttgtt

SEQ ID NO: 149550 - DNA, 20 bp, Artificial Sequence
  Description of Artificial Sequence: Synthetic oligonucleotide
  Target: ATXN1; (+) strand; PAM type: NRG; PAM sequence: GGG
aggcaatgccaaggttgttg

SEQ ID NO: 149551 - DNA, 20 bp, Artificial Sequence
  Description of Artificial Sequence: Synthetic oligonucleotide
  Target: ATXN1; (+) strand; PAM type: NRG; PAM sequence: GAG
gcaatgccaaggttgttggg

SEQ ID NO: 149552 - DNA, 20 bp, Artificial Sequence
  Description of Artificial Sequence: Synthetic oligonucleotide
  Target: ATXN1; (+) strand; PAM type: NRG; PAM sequence: CAG
caaggttgttggggagaata

SEQ ID NO: 149553 - DNA, 20 bp, Artificial Sequence
  Description of Artificial Sequence: Synthetic oligonucleotide
  Target: ATXN1; (+) strand; PAM type: NRG; PAM sequence: CAG
gggagaatacagtgtcttca

SEQ ID NO: 149554 - DNA, 20 bp, Artificial Sequence
  Description of Artificial Sequence: Synthetic oligonucleotide
  Target: ATXN1; (+) strand; PAM type: NRG; PAM sequence: AGG
ggagaatacagtgtcttcac

SEQ ID NO: 149555 - DNA, 20 bp, Artificial Sequence
  Description of Artificial Sequence: Synthetic oligonucleotide
  Target: ATXN1; (+) strand; PAM type: NRG; PAM sequence: AAG
aatacagtgtcttcacaggc

SEQ ID NO: 149556 - DNA, 20 bp, Artificial Sequence
  Description of Artificial Sequence: Synthetic oligonucleotide
  Target: ATXN1; (+) strand; PAM type: NRG; PAM sequence: AGG
atacagtgtcttcacaggca

SEQ ID NO: 149557 - DNA, 20 bp, Artificial Sequence
  Description of Artificial Sequence: Synthetic oligonucleotide
  Target: ATXN1; (+) strand; PAM type: NRG; PAM sequence: TAG
cttcacaggcaaggccaccc

SEQ ID NO: 149558 - DNA, 20 bp, Artificial Sequence
  Description of Artificial Sequence: Synthetic oligonucleotide
  Target: ATXN1; (+) strand; PAM type: NRG; PAM sequence: GAG
acaggcaaggccaccctagt

SEQ ID NO: 149559 - DNA, 20 bp, Artificial Sequence
  Description of Artificial Sequence: Synthetic oligonucleotide
  Target: ATXN1; (+) strand; PAM type: NRG; PAM sequence: TAG
ccaccctagtgagatgactg

SEQ ID NO: 149560 - DNA, 20 bp, Artificial Sequence
  Description of Artificial Sequence: Synthetic oligonucleotide
  Target: ATXN1; (+) strand; PAM type: NRG; PAM sequence: AGG
caccctagtgagatgactgt

SEQ ID NO: 149561 - DNA, 20 bp, Artificial Sequence
  Description of Artificial Sequence: Synthetic oligonucleotide
  Target: ATXN1; (+) strand; PAM type: NRG; PAM sequence: GGG
accctagtgagatgactgta

SEQ ID NO: 149562 - DNA, 20 bp, Artificial Sequence
  Description of Artificial Sequence: Synthetic oligonucleotide
  Target: ATXN1; (+) strand; PAM type: NRG; PAM sequence: GAG
cctagtgagatgactgtagg

SEQ ID NO: 149563 - DNA, 20 bp, Artificial Sequence
  Description of Artificial Sequence: Synthetic oligonucleotide
  Target: ATXN1; (+) strand; PAM type: NRG; PAM sequence: TAG
agtgagatgactgtagggag

SEQ ID NO: 149564 - DNA, 20 bp, Artificial Sequence
  Description of Artificial Sequence: Synthetic oligonucleotide
  Target: ATXN1; (+) strand; PAM type: NRG; PAM sequence: CAG
gagatgactgtagggagtag

SEQ ID NO: 149565 - DNA, 20 bp, Artificial Sequence
  Description of Artificial Sequence: Synthetic oligonucleotide
  Target: ATXN1; (+) strand; PAM type: NRG; PAM sequence: AGG
agatgactgtagggagtagc

SEQ ID NO: 149566 - DNA, 20 bp, Artificial Sequence
  Description of Artificial Sequence: Synthetic oligonucleotide
  Target: ATXN1; (+) strand; PAM type: NRG; PAM sequence: TGG
ggcaatgactgacatgttcc

SEQ ID NO: 149567 - DNA, 20 bp, Artificial Sequence
  Description of Artificial Sequence: Synthetic oligonucleotide
  Target: ATXN1; (+) strand; PAM type: NRG; PAM sequence: TAG
tgacatgttcctggtcccac

SEQ ID NO: 149568 - DNA, 20 bp, Artificial Sequence
  Description of Artificial Sequence: Synthetic oligonucleotide
  Target: ATXN1; (+) strand; PAM type: NRG; PAM sequence: AAG
tgttcctggtcccactagaa

SEQ ID NO: 149569 - DNA, 20 bp, Artificial Sequence
  Description of Artificial Sequence: Synthetic oligonucleotide
  Target: ATXN1; (+) strand; PAM type: NRG; PAM sequence: GAG
agaaaagccacccttctcct

SEQ ID NO: 149570 - DNA, 20 bp, Artificial Sequence
  Description of Artificial Sequence: Synthetic oligonucleotide
  Target: ATXN1; (+) strand; PAM type: NRG; PAM sequence: CAG
cacccttctcctgagatgaa

SEQ ID NO: 149571 - DNA, 20 bp, Artificial Sequence
  Description of Artificial Sequence: Synthetic oligonucleotide
  Target: ATXN1; (+) strand; PAM type: NRG; PAM sequence: GAG
cccttctcctgagatgaaca

SEQ ID NO: 149572 - DNA, 20 bp, Artificial Sequence
  Description of Artificial Sequence: Synthetic oligonucleotide
  Target: ATXN1; (+) strand; PAM type: NRG; PAM sequence: GAG
cttctcctgagatgaacaga

SEQ ID NO: 149573 - DNA, 20 bp, Artificial Sequence
  Description of Artificial Sequence: Synthetic oligonucleotide
  Target: ATXN1; (+) strand; PAM type: NRG; PAM sequence: AGG
ttctcctgagatgaacagag

SEQ ID NO: 149574 - DNA, 20 bp, Artificial Sequence
  Description of Artificial Sequence: Synthetic oligonucleotide
  Target: ATXN1; (+) strand; PAM type: NRG; PAM sequence: CAG
tcctgagatgaacagagagg

SEQ ID NO: 149575 - DNA, 20 bp, Artificial Sequence
  Description of Artificial Sequence: Synthetic oligonucleotide
  Target: ATXN1; (+) strand; PAM type: NRG; PAM sequence: AGG
cctgagatgaacagagaggc

SEQ ID NO: 149576 - DNA, 20 bp, Artificial Sequence
  Description of Artificial Sequence: Synthetic oligonucleotide
  Target: ATXN1; (+) strand; PAM type: NRG; PAM sequence: TGG
agaggcaggctatgtttgct

SEQ ID NO: 149577 - DNA, 20 bp, Artificial Sequence
  Description of Artificial Sequence: Synthetic oligonucleotide
  Target: ATXN1; (+) strand; PAM type: NRG; PAM sequence: CAG
gtttgcttggtgccacttaa

SEQ ID NO: 149578 - DNA, 20 bp, Artificial Sequence
  Description of Artificial Sequence: Synthetic oligonucleotide
  Target: ATXN1; (+) strand; PAM type: NRG; PAM sequence: AAG
gttccgattccctgctcacc

SEQ ID NO: 149579 - DNA, 20 bp, Artificial Sequence
  Description of Artificial Sequence: Synthetic oligonucleotide
  Target: ATXN1; (+) strand; PAM type: NRG; PAM sequence: TGG
agcaaacacctgactccata

SEQ ID NO: 149580 - DNA, 20 bp, Artificial Sequence
  Description of Artificial Sequence: Synthetic oligonucleotide
  Target: ATXN1; (+) strand; PAM type: NRG; PAM sequence: TAG
gactccatatggatcttcct

SEQ ID NO: 149581 - DNA, 20 bp, Artificial Sequence
  Description of Artificial Sequence: Synthetic oligonucleotide
  Target: ATXN1; (+) strand; PAM type: NRG; PAM sequence: GAG
ctccatatggatcttcctta

SEQ ID NO: 149582 - DNA, 20 bp, Artificial Sequence
  Description of Artificial Sequence: Synthetic oligonucleotide
  Target: ATXN1; (+) strand; PAM type: NRG; PAM sequence: GAG
ccatatggatcttccttaga

SEQ ID NO: 149583 - DNA, 20 bp, Artificial Sequence
  Description of Artificial Sequence: Synthetic oligonucleotide
  Target: ATXN1; (+) strand; PAM type: NRG; PAM sequence: CAG
gtgactgctgctgatacctg

SEQ ID NO: 149584 - DNA, 20 bp, Artificial Sequence
  Description of Artificial Sequence: Synthetic oligonucleotide
  Target: ATXN1; (+) strand; PAM type: NRG; PAM sequence: CAG
ctgctgctgatacctgcagc

SEQ ID NO: 149585 - DNA, 20 bp, Artificial Sequence
  Description of Artificial Sequence: Synthetic oligonucleotide
  Target: ATXN1; (+) strand; PAM type: NRG; PAM sequence: GAG
gctgctgatacctgcagcca

SEQ ID NO: 149586 - DNA, 20 bp, Artificial Sequence
  Description of Artificial Sequence: Synthetic oligonucleotide
  Target: ATXN1; (+) strand; PAM type: NRG; PAM sequence: GAG
tgctgatacctgcagccaga

SEQ ID NO: 149587 - DNA, 20 bp, Artificial Sequence
  Description of Artificial Sequence: Synthetic oligonucleotide
  Target: ATXN1; (+) strand; PAM type: NRG; PAM sequence: CAG
tgatacctgcagccagagag

SEQ ID NO: 149588 - DNA, 20 bp, Artificial Sequence
  Description of Artificial Sequence: Synthetic oligonucleotide
  Target: ATXN1; (+) strand; PAM type: NRG; PAM sequence: AAG
ccagagagcagcaatttctc

SEQ ID NO: 149589 - DNA, 20 bp, Artificial Sequence
  Description of Artificial Sequence: Synthetic oligonucleotide
  Target: ATXN1; (+) strand; PAM type: NRG; PAM sequence: AGG
cagagagcagcaatttctca

SEQ ID NO: 149590 - DNA, 20 bp, Artificial Sequence
  Description of Artificial Sequence: Synthetic oligonucleotide
  Target: ATXN1; (+) strand; PAM type: NRG; PAM sequence: AAG
tttctcaaggcacatcaata

SEQ ID NO: 149591 - DNA, 20 bp, Artificial Sequence
  Description of Artificial Sequence: Synthetic oligonucleotide
  Target: ATXN1; (+) strand; PAM type: NRG; PAM sequence: TAG
ctcaaggcacatcaataaag

SEQ ID NO: 149592 - DNA, 20 bp, Artificial Sequence
  Description of Artificial Sequence: Synthetic oligonucleotide
  Target: ATXN1; (+) strand; PAM type: NRG; PAM sequence: CAG
cacatcaataaagtagcttc

SEQ ID NO: 149593 - DNA, 20 bp, Artificial Sequence
  Description of Artificial Sequence: Synthetic oligonucleotide
  Target: ATXN1; (+) strand; PAM type: NRG; PAM sequence: TAG
tcaataaagtagcttccagt

SEQ ID NO: 149594 - DNA, 20 bp, Artificial Sequence
  Description of Artificial Sequence: Synthetic oligonucleotide
  Target: ATXN1; (+) strand; PAM type: NRG; PAM sequence: AGG
caataaagtagcttccagtt

SEQ ID NO: 149595 - DNA, 20 bp, Artificial Sequence
  Description of Artificial Sequence: Synthetic oligonucleotide
  Target: ATXN1; (+) strand; PAM type: NRG; PAM sequence: CAG
ttaggatttacattcccatg

SEQ ID NO: 149596 - DNA, 20 bp, Artificial Sequence
  Description of Artificial Sequence: Synthetic oligonucleotide
  Target: ATXN1; (+) strand; PAM type: NRG; PAM sequence: CAG
cattcccatgcagcttaaca

SEQ ID NO: 149597 - DNA, 20 bp, Artificial Sequence
  Description of Artificial Sequence: Synthetic oligonucleotide
  Target: ATXN1; (+) strand; PAM type: NRG; PAM sequence: GAG
ttcccatgcagcttaacaca

SEQ ID NO: 149598 - DNA, 20 bp, Artificial Sequence
  Description of Artificial Sequence: Synthetic oligonucleotide
  Target: ATXN1; (+) strand; PAM type: NRG; PAM sequence: GAG
cccatgcagcttaacacaga

SEQ ID NO: 149599 - DNA, 20 bp, Artificial Sequence
  Description of Artificial Sequence: Synthetic oligonucleotide
  Target: ATXN1; (+) strand; PAM type: NRG; PAM sequence: GAG
catgcagcttaacacagaga

SEQ ID NO: 149600 - DNA, 20 bp, Artificial Sequence
  Description of Artificial Sequence: Synthetic oligonucleotide
  Target: ATXN1; (+) strand; PAM type: NRG; PAM sequence: TGG
gagagaatgtgctcatcatg

SEQ ID NO: 149601 - DNA, 20 bp, Artificial Sequence
  Description of Artificial Sequence: Synthetic oligonucleotide
  Target: ATXN1; (+) strand; PAM type: NRG; PAM sequence: GGG
agagaatgtgctcatcatgt

SEQ ID NO: 149602 - DNA, 20 bp, Artificial Sequence
  Description of Artificial Sequence: Synthetic oligonucleotide
  Target: ATXN1; (+) strand; PAM type: NRG; PAM sequence: GAG
gtgctcatcatgtgggcctt

SEQ ID NO: 149603 - DNA, 20 bp, Artificial Sequence
  Description of Artificial Sequence: Synthetic oligonucleotide
  Target: ATXN1; (+) strand; PAM type: NRG; PAM sequence: GAG
gctcatcatgtgggccttga

SEQ ID NO: 149604 - DNA, 20 bp, Artificial Sequence
  Description of Artificial Sequence: Synthetic oligonucleotide
  Target: ATXN1; (+) strand; PAM type: NRG; PAM sequence: TAG
tgtgggccttgagagtatgt

SEQ ID NO: 149605 - DNA, 20 bp, Artificial Sequence
  Description of Artificial Sequence: Synthetic oligonucleotide
  Target: ATXN1; (+) strand; PAM type: NRG; PAM sequence: TGG
ccttgagagtatgttagtaa

SEQ ID NO: 149606 - DNA, 20 bp, Artificial Sequence
  Description of Artificial Sequence: Synthetic oligonucleotide
  Target: ATXN1; (+) strand; PAM type: NRG; PAM sequence: CGG
gttagtaatggtttccactg

SEQ ID NO: 149607 - DNA, 20 bp, Artificial Sequence
  Description of Artificial Sequence: Synthetic oligonucleotide
  Target: ATXN1; (+) strand; PAM type: NRG; PAM sequence: TGG
tccactgcggattaacattc

SEQ ID NO: 149608 - DNA, 20 bp, Artificial Sequence
  Description of Artificial Sequence: Synthetic oligonucleotide
  Target: ATXN1; (+) strand; PAM type: NRG; PAM sequence: TGG
attctggcataacgatctcg

SEQ ID NO: 149609 - DNA, 20 bp, Artificial Sequence
  Description of Artificial Sequence: Synthetic oligonucleotide
  Target: ATXN1; (+) strand; PAM type: NRG; PAM sequence: GGG
ttctggcataacgatctcgt

SEQ ID NO: 149610 - DNA, 20 bp, Artificial Sequence
  Description of Artificial Sequence: Synthetic oligonucleotide
  Target: ATXN1; (+) strand; PAM type: NRG; PAM sequence: GAG
cataacgatctcgtgggtct

SEQ ID NO: 149611 - DNA, 20 bp, Artificial Sequence
  Description of Artificial Sequence: Synthetic oligonucleotide
  Target: ATXN1; (+) strand; PAM type: NRG; PAM sequence: AGG
ataacgatctcgtgggtctg

SEQ ID NO: 149612 - DNA, 20 bp, Artificial Sequence
  Description of Artificial Sequence: Synthetic oligonucleotide
  Target: ATXN1; (+) strand; PAM type: NRG; PAM sequence: TGG
tcgtgggtctgaggatatgc

SEQ ID NO: 149613 - DNA, 20 bp, Artificial Sequence
  Description of Artificial Sequence: Synthetic oligonucleotide
  Target: ATXN1; (+) strand; PAM type: NRG; PAM sequence: TGG
ctgaggatatgctggcatca

SEQ ID NO: 149614 - DNA, 20 bp, Artificial Sequence
  Description of Artificial Sequence: Synthetic oligonucleotide
  Target: ATXN1; (+) strand; PAM type: NRG; PAM sequence: CAG
ctggcatcatggtctcaact

SEQ ID NO: 149615 - DNA, 20 bp, Artificial Sequence
  Description of Artificial Sequence: Synthetic oligonucleotide
  Target: ATXN1; (+) strand; PAM type: NRG; PAM sequence: AGG
tggcatcatggtctcaactc

SEQ ID NO: 149616 - DNA, 20 bp, Artificial Sequence
  Description of Artificial Sequence: Synthetic oligonucleotide
  Target: ATXN1; (+) strand; PAM type: NRG; PAM sequence: TGG
tctcaactcaggctcatctg

SEQ ID NO: 149617 - DNA, 20 bp, Artificial Sequence
  Description of Artificial Sequence: Synthetic oligonucleotide
  Target: ATXN1; (+) strand; PAM type: NRG; PAM sequence: TAG
actcaggctcatctgtggca

SEQ ID NO: 149618 - DNA, 20 bp, Artificial Sequence
  Description of Artificial Sequence: Synthetic oligonucleotide
  Target: ATXN1; (+) strand; PAM type: NRG; PAM sequence: CAG
tgtggcatagctctctgaat

SEQ ID NO: 149619 - DNA, 20 bp, Artificial Sequence
  Description of Artificial Sequence: Synthetic oligonucleotide
  Target: ATXN1; (+) strand; PAM type: NRG; PAM sequence: TGG
catagctctctgaatcagca

SEQ ID NO: 149620 - DNA, 20 bp, Artificial Sequence
  Description of Artificial Sequence: Synthetic oligonucleotide
  Target: ATXN1; (+) strand; PAM type: NRG; PAM sequence: AAG
gctctctgaatcagcatggc

SEQ ID NO: 149621 - DNA, 20 bp, Artificial Sequence
  Description of Artificial Sequence: Synthetic oligonucleotide
  Target: ATXN1; (+) strand; PAM type: NRG; PAM sequence: TGG
tgaatcagcatggcaagccc

SEQ ID NO: 149622 - DNA, 20 bp, Artificial Sequence
  Description of Artificial Sequence: Synthetic oligonucleotide
  Target: ATXN1; (+) strand; PAM type: NRG; PAM sequence: CAG
agcatggcaagccctggaca

SEQ ID NO: 149623 - DNA, 20 bp, Artificial Sequence
  Description of Artificial Sequence: Synthetic oligonucleotide
  Target: ATXN1; (+) strand; PAM type: NRG; PAM sequence: CAG
ggcaagccctggacacagac

SEQ ID NO: 149624 - DNA, 20 bp, Artificial Sequence
  Description of Artificial Sequence: Synthetic oligonucleotide
  Target: ATXN1; (+) strand; PAM type: NRG; PAM sequence: AAG
aagccctggacacagaccag

SEQ ID NO: 149625 - DNA, 20 bp, Artificial Sequence
  Description of Artificial Sequence: Synthetic oligonucleotide
  Target: ATXN1; (+) strand; PAM type: NRG; PAM sequence: TAG
cacagaccagaagccatctc

SEQ ID NO: 149626 - DNA, 20 bp, Artificial Sequence
  Description of Artificial Sequence: Synthetic oligonucleotide
  Target: ATXN1; (+) strand; PAM type: NRG; PAM sequence: AAG
aagccatctctagtctccaa

SEQ ID NO: 149627 - DNA, 20 bp, Artificial Sequence
  Description of Artificial Sequence: Synthetic oligonucleotide
  Target: ATXN1; (+) strand; PAM type: NRG; PAM sequence: CAG
ccatctctagtctccaaaag

SEQ ID NO: 149628 - DNA, 20 bp, Artificial Sequence
  Description of Artificial Sequence: Synthetic oligonucleotide
  Target: ATXN1; (+) strand; PAM type: NRG; PAM sequence: AGG
catctctagtctccaaaagc

SEQ ID NO: 149629 - DNA, 20 bp, Artificial Sequence
  Description of Artificial Sequence: Synthetic oligonucleotide
  Target: ATXN1; (+) strand; PAM type: NRG; PAM sequence: GGG
atctctagtctccaaaagca

SEQ ID NO: 149630 - DNA, 20 bp, Artificial Sequence
  Description of Artificial Sequence: Synthetic oligonucleotide
  Target: ATXN1; (+) strand; PAM type: NRG; PAM sequence: GGG
tctctagtctccaaaagcag

SEQ ID NO: 149631 - DNA, 20 bp, Artificial Sequence
  Description of Artificial Sequence: Synthetic oligonucleotide
  Target: ATXN1; (+) strand; PAM type: NRG; PAM sequence: CAG
ctagtctccaaaagcagggg

SEQ ID NO: 149632 - DNA, 20 bp, Artificial Sequence
  Description of Artificial Sequence: Synthetic oligonucleotide
  Target: ATXN1; (+) strand; PAM type: NRG; PAM sequence: AAG
gtctccaaaagcaggggcag

SEQ ID NO: 149633 - DNA, 20 bp, Artificial Sequence
  Description of Artificial Sequence: Synthetic oligonucleotide
  Target: ATXN1; (+) strand; PAM type: NRG; PAM sequence: AGG
tctccaaaagcaggggcaga

SEQ ID NO: 149634 - DNA, 20 bp, Artificial Sequence
  Description of Artificial Sequence: Synthetic oligonucleotide
  Target: ATXN1; (+) strand; PAM type: NRG; PAM sequence: CGG
ccaaaagcaggggcagaagg

SEQ ID NO: 149635 - DNA, 20 bp, Artificial Sequence
  Description of Artificial Sequence: Synthetic oligonucleotide
  Target: ATXN1; (+) strand; PAM type: NRG; PAM sequence: CAG
cagaaggcggcgatcgtatg

SEQ ID NO: 149636 - DNA, 20 bp, Artificial Sequence
  Description of Artificial Sequence: Synthetic oligonucleotide
  Target: ATXN1; (+) strand; PAM type: NRG; PAM sequence: CAG
gcggcgatcgtatgcagatc

SEQ ID NO: 149637 - DNA, 20 bp, Artificial Sequence
  Description of Artificial Sequence: Synthetic oligonucleotide
  Target: ATXN1; (+) strand; PAM type: NRG; PAM sequence: CAG
cgatcgtatgcagatccagc

SEQ ID NO: 149638 - DNA, 20 bp, Artificial Sequence
  Description of Artificial Sequence: Synthetic oligonucleotide
  Target: ATXN1; (+) strand; PAM type: NRG; PAM sequence: CAG
atccagccagccctcgctga

SEQ ID NO: 149639 - DNA, 20 bp, Artificial Sequence
  Description of Artificial Sequence: Synthetic oligonucleotide
  Target: ATXN1; (+) strand; PAM type: NRG; PAM sequence: TGG
gccagccctcgctgacagca

SEQ ID NO: 149640 - DNA, 20 bp, Artificial Sequence
  Description of Artificial Sequence: Synthetic oligonucleotide
  Target: ATXN1; (+) strand; PAM type: NRG; PAM sequence: TGG
catggcttacacgccacttc

SEQ ID NO: 149641 - DNA, 20 bp, Artificial Sequence
  Description of Artificial Sequence: Synthetic oligonucleotide
  Target: ATXN1; (+) strand; PAM type: NRG; PAM sequence: CAG
tcactttcaactgattttca

SEQ ID NO: 149642 - DNA, 20 bp, Artificial Sequence
  Description of Artificial Sequence: Synthetic oligonucleotide
  Target: ATXN1; (+) strand; PAM type: NRG; PAM sequence: GAG
actttcaactgattttcaca

SEQ ID NO: 149643 - DNA, 20 bp, Artificial Sequence
  Description of Artificial Sequence: Synthetic oligonucleotide
  Target: ATXN1; (+) strand; PAM type: NRG; PAM sequence: TAG
ctgattttcacagagctgtt

SEQ ID NO: 149644 - DNA, 20 bp, Artificial Sequence
  Description of Artificial Sequence: Synthetic oligonucleotide
  Target: ATXN1; (+) strand; PAM type: NRG; PAM sequence: AGG
tgattttcacagagctgttt

SEQ ID NO: 149645 - DNA, 20 bp, Artificial Sequence
  Description of Artificial Sequence: Synthetic oligonucleotide
  Target: ATXN1; (+) strand; PAM type: NRG; PAM sequence: AAG
cagagctgtttaggatgatg

SEQ ID NO: 149646 - DNA, 20 bp, Artificial Sequence
  Description of Artificial Sequence: Synthetic oligonucleotide
  Target: ATXN1; (+) strand; PAM type: NRG; PAM sequence: AAG
tgtttaggatgatgaagcca

SEQ ID NO: 149647 - DNA, 20 bp, Artificial Sequence
  Description of Artificial Sequence: Synthetic oligonucleotide
  Target: ATXN1; (+) strand; PAM type: NRG; PAM sequence: TGG
gatgatgaagccaaagaacc

SEQ ID NO: 149648 - DNA, 20 bp, Artificial Sequence
  Description of Artificial Sequence: Synthetic oligonucleotide
  Target: ATXN1; (+) strand; PAM type: NRG; PAM sequence: CAG
agccaaagaacctggtgctt

SEQ ID NO: 149649 - DNA, 20 bp, Artificial Sequence
  Description of Artificial Sequence: Synthetic oligonucleotide
  Target: ATXN1; (+) strand; PAM type: NRG; PAM sequence: AGG
gccaaagaacctggtgcttc

SEQ ID NO: 149650 - DNA, 20 bp, Artificial Sequence
  Description of Artificial Sequence: Synthetic oligonucleotide
  Target: ATXN1; (+) strand; PAM type: NRG; PAM sequence: AAG
gaacctggtgcttcaggaca

SEQ ID NO: 149651 - DNA, 20 bp, Artificial Sequence
  Description of Artificial Sequence: Synthetic oligonucleotide
  Target: ATXN1; (+) strand; PAM type: NRG; PAM sequence: TAG
tttgcttccctatacatgta

SEQ ID NO: 149652 - DNA, 20 bp, Artificial Sequence
  Description of Artificial Sequence: Synthetic oligonucleotide
  Target: ATXN1; (+) strand; PAM type: NRG; PAM sequence: TGG
ttccctatacatgtatagaa

SEQ ID NO: 149653 - DNA, 20 bp, Artificial Sequence
  Description of Artificial Sequence: Synthetic oligonucleotide
  Target: ATXN1; (+) strand; PAM type: NRG; PAM sequence: TGG
tacatgtatagaatggaaac

SEQ ID NO: 149654 - DNA, 20 bp, Artificial Sequence
  Description of Artificial Sequence: Synthetic oligonucleotide
  Target: ATXN1; (+) strand; PAM type: NRG; PAM sequence: AAG
tatagaatggaaactggcac

SEQ ID NO: 149655 - DNA, 20 bp, Artificial Sequence
  Description of Artificial Sequence: Synthetic oligonucleotide
  Target: ATXN1; (+) strand; PAM type: NRG; PAM sequence: AAG
aactggcacaagatttaatt

SEQ ID NO: 149656 - DNA, 20 bp, Artificial Sequence
  Description of Artificial Sequence: Synthetic oligonucleotide
  Target: ATXN1; (+) strand; PAM type: NRG; PAM sequence: CAG
taattaagtgatgtaaaaac

SEQ ID NO: 149657 - DNA, 20 bp, Artificial Sequence
  Description of Artificial Sequence: Synthetic oligonucleotide
  Target: ATXN1; (+) strand; PAM type: NRG; PAM sequence: GAG
attaagtgatgtaaaaacca

SEQ ID NO: 149658 - DNA, 20 bp, Artificial Sequence
  Description of Artificial Sequence: Synthetic oligonucleotide
  Target: ATXN1; (+) strand; PAM type: NRG; PAM sequence: AGG
ttaagtgatgtaaaaaccag

SEQ ID NO: 149659 - DNA, 20 bp, Artificial Sequence
  Description of Artificial Sequence: Synthetic oligonucleotide
  Target: ATXN1; (+) strand; PAM type: NRG; PAM sequence: AAG
gtgatgtaaaaaccagagga

SEQ ID NO: 149660 - DNA, 20 bp, Artificial Sequence
  Description of Artificial Sequence: Synthetic oligonucleotide
  Target: ATXN1; (+) strand; PAM type: NRG; PAM sequence: AAG
aaaaccagaggaaagtaaat

SEQ ID NO: 149661 - DNA, 20 bp, Artificial Sequence
  Description of Artificial Sequence: Synthetic oligonucleotide
  Target: ATXN1; (+) strand; PAM type: NRG; PAM sequence: GAG
aaccagaggaaagtaaataa

SEQ ID NO: 149662 - DNA, 20 bp, Artificial Sequence
  Description of Artificial Sequence: Synthetic oligonucleotide
  Target: ATXN1; (+) strand; PAM type: NRG; PAM sequence: CAG
aggaaagtaaataagagcaa

SEQ ID NO: 149663 - DNA, 20 bp, Artificial Sequence
  Description of Artificial Sequence: Synthetic oligonucleotide
  Target: ATXN1; (+) strand; PAM type: NRG; PAM sequence: CAG
gagcaacagccaaatatcca

SEQ ID NO: 149664 - DNA, 20 bp, Artificial Sequence
  Description of Artificial Sequence: Synthetic oligonucleotide
  Target: ATXN1; (+) strand; PAM type: NRG; PAM sequence: TAG
caaatatccacagtaccaat

SEQ ID NO: 149665 - DNA, 20 bp, Artificial Sequence
  Description of Artificial Sequence: Synthetic oligonucleotide
  Target: ATXN1; (+) strand; PAM type: NRG; PAM sequence: TGG
ccacagtaccaattagtgac

SEQ ID NO: 149666 - DNA, 20 bp, Artificial Sequence
  Description of Artificial Sequence: Synthetic oligonucleotide
  Target: ATXN1; (+) strand; PAM type: NRG; PAM sequence: CAG
cagtaccaattagtgactgg

SEQ ID NO: 149667 - DNA, 20 bp, Artificial Sequence
  Description of Artificial Sequence: Synthetic oligonucleotide
  Target: ATXN1; (+) strand; PAM type: NRG; PAM sequence: GAG
gtaccaattagtgactggca

SEQ ID NO: 149668 - DNA, 20 bp, Artificial Sequence
  Description of Artificial Sequence: Synthetic oligonucleotide
  Target: ATXN1; (+) strand; PAM type: NRG; PAM sequence: AAG
tggcagagttgccacacaac

SEQ ID NO: 149669 - DNA, 20 bp, Artificial Sequence
  Description of Artificial Sequence: Synthetic oligonucleotide
  Target: ATXN1; (+) strand; PAM type: NRG; PAM sequence: AGG
ggcagagttgccacacaaca

SEQ ID NO: 149670 - DNA, 20 bp, Artificial Sequence
  Description of Artificial Sequence: Synthetic oligonucleotide
  Target: ATXN1; (+) strand; PAM type: NRG; PAM sequence: CAG
acacaacaaggtgcaatgaa

SEQ ID NO: 149671 - DNA, 20 bp, Artificial Sequence
  Description of Artificial Sequence: Synthetic oligonucleotide
  Target: ATXN1; (+) strand; PAM type: NRG; PAM sequence: TAG
tctttaaaaaatctaaatca

SEQ ID NO: 149672 - DNA, 20 bp, Artificial Sequence
  Description of Artificial Sequence: Synthetic oligonucleotide
  Target: ATXN1; (+) strand; PAM type: NRG; PAM sequence: AAG
aaaaaatctaaatcatagtg

SEQ ID NO: 149673 - DNA, 20 bp, Artificial Sequence
  Description of Artificial Sequence: Synthetic oligonucleotide
  Target: ATXN1; (+) strand; PAM type: NRG; PAM sequence: AGG
aaaaatctaaatcatagtga

SEQ ID NO: 149674 - DNA, 20 bp, Artificial Sequence
  Description of Artificial Sequence: Synthetic oligonucleotide
  Target: ATXN1; (+) strand; PAM type: NRG; PAM sequence: GGG
aaaatctaaatcatagtgaa

SEQ ID NO: 149675 - DNA, 20 bp, Artificial Sequence
  Description of Artificial Sequence: Synthetic oligonucleotide
  Target: ATXN1; (+) strand; PAM type: NRG; PAM sequence: CAG
agtgaagggtcaatgatgcc

SEQ ID NO: 149676 - DNA, 20 bp, Artificial Sequence
  Description of Artificial Sequence: Synthetic oligonucleotide
  Target: ATXN1; (+) strand; PAM type: NRG; PAM sequence: CAG
caatgatgcccagaaaatgc

SEQ ID NO: 149677 - DNA, 20 bp, Artificial Sequence
  Description of Artificial Sequence: Synthetic oligonucleotide
  Target: ATXN1; (+) strand; PAM type: NRG; PAM sequence: AAG
gccagctcttttgccctatt

SEQ ID NO: 149678 - DNA, 20 bp, Artificial Sequence
  Description of Artificial Sequence: Synthetic oligonucleotide
  Target: ATXN1; (+) strand; PAM type: NRG; PAM sequence: CAG
agctcttttgccctattaag

SEQ ID NO: 149679 - DNA, 20 bp, Artificial Sequence
  Description of Artificial Sequence: Synthetic oligonucleotide
  Target: ATXN1; (+) strand; PAM type: NRG; PAM sequence: AAG
gccctattaagcagaaaaca

SEQ ID NO: 149680 - DNA, 20 bp, Artificial Sequence
  Description of Artificial Sequence: Synthetic oligonucleotide
  Target: ATXN1; (+) strand; PAM type: NRG; PAM sequence: AGG
ccctattaagcagaaaacaa

SEQ ID NO: 149681 - DNA, 20 bp, Artificial Sequence
  Description of Artificial Sequence: Synthetic oligonucleotide
  Target: ATXN1; (+) strand; PAM type: NRG; PAM sequence: CAG
ttaagcagaaaacaaaggct

SEQ ID NO: 149682 - DNA, 20 bp, Artificial Sequence
  Description of Artificial Sequence: Synthetic oligonucleotide
  Target: ATXN1; (+) strand; PAM type: NRG; PAM sequence: TAG
gaaaacaaaggctcagtgta

SEQ ID NO: 149683 - DNA, 20 bp, Artificial Sequence
  Description of Artificial Sequence: Synthetic oligonucleotide
  Target: ATXN1; (+) strand; PAM type: NRG; PAM sequence: AAG
aacaaaggctcagtgtatag

SEQ ID NO: 149684 - DNA, 20 bp, Artificial Sequence
  Description of Artificial Sequence: Synthetic oligonucleotide
  Target: ATXN1; (+) strand; PAM type: NRG; PAM sequence: TAG
aaggctcagtgtatagaagt

SEQ ID NO: 149685 - DNA, 20 bp, Artificial Sequence
  Description of Artificial Sequence: Synthetic oligonucleotide
  Target: ATXN1; (+) strand; PAM type: NRG; PAM sequence: TAG
tatagaagttagaaaacttt

SEQ ID NO: 149686 - DNA, 20 bp, Artificial Sequence
  Description of Artificial Sequence: Synthetic oligonucleotide
  Target: ATXN1; (+) strand; PAM type: NRG; PAM sequence: CAG
ttttagccacaaaaatatga

SEQ ID NO: 149687 - DNA, 20 bp, Artificial Sequence
  Description of Artificial Sequence: Synthetic oligonucleotide
  Target: ATXN1; (+) strand; PAM type: NRG; PAM sequence: TGG
atgcctcttaataatatgca

SEQ ID NO: 149688 - DNA, 20 bp, Artificial Sequence
  Description of Artificial Sequence: Synthetic oligonucleotide
  Target: ATXN1; (+) strand; PAM type: NRG; PAM sequence: GGG
tgcctcttaataatatgcat

SEQ ID NO: 149689 - DNA, 20 bp, Artificial Sequence
  Description of Artificial Sequence: Synthetic oligonucleotide
  Target: ATXN1; (+) strand; PAM type: NRG; PAM sequence: GGG
gcctcttaataatatgcatg

SEQ ID NO: 149690 - DNA, 20 bp, Artificial Sequence
  Description of Artificial Sequence: Synthetic oligonucleotide
  Target: ATXN1; (+) strand; PAM type: NRG; PAM sequence: AAG
atatgcatggggcaaaatga

SEQ ID NO: 149691 - DNA, 20 bp, Artificial Sequence
  Description of Artificial Sequence: Synthetic oligonucleotide
  Target: ATXN1; (+) strand; PAM type: NRG; PAM sequence: GAG
atgcatggggcaaaatgaaa

SEQ ID NO: 149692 - DNA, 20 bp, Artificial Sequence
  Description of Artificial Sequence: Synthetic oligonucleotide
  Target: ATXN1; (+) strand; PAM type: NRG; PAM sequence: CAG
ggcaaaatgaaagagcattc

SEQ ID NO: 149693 - DNA, 20 bp, Artificial Sequence
  Description of Artificial Sequence: Synthetic oligonucleotide
  Target: ATXN1; (+) strand; PAM type: NRG; PAM sequence: AAG
aaatgaaagagcattccaga

SEQ ID NO: 149694 - DNA, 20 bp, Artificial Sequence
  Description of Artificial Sequence: Synthetic oligonucleotide
  Target: ATXN1; (+) strand; PAM type: NRG; PAM sequence: AAG
tgaaagagcattccagaaag

SEQ ID NO: 149695 - DNA, 20 bp, Artificial Sequence
  Description of Artificial Sequence: Synthetic oligonucleotide
  Target: ATXN1; (+) strand; PAM type: NRG; PAM sequence: AGG
gaaagagcattccagaaaga

SEQ ID NO: 149696 - DNA, 20 bp, Artificial Sequence
  Description of Artificial Sequence: Synthetic oligonucleotide
  Target: ATXN1; (+) strand; PAM type: NRG; PAM sequence: CAG
gagcattccagaaagaaggt

SEQ ID NO: 149697 - DNA, 20 bp, Artificial Sequence
  Description of Artificial Sequence: Synthetic oligonucleotide
  Target: ATXN1; (+) strand; PAM type: NRG; PAM sequence: CAG
ctgttttgcctaaatcttgc

SEQ ID NO: 149698 - DNA, 20 bp, Artificial Sequence
  Description of Artificial Sequence: Synthetic oligonucleotide
  Target: ATXN1; (+) strand; PAM type: NRG; PAM sequence: AGG
tgttttgcctaaatcttgcc

SEQ ID NO: 149699 - DNA, 20 bp, Artificial Sequence
  Description of Artificial Sequence: Synthetic oligonucleotide
  Target: ATXN1; (+) strand; PAM type: NRG; PAM sequence: AAG
taaatcttgccaggatatgc

SEQ ID NO: 149700 - DNA, 20 bp, Artificial Sequence
  Description of Artificial Sequence: Synthetic oligonucleotide
  Target: ATXN1; (+) strand; PAM type: NRG; PAM sequence: AGG
aaatcttgccaggatatgca

SEQ ID NO: 149701 - DNA, 20 bp, Artificial Sequence
  Description of Artificial Sequence: Synthetic oligonucleotide
  Target: ATXN1; (+) strand; PAM type: NRG; PAM sequence: AAG
aggccaaatgcccccaaacc

SEQ ID NO: 149702 - DNA, 20 bp, Artificial Sequence
  Description of Artificial Sequence: Synthetic oligonucleotide
  Target: ATXN1; (+) strand; PAM type: NRG; PAM sequence: AGG
ggccaaatgcccccaaacca

SEQ ID NO: 149703 - DNA, 20 bp, Artificial Sequence
  Description of Artificial Sequence: Synthetic oligonucleotide
  Target: ATXN1; (+) strand; PAM type: NRG; PAM sequence: AAG
caaatgcccccaaaccaagg

SEQ ID NO: 149704 - DNA, 20 bp, Artificial Sequence
  Description of Artificial Sequence: Synthetic oligonucleotide
  Target: ATXN1; (+) strand; PAM type: NRG; PAM sequence: AGG
aaatgcccccaaaccaagga

SEQ ID NO: 149705 - DNA, 20 bp, Artificial Sequence
  Description of Artificial Sequence: Synthetic oligonucleotide
  Target: ATXN1; (+) strand; PAM type: NRG; PAM sequence: CGG
gaaaacaaaactaactgcaa

SEQ ID NO: 149706 - DNA, 20 bp, Artificial Sequence
  Description of Artificial Sequence: Synthetic oligonucleotide
  Target: ATXN1; (+) strand; PAM type: NRG; PAM sequence: GAG
aaacaaaactaactgcaacg

SEQ ID NO: 149707 - DNA, 20 bp, Artificial Sequence
  Description of Artificial Sequence: Synthetic oligonucleotide
  Target: ATXN1; (+) strand; PAM type: NRG; PAM sequence: AAG
aaaactaactgcaacggagc

SEQ ID NO: 149708 - DNA, 20 bp, Artificial Sequence
  Description of Artificial Sequence: Synthetic oligonucleotide
  Target: ATXN1; (+) strand; PAM type: NRG; PAM sequence: AAG
tgcaacggagcaagaatgca

SEQ ID NO: 149709 - DNA, 20 bp, Artificial Sequence
  Description of Artificial Sequence: Synthetic oligonucleotide
  Target: ATXN1; (+) strand; PAM type: NRG; PAM sequence: CAG
tcatttttctccttctgttc

SEQ ID NO: 149710 - DNA, 20 bp, Artificial Sequence
  Description of Artificial Sequence: Synthetic oligonucleotide
  Target: ATXN1; (+) strand; PAM type: NRG; PAM sequence: TAG
gttccagaacttctaaccta

SEQ ID NO: 149711 - DNA, 20 bp, Artificial Sequence
  Description of Artificial Sequence: Synthetic oligonucleotide
  Target: ATXN1; (+) strand; PAM type: NRG; PAM sequence: AGG
ttccagaacttctaacctat

SEQ ID NO: 149712 - DNA, 20 bp, Artificial Sequence
  Description of Artificial Sequence: Synthetic oligonucleotide
  Target: ATXN1; (+) strand; PAM type: NRG; PAM sequence: CAG
ataggtcatgcttataccca

SEQ ID NO: 149713 - DNA, 20 bp, Artificial Sequence
  Description of Artificial Sequence: Synthetic oligonucleotide
  Target: ATXN1; (+) strand; PAM type: NRG; PAM sequence: AAG
ggtcatgcttatacccacag

SEQ ID NO: 149714 - DNA, 20 bp, Artificial Sequence
  Description of Artificial Sequence: Synthetic oligonucleotide
  Target: ATXN1; (+) strand; PAM type: NRG; PAM sequence: AAG
cttatacccacagaagaacc

SEQ ID NO: 149715 - DNA, 20 bp, Artificial Sequence
  Description of Artificial Sequence: Synthetic oligonucleotide
  Target: ATXN1; (+) strand; PAM type: NRG; PAM sequence: AGG
ttatacccacagaagaacca

SEQ ID NO: 149716 - DNA, 20 bp, Artificial Sequence
  Description of Artificial Sequence: Synthetic oligonucleotide
  Target: ATXN1; (+) strand; PAM type: NRG; PAM sequence: GGG
tatacccacagaagaaccaa

SEQ ID NO: 149717 - DNA, 20 bp, Artificial Sequence
  Description of Artificial Sequence: Synthetic oligonucleotide
  Target: ATXN1; (+) strand; PAM type: NRG; PAM sequence: GAG
tacccacagaagaaccaagg

SEQ ID NO: 149718 - DNA, 20 bp, Artificial Sequence
  Description of Artificial Sequence: Synthetic oligonucleotide
  Target: ATXN1; (+) strand; PAM type: NRG; PAM sequence: AAG
cacagaagaaccaagggagt

SEQ ID NO: 149719 - DNA, 20 bp, Artificial Sequence
  Description of Artificial Sequence: Synthetic oligonucleotide
  Target: ATXN1; (+) strand; PAM type: NRG; PAM sequence: AGG
acagaagaaccaagggagta

SEQ ID NO: 149720 - DNA, 20 bp, Artificial Sequence
  Description of Artificial Sequence: Synthetic oligonucleotide
  Target: ATXN1; (+) strand; PAM type: NRG; PAM sequence: AAG
gaagaaccaagggagtaagg

SEQ ID NO: 149721 - DNA, 20 bp, Artificial Sequence
  Description of Artificial Sequence: Synthetic oligonucleotide
  Target: ATXN1; (+) strand; PAM type: NRG; PAM sequence: TGG
caagggagtaaggaagctgc

SEQ ID NO: 149722 - DNA, 20 bp, Artificial Sequence
  Description of Artificial Sequence: Synthetic oligonucleotide
  Target: ATXN1; (+) strand; PAM type: NRG; PAM sequence: AAG
aaggaagctgctggtttcca

SEQ ID NO: 149723 - DNA, 20 bp, Artificial Sequence
  Description of Artificial Sequence: Synthetic oligonucleotide
  Target: ATXN1; (+) strand; PAM type: NRG; PAM sequence: AAG
atgcttacttcccatttgca

SEQ ID NO: 149724 - DNA, 20 bp, Artificial Sequence
  Description of Artificial Sequence: Synthetic oligonucleotide
  Target: ATXN1; (+) strand; PAM type: NRG; PAM sequence: TGG
ccatttgcaaagcgtttcgc

SEQ ID NO: 149725 - DNA, 20 bp, Artificial Sequence
  Description of Artificial Sequence: Synthetic oligonucleotide
  Target: ATXN1; (+) strand; PAM type: NRG; PAM sequence: GAG
ttcgctggaaatgctgtgtt

SEQ ID NO: 149726 - DNA, 20 bp, Artificial Sequence
  Description of Artificial Sequence: Synthetic oligonucleotide
  Target: ATXN1; (+) strand; PAM type: NRG; PAM sequence: TAG
gttgagttacaccatccaac

SEQ ID NO: 149727 - DNA, 20 bp, Artificial Sequence
  Description of Artificial Sequence: Synthetic oligonucleotide
  Target: ATXN1; (+) strand; PAM type: NRG; PAM sequence: AGG
ttgagttacaccatccaact

SEQ ID NO: 149728 - DNA, 20 bp, Artificial Sequence
  Description of Artificial Sequence: Synthetic oligonucleotide
  Target: ATXN1; (+) strand; PAM type: NRG; PAM sequence: TGG
attaaatatattatgctctt

SEQ ID NO: 149729 - DNA, 20 bp, Artificial Sequence
  Description of Artificial Sequence: Synthetic oligonucleotide
  Target: ATXN1; (+) strand; PAM type: NRG; PAM sequence: CAG
attatcaaaatgtaaaccaa

SEQ ID NO: 149730 - DNA, 20 bp, Artificial Sequence
  Description of Artificial Sequence: Synthetic oligonucleotide
  Target: ATXN1; (+) strand; PAM type: NRG; PAM sequence: CAG
aaaatgtaaaccaacagcta

SEQ ID NO: 149731 - DNA, 20 bp, Artificial Sequence
  Description of Artificial Sequence: Synthetic oligonucleotide
  Target: ATXN1; (+) strand; PAM type: NRG; PAM sequence: TGG
atgtaaaccaacagctacag

SEQ ID NO: 149732 - DNA, 20 bp, Artificial Sequence
  Description of Artificial Sequence: Synthetic oligonucleotide
  Target: ATXN1; (+) strand; PAM type: NRG; PAM sequence: GAG
gtaaaccaacagctacagtg

SEQ ID NO: 149733 - DNA, 20 bp, Artificial Sequence
  Description of Artificial Sequence: Synthetic oligonucleotide
  Target: ATXN1; (+) strand; PAM type: NRG; PAM sequence: AAG
tggagaccatctgaactgcc

SEQ ID NO: 149734 - DNA, 20 bp, Artificial Sequence
  Description of Artificial Sequence: Synthetic oligonucleotide
  Target: ATXN1; (+) strand; PAM type: NRG; PAM sequence: GAG
gagaccatctgaactgccaa

SEQ ID NO: 149735 - DNA, 20 bp, Artificial Sequence
  Description of Artificial Sequence: Synthetic oligonucleotide
  Target: ATXN1; (+) strand; PAM type: NRG; PAM sequence: TAG
gagttttaacactgtgattt

SEQ ID NO: 149736 - DNA, 20 bp, Artificial Sequence
  Description of Artificial Sequence: Synthetic oligonucleotide
  Target: ATXN1; (+) strand; PAM type: NRG; PAM sequence: GAG
tttaacactgtgattttagt

SEQ ID NO: 149737 - DNA, 20 bp, Artificial Sequence
  Description of Artificial Sequence: Synthetic oligonucleotide
  Target: ATXN1; (+) strand; PAM type: NRG; PAM sequence: AAG
acactgtgattttagtgaga

SEQ ID NO: 149738 - DNA, 20 bp, Artificial Sequence
  Description of Artificial Sequence: Synthetic oligonucleotide
  Target: ATXN1; (+) strand; PAM type: NRG; PAM sequence: TAG
agaacatttcccctgctgtt

SEQ ID NO: 149739 - DNA, 20 bp, Artificial Sequence
  Description of Artificial Sequence: Synthetic oligonucleotide
  Target: ATXN1; (+) strand; PAM type: NRG; PAM sequence: CAG
ttcccctgctgtttagtttt

SEQ ID NO: 149740 - DNA, 20 bp, Artificial Sequence
  Description of Artificial Sequence: Synthetic oligonucleotide
  Target: ATXN1; (+) strand; PAM type: NRG; PAM sequence: AAG
ctgctgtttagttttcagct

SEQ ID NO: 149741 - DNA, 20 bp, Artificial Sequence
  Description of Artificial Sequence: Synthetic oligonucleotide
  Target: ATXN1; (+) strand; PAM type: NRG; PAM sequence: CAG
gtttagttttcagctaagtt

SEQ ID NO: 149742 - DNA, 20 bp, Artificial Sequence
  Description of Artificial Sequence: Synthetic oligonucleotide
  Target: ATXN1; (+) strand; PAM type: NRG; PAM sequence: TAG
gttttcagctaagttcagcc

SEQ ID NO: 149743 - DNA, 20 bp, Artificial Sequence
  Description of Artificial Sequence: Synthetic oligonucleotide
  Target: ATXN1; (+) strand; PAM type: NRG; PAM sequence: TAG
ctaagttcagcctagctgtt

SEQ ID NO: 149744 - DNA, 20 bp, Artificial Sequence
  Description of Artificial Sequence: Synthetic oligonucleotide
  Target: ATXN1; (+) strand; PAM type: NRG; PAM sequence: CAG
cagcctagctgtttagtttt

SEQ ID NO: 149745 - DNA, 20 bp, Artificial Sequence
  Description of Artificial Sequence: Synthetic oligonucleotide
  Target: ATXN1; (+) strand; PAM type: NRG; PAM sequence: TAG
ctagctgtttagttttcagc

SEQ ID NO: 149746 - DNA, 20 bp, Artificial Sequence
  Description of Artificial Sequence: Synthetic oligonucleotide
  Target: ATXN1; (+) strand; PAM type: NRG; PAM sequence: AAG
ttttcagctagcttcataca

SEQ ID NO: 149747 - DNA, 20 bp, Artificial Sequence
  Description of Artificial Sequence: Synthetic oligonucleotide
  Target: ATXN1; (+) strand; PAM type: NRG; PAM sequence: CAG
aaagctgtgcattgtacgca

SEQ ID NO: 149748 - DNA, 20 bp, Artificial Sequence
  Description of Artificial Sequence: Synthetic oligonucleotide
  Target: ATXN1; (+) strand; PAM type: NRG; PAM sequence: AAG
gtgcacacaatgtatacatg

SEQ ID NO: 149749 - DNA, 20 bp, Artificial Sequence
  Description of Artificial Sequence: Synthetic oligonucleotide
  Target: ATXN1; (+) strand; PAM type: NRG; PAM sequence: TAG
caaccacacacttttgttca

SEQ ID NO: 149750 - DNA, 20 bp, Artificial Sequence
  Description of Artificial Sequence: Synthetic oligonucleotide
  Target: ATXN1; (+) strand; PAM type: NRG; PAM sequence: AGG
aaccacacacttttgttcat

SEQ ID NO: 149751 - DNA, 20 bp, Artificial Sequence
  Description of Artificial Sequence: Synthetic oligonucleotide
  Target: ATXN1; (+) strand; PAM type: NRG; PAM sequence: TGG
ttttgttcataggtttttac

SEQ ID NO: 149752 - DNA, 20 bp, Artificial Sequence
  Description of Artificial Sequence: Synthetic oligonucleotide
  Target: ATXN1; (+) strand; PAM type: NRG; PAM sequence: GGG
tttgttcataggtttttact

SEQ ID NO: 149753 - DNA, 20 bp, Artificial Sequence
  Description of Artificial Sequence: Synthetic oligonucleotide
  Target: ATXN1; (+) strand; PAM type: NRG; PAM sequence: TAG
ttttactgggaattttcaca

SEQ ID NO: 149754 - DNA, 20 bp, Artificial Sequence
  Description of Artificial Sequence: Synthetic oligonucleotide
  Target: ATXN1; (+) strand; PAM type: NRG; PAM sequence: AGG
tttactgggaattttcacat

SEQ ID NO: 149755 - DNA, 20 bp, Artificial Sequence
  Description of Artificial Sequence: Synthetic oligonucleotide
  Target: ATXN1; (+) strand; PAM type: NRG; PAM sequence: AAG
attttcacataggattcatt

SEQ ID NO: 149756 - DNA, 20 bp, Artificial Sequence
  Description of Artificial Sequence: Synthetic oligonucleotide
  Target: ATXN1; (+) strand; PAM type: NRG; PAM sequence: AAG
cacataggattcattaagtg

SEQ ID NO: 149757 - DNA, 20 bp, Artificial Sequence
  Description of Artificial Sequence: Synthetic oligonucleotide
  Target: ATXN1; (+) strand; PAM type: NRG; PAM sequence: AGG
acataggattcattaagtga

SEQ ID NO: 149758 - DNA, 20 bp, Artificial Sequence
  Description of Artificial Sequence: Synthetic oligonucleotide
  Target: ATXN1; (+) strand; PAM type: NRG; PAM sequence: TAG
attcattaagtgaaggtatg

SEQ ID NO: 149759 - DNA, 20 bp, Artificial Sequence
  Description of Artificial Sequence: Synthetic oligonucleotide
  Target: ATXN1; (+) strand; PAM type: NRG; PAM sequence: AAG
tgataaaactgtcatttcct

SEQ ID NO: 149760 - DNA, 20 bp, Artificial Sequence
  Description of Artificial Sequence: Synthetic oligonucleotide
  Target: ATXN1; (+) strand; PAM type: NRG; PAM sequence: TGG
tttttctacccaccataatt

SEQ ID NO: 149761 - DNA, 20 bp, Artificial Sequence
  Description of Artificial Sequence: Synthetic oligonucleotide
  Target: ATXN1; (+) strand; PAM type: NRG; PAM sequence: GGG
ttttctacccaccataattt

SEQ ID NO: 149762 - DNA, 20 bp, Artificial Sequence
  Description of Artificial Sequence: Synthetic oligonucleotide
  Target: ATXN1; (+) strand; PAM type: NRG; PAM sequence: AAG
tctacccaccataatttggg

SEQ ID NO: 149763 - DNA, 20 bp, Artificial Sequence
  Description of Artificial Sequence: Synthetic oligonucleotide
  Target: ATXN1; (+) strand; PAM type: NRG; PAM sequence: TGG
acccaccataatttgggaag

SEQ ID NO: 149764 - DNA, 20 bp, Artificial Sequence
  Description of Artificial Sequence: Synthetic oligonucleotide
  Target: ATXN1; (+) strand; PAM type: NRG; PAM sequence: TAG
ggctttgtttctctgactac

SEQ ID NO: 149765 - DNA, 20 bp, Artificial Sequence
  Description of Artificial Sequence: Synthetic oligonucleotide
  Target: ATXN1; (+) strand; PAM type: NRG; PAM sequence: TGG
tctctgactactagacttcc

SEQ ID NO: 149766 - DNA, 20 bp, Artificial Sequence
  Description of Artificial Sequence: Synthetic oligonucleotide
  Target: ATXN1; (+) strand; PAM type: NRG; PAM sequence: GGG
ctctgactactagacttcct

SEQ ID NO: 149767 - DNA, 20 bp, Artificial Sequence
  Description of Artificial Sequence: Synthetic oligonucleotide
  Target: ATXN1; (+) strand; PAM type: NRG; PAM sequence: GGG
tctgactactagacttcctg

SEQ ID NO: 149768 - DNA, 20 bp, Artificial Sequence
  Description of Artificial Sequence: Synthetic oligonucleotide
  Target: ATXN1; (+) strand; PAM type: NRG; PAM sequence: CGG
gggactctgtctttatttcc

SEQ ID NO: 149769 - DNA, 20 bp, Artificial Sequence
  Description of Artificial Sequence: Synthetic oligonucleotide
  Target: ATXN1; (+) strand; PAM type: NRG; PAM sequence: GGG
ggactctgtctttatttccc

SEQ ID NO: 149770 - DNA, 20 bp, Artificial Sequence
  Description of Artificial Sequence: Synthetic oligonucleotide
  Target: ATXN1; (+) strand; PAM type: NRG; PAM sequence: GGG
gactctgtctttatttcccg

SEQ ID NO: 149771 - DNA, 20 bp, Artificial Sequence
  Description of Artificial Sequence: Synthetic oligonucleotide
  Target: ATXN1; (+) strand; PAM type: NRG; PAM sequence: CAG
tttatttcccataacatttg

SEQ ID NO: 149772 - DNA, 20 bp, Artificial Sequence
  Description of Artificial Sequence: Synthetic oligonucleotide
  Target: ATXN1; (+) strand; PAM type: NRG; PAM sequence: GAG
tatttcccataacatttgca

SEQ ID NO: 149773 - DNA, 20 bp, Artificial Sequence
  Description of Artificial Sequence: Synthetic oligonucleotide
  Target: ATXN1; (+) strand; PAM type: NRG; PAM sequence: GAG
cagagtgccatgcacacaat

SEQ ID NO: 149774 - DNA, 20 bp, Artificial Sequence
  Description of Artificial Sequence: Synthetic oligonucleotide
  Target: ATXN1; (+) strand; PAM type: NRG; PAM sequence: AAG
tccacaatatcaacgcaatt

SEQ ID NO: 149775 - DNA, 20 bp, Artificial Sequence
  Description of Artificial Sequence: Synthetic oligonucleotide
  Target: ATXN1; (+) strand; PAM type: NRG; PAM sequence: GAG
cacaatatcaacgcaattaa

SEQ ID NO: 149776 - DNA, 20 bp, Artificial Sequence
  Description of Artificial Sequence: Synthetic oligonucleotide
  Target: ATXN1; (+) strand; PAM type: NRG; PAM sequence: TGG
caacgcaattaagagaaatc

SEQ ID NO: 149777 - DNA, 20 bp, Artificial Sequence
  Description of Artificial Sequence: Synthetic oligonucleotide
  Target: ATXN1; (+) strand; PAM type: NRG; PAM sequence: AAG
ttcacgtgaatttatgatac

SEQ ID NO: 149778 - DNA, 20 bp, Artificial Sequence
  Description of Artificial Sequence: Synthetic oligonucleotide
  Target: ATXN1; (+) strand; PAM type: NRG; PAM sequence: AAG
atttatgatacaagcaaaat

SEQ ID NO: 149779 - DNA, 20 bp, Artificial Sequence
  Description of Artificial Sequence: Synthetic oligonucleotide
  Target: ATXN1; (+) strand; PAM type: NRG; PAM sequence: AAG
aataagcacaacaaatttta

SEQ ID NO: 149780 - DNA, 20 bp, Artificial Sequence
  Description of Artificial Sequence: Synthetic oligonucleotide
  Target: ATXN1; (+) strand; PAM type: NRG; PAM sequence: TAG
caacaaattttaaagctctt

SEQ ID NO: 149781 - DNA, 20 bp, Artificial Sequence
  Description of Artificial Sequence: Synthetic oligonucleotide
  Target: ATXN1; (+) strand; PAM type: NRG; PAM sequence: TAG
tagtcctctgtcttcttata

SEQ ID NO: 149782 - DNA, 20 bp, Artificial Sequence
  Description of Artificial Sequence: Synthetic oligonucleotide
  Target: ATXN1; (+) strand; PAM type: NRG; PAM sequence: CAG
ttcttatatagaaaactatt

SEQ ID NO: 149783 - DNA, 20 bp, Artificial Sequence
  Description of Artificial Sequence: Synthetic oligonucleotide
  Target: ATXN1; (+) strand; PAM type: NRG; PAM sequence: CAG
tttctacatcaaaaattctc

SEQ ID NO: 149784 - DNA, 20 bp, Artificial Sequence
  Description of Artificial Sequence: Synthetic oligonucleotide
  Target: ATXN1; (+) strand; PAM type: NRG; PAM sequence: AGG
ttctacatcaaaaattctcc

SEQ ID NO: 149785 - DNA, 20 bp, Artificial Sequence
  Description of Artificial Sequence: Synthetic oligonucleotide
  Target: ATXN1; (+) strand; PAM type: NRG; PAM sequence: GGG
tctacatcaaaaattctcca

SEQ ID NO: 149786 - DNA, 20 bp, Artificial Sequence
  Description of Artificial Sequence: Synthetic oligonucleotide
  Target: ATXN1; (+) strand; PAM type: NRG; PAM sequence: AAG
acatcaaaaattctccaggg

SEQ ID NO: 149787 - DNA, 20 bp, Artificial Sequence
  Description of Artificial Sequence: Synthetic oligonucleotide
  Target: ATXN1; (+) strand; PAM type: NRG; PAM sequence: AGG
catcaaaaattctccaggga

SEQ ID NO: 149788 - DNA, 20 bp, Artificial Sequence
  Description of Artificial Sequence: Synthetic oligonucleotide
  Target: ATXN1; (+) strand; PAM type: NRG; PAM sequence: AAG
tttttttatacattccccca

SEQ ID NO: 149789 - DNA, 20 bp, Artificial Sequence
  Description of Artificial Sequence: Synthetic oligonucleotide
  Target: ATXN1; (+) strand; PAM type: NRG; PAM sequence: CAG
ttatacattcccccaaagca

SEQ ID NO: 149790 - DNA, 20 bp, Artificial Sequence
  Description of Artificial Sequence: Synthetic oligonucleotide
  Target: ATXN1; (+) strand; PAM type: NRG; PAM sequence: AGG
tatacattcccccaaagcac

SEQ ID NO: 149791 - DNA, 20 bp, Artificial Sequence
  Description of Artificial Sequence: Synthetic oligonucleotide
  Target: ATXN1; (+) strand; PAM type: NRG; PAM sequence: AAG
acattcccccaaagcacagg

SEQ ID NO: 149792 - DNA, 20 bp, Artificial Sequence
  Description of Artificial Sequence: Synthetic oligonucleotide
  Target: ATXN1; (+) strand; PAM type: NRG; PAM sequence: AAG
tcccccaaagcacaggaaga

SEQ ID NO: 149793 - DNA, 20 bp, Artificial Sequence
  Description of Artificial Sequence: Synthetic oligonucleotide
  Target: ATXN1; (+) strand; PAM type: NRG; PAM sequence: GAG
ccccaaagcacaggaagaaa

SEQ ID NO: 149794 - DNA, 20 bp, Artificial Sequence
  Description of Artificial Sequence: Synthetic oligonucleotide
  Target: ATXN1; (+) strand; PAM type: NRG; PAM sequence: TAG
atttcatttgtgcaaattga

SEQ ID NO: 149795 - DNA, 20 bp, Artificial Sequence
  Description of Artificial Sequence: Synthetic oligonucleotide
  Target: ATXN1; (+) strand; PAM type: NRG; PAM sequence: CAG
ccttttgaattcatgctaaa

SEQ ID NO: 149796 - DNA, 20 bp, Artificial Sequence
  Description of Artificial Sequence: Synthetic oligonucleotide
  Target: ATXN1; (+) strand; PAM type: NRG; PAM sequence: AAG
gctaaacagctaaatgtcgc

SEQ ID NO: 149797 - DNA, 20 bp, Artificial Sequence
  Description of Artificial Sequence: Synthetic oligonucleotide
  Target: ATXN1; (+) strand; PAM type: NRG; PAM sequence: CAG
aaacagctaaatgtcgcaag

SEQ ID NO: 149798 - DNA, 20 bp, Artificial Sequence
  Description of Artificial Sequence: Synthetic oligonucleotide
  Target: ATXN1; (+) strand; PAM type: NRG; PAM sequence: AAG
gcatgctgtcaaaaactgtc

SEQ ID NO: 149799 - DNA, 20 bp, Artificial Sequence
  Description of Artificial Sequence: Synthetic oligonucleotide
  Target: ATXN1; (+) strand; PAM type: NRG; PAM sequence: TGG
caagtgaaataattattgat

SEQ ID NO: 149800 - DNA, 20 bp, Artificial Sequence
  Description of Artificial Sequence: Synthetic oligonucleotide
  Target: ATXN1; (+) strand; PAM type: NRG; PAM sequence: TAG
attaaaattaaaaacgaatg

SEQ ID NO: 149801 - DNA, 20 bp, Artificial Sequence
  Description of Artificial Sequence: Synthetic oligonucleotide
  Target: ATXN1; (+) strand; PAM type: NRG; PAM sequence: AAG
cgaatgtagattaataaatg

SEQ ID NO: 149802 - DNA, 20 bp, Artificial Sequence
  Description of Artificial Sequence: Synthetic oligonucleotide
  Target: ATXN1; (+) strand; PAM type: NRG; PAM sequence: TGG
tgtagattaataaatgaaga

SEQ ID NO: 149803 - DNA, 20 bp, Artificial Sequence
  Description of Artificial Sequence: Synthetic oligonucleotide
  Target: ATXN1; (+) strand; PAM type: NRG; PAM sequence: AAG
taataaatgaagatggcttt

SEQ ID NO: 149804 - DNA, 20 bp, Artificial Sequence
  Description of Artificial Sequence: Synthetic oligonucleotide
  Target: ATXN1; (+) strand; PAM type: NRG; PAM sequence: AAG
atgaagatggctttaagaaa

SEQ ID NO: 149805 - DNA, 20 bp, Artificial Sequence
  Description of Artificial Sequence: Synthetic oligonucleotide
  Target: ATXN1; (+) strand; PAM type: NRG; PAM sequence: TAG
aaaagcatgtcatctacaac

SEQ ID NO: 149806 - DNA, 20 bp, Artificial Sequence
  Description of Artificial Sequence: Synthetic oligonucleotide
  Target: ATXN1; (+) strand; PAM type: NRG; PAM sequence: CAG
ctacaactagaaaaacccga

SEQ ID NO: 149807 - DNA, 20 bp, Artificial Sequence
  Description of Artificial Sequence: Synthetic oligonucleotide
  Target: ATXN1; (+) strand; PAM type: NRG; PAM sequence: CAG
aaacccgacagcgaatctgc

SEQ ID NO: 149808 - DNA, 20 bp, Artificial Sequence
  Description of Artificial Sequence: Synthetic oligonucleotide
  Target: ATXN1; (+) strand; PAM type: NRG; PAM sequence: CAG
ccgacagcgaatctgccagt

SEQ ID NO: 149809 - DNA, 20 bp, Artificial Sequence
  Description of Artificial Sequence: Synthetic oligonucleotide
  Target: ATXN1; (+) strand; PAM type: NRG; PAM sequence: AGG
cgacagcgaatctgccagtc

SEQ ID NO: 149810 - DNA, 20 bp, Artificial Sequence
  Description of Artificial Sequence: Synthetic oligonucleotide
  Target: ATXN1; (+) strand; PAM type: NRG; PAM sequence: GGG
gacagcgaatctgccagtca

SEQ ID NO: 149811 - DNA, 20 bp, Artificial Sequence
  Description of Artificial Sequence: Synthetic oligonucleotide
  Target: ATXN1; (+) strand; PAM type: NRG; PAM sequence: TAG
gaatctgccagtcagggcta

SEQ ID NO: 149812 - DNA, 20 bp, Artificial Sequence
  Description of Artificial Sequence: Synthetic oligonucleotide
  Target: ATXN1; (+) strand; PAM type: NRG; PAM sequence: AGG
aatctgccagtcagggctat

SEQ ID NO: 149813 - DNA, 20 bp, Artificial Sequence
  Description of Artificial Sequence: Synthetic oligonucleotide
  Target: ATXN1; (+) strand; PAM type: NRG; PAM sequence: GGG
atctgccagtcagggctata

SEQ ID NO: 149814 - DNA, 20 bp, Artificial Sequence
  Description of Artificial Sequence: Synthetic oligonucleotide
  Target: ATXN1; (+) strand; PAM type: NRG; PAM sequence: TAG
ccagtcagggctatagggct

SEQ ID NO: 149815 - DNA, 20 bp, Artificial Sequence
  Description of Artificial Sequence: Synthetic oligonucleotide
  Target: ATXN1; (+) strand; PAM type: NRG; PAM sequence: AAG
ggctatagggcttagaatga

SEQ ID NO: 149816 - DNA, 20 bp, Artificial Sequence
  Description of Artificial Sequence: Synthetic oligonucleotide
  Target: ATXN1; (+) strand; PAM type: NRG; PAM sequence: AAG
gggcttagaatgaaagatta

SEQ ID NO: 149817 - DNA, 20 bp, Artificial Sequence
  Description of Artificial Sequence: Synthetic oligonucleotide
  Target: ATXN1; (+) strand; PAM type: NRG; PAM sequence: GAG
gcttagaatgaaagattaaa

SEQ ID NO: 149818 - DNA, 20 bp, Artificial Sequence
  Description of Artificial Sequence: Synthetic oligonucleotide
  Target: ATXN1; (+) strand; PAM type: NRG; PAM sequence: AGG
cttagaatgaaagattaaag

SEQ ID NO: 149819 - DNA, 20 bp, Artificial Sequence
  Description of Artificial Sequence: Synthetic oligonucleotide
  Target: ATXN1; (+) strand; PAM type: NRG; PAM sequence: AAG
tgaaagattaaagaggaaac

SEQ ID NO: 149820 - DNA, 20 bp, Artificial Sequence
  Description of Artificial Sequence: Synthetic oligonucleotide
  Target: ATXN1; (+) strand; PAM type: NRG; PAM sequence: AAG
attaaagaggaaacaagaat

SEQ ID NO: 149821 - DNA, 20 bp, Artificial Sequence
  Description of Artificial Sequence: Synthetic oligonucleotide
  Target: ATXN1; (+) strand; PAM type: NRG; PAM sequence: AAG
aaagaggaaacaagaataag

SEQ ID NO: 149822 - DNA, 20 bp, Artificial Sequence
  Description of Artificial Sequence: Synthetic oligonucleotide
  Target: ATXN1; (+) strand; PAM type: NRG; PAM sequence: TGG
gataaaaattaaccacacaa

SEQ ID NO: 149823 - DNA, 20 bp, Artificial Sequence
  Description of Artificial Sequence: Synthetic oligonucleotide
  Target: ATXN1; (+) strand; PAM type: NRG; PAM sequence: CAG
gcctttgtgacaacccatga

SEQ ID NO: 149824 - DNA, 20 bp, Artificial Sequence
  Description of Artificial Sequence: Synthetic oligonucleotide
  Target: ATXN1; (+) strand; PAM type: NRG; PAM sequence: GAG
tgtgacaacccatgacagct

SEQ ID NO: 149825 - DNA, 20 bp, Artificial Sequence
  Description of Artificial Sequence: Synthetic oligonucleotide
  Target: ATXN1; (+) strand; PAM type: NRG; PAM sequence: TAG
acaacccatgacagctgaga

SEQ ID NO: 149826 - DNA, 20 bp, Artificial Sequence
  Description of Artificial Sequence: Synthetic oligonucleotide
  Target: ATXN1; (+) strand; PAM type: NRG; PAM sequence: AGG
caacccatgacagctgagat

SEQ ID NO: 149827 - DNA, 20 bp, Artificial Sequence
  Description of Artificial Sequence: Synthetic oligonucleotide
  Target: ATXN1; (+) strand; PAM type: NRG; PAM sequence: CGG
gacagctgagataggctctc

SEQ ID NO: 149828 - DNA, 20 bp, Artificial Sequence
  Description of Artificial Sequence: Synthetic oligonucleotide
  Target: ATXN1; (+) strand; PAM type: NRG; PAM sequence: TGG
gctgagataggctctccgga

SEQ ID NO: 149829 - DNA, 20 bp, Artificial Sequence
  Description of Artificial Sequence: Synthetic oligonucleotide
  Target: ATXN1; (+) strand; PAM type: NRG; PAM sequence: CAG
cccacctgtccttccttttc

SEQ ID NO: 149830 - DNA, 20 bp, Artificial Sequence
  Description of Artificial Sequence: Synthetic oligonucleotide
  Target: ATXN1; (+) strand; PAM type: NRG; PAM sequence: TGG
agcccctgacataaatgtca

SEQ ID NO: 149831 - DNA, 20 bp, Artificial Sequence
  Description of Artificial Sequence: Synthetic oligonucleotide
  Target: ATXN1; (+) strand; PAM type: NRG; PAM sequence: CGG
cataaatgtcatggatttcc

SEQ ID NO: 149832 - DNA, 20 bp, Artificial Sequence
  Description of Artificial Sequence: Synthetic oligonucleotide
  Target: ATXN1; (+) strand; PAM type: NRG; PAM sequence: GGG
ataaatgtcatggatttccc

SEQ ID NO: 149833 - DNA, 20 bp, Artificial Sequence
  Description of Artificial Sequence: Synthetic oligonucleotide
  Target: ATXN1; (+) strand; PAM type: NRG; PAM sequence: TGG
aatgtcatggatttcccggg

SEQ ID NO: 149834 - DNA, 20 bp, Artificial Sequence
  Description of Artificial Sequence: Synthetic oligonucleotide
  Target: ATXN1; (+) strand; PAM type: NRG; PAM sequence: GGG
atgtcatggatttcccgggt

SEQ ID NO: 149835 - DNA, 20 bp, Artificial Sequence
  Description of Artificial Sequence: Synthetic oligonucleotide
  Target: ATXN1; (+) strand; PAM type: NRG; PAM sequence: AAG
ccaatgaccactgttcttct

SEQ ID NO: 149836 - DNA, 20 bp, Artificial Sequence
  Description of Artificial Sequence: Synthetic oligonucleotide
  Target: ATXN1; (+) strand; PAM type: NRG; PAM sequence: GAG
aatgaccactgttcttctaa

SEQ ID NO: 149837 - DNA, 20 bp, Artificial Sequence
  Description of Artificial Sequence: Synthetic oligonucleotide
  Target: ATXN1; (+) strand; PAM type: NRG; PAM sequence: CAG
accactgttcttctaagaga

SEQ ID NO: 149838 - DNA, 20 bp, Artificial Sequence
  Description of Artificial Sequence: Synthetic oligonucleotide
  Target: ATXN1; (+) strand; PAM type: NRG; PAM sequence: AGG
ccactgttcttctaagagac

SEQ ID NO: 149839 - DNA, 20 bp, Artificial Sequence
  Description of Artificial Sequence: Synthetic oligonucleotide
  Target: ATXN1; (+) strand; PAM type: NRG; PAM sequence: GAG
actgttcttctaagagacag

SEQ ID NO: 149840 - DNA, 20 bp, Artificial Sequence
  Description of Artificial Sequence: Synthetic oligonucleotide
  Target: ATXN1; (+) strand; PAM type: NRG; PAM sequence: GAG
tgttcttctaagagacagga

SEQ ID NO: 149841 - DNA, 20 bp, Artificial Sequence
  Description of Artificial Sequence: Synthetic oligonucleotide
  Target: ATXN1; (+) strand; PAM type: NRG; PAM sequence: AGG
gttcttctaagagacaggag

SEQ ID NO: 149842 - DNA, 20 bp, Artificial Sequence
  Description of Artificial Sequence: Synthetic oligonucleotide
  Target: ATXN1; (+) strand; PAM type: NRG; PAM sequence: TGG
ctaagagacaggagaggacc

SEQ ID NO: 149843 - DNA, 20 bp, Artificial Sequence
  Description of Artificial Sequence: Synthetic oligonucleotide
  Target: ATXN1; (+) strand; PAM type: NRG; PAM sequence: CAG
agacaggagaggacctggta

SEQ ID NO: 149844 - DNA, 20 bp, Artificial Sequence
  Description of Artificial Sequence: Synthetic oligonucleotide
  Target: ATXN1; (+) strand; PAM type: NRG; PAM sequence: CAG
gagaggacctggtacagaca

SEQ ID NO: 149845 - DNA, 20 bp, Artificial Sequence
  Description of Artificial Sequence: Synthetic oligonucleotide
  Target: ATXN1; (+) strand; PAM type: NRG; PAM sequence: GAG
gaggacctggtacagacaca

SEQ ID NO: 149846 - DNA, 20 bp, Artificial Sequence
  Description of Artificial Sequence: Synthetic oligonucleotide
  Target: ATXN1; (+) strand; PAM type: NRG; PAM sequence: AGG
aggacctggtacagacacag

SEQ ID NO: 149847 - DNA, 20 bp, Artificial Sequence
  Description of Artificial Sequence: Synthetic oligonucleotide
  Target: ATXN1; (+) strand; PAM type: NRG; PAM sequence: GAG
gacctggtacagacacagag

SEQ ID NO: 149848 - DNA, 20 bp, Artificial Sequence
  Description of Artificial Sequence: Synthetic oligonucleotide
  Target: ATXN1; (+) strand; PAM type: NRG; PAM sequence: AAG
ctggtacagacacagaggag

SEQ ID NO: 149849 - DNA, 20 bp, Artificial Sequence
  Description of Artificial Sequence: Synthetic oligonucleotide
  Target: ATXN1; (+) strand; PAM type: NRG; PAM sequence: AGG
tggtacagacacagaggaga

SEQ ID NO: 149850 - DNA, 20 bp, Artificial Sequence
  Description of Artificial Sequence: Synthetic oligonucleotide
  Target: ATXN1; (+) strand; PAM type: NRG; PAM sequence: CAG
aggagaaggccatgtgaaaa

SEQ ID NO: 149851 - DNA, 20 bp, Artificial Sequence
  Description of Artificial Sequence: Synthetic oligonucleotide
  Target: ATXN1; (+) strand; PAM type: NRG; PAM sequence: GAG
gagaaggccatgtgaaaaca

SEQ ID NO: 149852 - DNA, 20 bp, Artificial Sequence
  Description of Artificial Sequence: Synthetic oligonucleotide
  Target: ATXN1; (+) strand; PAM type: NRG; PAM sequence: AGG
agaaggccatgtgaaaacag

SEQ ID NO: 149853 - DNA, 20 bp, Artificial Sequence
  Description of Artificial Sequence: Synthetic oligonucleotide
  Target: ATXN1; (+) strand; PAM type: NRG; PAM sequence: CAG
aggccatgtgaaaacagagg

SEQ ID NO: 149854 - DNA, 20 bp, Artificial Sequence
  Description of Artificial Sequence: Synthetic oligonucleotide
  Target: ATXN1; (+) strand; PAM type: NRG; PAM sequence: GAG
gccatgtgaaaacagaggca

SEQ ID NO: 149855 - DNA, 20 bp, Artificial Sequence
  Description of Artificial Sequence: Synthetic oligonucleotide
  Target: ATXN1; (+) strand; PAM type: NRG; PAM sequence: TGG
gtgaaaacagaggcagagac

SEQ ID NO: 149856 - DNA, 20 bp, Artificial Sequence
  Description of Artificial Sequence: Synthetic oligonucleotide
  Target: ATXN1; (+) strand; PAM type: NRG; PAM sequence: GAG
gaaaacagaggcagagactg

SEQ ID NO: 149857 - DNA, 20 bp, Artificial Sequence
  Description of Artificial Sequence: Synthetic oligonucleotide
  Target: ATXN1; (+) strand; PAM type: NRG; PAM sequence: AAG
gactggagtgacgctgccac

SEQ ID NO: 149858 - DNA, 20 bp, Artificial Sequence
  Description of Artificial Sequence: Synthetic oligonucleotide
  Target: ATXN1; (+) strand; PAM type: NRG; PAM sequence: AAG
gagtgacgctgccacaagcc

SEQ ID NO: 149859 - DNA, 20 bp, Artificial Sequence
  Description of Artificial Sequence: Synthetic oligonucleotide
  Target: ATXN1; (+) strand; PAM type: NRG; PAM sequence: AGG
agtgacgctgccacaagcca

SEQ ID NO: 149860 - DNA, 20 bp, Artificial Sequence
  Description of Artificial Sequence: Synthetic oligonucleotide
  Target: ATXN1; (+) strand; PAM type: NRG; PAM sequence: TGG
gccacaagccaaggaacgcc

SEQ ID NO: 149861 - DNA, 20 bp, Artificial Sequence
  Description of Artificial Sequence: Synthetic oligonucleotide
  Target: ATXN1; (+) strand; PAM type: NRG; PAM sequence: CAG
caaggaacgcctggaaccac

SEQ ID NO: 149862 - DNA, 20 bp, Artificial Sequence
  Description of Artificial Sequence: Synthetic oligonucleotide
  Target: ATXN1; (+) strand; PAM type: NRG; PAM sequence: GAG
aggaacgcctggaaccacca

SEQ ID NO: 149863 - DNA, 20 bp, Artificial Sequence
  Description of Artificial Sequence: Synthetic oligonucleotide
  Target: ATXN1; (+) strand; PAM type: NRG; PAM sequence: AGG
ggaacgcctggaaccaccag

SEQ ID NO: 149864 - DNA, 20 bp, Artificial Sequence
  Description of Artificial Sequence: Synthetic oligonucleotide
  Target: ATXN1; (+) strand; PAM type: NRG; PAM sequence: CAG
ctggaaccaccagaggatga

SEQ ID NO: 149865 - DNA, 20 bp, Artificial Sequence
  Description of Artificial Sequence: Synthetic oligonucleotide
  Target: ATXN1; (+) strand; PAM type: NRG; PAM sequence: CGG
gaaccaccagaggatgacag

SEQ ID NO: 149866 - DNA, 20 bp, Artificial Sequence
  Description of Artificial Sequence: Synthetic oligonucleotide
  Target: ATXN1; (+) strand; PAM type: NRG; PAM sequence: AAG
caccagaggatgacagcggc

SEQ ID NO: 149867 - DNA, 20 bp, Artificial Sequence
  Description of Artificial Sequence: Synthetic oligonucleotide
  Target: ATXN1; (+) strand; PAM type: NRG; PAM sequence: AGG
accagaggatgacagcggca

SEQ ID NO: 149868 - DNA, 20 bp, Artificial Sequence
  Description of Artificial Sequence: Synthetic oligonucleotide
  Target: ATXN1; (+) strand; PAM type: NRG; PAM sequence: AAG
gaggatgacagcggcaagga

SEQ ID NO: 149869 - DNA, 20 bp, Artificial Sequence
  Description of Artificial Sequence: Synthetic oligonucleotide
  Target: ATXN1; (+) strand; PAM type: NRG; PAM sequence: AGG
aggatgacagcggcaaggaa

SEQ ID NO: 149870 - DNA, 20 bp, Artificial Sequence
  Description of Artificial Sequence: Synthetic oligonucleotide
  Target: ATXN1; (+) strand; PAM type: NRG; PAM sequence: CAG
gcaaggaaaggttctcccaa

SEQ ID NO: 149871 - DNA, 20 bp, Artificial Sequence
  Description of Artificial Sequence: Synthetic oligonucleotide
  Target: ATXN1; (+) strand; PAM type: NRG; PAM sequence: GAG
aaggaaaggttctcccaaca

SEQ ID NO: 149872 - DNA, 20 bp, Artificial Sequence
  Description of Artificial Sequence: Synthetic oligonucleotide
  Target: ATXN1; (+) strand; PAM type: NRG; PAM sequence: CGG
aggttctcccaacagagctt

SEQ ID NO: 149873 - DNA, 20 bp, Artificial Sequence
  Description of Artificial Sequence: Synthetic oligonucleotide
  Target: ATXN1; (+) strand; PAM type: NRG; PAM sequence: GGG
ggttctcccaacagagcttc

SEQ ID NO: 149874 - DNA, 20 bp, Artificial Sequence
  Description of Artificial Sequence: Synthetic oligonucleotide
  Target: ATXN1; (+) strand; PAM type: NRG; PAM sequence: GAG
ttctcccaacagagcttcgg

SEQ ID NO: 149875 - DNA, 20 bp, Artificial Sequence
  Description of Artificial Sequence: Synthetic oligonucleotide
  Target: ATXN1; (+) strand; PAM type: NRG; PAM sequence: AGG
tctcccaacagagcttcggg

SEQ ID NO: 149876 - DNA, 20 bp, Artificial Sequence
  Description of Artificial Sequence: Synthetic oligonucleotide
  Target: ATXN1; (+) strand; PAM type: NRG; PAM sequence: GGG
ctcccaacagagcttcggga

SEQ ID NO: 149877 - DNA, 20 bp, Artificial Sequence
  Description of Artificial Sequence: Synthetic oligonucleotide
  Target: ATXN1; (+) strand; PAM type: NRG; PAM sequence: GAG
cccaacagagcttcgggagg

SEQ ID NO: 149878 - DNA, 20 bp, Artificial Sequence
  Description of Artificial Sequence: Synthetic oligonucleotide
  Target: ATXN1; (+) strand; PAM type: NRG; PAM sequence: TGG
cagagcttcgggagggagtg

SEQ ID NO: 149879 - DNA, 20 bp, Artificial Sequence
  Description of Artificial Sequence: Synthetic oligonucleotide
  Target: ATXN1; (+) strand; PAM type: NRG; PAM sequence: CGG
cttcgggagggagtgtggcc

SEQ ID NO: 149880 - DNA, 20 bp, Artificial Sequence
  Description of Artificial Sequence: Synthetic oligonucleotide
  Target: ATXN1; (+) strand; PAM type: NRG; PAM sequence: CAG
gcccggctgacacctgattt

SEQ ID NO: 149881 - DNA, 20 bp, Artificial Sequence
  Description of Artificial Sequence: Synthetic oligonucleotide
  Target: ATXN1; (+) strand; PAM type: NRG; PAM sequence: CAG
gatttcagacgtctgccctc

SEQ ID NO: 149882 - DNA, 20 bp, Artificial Sequence
  Description of Artificial Sequence: Synthetic oligonucleotide
  Target: ATXN1; (+) strand; PAM type: NRG; PAM sequence: GAG
cgtctgccctccagaacttt

SEQ ID NO: 149883 - DNA, 20 bp, Artificial Sequence
  Description of Artificial Sequence: Synthetic oligonucleotide
  Target: ATXN1; (+) strand; PAM type: NRG; PAM sequence: GAG
tctgccctccagaactttga

SEQ ID NO: 149884 - DNA, 20 bp, Artificial Sequence
  Description of Artificial Sequence: Synthetic oligonucleotide
  Target: ATXN1; (+) strand; PAM type: NRG; PAM sequence: AAG
tcctgttgttttaacccacc

SEQ ID NO: 149885 - DNA, 20 bp, Artificial Sequence
  Description of Artificial Sequence: Synthetic oligonucleotide
  Target: ATXN1; (+) strand; PAM type: NRG; PAM sequence: TGG
gttttaacccaccaagtttc

SEQ ID NO: 149886 - DNA, 20 bp, Artificial Sequence
  Description of Artificial Sequence: Synthetic oligonucleotide
  Target: ATXN1; (+) strand; PAM type: NRG; PAM sequence: TAG
ccaagtttctggtaatttat

SEQ ID NO: 149887 - DNA, 20 bp, Artificial Sequence
  Description of Artificial Sequence: Synthetic oligonucleotide
  Target: ATXN1; (+) strand; PAM type: NRG; PAM sequence: GAG
aagtttctggtaatttatta

SEQ ID NO: 149888 - DNA, 20 bp, Artificial Sequence
  Description of Artificial Sequence: Synthetic oligonucleotide
  Target: ATXN1; (+) strand; PAM type: NRG; PAM sequence: CAG
tttctggtaatttattagag

SEQ ID NO: 149889 - DNA, 20 bp, Artificial Sequence
  Description of Artificial Sequence: Synthetic oligonucleotide
  Target: ATXN1; (+) strand; PAM type: NRG; PAM sequence: TGG
gtaatttattagagcagccc

SEQ ID NO: 149890 - DNA, 20 bp, Artificial Sequence
  Description of Artificial Sequence: Synthetic oligonucleotide
  Target: ATXN1; (+) strand; PAM type: NRG; PAM sequence: CAG
gagcagccctggaaaactaa

SEQ ID NO: 149891 - DNA, 20 bp, Artificial Sequence
  Description of Artificial Sequence: Synthetic oligonucleotide
  Target: ATXN1; (+) strand; PAM type: NRG; PAM sequence: GAG
gcagccctggaaaactaaca

SEQ ID NO: 149892 - DNA, 20 bp, Artificial Sequence
  Description of Artificial Sequence: Synthetic oligonucleotide
  Target: ATXN1; (+) strand; PAM type: NRG; PAM sequence: TAG
acagagtttcccatcacatt

SEQ ID NO: 149893 - DNA, 20 bp, Artificial Sequence
  Description of Artificial Sequence: Synthetic oligonucleotide
  Target: ATXN1; (+) strand; PAM type: NRG; PAM sequence: AAG
tcacatttagcgtaaaatcc

SEQ ID NO: 149894 - DNA, 20 bp, Artificial Sequence
  Description of Artificial Sequence: Synthetic oligonucleotide
  Target: ATXN1; (+) strand; PAM type: NRG; PAM sequence: CAG
gcgtaaaatccaagctcctg

SEQ ID NO: 149895 - DNA, 20 bp, Artificial Sequence
  Description of Artificial Sequence: Synthetic oligonucleotide
  Target: ATXN1; (+) strand; PAM type: NRG; PAM sequence: TAG
atccaagctcctgcagcctc

SEQ ID NO: 149896 - DNA, 20 bp, Artificial Sequence
  Description of Artificial Sequence: Synthetic oligonucleotide
  Target: ATXN1; (+) strand; PAM type: NRG; PAM sequence: AAG
gcagcctctagatcaattca

SEQ ID NO: 149897 - DNA, 20 bp, Artificial Sequence
  Description of Artificial Sequence: Synthetic oligonucleotide
  Target: ATXN1; (+) strand; PAM type: NRG; PAM sequence: AGG
cagcctctagatcaattcaa

SEQ ID NO: 149898 - DNA, 20 bp, Artificial Sequence
  Description of Artificial Sequence: Synthetic oligonucleotide
  Target: ATXN1; (+) strand; PAM type: NRG; PAM sequence: TGG
atcaattcaaaggctccttc

SEQ ID NO: 149899 - DNA, 20 bp, Artificial Sequence
  Description of Artificial Sequence: Synthetic oligonucleotide
  Target: ATXN1; (+) strand; PAM type: NRG; PAM sequence: CAG
tcaaaggctccttctggcct

SEQ ID NO: 149900 - DNA, 20 bp, Artificial Sequence
  Description of Artificial Sequence: Synthetic oligonucleotide
  Target: ATXN1; (+) strand; PAM type: NRG; PAM sequence: GAG
aaaggctccttctggcctca

SEQ ID NO: 149901 - DNA, 20 bp, Artificial Sequence
  Description of Artificial Sequence: Synthetic oligonucleotide
  Target: ATXN1; (+) strand; PAM type: NRG; PAM sequence: TGG
ctggcctcagagccttcacc

SEQ ID NO: 149902 - DNA, 20 bp, Artificial Sequence
  Description of Artificial Sequence: Synthetic oligonucleotide
  Target: ATXN1; (+) strand; PAM type: NRG; PAM sequence: CAG
ctggccattctcttccttta

SEQ ID NO: 149903 - DNA, 20 bp, Artificial Sequence
  Description of Artificial Sequence: Synthetic oligonucleotide
  Target: ATXN1; (+) strand; PAM type: NRG; PAM sequence: CAG
tcctttacagtgctcatcct

SEQ ID NO: 149904 - DNA, 20 bp, Artificial Sequence
  Description of Artificial Sequence: Synthetic oligonucleotide
  Target: ATXN1; (+) strand; PAM type: NRG; PAM sequence: CAG
ccttcaccactcccatcttc

SEQ ID NO: 149905 - DNA, 20 bp, Artificial Sequence
  Description of Artificial Sequence: Synthetic oligonucleotide
  Target: ATXN1; (+) strand; PAM type: NRG; PAM sequence: AGG
cttcaccactcccatcttcc

SEQ ID NO: 149906 - DNA, 20 bp, Artificial Sequence
  Description of Artificial Sequence: Synthetic oligonucleotide
  Target: ATXN1; (+) strand; PAM type: NRG; PAM sequence: GGG
ttcaccactcccatcttcca

SEQ ID NO: 149907 - DNA, 20 bp, Artificial Sequence
  Description of Artificial Sequence: Synthetic oligonucleotide
  Target: ATXN1; (+) strand; PAM type: NRG; PAM sequence: TGG
ccactcccatcttccagggc

SEQ ID NO: 149908 - DNA, 20 bp, Artificial Sequence
  Description of Artificial Sequence: Synthetic oligonucleotide
  Target: ATXN1; (+) strand; PAM type: NRG; PAM sequence: CAG
ctggctcctataccttactg

SEQ ID NO: 149909 - DNA, 20 bp, Artificial Sequence
  Description of Artificial Sequence: Synthetic oligonucleotide
  Target: ATXN1; (+) strand; PAM type: NRG; PAM sequence: AAG
ttactgcagtctctgtacaa

SEQ ID NO: 149910 - DNA, 20 bp, Artificial Sequence
  Description of Artificial Sequence: Synthetic oligonucleotide
  Target: ATXN1; (+) strand; PAM type: NRG; PAM sequence: AAG
tgtacaaaagcccatcccct

SEQ ID NO: 149911 - DNA, 20 bp, Artificial Sequence
  Description of Artificial Sequence: Synthetic oligonucleotide
  Target: ATXN1; (+) strand; PAM type: NRG; PAM sequence: AAG
tccctgactccaccaaacaa

SEQ ID NO: 149912 - DNA, 20 bp, Artificial Sequence
  Description of Artificial Sequence: Synthetic oligonucleotide
  Target: ATXN1; (+) strand; PAM type: NRG; PAM sequence: TGG
taacatatcctactctattt

SEQ ID NO: 149913 - DNA, 20 bp, Artificial Sequence
  Description of Artificial Sequence: Synthetic oligonucleotide
  Target: ATXN1; (+) strand; PAM type: NRG; PAM sequence: GGG
aacatatcctactctatttt

SEQ ID NO: 149914 - DNA, 20 bp, Artificial Sequence
  Description of Artificial Sequence: Synthetic oligonucleotide
  Target: ATXN1; (+) strand; PAM type: NRG; PAM sequence: GGG
acatatcctactctattttg

SEQ ID NO: 149915 - DNA, 20 bp, Artificial Sequence
  Description of Artificial Sequence: Synthetic oligonucleotide
  Target: ATXN1; (+) strand; PAM type: NRG; PAM sequence: GGG
catatcctactctattttgg

SEQ ID NO: 149916 - DNA, 20 bp, Artificial Sequence
  Description of Artificial Sequence: Synthetic oligonucleotide
  Target: ATXN1; (+) strand; PAM type: NRG; PAM sequence: GGG
atatcctactctattttggg

SEQ ID NO: 149917 - DNA, 20 bp, Artificial Sequence
  Description of Artificial Sequence: Synthetic oligonucleotide
  Target: ATXN1; (+) strand; PAM type: NRG; PAM sequence: TAG
tattttggggggtctgcaaa

SEQ ID NO: 149918 - DNA, 20 bp, Artificial Sequence
  Description of Artificial Sequence: Synthetic oligonucleotide
  Target: ATXN1; (+) strand; PAM type: NRG; PAM sequence: GAG
ttttggggggtctgcaaata

SEQ ID NO: 149919 - DNA, 20 bp, Artificial Sequence
  Description of Artificial Sequence: Synthetic oligonucleotide
  Target: ATXN1; (+) strand; PAM type: NRG; PAM sequence: TGG
ctacttatgcaatttacttg

SEQ ID NO: 149920 - DNA, 20 bp, Artificial Sequence
  Description of Artificial Sequence: Synthetic oligonucleotide
  Target: ATXN1; (+) strand; PAM type: NRG; PAM sequence: GAG
cttgtggttgtctccactat

SEQ ID NO: 149921 - DNA, 20 bp, Artificial Sequence
  Description of Artificial Sequence: Synthetic oligonucleotide
  Target: ATXN1; (+) strand; PAM type: NRG; PAM sequence: AAG
tgtctccactatgagaacat

SEQ ID NO: 149922 - DNA, 20 bp, Artificial Sequence
  Description of Artificial Sequence: Synthetic oligonucleotide
  Target: ATXN1; (+) strand; PAM type: NRG; PAM sequence: GAG
tatgagaacataagctctct

SEQ ID NO: 149923 - DNA, 20 bp, Artificial Sequence
  Description of Artificial Sequence: Synthetic oligonucleotide
  Target: ATXN1; (+) strand; PAM type: NRG; PAM sequence: AGG
atgagaacataagctctctg

SEQ ID NO: 149924 - DNA, 20 bp, Artificial Sequence
  Description of Artificial Sequence: Synthetic oligonucleotide
  Target: ATXN1; (+) strand; PAM type: NRG; PAM sequence: GGG
tgagaacataagctctctga

SEQ ID NO: 149925 - DNA, 20 bp, Artificial Sequence
  Description of Artificial Sequence: Synthetic oligonucleotide
  Target: ATXN1; (+) strand; PAM type: NRG; PAM sequence: CAG
gaacataagctctctgaggg

SEQ ID NO: 149926 - DNA, 20 bp, Artificial Sequence
  Description of Artificial Sequence: Synthetic oligonucleotide
  Target: ATXN1; (+) strand; PAM type: NRG; PAM sequence: AGG
aacataagctctctgagggc

SEQ ID NO: 149927 - DNA, 20 bp, Artificial Sequence
  Description of Artificial Sequence: Synthetic oligonucleotide
  Target: ATXN1; (+) strand; PAM type: NRG; PAM sequence: GGG
acataagctctctgagggca

SEQ ID NO: 149928 - DNA, 20 bp, Artificial Sequence
  Description of Artificial Sequence: Synthetic oligonucleotide
  Target: ATXN1; (+) strand; PAM type: NRG; PAM sequence: TAG
gctctctgagggcagggact

SEQ ID NO: 149929 - DNA, 20 bp, Artificial Sequence
  Description of Artificial Sequence: Synthetic oligonucleotide
  Target: ATXN1; (+) strand; PAM type: NRG; PAM sequence: CAG
tttgttctctgttacgtcct

SEQ ID NO: 149930 - DNA, 20 bp, Artificial Sequence
  Description of Artificial Sequence: Synthetic oligonucleotide
  Target: ATXN1; (+) strand; PAM type: NRG; PAM sequence: TGG
tcagtgcatacaaccatgtc

SEQ ID NO: 149931 - DNA, 20 bp, Artificial Sequence
  Description of Artificial Sequence: Synthetic oligonucleotide
  Target: ATXN1; (+) strand; PAM type: NRG; PAM sequence: CAG
gcatacaaccatgtctggtg

SEQ ID NO: 149932 - DNA, 20 bp, Artificial Sequence
  Description of Artificial Sequence: Synthetic oligonucleotide
  Target: ATXN1; (+) strand; PAM type: NRG; PAM sequence: AAG
caaccatgtctggtgcagaa

SEQ ID NO: 149933 - DNA, 20 bp, Artificial Sequence
  Description of Artificial Sequence: Synthetic oligonucleotide
  Target: ATXN1; (+) strand; PAM type: NRG; PAM sequence: TGG
aaagacattcaataaatact

SEQ ID NO: 149934 - DNA, 20 bp, Artificial Sequence
  Description of Artificial Sequence: Synthetic oligonucleotide
  Target: ATXN1; (+) strand; PAM type: NRG; PAM sequence: AAG
caataaatacttggttgtat

SEQ ID NO: 149935 - DNA, 20 bp, Artificial Sequence
  Description of Artificial Sequence: Synthetic oligonucleotide
  Target: ATXN1; (+) strand; PAM type: NRG; PAM sequence: AAG
gtgctttcactcaattataa

SEQ ID NO: 149936 - DNA, 20 bp, Artificial Sequence
  Description of Artificial Sequence: Synthetic oligonucleotide
  Target: ATXN1; (+) strand; PAM type: NRG; PAM sequence: TAG
ttataaaagcctgacttgat

SEQ ID NO: 149937 - DNA, 20 bp, Artificial Sequence
  Description of Artificial Sequence: Synthetic oligonucleotide
  Target: ATXN1; (+) strand; PAM type: NRG; PAM sequence: AAG
ctgacttgattagcaccatc

SEQ ID NO: 149938 - DNA, 20 bp, Artificial Sequence
  Description of Artificial Sequence: Synthetic oligonucleotide
  Target: ATXN1; (+) strand; PAM type: NRG; PAM sequence: GAG
ttagcaccatcaagacatat

SEQ ID NO: 149939 - DNA, 20 bp, Artificial Sequence
  Description of Artificial Sequence: Synthetic oligonucleotide
  Target: ATXN1; (+) strand; PAM type: NRG; PAM sequence: AAG
ccatcaagacatatgagctt

SEQ ID NO: 149940 - DNA, 20 bp, Artificial Sequence
  Description of Artificial Sequence: Synthetic oligonucleotide
  Target: ATXN1; (+) strand; PAM type: NRG; PAM sequence: AAG
taagacattctctgcattgc

SEQ ID NO: 149941 - DNA, 20 bp, Artificial Sequence
  Description of Artificial Sequence: Synthetic oligonucleotide
  Target: ATXN1; (+) strand; PAM type: NRG; PAM sequence: AAG
cattctctgcattgcaagtc

SEQ ID NO: 149942 - DNA, 20 bp, Artificial Sequence
  Description of Artificial Sequence: Synthetic oligonucleotide
  Target: ATXN1; (+) strand; PAM type: NRG; PAM sequence: GAG
tattatttttgaaaatatct

SEQ ID NO: 149943 - DNA, 20 bp, Artificial Sequence
  Description of Artificial Sequence: Synthetic oligonucleotide
  Target: ATXN1; (+) strand; PAM type: NRG; PAM sequence: AGG
attatttttgaaaatatctg

SEQ ID NO: 149944 - DNA, 20 bp, Artificial Sequence
  Description of Artificial Sequence: Synthetic oligonucleotide
  Target: ATXN1; (+) strand; PAM type: NRG; PAM sequence: GGG
ttatttttgaaaatatctga

SEQ ID NO: 149945 - DNA, 20 bp, Artificial Sequence
  Description of Artificial Sequence: Synthetic oligonucleotide
  Target: ATXN1; (+) strand; PAM type: NRG; PAM sequence: CAG
aatgctcttctattaaaact

SEQ ID NO: 149946 - DNA, 20 bp, Artificial Sequence
  Description of Artificial Sequence: Synthetic oligonucleotide
  Target: ATXN1; (+) strand; PAM type: NRG; PAM sequence: TGG
aaactcagttgatccaaaca

SEQ ID NO: 149947 - DNA, 20 bp, Artificial Sequence
  Description of Artificial Sequence: Synthetic oligonucleotide
  Target: ATXN1; (+) strand; PAM type: NRG; PAM sequence: TGG
gcttttttgcttttattatt

SEQ ID NO: 149948 - DNA, 20 bp, Artificial Sequence
  Description of Artificial Sequence: Synthetic oligonucleotide
  Target: ATXN1; (+) strand; PAM type: NRG; PAM sequence: GGG
cttttttgcttttattattt

SEQ ID NO: 149949 - DNA, 20 bp, Artificial Sequence
  Description of Artificial Sequence: Synthetic oligonucleotide
  Target: ATXN1; (+) strand; PAM type: NRG; PAM sequence: GAG
ttgcttttattatttgggtc

SEQ ID NO: 149950 - DNA, 20 bp, Artificial Sequence
  Description of Artificial Sequence: Synthetic oligonucleotide
  Target: ATXN1; (+) strand; PAM type: NRG; PAM sequence: AAG
ttattatttgggtcgagcta

SEQ ID NO: 149951 - DNA, 20 bp, Artificial Sequence
  Description of Artificial Sequence: Synthetic oligonucleotide
  Target: ATXN1; (+) strand; PAM type: NRG; PAM sequence: TGG
atttgggtcgagctaaagca

SEQ ID NO: 149952 - DNA, 20 bp, Artificial Sequence
  Description of Artificial Sequence: Synthetic oligonucleotide
  Target: ATXN1; (+) strand; PAM type: NRG; PAM sequence: AAG
tcgagctaaagcatggtata

SEQ ID NO: 149953 - DNA, 20 bp, Artificial Sequence
  Description of Artificial Sequence: Synthetic oligonucleotide
  Target: ATXN1; (+) strand; PAM type: NRG; PAM sequence: AGG
cgagctaaagcatggtataa

SEQ ID NO: 149954 - DNA, 20 bp, Artificial Sequence
  Description of Artificial Sequence: Synthetic oligonucleotide
  Target: ATXN1; (+) strand; PAM type: NRG; PAM sequence: GAG
agctaaagcatggtataaag

SEQ ID NO: 149955 - DNA, 20 bp, Artificial Sequence
  Description of Artificial Sequence: Synthetic oligonucleotide
  Target: ATXN1; (+) strand; PAM type: NRG; PAM sequence: GAG
ctaaagcatggtataaagga

SEQ ID NO: 149956 - DNA, 20 bp, Artificial Sequence
  Description of Artificial Sequence: Synthetic oligonucleotide
  Target: ATXN1; (+) strand; PAM type: NRG; PAM sequence: AGG
taaagcatggtataaaggag

SEQ ID NO: 149957 - DNA, 20 bp, Artificial Sequence
  Description of Artificial Sequence: Synthetic oligonucleotide
  Target: ATXN1; (+) strand; PAM type: NRG; PAM sequence: CAG
ggcctaaatccttttcctac

SEQ ID NO: 149958 - DNA, 20 bp, Artificial Sequence
  Description of Artificial Sequence: Synthetic oligonucleotide
  Target: ATXN1; (+) strand; PAM type: NRG; PAM sequence: GAG
ccttttcctaccagctatgt

SEQ ID NO: 149959 - DNA, 20 bp, Artificial Sequence
  Description of Artificial Sequence: Synthetic oligonucleotide
  Target: ATXN1; (+) strand; PAM type: NRG; PAM sequence: GAG
cctaccagctatgtgagcct

SEQ ID NO: 149960 - DNA, 20 bp, Artificial Sequence
  Description of Artificial Sequence: Synthetic oligonucleotide
  Target: ATXN1; (+) strand; PAM type: NRG; PAM sequence: AAG
ccagctatgtgagcctgagt

SEQ ID NO: 149961 - DNA, 20 bp, Artificial Sequence
  Description of Artificial Sequence: Synthetic oligonucleotide
  Target: ATXN1; (+) strand; PAM type: NRG; PAM sequence: GAG
agtaagtaattaccctcttt

SEQ ID NO: 149962 - DNA, 20 bp, Artificial Sequence
  Description of Artificial Sequence: Synthetic oligonucleotide
  Target: ATXN1; (+) strand; PAM type: NRG; PAM sequence: TAG
aattaccctctttgagcctg

SEQ ID NO: 149963 - DNA, 20 bp, Artificial Sequence
  Description of Artificial Sequence: Synthetic oligonucleotide
  Target: ATXN1; (+) strand; PAM type: NRG; PAM sequence: AAG
ccctctttgagcctgtagaa

SEQ ID NO: 149964 - DNA, 20 bp, Artificial Sequence
  Description of Artificial Sequence: Synthetic oligonucleotide
  Target: ATXN1; (+) strand; PAM type: NRG; PAM sequence: CAG
acatgctgtgtctatatcca

SEQ ID NO: 149965 - DNA, 20 bp, Artificial Sequence
  Description of Artificial Sequence: Synthetic oligonucleotide
  Target: ATXN1; (+) strand; PAM type: NRG; PAM sequence: AGG
catgctgtgtctatatccac

SEQ ID NO: 149966 - DNA, 20 bp, Artificial Sequence
  Description of Artificial Sequence: Synthetic oligonucleotide
  Target: ATXN1; (+) strand; PAM type: NRG; PAM sequence: GGG
atgctgtgtctatatccaca

SEQ ID NO: 149967 - DNA, 20 bp, Artificial Sequence
  Description of Artificial Sequence: Synthetic oligonucleotide
  Target: ATXN1; (+) strand; PAM type: NRG; PAM sequence: GAG
tatatccacagggctgctat

SEQ ID NO: 149968 - DNA, 20 bp, Artificial Sequence
  Description of Artificial Sequence: Synthetic oligonucleotide
  Target: ATXN1; (+) strand; PAM type: NRG; PAM sequence: GAG
ggctgctatgagaacccatt

SEQ ID NO: 149969 - DNA, 20 bp, Artificial Sequence
  Description of Artificial Sequence: Synthetic oligonucleotide
  Target: ATXN1; (+) strand; PAM type: NRG; PAM sequence: AGG
gctgctatgagaacccattg

SEQ ID NO: 149970 - DNA, 20 bp, Artificial Sequence
  Description of Artificial Sequence: Synthetic oligonucleotide
  Target: ATXN1; (+) strand; PAM type: NRG; PAM sequence: CAG
acccattgaggtaacccatc

SEQ ID NO: 149971 - DNA, 20 bp, Artificial Sequence
  Description of Artificial Sequence: Synthetic oligonucleotide
  Target: ATXN1; (+) strand; PAM type: NRG; PAM sequence: TAG
catccagcaaaatatttctt

SEQ ID NO: 149972 - DNA, 20 bp, Artificial Sequence
  Description of Artificial Sequence: Synthetic oligonucleotide
  Target: ATXN1; (+) strand; PAM type: NRG; PAM sequence: CAG
atatttctttagatgctgtt

SEQ ID NO: 149973 - DNA, 20 bp, Artificial Sequence
  Description of Artificial Sequence: Synthetic oligonucleotide
  Target: ATXN1; (+) strand; PAM type: NRG; PAM sequence: AGG
tatttctttagatgctgttc

SEQ ID NO: 149974 - DNA, 20 bp, Artificial Sequence
  Description of Artificial Sequence: Synthetic oligonucleotide
  Target: ATXN1; (+) strand; PAM type: NRG; PAM sequence: CAG
tctttagatgctgttcaggc

SEQ ID NO: 149975 - DNA, 20 bp, Artificial Sequence
  Description of Artificial Sequence: Synthetic oligonucleotide
  Target: ATXN1; (+) strand; PAM type: NRG; PAM sequence: TAG
gttcaggccagatactgtgc

SEQ ID NO: 149976 - DNA, 20 bp, Artificial Sequence
  Description of Artificial Sequence: Synthetic oligonucleotide
  Target: ATXN1; (+) strand; PAM type: NRG; PAM sequence: CAG
caggccagatactgtgctag

SEQ ID NO: 149977 - DNA, 20 bp, Artificial Sequence
  Description of Artificial Sequence: Synthetic oligonucleotide
  Target: ATXN1; (+) strand; PAM type: NRG; PAM sequence: CAG
atactgtgctagcagtgaca

SEQ ID NO: 149978 - DNA, 20 bp, Artificial Sequence
  Description of Artificial Sequence: Synthetic oligonucleotide
  Target: ATXN1; (+) strand; PAM type: NRG; PAM sequence: TAG
tgtgctagcagtgacacagt

SEQ ID NO: 149979 - DNA, 20 bp, Artificial Sequence
  Description of Artificial Sequence: Synthetic oligonucleotide
  Target: ATXN1; (+) strand; PAM type: NRG; PAM sequence: CAG
gcagtgacacagttagaacc

SEQ ID NO: 149980 - DNA, 20 bp, Artificial Sequence
  Description of Artificial Sequence: Synthetic oligonucleotide
  Target: ATXN1; (+) strand; PAM type: NRG; PAM sequence: AGG
cagtgacacagttagaaccc

SEQ ID NO: 149981 - DNA, 20 bp, Artificial Sequence
  Description of Artificial Sequence: Synthetic oligonucleotide
  Target: ATXN1; (+) strand; PAM type: NRG; PAM sequence: AAG
gacacagttagaacccaggc

SEQ ID NO: 149982 - DNA, 20 bp, Artificial Sequence
  Description of Artificial Sequence: Synthetic oligonucleotide
  Target: ATXN1; (+) strand; PAM type: NRG; PAM sequence: AAG
aagaaatgtctgtccttatc

SEQ ID NO: 149983 - DNA, 20 bp, Artificial Sequence
  Description of Artificial Sequence: Synthetic oligonucleotide
  Target: ATXN1; (+) strand; PAM type: NRG; PAM sequence: TAG
gtccttatcaagcatacctc

SEQ ID NO: 149984 - DNA, 20 bp, Artificial Sequence
  Description of Artificial Sequence: Synthetic oligonucleotide
  Target: ATXN1; (+) strand; PAM type: NRG; PAM sequence: AGG
tccttatcaagcatacctct

SEQ ID NO: 149985 - DNA, 20 bp, Artificial Sequence
  Description of Artificial Sequence: Synthetic oligonucleotide
  Target: ATXN1; (+) strand; PAM type: NRG; PAM sequence: AAG
ggcacattttgcaaactgtc

SEQ ID NO: 149986 - DNA, 20 bp, Artificial Sequence
  Description of Artificial Sequence: Synthetic oligonucleotide
  Target: ATXN1; (+) strand; PAM type: NRG; PAM sequence: CAG
gcaaactgtcaagacttgtg

SEQ ID NO: 149987 - DNA, 20 bp, Artificial Sequence
  Description of Artificial Sequence: Synthetic oligonucleotide
  Target: ATXN1; (+) strand; PAM type: NRG; PAM sequence: TGG
caagacttgtgcagatgtaa

SEQ ID NO: 149988 - DNA, 20 bp, Artificial Sequence
  Description of Artificial Sequence: Synthetic oligonucleotide
  Target: ATXN1; (+) strand; PAM type: NRG; PAM sequence: GAG
gtgcagatgtaatggaatct

SEQ ID NO: 149989 - DNA, 20 bp, Artificial Sequence
  Description of Artificial Sequence: Synthetic oligonucleotide
  Target: ATXN1; (+) strand; PAM type: NRG; PAM sequence: CAG
agatttgtgcttgacacacc

SEQ ID NO: 149990 - DNA, 20 bp, Artificial Sequence
  Description of Artificial Sequence: Synthetic oligonucleotide
  Target: ATXN1; (+) strand; PAM type: NRG; PAM sequence: GAG
atttgtgcttgacacaccca

SEQ ID NO: 149991 - DNA, 20 bp, Artificial Sequence
  Description of Artificial Sequence: Synthetic oligonucleotide
  Target: ATXN1; (+) strand; PAM type: NRG; PAM sequence: AGG
tttgtgcttgacacacccag

SEQ ID NO: 149992 - DNA, 20 bp, Artificial Sequence
  Description of Artificial Sequence: Synthetic oligonucleotide
  Target: ATXN1; (+) strand; PAM type: NRG; PAM sequence: CAG
tgacacacccagaggataac

SEQ ID NO: 149993 - DNA, 20 bp, Artificial Sequence
  Description of Artificial Sequence: Synthetic oligonucleotide
  Target: ATXN1; (+) strand; PAM type: NRG; PAM sequence: CAG
ctattaatacaaatgcaaac

SEQ ID NO: 149994 - DNA, 20 bp, Artificial Sequence
  Description of Artificial Sequence: Synthetic oligonucleotide
  Target: ATXN1; (+) strand; PAM type: NRG; PAM sequence: AAG
ttaatacaaatgcaaaccag

SEQ ID NO: 149995 - DNA, 20 bp, Artificial Sequence
  Description of Artificial Sequence: Synthetic oligonucleotide
  Target: ATXN1; (+) strand; PAM type: NRG; PAM sequence: TGG
tacaaatgcaaaccagaaga

SEQ ID NO: 149996 - DNA, 20 bp, Artificial Sequence
  Description of Artificial Sequence: Synthetic oligonucleotide
  Target: ATXN1; (+) strand; PAM type: NRG; PAM sequence: AAG
aaccagaagatggttccctt

SEQ ID NO: 149997 - DNA, 20 bp, Artificial Sequence
  Description of Artificial Sequence: Synthetic oligonucleotide
  Target: ATXN1; (+) strand; PAM type: NRG; PAM sequence: CAG
agaagatggttcccttaaga

SEQ ID NO: 149998 - DNA, 20 bp, Artificial Sequence
  Description of Artificial Sequence: Synthetic oligonucleotide
  Target: ATXN1; (+) strand; PAM type: NRG; PAM sequence: TAG
ggttcccttaagacagctat

SEQ ID NO: 149999 - DNA, 20 bp, Artificial Sequence
  Description of Artificial Sequence: Synthetic oligonucleotide
  Target: ATXN1; (+) strand; PAM type: NRG; PAM sequence: GAG
ttcctcatttgtctcatgcc

SEQ ID NO: 150000 - DNA, 20 bp, Artificial Sequence
  Description of Artificial Sequence: Synthetic oligonucleotide
  Target: ATXN1; (+) strand; PAM type: NRG; PAM sequence: CAG
atgccgagcaatttctaata

SEQ ID NO: 150001 - DNA, 20 bp, Artificial Sequence
  Description of Artificial Sequence: Synthetic oligonucleotide
  Target: ATXN1; (+) strand; PAM type: NRG; PAM sequence: CAG
tttctaatacagataaaaat

SEQ ID NO: 150002 - DNA, 20 bp, Artificial Sequence
  Description of Artificial Sequence: Synthetic oligonucleotide
  Target: ATXN1; (+) strand; PAM type: NRG; PAM sequence: AGG
ttctaatacagataaaaatc

SEQ ID NO: 150003 - DNA, 20 bp, Artificial Sequence
  Description of Artificial Sequence: Synthetic oligonucleotide
  Target: ATXN1; (+) strand; PAM type: NRG; PAM sequence: GAG
ctaatacagataaaaatcag

SEQ ID NO: 150004 - DNA, 20 bp, Artificial Sequence
  Description of Artificial Sequence: Synthetic oligonucleotide
  Target: ATXN1; (+) strand; PAM type: NRG; PAM sequence: AAG
aatcaggagctactacgaac

SEQ ID NO: 150005 - DNA, 20 bp, Artificial Sequence
  Description of Artificial Sequence: Synthetic oligonucleotide
  Target: ATXN1; (+) strand; PAM type: NRG; PAM sequence: AGG
atcaggagctactacgaaca

SEQ ID NO: 150006 - DNA, 20 bp, Artificial Sequence
  Description of Artificial Sequence: Synthetic oligonucleotide
  Target: ATXN1; (+) strand; PAM type: NRG; PAM sequence: CGG
agctactacgaacaaggtta

SEQ ID NO: 150007 - DNA, 20 bp, Artificial Sequence
  Description of Artificial Sequence: Synthetic oligonucleotide
  Target: ATXN1; (+) strand; PAM type: NRG; PAM sequence: TAG
acgaacaaggttacggcatg

SEQ ID NO: 150008 - DNA, 20 bp, Artificial Sequence
  Description of Artificial Sequence: Synthetic oligonucleotide
  Target: ATXN1; (+) strand; PAM type: NRG; PAM sequence: TGG
catgtagccatcccaaaatg

SEQ ID NO: 150009 - DNA, 20 bp, Artificial Sequence
  Description of Artificial Sequence: Synthetic oligonucleotide
  Target: ATXN1; (+) strand; PAM type: NRG; PAM sequence: AAG
attccttttcattatttcaa

SEQ ID NO: 150010 - DNA, 20 bp, Artificial Sequence
  Description of Artificial Sequence: Synthetic oligonucleotide
  Target: ATXN1; (+) strand; PAM type: NRG; PAM sequence: AAG
ccacatttgaaatatgtacc

SEQ ID NO: 150011 - DNA, 20 bp, Artificial Sequence
  Description of Artificial Sequence: Synthetic oligonucleotide
  Target: ATXN1; (+) strand; PAM type: NRG; PAM sequence: TGG
catttgaaatatgtaccaag

SEQ ID NO: 150012 - DNA, 20 bp, Artificial Sequence
  Description of Artificial Sequence: Synthetic oligonucleotide
  Target: ATXN1; (+) strand; PAM type: NRG; PAM sequence: TGG
tgaaatatgtaccaagtggc

SEQ ID NO: 150013 - DNA, 20 bp, Artificial Sequence
  Description of Artificial Sequence: Synthetic oligonucleotide
  Target: ATXN1; (+) strand; PAM type: NRG; PAM sequence: GGG
gaaatatgtaccaagtggct

SEQ ID NO: 150014 - DNA, 20 bp, Artificial Sequence
  Description of Artificial Sequence: Synthetic oligonucleotide
  Target: ATXN1; (+) strand; PAM type: NRG; PAM sequence: GGG
aaatatgtaccaagtggctg

SEQ ID NO: 150015 - DNA, 20 bp, Artificial Sequence
  Description of Artificial Sequence: Synthetic oligonucleotide
  Target: ATXN1; (+) strand; PAM type: NRG; PAM sequence: GGG
aatatgtaccaagtggctgg

SEQ ID NO: 150016 - DNA, 20 bp, Artificial Sequence
  Description of Artificial Sequence: Synthetic oligonucleotide
  Target: ATXN1; (+) strand; PAM type: NRG; PAM sequence: TGG
atgtaccaagtggctggggg

SEQ ID NO: 150017 - DNA, 20 bp, Artificial Sequence
  Description of Artificial Sequence: Synthetic oligonucleotide
  Target: ATXN1; (+) strand; PAM type: NRG; PAM sequence: CAG
gttgttcatgcctataatcc

SEQ ID NO: 150018 - DNA, 20 bp, Artificial Sequence
  Description of Artificial Sequence: Synthetic oligonucleotide
  Target: ATXN1; (+) strand; PAM type: NRG; PAM sequence: TGG
tgcctataatcccagcactt

SEQ ID NO: 150019 - DNA, 20 bp, Artificial Sequence
  Description of Artificial Sequence: Synthetic oligonucleotide
  Target: ATXN1; (+) strand; PAM type: NRG; PAM sequence: GGG
gcctataatcccagcacttt

SEQ ID NO: 150020 - DNA, 20 bp, Artificial Sequence
  Description of Artificial Sequence: Synthetic oligonucleotide
  Target: ATXN1; (+) strand; PAM type: NRG; PAM sequence: GAG
ctataatcccagcactttgg

SEQ ID NO: 150021 - DNA, 20 bp, Artificial Sequence
  Description of Artificial Sequence: Synthetic oligonucleotide
  Target: ATXN1; (+) strand; PAM type: NRG; PAM sequence: AGG
tataatcccagcactttggg

SEQ ID NO: 150022 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggct

SEQ ID NO: 150023 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggctg

SEQ ID NO: 150024 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggctgagg

SEQ ID NO: 150025 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggctgaggt

SEQ ID NO: 150026 - DNA, 20 bp, Artificial Sequence
  Description of Artificial Sequence: Synthetic oligonucleotide
  Target: ATXN1; (+) strand; PAM type: NRG; PAM sequence: GAG
actttgggaggctgaggtgg

SEQ ID NO: 150027 - DNA, 20 bp, Artificial Sequence
  Description of Artificial Sequence: Synthetic oligonucleotide
  Target: ATXN1; (+) strand; PAM type: NRG; PAM sequence: AGG
ctttgggaggctgaggtggg

SEQ ID NO: 150028 - DNA, 20 bp, Artificial Sequence
  Description of Artificial Sequence: Synthetic oligonucleotide
  Target: ATXN1; (+) strand; PAM type: NRG; PAM sequence: GAG
ctgaggtgggaggactgctt

SEQ ID NO: 150029 - DNA, 20 bp, Artificial Sequence
  Description of Artificial Sequence: Synthetic oligonucleotide
  Target: ATXN1; (+) strand; PAM type: NRG; PAM sequence: AGG
tgaggtgggaggactgcttg

SEQ ID NO: 150030 - DNA, 20 bp, Artificial Sequence
  Description of Artificial Sequence: Synthetic oligonucleotide
  Target: ATXN1; (+) strand; PAM type: NRG; PAM sequence: CAG
gtgggaggactgcttgaggc

SEQ ID NO: 150031 - DNA, 20 bp, Artificial Sequence
  Description of Artificial Sequence: Synthetic oligonucleotide
  Target: ATXN1; (+) strand; PAM type: NRG; PAM sequence: AGG
tgggaggactgcttgaggcc

SEQ ID NO: 150032 - DNA, 20 bp, Artificial Sequence
  Description of Artificial Sequence: Synthetic oligonucleotide
  Target: ATXN1; (+) strand; PAM type: NRG; PAM sequence: GGG
gggaggactgcttgaggcca

SEQ ID NO: 150033 - DNA, 20 bp, Artificial Sequence
  Description of Artificial Sequence: Synthetic oligonucleotide
  Target: ATXN1; (+) strand; PAM type: NRG; PAM sequence: GAG
gaggactgcttgaggccagg

SEQ ID NO: 150034 - DNA, 20 bp, Artificial Sequence
  Description of Artificial Sequence: Synthetic oligonucleotide
  Target: ATXN1; (+) strand; PAM type: NRG; PAM sequence: GAG
tgcttgaggccagggagttc

SEQ ID NO: 150035 - DNA, 20 bp, Artificial Sequence
  Description of Artificial Sequence: Synthetic oligonucleotide
  Target: ATXN1; (+) strand; PAM type: NRG; PAM sequence: CAG
gaggccagggagttcgagac

SEQ ID NO: 150036 - DNA, 20 bp, Artificial Sequence
  Description of Artificial Sequence: Synthetic oligonucleotide
  Target: ATXN1; (+) strand; PAM type: NRG; PAM sequence: TGG
cagggagttcgagaccagcc

SEQ ID NO: 150037 - DNA, 20 bp, Artificial Sequence
  Description of Artificial Sequence: Synthetic oligonucleotide
  Target: ATXN1; (+) strand; PAM type: NRG; PAM sequence: GGG
agggagttcgagaccagcct

SEQ ID NO: 150038 - DNA, 20 bp, Artificial Sequence
  Description of Artificial Sequence: Synthetic oligonucleotide
  Target: ATXN1; (+) strand; PAM type: NRG; PAM sequence: TAG
cgagaccagcctgggcaaca

SEQ ID NO: 150039 - DNA, 20 bp, Artificial Sequence
  Description of Artificial Sequence: Synthetic oligonucleotide
  Target: ATXN1; (+) strand; PAM type: NRG; PAM sequence: GAG
accagcctgggcaacatagt

SEQ ID NO: 150040 - DNA, 20 bp, Artificial Sequence
  Description of Artificial Sequence: Synthetic oligonucleotide
  Target: ATXN1; (+) strand; PAM type: NRG; PAM sequence: GAG
tctacaaaaaatttgaaaat

SEQ ID NO: 150041 - DNA, 20 bp, Artificial Sequence
  Description of Artificial Sequence: Synthetic oligonucleotide
  Target: ATXN1; (+) strand; PAM type: NRG; PAM sequence: CAG
caaaaaatttgaaaatgagc

SEQ ID NO: 150042 - DNA, 20 bp, Artificial Sequence
  Description of Artificial Sequence: Synthetic oligonucleotide
  Target: ATXN1; (+) strand; PAM type: NRG; PAM sequence: TGG
atttgaaaatgagccagcta

SEQ ID NO: 150043 - DNA, 20 bp, Artificial Sequence
  Description of Artificial Sequence: Synthetic oligonucleotide
  Target: ATXN1; (+) strand; PAM type: NRG; PAM sequence: TGG
tgaaaatgagccagctatgg

SEQ ID NO: 150044 - DNA, 20 bp, Artificial Sequence
  Description of Artificial Sequence: Synthetic oligonucleotide
  Target: ATXN1; (+) strand; PAM type: NRG; PAM sequence: TAG
gctatggtggcacgtccttg

SEQ ID NO: 150045 - DNA, 20 bp, Artificial Sequence
  Description of Artificial Sequence: Synthetic oligonucleotide
  Target: ATXN1; (+) strand; PAM type: NRG; PAM sequence: TAG
gtggcacgtccttgtagttc

SEQ ID NO: 150046 - DNA, 20 bp, Artificial Sequence
  Description of Artificial Sequence: Synthetic oligonucleotide
  Target: ATXN1; (+) strand; PAM type: NRG; PAM sequence: CGG
tccttgtagttctagatatt

SEQ ID NO: 150047 - DNA, 20 bp, Artificial Sequence
  Description of Artificial Sequence: Synthetic oligonucleotide
  Target: ATXN1; (+) strand; PAM type: NRG; PAM sequence: GGG
ccttgtagttctagatattc

SEQ ID NO: 150048 - DNA, 20 bp, Artificial Sequence
  Description of Artificial Sequence: Synthetic oligonucleotide
  Target: ATXN1; (+) strand; PAM type: NRG; PAM sequence: GAG
ttgtagttctagatattcgg

SEQ ID NO: 150049 - DNA, 20 bp, Artificial Sequence
  Description of Artificial Sequence: Synthetic oligonucleotide
  Target: ATXN1; (+) strand; PAM type: NRG; PAM sequence: AGG
tgtagttctagatattcggg

SEQ ID NO: 150050 - DNA, 20 bp, Artificial Sequence
  Description of Artificial Sequence: Synthetic oligonucleotide
  Target: ATXN1; (+) strand; PAM type: NRG; PAM sequence: TGG
gttctagatattcgggaggc

SEQ ID NO: 150051 - DNA, 20 bp, Artificial Sequence
  Description of Artificial Sequence: Synthetic oligonucleotide
  Target: ATXN1; (+) strand; PAM type: NRG; PAM sequence: AAG
gatattcgggaggctggaac

SEQ ID NO: 150052 - DNA, 20 bp, Artificial Sequence
  Description of Artificial Sequence: Synthetic oligonucleotide
  Target: ATXN1; (+) strand; PAM type: NRG; PAM sequence: GAG
tattcgggaggctggaacaa

SEQ ID NO: 150053 - DNA, 20 bp, Artificial Sequence
  Description of Artificial Sequence: Synthetic oligonucleotide
  Target: ATXN1; (+) strand; PAM type: NRG; PAM sequence: AGG
attcgggaggctggaacaag

SEQ ID NO: 150054 - DNA, 20 bp, Artificial Sequence
  Description of Artificial Sequence: Synthetic oligonucleotide
  Target: ATXN1; (+) strand; PAM type: NRG; PAM sequence: GAG
ctggaacaagaggactgctt

SEQ ID NO: 150055 - DNA, 20 bp, Artificial Sequence
  Description of Artificial Sequence: Synthetic oligonucleotide
  Target: ATXN1; (+) strand; PAM type: NRG; PAM sequence: CGG
acaagaggactgcttgagcc

SEQ ID NO: 150056 - DNA, 20 bp, Artificial Sequence
  Description of Artificial Sequence: Synthetic oligonucleotide
  Target: ATXN1; (+) strand; PAM type: NRG; PAM sequence: GGG
caagaggactgcttgagccc

SEQ ID NO: 150057 - DNA, 20 bp, Artificial Sequence
  Description of Artificial Sequence: Synthetic oligonucleotide
  Target: ATXN1; (+) strand; PAM type: NRG; PAM sequence: GAG
ctgcttgagcccgggtattt

SEQ ID NO: 150058 - DNA, 20 bp, Artificial Sequence
  Description of Artificial Sequence: Synthetic oligonucleotide
  Target: ATXN1; (+) strand; PAM type: NRG; PAM sequence: AGG
tgcttgagcccgggtatttg

SEQ ID NO: 150059 - DNA, 20 bp, Artificial Sequence
  Description of Artificial Sequence: Synthetic oligonucleotide
  Target: ATXN1; (+) strand; PAM type: NRG; PAM sequence: CAG
agcccgggtatttgaggctg

SEQ ID NO: 150060 - DNA, 20 bp, Artificial Sequence
  Description of Artificial Sequence: Synthetic oligonucleotide
  Target: ATXN1; (+) strand; PAM type: NRG; PAM sequence: GAG
cgggtatttgaggctgcagt

SEQ ID NO: 150061 - DNA, 20 bp, Artificial Sequence
  Description of Artificial Sequence: Synthetic oligonucleotide
  Target: ATXN1; (+) strand; PAM type: NRG; PAM sequence: CAG
atgatcatgccactgcactc

SEQ ID NO: 150062 - DNA, 20 bp, Artificial Sequence
  Description of Artificial Sequence: Synthetic oligonucleotide
  Target: ATXN1; (+) strand; PAM type: NRG; PAM sequence: CAG
tcatgccactgcactccagc

SEQ ID NO: 150063 - DNA, 20 bp, Artificial Sequence
  Description of Artificial Sequence: Synthetic oligonucleotide
  Target: ATXN1; (+) strand; PAM type: NRG; PAM sequence: AGG
catgccactgcactccagcc

SEQ ID NO: 150064 - DNA, 20 bp, Artificial Sequence
  Description of Artificial Sequence: Synthetic oligonucleotide
  Target: ATXN1; (+) strand; PAM type: NRG; PAM sequence: GGG
atgccactgcactccagcca

SEQ ID NO: 150065 - DNA, 20 bp, Artificial Sequence
  Description of Artificial Sequence: Synthetic oligonucleotide
  Target: ATXN1; (+) strand; PAM type: NRG; PAM sequence: TAG
ctgcactccagccagggtga

SEQ ID NO: 150066 - DNA, 20 bp, Artificial Sequence
  Description of Artificial Sequence: Synthetic oligonucleotide
  Target: ATXN1; (+) strand; PAM type: NRG; PAM sequence: GAG
gcactccagccagggtgata

SEQ ID NO: 150067 - DNA, 20 bp, Artificial Sequence
  Description of Artificial Sequence: Synthetic oligonucleotide
  Target: ATXN1; (+) strand; PAM type: NRG; PAM sequence: AGG
cactccagccagggtgatag

SEQ ID NO: 150068 - DNA, 20 bp, Artificial Sequence
  Description of Artificial Sequence: Synthetic oligonucleotide
  Target: ATXN1; (+) strand; PAM type: NRG; PAM sequence: GGG
actccagccagggtgataga

SEQ ID NO: 150069 - DNA, 20 bp, Artificial Sequence
  Description of Artificial Sequence: Synthetic oligonucleotide
  Target: ATXN1; (+) strand; PAM type: NRG; PAM sequence: GAG
tccagccagggtgatagagg

SEQ ID NO: 150070 - DNA, 20 bp, Artificial Sequence
  Description of Artificial Sequence: Synthetic oligonucleotide
  Target: ATXN1; (+) strand; PAM type: NRG; PAM sequence: CAG
ataaataaataaatacgtac

SEQ ID NO: 150071 - DNA, 20 bp, Artificial Sequence
  Description of Artificial Sequence: Synthetic oligonucleotide
  Target: ATXN1; (+) strand; PAM type: NRG; PAM sequence: AGG
taaataaataaatacgtacc

SEQ ID NO: 150072 - DNA, 20 bp, Artificial Sequence
  Description of Artificial Sequence: Synthetic oligonucleotide
  Target: ATXN1; (+) strand; PAM type: NRG; PAM sequence: CAG
taccaggtatgtctgcaatg

SEQ ID NO: 150073 - DNA, 20 bp, Artificial Sequence
  Description of Artificial Sequence: Synthetic oligonucleotide
  Target: ATXN1; (+) strand; PAM type: NRG; PAM sequence: TGG
taatgtaataatttacaaaa

SEQ ID NO: 150074 - DNA, 20 bp, Artificial Sequence
  Description of Artificial Sequence: Synthetic oligonucleotide
  Target: ATXN1; (+) strand; PAM type: NRG; PAM sequence: TGG
tttacaaaatggccatgtca

SEQ ID NO: 150075 - DNA, 20 bp, Artificial Sequence
  Description of Artificial Sequence: Synthetic oligonucleotide
  Target: ATXN1; (+) strand; PAM type: NRG; PAM sequence: TAG
ttatttttaattgaataaaa

SEQ ID NO: 150076 - DNA, 20 bp, Artificial Sequence
  Description of Artificial Sequence: Synthetic oligonucleotide
  Target: ATXN1; (+) strand; PAM type: NRG; PAM sequence: AGG
tatttttaattgaataaaat

SEQ ID NO: 150077 - DNA, 20 bp, Artificial Sequence
  Description of Artificial Sequence: Synthetic oligonucleotide
  Target: ATXN1; (+) strand; PAM type: NRG; PAM sequence: TAG
ttttaattgaataaaatagg

SEQ ID NO: 150078 - DNA, 20 bp, Artificial Sequence
  Description of Artificial Sequence: Synthetic oligonucleotide
  Target: ATXN1; (+) strand; PAM type: NRG; PAM sequence: TGG
tgaataaaataggtagctta

SEQ ID NO: 150079 - DNA, 20 bp, Artificial Sequence
  Description of Artificial Sequence: Synthetic oligonucleotide
  Target: ATXN1; (+) strand; PAM type: NRG; PAM sequence: CAG
atggcttgttttctgtaact

SEQ ID NO: 150080 - DNA, 20 bp, Artificial Sequence
  Description of Artificial Sequence: Synthetic oligonucleotide
  Target: ATXN1; (+) strand; PAM type: NRG; PAM sequence: AAG
ctcagccttaacattttgtt

SEQ ID NO: 150081 - DNA, 20 bp, Artificial Sequence
  Description of Artificial Sequence: Synthetic oligonucleotide
  Target: ATXN1; (+) strand; PAM type: NRG; PAM sequence: CAG
agcctttcatttgttttcct

SEQ ID NO: 150082 - DNA, 20 bp, Artificial Sequence
  Description of Artificial Sequence: Synthetic oligonucleotide
  Target: ATXN1; (+) strand; PAM type: NRG; PAM sequence: AAG
ctttcatttgttttcctcag

SEQ ID NO: 150083 - DNA, 20 bp, Artificial Sequence
  Description of Artificial Sequence: Synthetic oligonucleotide
  Target: ATXN1; (+) strand; PAM type: NRG; PAM sequence: TGG
atctttcaattctaaataaa

SEQ ID NO: 150084 - DNA, 20 bp, Artificial Sequence
  Description of Artificial Sequence: Synthetic oligonucleotide
  Target: ATXN1; (+) strand; PAM type: NRG; PAM sequence: GAG
atggttcctatgaacctttt

SEQ ID NO: 150085 - DNA, 20 bp, Artificial Sequence
  Description of Artificial Sequence: Synthetic oligonucleotide
  Target: ATXN1; (+) strand; PAM type: NRG; PAM sequence: CAG
cctatgaaccttttgagaaa

SEQ ID NO: 150086 - DNA, 20 bp, Artificial Sequence
  Description of Artificial Sequence: Synthetic oligonucleotide
  Target: ATXN1; (+) strand; PAM type: NRG; PAM sequence: TGG
cttttgagaaacagaattct

SEQ ID NO: 150087 - DNA, 20 bp, Artificial Sequence
  Description of Artificial Sequence: Synthetic oligonucleotide
  Target: ATXN1; (+) strand; PAM type: NRG; PAM sequence: GAG
tttgagaaacagaattcttg

SEQ ID NO: 150088 - DNA, 20 bp, Artificial Sequence
  Description of Artificial Sequence: Synthetic oligonucleotide
  Target: ATXN1; (+) strand; PAM type: NRG; PAM sequence: AGG
ttgagaaacagaattcttgg

SEQ ID NO: 150089 - DNA, 20 bp, Artificial Sequence
  Description of Artificial Sequence: Synthetic oligonucleotide
  Target: ATXN1; (+) strand; PAM type: NRG; PAM sequence: AAG
ttcttggaggatctgattga

SEQ ID NO: 150090 - DNA, 20 bp, Artificial Sequence
  Description of Artificial Sequence: Synthetic oligonucleotide
  Target: ATXN1; (+) strand; PAM type: NRG; PAM sequence: CAG
tgaaagctacaatcctctcc

SEQ ID NO: 150091 - DNA, 20 bp, Artificial Sequence
  Description of Artificial Sequence: Synthetic oligonucleotide
  Target: ATXN1; (+) strand; PAM type: NRG; PAM sequence: CAG
cccagaaaaacccacataca

SEQ ID NO: 150092 - DNA, 20 bp, Artificial Sequence
  Description of Artificial Sequence: Synthetic oligonucleotide
  Target: ATXN1; (+) strand; PAM type: NRG; PAM sequence: CAG
cagaatgtcatgctgtaata

SEQ ID NO: 150093 - DNA, 20 bp, Artificial Sequence
  Description of Artificial Sequence: Synthetic oligonucleotide
  Target: ATXN1; (+) strand; PAM type: NRG; PAM sequence: TGG
tcatgctgtaatacagttcc

SEQ ID NO: 150094 - DNA, 20 bp, Artificial Sequence
  Description of Artificial Sequence: Synthetic oligonucleotide
  Target: ATXN1; (+) strand; PAM type: NRG; PAM sequence: GGG
catgctgtaatacagttcct

SEQ ID NO: 150095 - DNA, 20 bp, Artificial Sequence
  Description of Artificial Sequence: Synthetic oligonucleotide
  Target: ATXN1; (+) strand; PAM type: NRG; PAM sequence: GGG
atgctgtaatacagttcctg

SEQ ID NO: 150096 - DNA, 20 bp, Artificial Sequence
  Description of Artificial Sequence: Synthetic oligonucleotide
  Target: ATXN1; (+) strand; PAM type: NRG; PAM sequence: GGG
tgctgtaatacagttcctgg

SEQ ID NO: 150097 - DNA, 20 bp, Artificial Sequence
  Description of Artificial Sequence: Synthetic oligonucleotide
  Target: ATXN1; (+) strand; PAM type: NRG; PAM sequence: GAG
ctgtaatacagttcctgggg

SEQ ID NO: 150098 - DNA, 20 bp, Artificial Sequence
  Description of Artificial Sequence: Synthetic oligonucleotide
  Target: ATXN1; (+) strand; PAM type: NRG; PAM sequence: TGG
tacagttcctgggggagcct

SEQ ID NO: 150099 - DNA, 20 bp, Artificial Sequence
  Description of Artificial Sequence: Synthetic oligonucleotide
  Target: ATXN1; (+) strand; PAM type: NRG; PAM sequence: GGG
acagttcctgggggagcctt

SEQ ID NO: 150100 - DNA, 20 bp, Artificial Sequence
  Description of Artificial Sequence: Synthetic oligonucleotide
  Target: ATXN1; (+) strand; PAM type: NRG; PAM sequence: TGG
gggggagccttgggacgttc

SEQ ID NO: 150101 - DNA, 20 bp, Artificial Sequence
  Description of Artificial Sequence: Synthetic oligonucleotide
  Target: ATXN1; (+) strand; PAM type: NRG; PAM sequence: AAG
agccttgggacgttctggaa

SEQ ID NO: 150102 - DNA, 20 bp, Artificial Sequence
  Description of Artificial Sequence: Synthetic oligonucleotide
  Target: ATXN1; (+) strand; PAM type: NRG; PAM sequence: CAG
tgggacgttctggaaaagtt

SEQ ID NO: 150103 - DNA, 20 bp, Artificial Sequence
  Description of Artificial Sequence: Synthetic oligonucleotide
  Target: ATXN1; (+) strand; PAM type: NRG; PAM sequence: CAG
ttctggaaaagttcagtgat

SEQ ID NO: 150104 - DNA, 20 bp, Artificial Sequence
  Description of Artificial Sequence: Synthetic oligonucleotide
  Target: ATXN1; (+) strand; PAM type: NRG; PAM sequence: AAG
aagttcagtgatcagaaatg

SEQ ID NO: 150105 - DNA, 20 bp, Artificial Sequence
  Description of Artificial Sequence: Synthetic oligonucleotide
  Target: ATXN1; (+) strand; PAM type: NRG; PAM sequence: CAG
aattcccaaccaccttattg

SEQ ID NO: 150106 - DNA, 20 bp, Artificial Sequence
  Description of Artificial Sequence: Synthetic oligonucleotide
  Target: ATXN1; (+) strand; PAM type: NRG; PAM sequence: TGG
tcccaaccaccttattgcag

SEQ ID NO: 150107 - DNA, 20 bp, Artificial Sequence
  Description of Artificial Sequence: Synthetic oligonucleotide
  Target: ATXN1; (+) strand; PAM type: NRG; PAM sequence: AAG
accttattgcagtggccgca

SEQ ID NO: 150108 - DNA, 20 bp, Artificial Sequence
  Description of Artificial Sequence: Synthetic oligonucleotide
  Target: ATXN1; (+) strand; PAM type: NRG; PAM sequence: AGG
ccttattgcagtggccgcaa

SEQ ID NO: 150109 - DNA, 20 bp, Artificial Sequence
  Description of Artificial Sequence: Synthetic oligonucleotide
  Target: ATXN1; (+) strand; PAM type: NRG; PAM sequence: GGG
cttattgcagtggccgcaaa

SEQ ID NO: 150110 - DNA, 20 bp, Artificial Sequence
  Description of Artificial Sequence: Synthetic oligonucleotide
  Target: ATXN1; (+) strand; PAM type: NRG; PAM sequence: GGG
ttattgcagtggccgcaaag

SEQ ID NO: 150111 - DNA, 20 bp, Artificial Sequence
  Description of Artificial Sequence: Synthetic oligonucleotide
  Target: ATXN1; (+) strand; PAM type: NRG; PAM sequence: CAG
tggccgcaaaggggcacact

SEQ ID NO: 150112 - DNA, 20 bp, Artificial Sequence
  Description of Artificial Sequence: Synthetic oligonucleotide
  Target: ATXN1; (+) strand; PAM type: NRG; PAM sequence: TGG
ccgcaaaggggcacactcag

SEQ ID NO: 150113 - DNA, 20 bp, Artificial Sequence
  Description of Artificial Sequence: Synthetic oligonucleotide
  Target: ATXN1; (+) strand; PAM type: NRG; PAM sequence: AAG
ggcctcacctgaccactgca

SEQ ID NO: 150114 - DNA, 20 bp, Artificial Sequence
  Description of Artificial Sequence: Synthetic oligonucleotide
  Target: ATXN1; (+) strand; PAM type: NRG; PAM sequence: TAG
actgcaaagattcgttcttc

SEQ ID NO: 150115 - DNA, 20 bp, Artificial Sequence
  Description of Artificial Sequence: Synthetic oligonucleotide
  Target: ATXN1; (+) strand; PAM type: NRG; PAM sequence: CAG
caaagattcgttcttctagc

SEQ ID NO: 150116 - DNA, 20 bp, Artificial Sequence
  Description of Artificial Sequence: Synthetic oligonucleotide
  Target: ATXN1; (+) strand; PAM type: NRG; PAM sequence: TAG
ttctagccagcctacacaat

SEQ ID NO: 150117 - DNA, 20 bp, Artificial Sequence
  Description of Artificial Sequence: Synthetic oligonucleotide
  Target: ATXN1; (+) strand; PAM type: NRG; PAM sequence: AGG
tctagccagcctacacaatt

SEQ ID NO: 150118 - DNA, 20 bp, Artificial Sequence
  Description of Artificial Sequence: Synthetic oligonucleotide
  Target: ATXN1; (+) strand; PAM type: NRG; PAM sequence: AAG
cacaattaggcaccaactca

SEQ ID NO: 150119 - DNA, 20 bp, Artificial Sequence
  Description of Artificial Sequence: Synthetic oligonucleotide
  Target: ATXN1; (+) strand; PAM type: NRG; PAM sequence: CAG
atatcatgttgcaaactatg

SEQ ID NO: 150120 - DNA, 20 bp, Artificial Sequence
  Description of Artificial Sequence: Synthetic oligonucleotide
  Target: ATXN1; (+) strand; PAM type: NRG; PAM sequence: GAG
atgcagcattaactgatgtt

SEQ ID NO: 150121 - DNA, 20 bp, Artificial Sequence
  Description of Artificial Sequence: Synthetic oligonucleotide
  Target: ATXN1; (+) strand; PAM type: NRG; PAM sequence: AGG
tgcagcattaactgatgttg

SEQ ID NO: 150122 - DNA, 20 bp, Artificial Sequence
  Description of Artificial Sequence: Synthetic oligonucleotide
  Target: ATXN1; (+) strand; PAM type: NRG; PAM sequence: AAG
aactgatgttgaggaaatga

SEQ ID NO: 150123 - DNA, 20 bp, Artificial Sequence
  Description of Artificial Sequence: Synthetic oligonucleotide
  Target: ATXN1; (+) strand; PAM type: NRG; PAM sequence: AGG
actgatgttgaggaaatgaa

SEQ ID NO: 150124 - DNA, 20 bp, Artificial Sequence
  Description of Artificial Sequence: Synthetic oligonucleotide
  Target: ATXN1; (+) strand; PAM type: NRG; PAM sequence: GAG
tgatgttgaggaaatgaaag

SEQ ID NO: 150125 - DNA, 20 bp, Artificial Sequence
  Description of Artificial Sequence: Synthetic oligonucleotide
  Target: ATXN1; (+) strand; PAM type: NRG; PAM sequence: GAG
aggaaatgaaaggagataac

SEQ ID NO: 150126 - DNA, 20 bp, Artificial Sequence
  Description of Artificial Sequence: Synthetic oligonucleotide
  Target: ATXN1; (+) strand; PAM type: NRG; PAM sequence: AAG
tgaaaggagataacgagtcc

SEQ ID NO: 150127 - DNA, 20 bp, Artificial Sequence
  Description of Artificial Sequence: Synthetic oligonucleotide
  Target: ATXN1; (+) strand; PAM type: NRG; PAM sequence: TGG
cattacacacttctcccaaa

SEQ ID NO: 150128 - DNA, 20 bp, Artificial Sequence
  Description of Artificial Sequence: Synthetic oligonucleotide
  Target: ATXN1; (+) strand; PAM type: NRG; PAM sequence: CAG
acttctcccaaatggcactg

SEQ ID NO: 150129 - DNA, 20 bp, Artificial Sequence
  Description of Artificial Sequence: Synthetic oligonucleotide
  Target: ATXN1; (+) strand; PAM type: NRG; PAM sequence: CAG
tctcccaaatggcactgcag

SEQ ID NO: 150130 - DNA, 20 bp, Artificial Sequence
  Description of Artificial Sequence: Synthetic oligonucleotide
  Target: ATXN1; (+) strand; PAM type: NRG; PAM sequence: AGG
ctcccaaatggcactgcagc

SEQ ID NO: 150131 - DNA, 20 bp, Artificial Sequence
  Description of Artificial Sequence: Synthetic oligonucleotide
  Target: ATXN1; (+) strand; PAM type: NRG; PAM sequence: GGG
tcccaaatggcactgcagca

SEQ ID NO: 150132 - DNA, 20 bp, Artificial Sequence
  Description of Artificial Sequence: Synthetic oligonucleotide
  Target: ATXN1; (+) strand; PAM type: NRG; PAM sequence: GGG
cccaaatggcactgcagcag

SEQ ID NO: 150133 - DNA, 20 bp, Artificial Sequence
  Description of Artificial Sequence: Synthetic oligonucleotide
  Target: ATXN1; (+) strand; PAM type: NRG; PAM sequence: GGG
ccaaatggcactgcagcagg

SEQ ID NO: 150134 - DNA, 20 bp, Artificial Sequence
  Description of Artificial Sequence: Synthetic oligonucleotide
  Target: ATXN1; (+) strand; PAM type: NRG; PAM sequence: CGG
aatggcactgcagcaggggg

SEQ ID NO: 150135 - DNA, 20 bp, Artificial Sequence
  Description of Artificial Sequence: Synthetic oligonucleotide
  Target: ATXN1; (+) strand; PAM type: NRG; PAM sequence: AAG
ctgcagcagggggcggctgt

SEQ ID NO: 150136 - DNA, 20 bp, Artificial Sequence
  Description of Artificial Sequence: Synthetic oligonucleotide
  Target: ATXN1; (+) strand; PAM type: NRG; PAM sequence: CAG
agcagggggcggctgtaagc

SEQ ID NO: 150137 - DNA, 20 bp, Artificial Sequence
  Description of Artificial Sequence: Synthetic oligonucleotide
  Target: ATXN1; (+) strand; PAM type: NRG; PAM sequence: AGG
gcagggggcggctgtaagcc

SEQ ID NO: 150138 - DNA, 20 bp, Artificial Sequence
  Description of Artificial Sequence: Synthetic oligonucleotide
  Target: ATXN1; (+) strand; PAM type: NRG; PAM sequence: CAG
ggcggctgtaagccaggcaa

SEQ ID NO: 150139 - DNA, 20 bp, Artificial Sequence
  Description of Artificial Sequence: Synthetic oligonucleotide
  Target: ATXN1; (+) strand; PAM type: NRG; PAM sequence: AGG
gcggctgtaagccaggcaac

SEQ ID NO: 150140 - DNA, 20 bp, Artificial Sequence
  Description of Artificial Sequence: Synthetic oligonucleotide
  Target: ATXN1; (+) strand; PAM type: NRG; PAM sequence: GAG
ggctgtaagccaggcaacag

SEQ ID NO: 150141 - DNA, 20 bp, Artificial Sequence
  Description of Artificial Sequence: Synthetic oligonucleotide
  Target: ATXN1; (+) strand; PAM type: NRG; PAM sequence: TAG
gcaacaggagatgcattcat

SEQ ID NO: 150142 - DNA, 20 bp, Artificial Sequence
  Description of Artificial Sequence: Synthetic oligonucleotide
  Target: ATXN1; (+) strand; PAM type: NRG; PAM sequence: AAG
agccatgacctcccaatgcc

SEQ ID NO: 150143 - DNA, 20 bp, Artificial Sequence
  Description of Artificial Sequence: Synthetic oligonucleotide
  Target: ATXN1; (+) strand; PAM type: NRG; PAM sequence: AAG
atgacctcccaatgccaaga

SEQ ID NO: 150144 - DNA, 20 bp, Artificial Sequence
  Description of Artificial Sequence: Synthetic oligonucleotide
  Target: ATXN1; (+) strand; PAM type: NRG; PAM sequence: AGG
tgacctcccaatgccaagaa

SEQ ID NO: 150145 - DNA, 20 bp, Artificial Sequence
  Description of Artificial Sequence: Synthetic oligonucleotide
  Target: ATXN1; (+) strand; PAM type: NRG; PAM sequence: GGG
gacctcccaatgccaagaaa

SEQ ID NO: 150146 - DNA, 20 bp, Artificial Sequence
  Description of Artificial Sequence: Synthetic oligonucleotide
  Target: ATXN1; (+) strand; PAM type: NRG; PAM sequence: AAG
caatgccaagaaagggccca

SEQ ID NO: 150147 - DNA, 20 bp, Artificial Sequence
  Description of Artificial Sequence: Synthetic oligonucleotide
  Target: ATXN1; (+) strand; PAM type: NRG; PAM sequence: CAG
ccaagaaagggcccaaagtt

SEQ ID NO: 150148 - DNA, 20 bp, Artificial Sequence
  Description of Artificial Sequence: Synthetic oligonucleotide
  Target: ATXN1; (+) strand; PAM type: NRG; PAM sequence: TGG
agggcccaaagttcagcaaa

SEQ ID NO: 150149 - DNA, 20 bp, Artificial Sequence
  Description of Artificial Sequence: Synthetic oligonucleotide
  Target: ATXN1; (+) strand; PAM type: NRG; PAM sequence: GGG
gggcccaaagttcagcaaat

SEQ ID NO: 150150 - DNA, 20 bp, Artificial Sequence
  Description of Artificial Sequence: Synthetic oligonucleotide
  Target: ATXN1; (+) strand; PAM type: NRG; PAM sequence: GGG
ggcccaaagttcagcaaatg

SEQ ID NO: 150151 - DNA, 20 bp, Artificial Sequence
  Description of Artificial Sequence: Synthetic oligonucleotide
  Target: ATXN1; (+) strand; PAM type: NRG; PAM sequence: TAG
gttcagcaaatggggatgat

SEQ ID NO: 150152 - DNA, 20 bp, Artificial Sequence
  Description of Artificial Sequence: Synthetic oligonucleotide
  Target: ATXN1; (+) strand; PAM type: NRG; PAM sequence: AAG
gggatgattagaaattttac

SEQ ID NO: 150153 - DNA, 20 bp, Artificial Sequence
  Description of Artificial Sequence: Synthetic oligonucleotide
  Target: ATXN1; (+) strand; PAM type: NRG; PAM sequence: GAG
ttacaagaaaatgaaatctt

SEQ ID NO: 150154 - DNA, 20 bp, Artificial Sequence
  Description of Artificial Sequence: Synthetic oligonucleotide
  Target: ATXN1; (+) strand; PAM type: NRG; PAM sequence: AAG
tacatgttccacgtcctgtg

SEQ ID NO: 150155 - DNA, 20 bp, Artificial Sequence
  Description of Artificial Sequence: Synthetic oligonucleotide
  Target: ATXN1; (+) strand; PAM type: NRG; PAM sequence: AAG
ccacgtcctgtgaagttata

SEQ ID NO: 150156 - DNA, 20 bp, Artificial Sequence
  Description of Artificial Sequence: Synthetic oligonucleotide
  Target: ATXN1; (+) strand; PAM type: NRG; PAM sequence: AAG
tcctgtgaagttataaagaa

SEQ ID NO: 150157 - DNA, 20 bp, Artificial Sequence
  Description of Artificial Sequence: Synthetic oligonucleotide
  Target: ATXN1; (+) strand; PAM type: NRG; PAM sequence: AAG
agatacatttaaatgaacaa

SEQ ID NO: 150158 - DNA, 20 bp, Artificial Sequence
  Description of Artificial Sequence: Synthetic oligonucleotide
  Target: ATXN1; (+) strand; PAM type: NRG; PAM sequence: AAG
atttaaatgaacaaaagcca

SEQ ID NO: 150159 - DNA, 20 bp, Artificial Sequence
  Description of Artificial Sequence: Synthetic oligonucleotide
  Target: ATXN1; (+) strand; PAM type: NRG; PAM sequence: AGG
tttaaatgaacaaaagccaa

SEQ ID NO: 150160 - DNA, 20 bp, Artificial Sequence
  Description of Artificial Sequence: Synthetic oligonucleotide
  Target: ATXN1; (+) strand; PAM type: NRG; PAM sequence: AAG
aaatgaacaaaagccaaagg

SEQ ID NO: 150161 - DNA, 20 bp, Artificial Sequence
  Description of Artificial Sequence: Synthetic oligonucleotide
  Target: ATXN1; (+) strand; PAM type: NRG; PAM sequence: TAG
aaggaagtgctcactaataa

SEQ ID NO: 150162 - DNA, 20 bp, Artificial Sequence
  Description of Artificial Sequence: Synthetic oligonucleotide
  Target: ATXN1; (+) strand; PAM type: NRG; PAM sequence: AAG
ataatagtctaattacaaaa

SEQ ID NO: 150163 - DNA, 20 bp, Artificial Sequence
  Description of Artificial Sequence: Synthetic oligonucleotide
  Target: ATXN1; (+) strand; PAM type: NRG; PAM sequence: TGG
ccatctcactatcgcttttc

SEQ ID NO: 150164 - DNA, 20 bp, Artificial Sequence
  Description of Artificial Sequence: Synthetic oligonucleotide
  Target: ATXN1; (+) strand; PAM type: NRG; PAM sequence: GGG
catctcactatcgcttttct

SEQ ID NO: 150165 - DNA, 20 bp, Artificial Sequence
  Description of Artificial Sequence: Synthetic oligonucleotide
  Target: ATXN1; (+) strand; PAM type: NRG; PAM sequence: GAG
tttctgggctacatgtatat

SEQ ID NO: 150166 - DNA, 20 bp, Artificial Sequence
  Description of Artificial Sequence: Synthetic oligonucleotide
  Target: ATXN1; (+) strand; PAM type: NRG; PAM sequence: CAG
gtatatgagcgcaaaactca

SEQ ID NO: 150167 - DNA, 20 bp, Artificial Sequence
  Description of Artificial Sequence: Synthetic oligonucleotide
  Target: ATXN1; (+) strand; PAM type: NRG; PAM sequence: CAG
taataaaaaatccaaaataa

SEQ ID NO: 150168 - DNA, 20 bp, Artificial Sequence
  Description of Artificial Sequence: Synthetic oligonucleotide
  Target: ATXN1; (+) strand; PAM type: NRG; PAM sequence: AGG
aataaaaaatccaaaataac

SEQ ID NO: 150169 - DNA, 20 bp, Artificial Sequence
  Description of Artificial Sequence: Synthetic oligonucleotide
  Target: ATXN1; (+) strand; PAM type: NRG; PAM sequence: CAG
aggaaacatctacaattatc

SEQ ID NO: 150170 - DNA, 20 bp, Artificial Sequence
  Description of Artificial Sequence: Synthetic oligonucleotide
  Target: ATXN1; (+) strand; PAM type: NRG; PAM sequence: GAG
gaaacatctacaattatcca

SEQ ID NO: 150171 - DNA, 20 bp, Artificial Sequence
  Description of Artificial Sequence: Synthetic oligonucleotide
  Target: ATXN1; (+) strand; PAM type: NRG; PAM sequence: AAG
agaaaatatgtcaaattata

SEQ ID NO: 150172 - DNA, 20 bp, Artificial Sequence
  Description of Artificial Sequence: Synthetic oligonucleotide
  Target: ATXN1; (+) strand; PAM type: NRG; PAM sequence: GAG
tgtcaaattataaagtctct

SEQ ID NO: 150173 - DNA, 20 bp, Artificial Sequence
  Description of Artificial Sequence: Synthetic oligonucleotide
  Target: ATXN1; (+) strand; PAM type: NRG; PAM sequence: TAG
ataaagtctctgagtcatga

SEQ ID NO: 150174 - DNA, 20 bp, Artificial Sequence
  Description of Artificial Sequence: Synthetic oligonucleotide
  Target: ATXN1; (+) strand; PAM type: NRG; PAM sequence: GAG
tcatgatagtaatcaaacct

SEQ ID NO: 150175 - DNA, 20 bp, Artificial Sequence
  Description of Artificial Sequence: Synthetic oligonucleotide
  Target: ATXN1; (+) strand; PAM type: NRG; PAM sequence: TGG
aatcaaacctgagtctctat

SEQ ID NO: 150176 - DNA, 20 bp, Artificial Sequence
  Description of Artificial Sequence: Synthetic oligonucleotide
  Target: ATXN1; (+) strand; PAM type: NRG; PAM sequence: GAG
tatttcctgtaataaaaact

SEQ ID NO: 150177 - DNA, 20 bp, Artificial Sequence
  Description of Artificial Sequence: Synthetic oligonucleotide
  Target: ATXN1; (+) strand; PAM type: NRG; PAM sequence: AGG
atttcctgtaataaaaactg

SEQ ID NO: 150178 - DNA, 20 bp, Artificial Sequence
  Description of Artificial Sequence: Synthetic oligonucleotide
  Target: ATXN1; (+) strand; PAM type: NRG; PAM sequence: TAG
ctgtaataaaaactgaggtg

SEQ ID NO: 150179 - DNA, 20 bp, Artificial Sequence
  Description of Artificial Sequence: Synthetic oligonucleotide
  Target: ATXN1; (+) strand; PAM type: NRG; PAM sequence: CAG
aaaactgaggtgtagttact

SEQ ID NO: 150180 - DNA, 20 bp, Artificial Sequence
  Description of Artificial Sequence: Synthetic oligonucleotide
  Target: ATXN1; (+) strand; PAM type: NRG; PAM sequence: AGG
aaactgaggtgtagttactc

SEQ ID NO: 150181 - DNA, 20 bp, Artificial Sequence
  Description of Artificial Sequence: Synthetic oligonucleotide
  Target: ATXN1; (+) strand; PAM type: NRG; PAM sequence: TAG
gtgtagttactcaggttctt

SEQ ID NO: 150182 - DNA, 20 bp, Artificial Sequence
  Description of Artificial Sequence: Synthetic oligonucleotide
  Target: ATXN1; (+) strand; PAM type: NRG; PAM sequence: GAG
agttactcaggttctttagt

SEQ ID NO: 150183 - DNA, 20 bp, Artificial Sequence
  Description of Artificial Sequence: Synthetic oligonucleotide
  Target: ATXN1; (+) strand; PAM type: NRG; PAM sequence: AAG
tcaacacatgtaatttgcta

SEQ ID NO: 150184 - DNA, 20 bp, Artificial Sequence
  Description of Artificial Sequence: Synthetic oligonucleotide
  Target: ATXN1; (+) strand; PAM type: NRG; PAM sequence: TGG
acacactgttgctttcccca

SEQ ID NO: 150185 - DNA, 20 bp, Artificial Sequence
  Description of Artificial Sequence: Synthetic oligonucleotide
  Target: ATXN1; (+) strand; PAM type: NRG; PAM sequence: GAG
ctgttgctttccccatggct

SEQ ID NO: 150186 - DNA, 20 bp, Artificial Sequence
  Description of Artificial Sequence: Synthetic oligonucleotide
  Target: ATXN1; (+) strand; PAM type: NRG; PAM sequence: CAG
tttccccatggctgagaatg

SEQ ID NO: 150187 - DNA, 20 bp, Artificial Sequence
  Description of Artificial Sequence: Synthetic oligonucleotide
  Target: ATXN1; (+) strand; PAM type: NRG; PAM sequence: CAG
catggctgagaatgcagtgt

SEQ ID NO: 150188 - DNA, 20 bp, Artificial Sequence
  Description of Artificial Sequence: Synthetic oligonucleotide
  Target: ATXN1; (+) strand; PAM type: NRG; PAM sequence: GAG
atgcagtgtcagtaacatgc

SEQ ID NO: 150189 - DNA, 20 bp, Artificial Sequence
  Description of Artificial Sequence: Synthetic oligonucleotide
  Target: ATXN1; (+) strand; PAM type: NRG; PAM sequence: AAG
agttttctgctctgcttcaa

SEQ ID NO: 150190 - DNA, 20 bp, Artificial Sequence
  Description of Artificial Sequence: Synthetic oligonucleotide
  Target: ATXN1; (+) strand; PAM type: NRG; PAM sequence: AAG
tcaaaagatctgttatgttt

SEQ ID NO: 150191 - DNA, 20 bp, Artificial Sequence
  Description of Artificial Sequence: Synthetic oligonucleotide
  Target: ATXN1; (+) strand; PAM type: NRG; PAM sequence: CAG
ctctcacacacacgcaaata

SEQ ID NO: 150192 - DNA, 20 bp, Artificial Sequence
  Description of Artificial Sequence: Synthetic oligonucleotide
  Target: ATXN1; (+) strand; PAM type: NRG; PAM sequence: AAG
tcacacacacgcaaatacag

SEQ ID NO: 150193 - DNA, 20 bp, Artificial Sequence
  Description of Artificial Sequence: Synthetic oligonucleotide
  Target: ATXN1; (+) strand; PAM type: NRG; PAM sequence: AAG
tacagaagtattttctacca

SEQ ID NO: 150194 - DNA, 20 bp, Artificial Sequence
  Description of Artificial Sequence: Synthetic oligonucleotide
  Target: ATXN1; (+) strand; PAM type: NRG; PAM sequence: AAG
agaagtattttctaccaaag

SEQ ID NO: 150195 - DNA, 20 bp, Artificial Sequence
  Description of Artificial Sequence: Synthetic oligonucleotide
  Target: ATXN1; (+) strand; PAM type: NRG; PAM sequence: AGG
gaagtattttctaccaaaga

SEQ ID NO: 150196 - DNA, 20 bp, Artificial Sequence
  Description of Artificial Sequence: Synthetic oligonucleotide
  Target: ATXN1; (+) strand; PAM type: NRG; PAM sequence: AAG
ttttctaccaaagaaggtac

SEQ ID NO: 150197 - DNA, 20 bp, Artificial Sequence
  Description of Artificial Sequence: Synthetic oligonucleotide
  Target: ATXN1; (+) strand; PAM type: NRG; PAM sequence: AGG
tttctaccaaagaaggtaca

SEQ ID NO: 150198 - DNA, 20 bp, Artificial Sequence
  Description of Artificial Sequence: Synthetic oligonucleotide
  Target: ATXN1; (+) strand; PAM type: NRG; PAM sequence: AAG
aatgtgtgtgatcatgcgta

SEQ ID NO: 150199 - DNA, 20 bp, Artificial Sequence
  Description of Artificial Sequence: Synthetic oligonucleotide
  Target: ATXN1; (+) strand; PAM type: NRG; PAM sequence: AAG
tcatgcgtaaagttctcttt

SEQ ID NO: 150200 - DNA, 20 bp, Artificial Sequence
  Description of Artificial Sequence: Synthetic oligonucleotide
  Target: ATXN1; (+) strand; PAM type: NRG; PAM sequence: TGG
aagttctctttaagtactat

SEQ ID NO: 150201 - DNA, 20 bp, Artificial Sequence
  Description of Artificial Sequence: Synthetic oligonucleotide
  Target: ATXN1; (+) strand; PAM type: NRG; PAM sequence: CAG
atgctacatttaaaatattt

SEQ ID NO: 150202 - DNA, 20 bp, Artificial Sequence
  Description of Artificial Sequence: Synthetic oligonucleotide
  Target: ATXN1; (+) strand; PAM type: NRG; PAM sequence: CAG
tgtttccataaacatttata

SEQ ID NO: 150203 - DNA, 20 bp, Artificial Sequence
  Description of Artificial Sequence: Synthetic oligonucleotide
  Target: ATXN1; (+) strand; PAM type: NRG; PAM sequence: CAG
aaacatttatacagacttct

SEQ ID NO: 150204 - DNA, 20 bp, Artificial Sequence
  Description of Artificial Sequence: Synthetic oligonucleotide
  Target: ATXN1; (+) strand; PAM type: NRG; PAM sequence: AAG
atacagacttctcagaaata

SEQ ID NO: 150205 - DNA, 20 bp, Artificial Sequence
  Description of Artificial Sequence: Synthetic oligonucleotide
  Target: ATXN1; (+) strand; PAM type: NRG; PAM sequence: AGG
tacagacttctcagaaataa

SEQ ID NO: 150206 - DNA, 20 bp, Artificial Sequence
  Description of Artificial Sequence: Synthetic oligonucleotide
  Target: ATXN1; (+) strand; PAM type: NRG; PAM sequence: GAG
cagacttctcagaaataaag

SEQ ID NO: 150207 - DNA, 20 bp, Artificial Sequence
  Description of Artificial Sequence: Synthetic oligonucleotide
  Target: ATXN1; (+) strand; PAM type: NRG; PAM sequence: AAG
aaataaaggagaattctact

SEQ ID NO: 150208 - DNA, 20 bp, Artificial Sequence
  Description of Artificial Sequence: Synthetic oligonucleotide
  Target: ATXN1; (+) strand; PAM type: NRG; PAM sequence: AGG
aataaaggagaattctacta

SEQ ID NO: 150209 - DNA, 20 bp, Artificial Sequence
  Description of Artificial Sequence: Synthetic oligonucleotide
  Target: ATXN1; (+) strand; PAM type: NRG; PAM sequence: AAG
agaattctactaaggattaa

SEQ ID NO: 150210 - DNA, 20 bp, Artificial Sequence
  Description of Artificial Sequence: Synthetic oligonucleotide
  Target: ATXN1; (+) strand; PAM type: NRG; PAM sequence: AAG
aagtcactgccgtgatttat

SEQ ID NO: 150211 - DNA, 20 bp, Artificial Sequence
  Description of Artificial Sequence: Synthetic oligonucleotide
  Target: ATXN1; (+) strand; PAM type: NRG; PAM sequence: TGG
caactaaacattgtaaactt

SEQ ID NO: 150212 - DNA, 20 bp, Artificial Sequence
  Description of Artificial Sequence: Synthetic oligonucleotide
  Target: ATXN1; (+) strand; PAM type: NRG; PAM sequence: CAG
actttggactatttactttt

SEQ ID NO: 150213 - DNA, 20 bp, Artificial Sequence
  Description of Artificial Sequence: Synthetic oligonucleotide
  Target: ATXN1; (+) strand; PAM type: NRG; PAM sequence: TGG
ttggactatttacttttcag

SEQ ID NO: 150214 - DNA, 20 bp, Artificial Sequence
  Description of Artificial Sequence: Synthetic oligonucleotide
  Target: ATXN1; (+) strand; PAM type: NRG; PAM sequence: GGG
tggactatttacttttcagt

SEQ ID NO: 150215 - DNA, 20 bp, Artificial Sequence
  Description of Artificial Sequence: Synthetic oligonucleotide
  Target: ATXN1; (+) strand; PAM type: NRG; PAM sequence: GAG
gactatttacttttcagtgg

SEQ ID NO: 150216 - DNA, 20 bp, Artificial Sequence
  Description of Artificial Sequence: Synthetic oligonucleotide
  Target: ATXN1; (+) strand; PAM type: NRG; PAM sequence: GAG
ctatttacttttcagtggga

SEQ ID NO: 150217 - DNA, 20 bp, Artificial Sequence
  Description of Artificial Sequence: Synthetic oligonucleotide
  Target: ATXN1; (+) strand; PAM type: NRG; PAM sequence: CAG
gtgggagagatcattccttc

SEQ ID NO: 150218 - DNA, 20 bp, Artificial Sequence
  Description of Artificial Sequence: Synthetic oligonucleotide
  Target: ATXN1; (+) strand; PAM type: NRG; PAM sequence: GAG
gggagagatcattccttcca

SEQ ID NO: 150219 - DNA, 20 bp, Artificial Sequence
  Description of Artificial Sequence: Synthetic oligonucleotide
  Target: ATXN1; (+) strand; PAM type: NRG; PAM sequence: TAG
gagatcattccttccagaga

SEQ ID NO: 150220 - DNA, 20 bp, Artificial Sequence
  Description of Artificial Sequence: Synthetic oligonucleotide
  Target: ATXN1; (+) strand; PAM type: NRG; PAM sequence: GAG
gatcattccttccagagata

SEQ ID NO: 150221 - DNA, 20 bp, Artificial Sequence
  Description of Artificial Sequence: Synthetic oligonucleotide
  Target: ATXN1; (+) strand; PAM type: NRG; PAM sequence: AAG
ttatcatttttcctactttt

SEQ ID NO: 150222 - DNA, 20 bp, Artificial Sequence
  Description of Artificial Sequence: Synthetic oligonucleotide
  Target: ATXN1; (+) strand; PAM type: NRG; PAM sequence: CAG
ttttcctacttttaagtttc

SEQ ID NO: 150223 - DNA, 20 bp, Artificial Sequence
  Description of Artificial Sequence: Synthetic oligonucleotide
  Target: ATXN1; (+) strand; PAM type: NRG; PAM sequence: AGG
tttcctacttttaagtttcc

SEQ ID NO: 150224 - DNA, 20 bp, Artificial Sequence
  Description of Artificial Sequence: Synthetic oligonucleotide
  Target: ATXN1; (+) strand; PAM type: NRG; PAM sequence: TGG
gtttccaggtgtaacatctc

SEQ ID NO: 150225 - DNA, 20 bp, Artificial Sequence
  Description of Artificial Sequence: Synthetic oligonucleotide
  Target: ATXN1; (+) strand; PAM type: NRG; PAM sequence: GGG
tttccaggtgtaacatctct

SEQ ID NO: 150226 - DNA, 20 bp, Artificial Sequence
  Description of Artificial Sequence: Synthetic oligonucleotide
  Target: ATXN1; (+) strand; PAM type: NRG; PAM sequence: GGG
ttccaggtgtaacatctctg

SEQ ID NO: 150227 - DNA, 20 bp, Artificial Sequence
  Description of Artificial Sequence: Synthetic oligonucleotide
  Target: ATXN1; (+) strand; PAM type: NRG; PAM sequence: CAG
aacaacaatctatccttctg

SEQ ID NO: 150228 - DNA, 20 bp, Artificial Sequence
  Description of Artificial Sequence: Synthetic oligonucleotide
  Target: ATXN1; (+) strand; PAM type: NRG; PAM sequence: GAG
tatccttctgcagttgaaat

SEQ ID NO: 150229 - DNA, 20 bp, Artificial Sequence
  Description of Artificial Sequence: Synthetic oligonucleotide
  Target: ATXN1; (+) strand; PAM type: NRG; PAM sequence: CAG
gaaatgagttcaactaccca

SEQ ID NO: 150230 - DNA, 20 bp, Artificial Sequence
  Description of Artificial Sequence: Synthetic oligonucleotide
  Target: ATXN1; (+) strand; PAM type: NRG; PAM sequence: CAG
tgagttcaactacccacagt

SEQ ID NO: 150231 - DNA, 20 bp, Artificial Sequence
  Description of Artificial Sequence: Synthetic oligonucleotide
  Target: ATXN1; (+) strand; PAM type: NRG; PAM sequence: AAG
ataaatcaactataaaaact

SEQ ID NO: 150232 - DNA, 20 bp, Artificial Sequence
  Description of Artificial Sequence: Synthetic oligonucleotide
  Target: ATXN1; (+) strand; PAM type: NRG; PAM sequence: AAG
caatcattacttaatcctaa

SEQ ID NO: 150233 - DNA, 20 bp, Artificial Sequence
  Description of Artificial Sequence: Synthetic oligonucleotide
  Target: ATXN1; (+) strand; PAM type: NRG; PAM sequence: AGG
aatcattacttaatcctaaa

SEQ ID NO: 150234 - DNA, 20 bp, Artificial Sequence
  Description of Artificial Sequence: Synthetic oligonucleotide
  Target: ATXN1; (+) strand; PAM type: NRG; PAM sequence: GAG
tcattacttaatcctaaaag

SEQ ID NO: 150235 - DNA, 20 bp, Artificial Sequence
  Description of Artificial Sequence: Synthetic oligonucleotide
  Target: ATXN1; (+) strand; PAM type: NRG; PAM sequence: AGG
cattacttaatcctaaaagg

SEQ ID NO: 150236 - DNA, 20 bp, Artificial Sequence
  Description of Artificial Sequence: Synthetic oligonucleotide
  Target: ATXN1; (+) strand; PAM type: NRG; PAM sequence: GAG
ttacttaatcctaaaaggag

SEQ ID NO: 150237 - DNA, 20 bp, Artificial Sequence
  Description of Artificial Sequence: Synthetic oligonucleotide
  Target: ATXN1; (+) strand; PAM type: NRG; PAM sequence: AGG
tacttaatcctaaaaggagg

SEQ ID NO: 150238 - DNA, 20 bp, Artificial Sequence
  Description of Artificial Sequence: Synthetic oligonucleotide
  Target: ATXN1; (+) strand; PAM type: NRG; PAM sequence: AAG
ttaatcctaaaaggaggagg

SEQ ID NO: 150239 - DNA, 20 bp, Artificial Sequence
  Description of Artificial Sequence: Synthetic oligonucleotide
  Target: ATXN1; (+) strand; PAM type: NRG; PAM sequence: GAG
aatcctaaaaggaggaggaa

SEQ ID NO: 150240 - DNA, 20 bp, Artificial Sequence
  Description of Artificial Sequence: Synthetic oligonucleotide
  Target: ATXN1; (+) strand; PAM type: NRG; PAM sequence: AAG
aggaggaagagacaaaactc

SEQ ID NO: 150241 - DNA, 20 bp, Artificial Sequence
  Description of Artificial Sequence: Synthetic oligonucleotide
  Target: ATXN1; (+) strand; PAM type: NRG; PAM sequence: TAG
aactcaagtacaatctttta

SEQ ID NO: 150242 - DNA, 20 bp, Artificial Sequence
  Description of Artificial Sequence: Synthetic oligonucleotide
  Target: ATXN1; (+) strand; PAM type: NRG; PAM sequence: TGG
catgttctatatcacccctt

SEQ ID NO: 150243 - DNA, 20 bp, Artificial Sequence
  Description of Artificial Sequence: Synthetic oligonucleotide
  Target: ATXN1; (+) strand; PAM type: NRG; PAM sequence: TAG
aaaccttttatttatgaatc

SEQ ID NO: 150244 - DNA, 20 bp, Artificial Sequence
  Description of Artificial Sequence: Synthetic oligonucleotide
  Target: ATXN1; (+) strand; PAM type: NRG; PAM sequence: TAG
atctagcgcatttcccctcg

SEQ ID NO: 150245 - DNA, 20 bp, Artificial Sequence
  Description of Artificial Sequence: Synthetic oligonucleotide
  Target: ATXN1; (+) strand; PAM type: NRG; PAM sequence: AGG
tctagcgcatttcccctcgt

SEQ ID NO: 150246 - DNA, 20 bp, Artificial Sequence
  Description of Artificial Sequence: Synthetic oligonucleotide
  Target: ATXN1; (+) strand; PAM type: NRG; PAM sequence: AAG
ctcgtaggctaaatttcctt

SEQ ID NO: 150247 - DNA, 20 bp, Artificial Sequence
  Description of Artificial Sequence: Synthetic oligonucleotide
  Target: ATXN1; (+) strand; PAM type: NRG; PAM sequence: TGG
taaatttccttaagcttttc

SEQ ID NO: 150248 - DNA, 20 bp, Artificial Sequence
  Description of Artificial Sequence: Synthetic oligonucleotide
  Target: ATXN1; (+) strand; PAM type: NRG; PAM sequence: CAG
gacaaattccctgcattcaa

SEQ ID NO: 150249 - DNA, 20 bp, Artificial Sequence
  Description of Artificial Sequence: Synthetic oligonucleotide
  Target: ATXN1; (+) strand; PAM type: NRG; PAM sequence: AAG
ttccctgcattcaacagaat

SEQ ID NO: 150250 - DNA, 20 bp, Artificial Sequence
  Description of Artificial Sequence: Synthetic oligonucleotide
  Target: ATXN1; (+) strand; PAM type: NRG; PAM sequence: TAG
acagaataagttccaatgtt

SEQ ID NO: 150251 - DNA, 20 bp, Artificial Sequence
  Description of Artificial Sequence: Synthetic oligonucleotide
  Target: ATXN1; (+) strand; PAM type: NRG; PAM sequence: CAG
aataagttccaatgtttagt

SEQ ID NO: 150252 - DNA, 20 bp, Artificial Sequence
  Description of Artificial Sequence: Synthetic oligonucleotide
  Target: ATXN1; (+) strand; PAM type: NRG; PAM sequence: AAG
gttccaatgtttagtcagaa

SEQ ID NO: 150253 - DNA, 20 bp, Artificial Sequence
  Description of Artificial Sequence: Synthetic oligonucleotide
  Target: ATXN1; (+) strand; PAM type: NRG; PAM sequence: GAG
tccaatgtttagtcagaaaa

SEQ ID NO: 150254 - DNA, 20 bp, Artificial Sequence
  Description of Artificial Sequence: Synthetic oligonucleotide
  Target: ATXN1; (+) strand; PAM type: NRG; PAM sequence: TGG
tttagtcagaaaagagactc

SEQ ID NO: 150255 - DNA, 20 bp, Artificial Sequence
  Description of Artificial Sequence: Synthetic oligonucleotide
  Target: ATXN1; (+) strand; PAM type: NRG; PAM sequence: GAG
tagtcagaaaagagactctg

SEQ ID NO: 150256 - DNA, 20 bp, Artificial Sequence
  Description of Artificial Sequence: Synthetic oligonucleotide
  Target: ATXN1; (+) strand; PAM type: NRG; PAM sequence: AAG
aaaagagactctggagcatt

SEQ ID NO: 150257 - DNA, 20 bp, Artificial Sequence
  Description of Artificial Sequence: Synthetic oligonucleotide
  Target: ATXN1; (+) strand; PAM type: NRG; PAM sequence: AAG
attacacaatttcaacttct

SEQ ID NO: 150258 - DNA, 20 bp, Artificial Sequence
  Description of Artificial Sequence: Synthetic oligonucleotide
  Target: ATXN1; (+) strand; PAM type: NRG; PAM sequence: TAG
tatttttaaaattaataaca

SEQ ID NO: 150259 - DNA, 20 bp, Artificial Sequence
  Description of Artificial Sequence: Synthetic oligonucleotide
  Target: ATXN1; (+) strand; PAM type: NRG; PAM sequence: TAG
acatagtgcacttccttact

SEQ ID NO: 150260 - DNA, 20 bp, Artificial Sequence
  Description of Artificial Sequence: Synthetic oligonucleotide
  Target: ATXN1; (+) strand; PAM type: NRG; PAM sequence: AAG
tagtgcacttccttacttag

SEQ ID NO: 150261 - DNA, 20 bp, Artificial Sequence
  Description of Artificial Sequence: Synthetic oligonucleotide
  Target: ATXN1; (+) strand; PAM type: NRG; PAM sequence: AGG
agtgcacttccttacttaga

SEQ ID NO: 150262 - DNA, 20 bp, Artificial Sequence
  Description of Artificial Sequence: Synthetic oligonucleotide
  Target: ATXN1; (+) strand; PAM type: NRG; PAM sequence: AAG
agaaggaaatttaaattaca

SEQ ID NO: 150263 - DNA, 20 bp, Artificial Sequence
  Description of Artificial Sequence: Synthetic oligonucleotide
  Target: ATXN1; (+) strand; PAM type: NRG; PAM sequence: AAG
tttgaaatttctgaacccaa

SEQ ID NO: 150264 - DNA, 20 bp, Artificial Sequence
  Description of Artificial Sequence: Synthetic oligonucleotide
  Target: ATXN1; (+) strand; PAM type: NRG; PAM sequence: TAG
cccaaaagccattaaaaaaa

SEQ ID NO: 150265 - DNA, 20 bp, Artificial Sequence
  Description of Artificial Sequence: Synthetic oligonucleotide
  Target: ATXN1; (+) strand; PAM type: NRG; PAM sequence: GAG
ccattaaaaaaatagcccat

SEQ ID NO: 150266 - DNA, 20 bp, Artificial Sequence
  Description of Artificial Sequence: Synthetic oligonucleotide
  Target: ATXN1; (+) strand; PAM type: NRG; PAM sequence: AAG
aaaaaaatagcccatgagcc

SEQ ID NO: 150267 - DNA, 20 bp, Artificial Sequence
  Description of Artificial Sequence: Synthetic oligonucleotide
  Target: ATXN1; (+) strand; PAM type: NRG; PAM sequence: CAG
aaaatagcccatgagccaag

SEQ ID NO: 150268 - DNA, 20 bp, Artificial Sequence
  Description of Artificial Sequence: Synthetic oligonucleotide
  Target: ATXN1; (+) strand; PAM type: NRG; PAM sequence: CAG
gcttcactaaatgtttatca

SEQ ID NO: 150269 - DNA, 20 bp, Artificial Sequence
  Description of Artificial Sequence: Synthetic oligonucleotide
  Target: ATXN1; (+) strand; PAM type: NRG; PAM sequence: CAG
atcacagtgtaacatttcca

SEQ ID NO: 150270 - DNA, 20 bp, Artificial Sequence
  Description of Artificial Sequence: Synthetic oligonucleotide
  Target: ATXN1; (+) strand; PAM type: NRG; PAM sequence: AAG
taacatttccacagtatgaa

SEQ ID NO: 150271 - DNA, 20 bp, Artificial Sequence
  Description of Artificial Sequence: Synthetic oligonucleotide
  Target: ATXN1; (+) strand; PAM type: NRG; PAM sequence: TGG
tccacagtatgaaaagtttc

SEQ ID NO: 150272 - DNA, 20 bp, Artificial Sequence
  Description of Artificial Sequence: Synthetic oligonucleotide
  Target: ATXN1; (+) strand; PAM type: NRG; PAM sequence: AAG
cgactgtgtttttttaacat

SEQ ID NO: 150273 - DNA, 20 bp, Artificial Sequence
  Description of Artificial Sequence: Synthetic oligonucleotide
  Target: ATXN1; (+) strand; PAM type: NRG; PAM sequence: AAG
gtttttttaacataagacta

SEQ ID NO: 150274 - DNA, 20 bp, Artificial Sequence
  Description of Artificial Sequence: Synthetic oligonucleotide
  Target: ATXN1; (+) strand; PAM type: NRG; PAM sequence: AAG
gattcttacacaaatcataa

SEQ ID NO: 150275 - DNA, 20 bp, Artificial Sequence
  Description of Artificial Sequence: Synthetic oligonucleotide
  Target: ATXN1; (+) strand; PAM type: NRG; PAM sequence: GAG
ttcttacacaaatcataaaa

SEQ ID NO: 150276 - DNA, 20 bp, Artificial Sequence
  Description of Artificial Sequence: Synthetic oligonucleotide
  Target: ATXN1; (+) strand; PAM type: NRG; PAM sequence: GAG
caaatcataaaagagactat

SEQ ID NO: 150277 - DNA, 20 bp, Artificial Sequence
  Description of Artificial Sequence: Synthetic oligonucleotide
  Target: ATXN1; (+) strand; PAM type: NRG; PAM sequence: AGG
aaatcataaaagagactatg

SEQ ID NO: 150278 - DNA, 20 bp, Artificial Sequence
  Description of Artificial Sequence: Synthetic oligonucleotide
  Target: ATXN1; (+) strand; PAM type: NRG; PAM sequence: AAG
cataaaagagactatgagga

SEQ ID NO: 150279 - DNA, 20 bp, Artificial Sequence
  Description of Artificial Sequence: Synthetic oligonucleotide
  Target: ATXN1; (+) strand; PAM type: NRG; PAM sequence: AAG
gagactatgaggaaagttca

SEQ ID NO: 150280 - DNA, 20 bp, Artificial Sequence
  Description of Artificial Sequence: Synthetic oligonucleotide
  Target: ATXN1; (+) strand; PAM type: NRG; PAM sequence: AAG
ggaaagttcaaagtaacctc

SEQ ID NO: 150281 - DNA, 20 bp, Artificial Sequence
  Description of Artificial Sequence: Synthetic oligonucleotide
  Target: ATXN1; (+) strand; PAM type: NRG; PAM sequence: AAG
catgatgacttcacgttcaa

SEQ ID NO: 150282 - DNA, 20 bp, Artificial Sequence
  Description of Artificial Sequence: Synthetic oligonucleotide
  Target: ATXN1; (+) strand; PAM type: NRG; PAM sequence: CAG
tgtgtgtgactcacatgcct

SEQ ID NO: 150283 - DNA, 20 bp, Artificial Sequence
  Description of Artificial Sequence: Synthetic oligonucleotide
  Target: ATXN1; (+) strand; PAM type: NRG; PAM sequence: TGG
gtgactcacatgcctcagac

SEQ ID NO: 150284 - DNA, 20 bp, Artificial Sequence
  Description of Artificial Sequence: Synthetic oligonucleotide
  Target: ATXN1; (+) strand; PAM type: NRG; PAM sequence: AAG
actcacatgcctcagactgg

SEQ ID NO: 150285 - DNA, 20 bp, Artificial Sequence
  Description of Artificial Sequence: Synthetic oligonucleotide
  Target: ATXN1; (+) strand; PAM type: NRG; PAM sequence: CAG
catgcctcagactggaagtt

SEQ ID NO: 150286 - DNA, 20 bp, Artificial Sequence
  Description of Artificial Sequence: Synthetic oligonucleotide
  Target: ATXN1; (+) strand; PAM type: NRG; PAM sequence: CAG
gactggaagttcagcccaat

SEQ ID NO: 150287 - DNA, 20 bp, Artificial Sequence
  Description of Artificial Sequence: Synthetic oligonucleotide
  Target: ATXN1; (+) strand; PAM type: NRG; PAM sequence: TGG
aatcagctctcccaactgat

SEQ ID NO: 150288 - DNA, 20 bp, Artificial Sequence
  Description of Artificial Sequence: Synthetic oligonucleotide
  Target: ATXN1; (+) strand; PAM type: NRG; PAM sequence: GAG
agctctcccaactgattggt

SEQ ID NO: 150289 - DNA, 20 bp, Artificial Sequence
  Description of Artificial Sequence: Synthetic oligonucleotide
  Target: ATXN1; (+) strand; PAM type: NRG; PAM sequence: AGG
gctctcccaactgattggtg

SEQ ID NO: 150290 - DNA, 20 bp, Artificial Sequence
  Description of Artificial Sequence: Synthetic oligonucleotide
  Target: ATXN1; (+) strand; PAM type: NRG; PAM sequence: GGG
ctctcccaactgattggtga

SEQ ID NO: 150291 - DNA, 20 bp, Artificial Sequence
  Description of Artificial Sequence: Synthetic oligonucleotide
  Target: ATXN1; (+) strand; PAM type: NRG; PAM sequence: AAG
tcccaactgattggtgaggg

SEQ ID NO: 150292 - DNA, 20 bp, Artificial Sequence
  Description of Artificial Sequence: Synthetic oligonucleotide
  Target: ATXN1; (+) strand; PAM type: NRG; PAM sequence: GAG
acttcattgtcttaaacccc

SEQ ID NO: 150293 - DNA, 20 bp, Artificial Sequence
  Description of Artificial Sequence: Synthetic oligonucleotide
  Target: ATXN1; (+) strand; PAM type: NRG; PAM sequence: TGG
tgtcttaaaccccgagtgac

SEQ ID NO: 150294 - DNA, 20 bp, Artificial Sequence
  Description of Artificial Sequence: Synthetic oligonucleotide
  Target: ATXN1; (+) strand; PAM type: NRG; PAM sequence: TGG
tgactggcattccctttaac

SEQ ID NO: 150295 - DNA, 20 bp, Artificial Sequence
  Description of Artificial Sequence: Synthetic oligonucleotide
  Target: ATXN1; (+) strand; PAM type: NRG; PAM sequence: GGG
gactggcattccctttaact

SEQ ID NO: 150296 - DNA, 20 bp, Artificial Sequence
  Description of Artificial Sequence: Synthetic oligonucleotide
  Target: ATXN1; (+) strand; PAM type: NRG; PAM sequence: CAG
tggcattccctttaactggg

SEQ ID NO: 150297 - DNA, 20 bp, Artificial Sequence
  Description of Artificial Sequence: Synthetic oligonucleotide
  Target: ATXN1; (+) strand; PAM type: NRG; PAM sequence: TGG
ctgggcagtgtgtctaaata

SEQ ID NO: 150298 - DNA, 20 bp, Artificial Sequence
  Description of Artificial Sequence: Synthetic oligonucleotide
  Target: ATXN1; (+) strand; PAM type: NRG; PAM sequence: GAG
taaatatggaaaaacttcat

SEQ ID NO: 150299 - DNA, 20 bp, Artificial Sequence
  Description of Artificial Sequence: Synthetic oligonucleotide
  Target: ATXN1; (+) strand; PAM type: NRG; PAM sequence: CAG
aacttcatgagaaactgaaa

SEQ ID NO: 150300 - DNA, 20 bp, Artificial Sequence
  Description of Artificial Sequence: Synthetic oligonucleotide
  Target: ATXN1; (+) strand; PAM type: NRG; PAM sequence: AGG
acttcatgagaaactgaaac

SEQ ID NO: 150301 - DNA, 20 bp, Artificial Sequence
  Description of Artificial Sequence: Synthetic oligonucleotide
  Target: ATXN1; (+) strand; PAM type: NRG; PAM sequence: AAG
atgagaaactgaaacaggca

SEQ ID NO: 150302 - DNA, 20 bp, Artificial Sequence
  Description of Artificial Sequence: Synthetic oligonucleotide
  Target: ATXN1; (+) strand; PAM type: NRG; PAM sequence: GAG
gagaaactgaaacaggcaaa

SEQ ID NO: 150303 - DNA, 20 bp, Artificial Sequence
  Description of Artificial Sequence: Synthetic oligonucleotide
  Target: ATXN1; (+) strand; PAM type: NRG; PAM sequence: AGG
agaaactgaaacaggcaaag

SEQ ID NO: 150304 - DNA, 20 bp, Artificial Sequence
  Description of Artificial Sequence: Synthetic oligonucleotide
  Target: ATXN1; (+) strand; PAM type: NRG; PAM sequence: TGG
gcaaagaggaaaaatattac

SEQ ID NO: 150305 - DNA, 20 bp, Artificial Sequence
  Description of Artificial Sequence: Synthetic oligonucleotide
  Target: ATXN1; (+) strand; PAM type: NRG; PAM sequence: CAG
aggaaaaatattactggcac

SEQ ID NO: 150306 - DNA, 20 bp, Artificial Sequence
  Description of Artificial Sequence: Synthetic oligonucleotide
  Target: ATXN1; (+) strand; PAM type: NRG; PAM sequence: CAG
tattactggcaccagtcctt

SEQ ID NO: 150307 - DNA, 20 bp, Artificial Sequence
  Description of Artificial Sequence: Synthetic oligonucleotide
  Target: ATXN1; (+) strand; PAM type: NRG; PAM sequence: GAG
ccagtccttcagtatgaatc

SEQ ID NO: 150308 - DNA, 20 bp, Artificial Sequence
  Description of Artificial Sequence: Synthetic oligonucleotide
  Target: ATXN1; (+) strand; PAM type: NRG; PAM sequence: GAG
agtccttcagtatgaatcga

SEQ ID NO: 150309 - DNA, 20 bp, Artificial Sequence
  Description of Artificial Sequence: Synthetic oligonucleotide
  Target: ATXN1; (+) strand; PAM type: NRG; PAM sequence: AAG
gaatcgagagaaaattcatg

SEQ ID NO: 150310 - DNA, 20 bp, Artificial Sequence
  Description of Artificial Sequence: Synthetic oligonucleotide
  Target: ATXN1; (+) strand; PAM type: NRG; PAM sequence: AAG
aaaattcatgaagtctccaa

SEQ ID NO: 150311 - DNA, 20 bp, Artificial Sequence
  Description of Artificial Sequence: Synthetic oligonucleotide
  Target: ATXN1; (+) strand; PAM type: NRG; PAM sequence: TAG
aagtctccaaaagaattttt

SEQ ID NO: 150312 - DNA, 20 bp, Artificial Sequence
  Description of Artificial Sequence: Synthetic oligonucleotide
  Target: ATXN1; (+) strand; PAM type: NRG; PAM sequence: AGG
agtctccaaaagaatttttt

SEQ ID NO: 150313 - DNA, 20 bp, Artificial Sequence
  Description of Artificial Sequence: Synthetic oligonucleotide
  Target: ATXN1; (+) strand; PAM type: NRG; PAM sequence: GAG
tttttaggtgtctttttgat

SEQ ID NO: 150314 - DNA, 20 bp, Artificial Sequence
  Description of Artificial Sequence: Synthetic oligonucleotide
  Target: ATXN1; (+) strand; PAM type: NRG; PAM sequence: CAG
ttaggtgtctttttgatgag

SEQ ID NO: 150315 - DNA, 20 bp, Artificial Sequence
  Description of Artificial Sequence: Synthetic oligonucleotide
  Target: ATXN1; (+) strand; PAM type: NRG; PAM sequence: AGG
taggtgtctttttgatgagc

SEQ ID NO: 150316 - DNA, 20 bp, Artificial Sequence
  Description of Artificial Sequence: Synthetic oligonucleotide
  Target: ATXN1; (+) strand; PAM type: NRG; PAM sequence: CAG
tttttgatgagcaggaattc

SEQ ID NO: 150317 - DNA, 20 bp, Artificial Sequence
  Description of Artificial Sequence: Synthetic oligonucleotide
  Target: ATXN1; (+) strand; PAM type: NRG; PAM sequence: TAG
tgagcaggaattccagtgcc

SEQ ID NO: 150318 - DNA, 20 bp, Artificial Sequence
  Description of Artificial Sequence: Synthetic oligonucleotide
  Target: ATXN1; (+) strand; PAM type: NRG; PAM sequence: AGG
gagcaggaattccagtgcct

SEQ ID NO: 150319 - DNA, 20 bp, Artificial Sequence
  Description of Artificial Sequence: Synthetic oligonucleotide
  Target: ATXN1; (+) strand; PAM type: NRG; PAM sequence: GGG
agcaggaattccagtgccta

SEQ ID NO: 150320 - DNA, 20 bp, Artificial Sequence
  Description of Artificial Sequence: Synthetic oligonucleotide
  Target: ATXN1; (+) strand; PAM type: NRG; PAM sequence: CAG
attccagtgcctagggcttt

SEQ ID NO: 150321 - DNA, 20 bp, Artificial Sequence
  Description of Artificial Sequence: Synthetic oligonucleotide
  Target: ATXN1; (+) strand; PAM type: NRG; PAM sequence: AAG
tttcagttctttgtgcatca

SEQ ID NO: 150322 - DNA, 20 bp, Artificial Sequence
  Description of Artificial Sequence: Synthetic oligonucleotide
  Target: ATXN1; (+) strand; PAM type: NRG; PAM sequence: AAG
gtgcatcaaagttttcttct

SEQ ID NO: 150323 - DNA, 20 bp, Artificial Sequence
  Description of Artificial Sequence: Synthetic oligonucleotide
  Target: ATXN1; (+) strand; PAM type: NRG; PAM sequence: TGG
agttttcttctaagcatgta

SEQ ID NO: 150324 - DNA, 20 bp, Artificial Sequence
  Description of Artificial Sequence: Synthetic oligonucleotide
  Target: ATXN1; (+) strand; PAM type: NRG; PAM sequence: TGG
cttctaagcatgtatggtca

SEQ ID NO: 150325 - DNA, 20 bp, Artificial Sequence
  Description of Artificial Sequence: Synthetic oligonucleotide
  Target: ATXN1; (+) strand; PAM type: NRG; PAM sequence: AAG
ctaagcatgtatggtcatgg

SEQ ID NO: 150326 - DNA, 20 bp, Artificial Sequence
  Description of Artificial Sequence: Synthetic oligonucleotide
  Target: ATXN1; (+) strand; PAM type: NRG; PAM sequence: GAG
aagcatgtatggtcatggaa

SEQ ID NO: 150327 - DNA, 20 bp, Artificial Sequence
  Description of Artificial Sequence: Synthetic oligonucleotide
  Target: ATXN1; (+) strand; PAM type: NRG; PAM sequence: TGG
atgtatggtcatggaagagc

SEQ ID NO: 150328 - DNA, 20 bp, Artificial Sequence
  Description of Artificial Sequence: Synthetic oligonucleotide
  Target: ATXN1; (+) strand; PAM type: NRG; PAM sequence: GAG
gtatggtcatggaagagctg

SEQ ID NO: 150329 - DNA, 20 bp, Artificial Sequence
  Description of Artificial Sequence: Synthetic oligonucleotide
  Target: ATXN1; (+) strand; PAM type: NRG; PAM sequence: TGG
tggagtatctttcatgacaa

SEQ ID NO: 150330 - DNA, 20 bp, Artificial Sequence
  Description of Artificial Sequence: Synthetic oligonucleotide
  Target: ATXN1; (+) strand; PAM type: NRG; PAM sequence: CAG
caatggcctctaatcaaacc

SEQ ID NO: 150331 - DNA, 20 bp, Artificial Sequence
  Description of Artificial Sequence: Synthetic oligonucleotide
  Target: ATXN1; (+) strand; PAM type: NRG; PAM sequence: GAG
caaacccagtgttcacccct

SEQ ID NO: 150332 - DNA, 20 bp, Artificial Sequence
  Description of Artificial Sequence: Synthetic oligonucleotide
  Target: ATXN1; (+) strand; PAM type: NRG; PAM sequence: GAG
aacccagtgttcacccctga

SEQ ID NO: 150333 - DNA, 20 bp, Artificial Sequence
  Description of Artificial Sequence: Synthetic oligonucleotide
  Target: ATXN1; (+) strand; PAM type: NRG; PAM sequence: CAG
gcacttcactccatccatca

SEQ ID NO: 150334 - DNA, 20 bp, Artificial Sequence
  Description of Artificial Sequence: Synthetic oligonucleotide
  Target: ATXN1; (+) strand; PAM type: NRG; PAM sequence: AGG
cacttcactccatccatcac

SEQ ID NO: 150335 - DNA, 20 bp, Artificial Sequence
  Description of Artificial Sequence: Synthetic oligonucleotide
  Target: ATXN1; (+) strand; PAM type: NRG; PAM sequence: CAG
caggcaactaaatatacaac

SEQ ID NO: 150336 - DNA, 20 bp, Artificial Sequence
  Description of Artificial Sequence: Synthetic oligonucleotide
  Target: ATXN1; (+) strand; PAM type: NRG; PAM sequence: AGG
aggcaactaaatatacaacc

SEQ ID NO: 150337 - DNA, 20 bp, Artificial Sequence
  Description of Artificial Sequence: Synthetic oligonucleotide
  Target: ATXN1; (+) strand; PAM type: NRG; PAM sequence: GGG
ggcaactaaatatacaacca

SEQ ID NO: 150338 - DNA, 20 bp, Artificial Sequence
  Description of Artificial Sequence: Synthetic oligonucleotide
  Target: ATXN1; (+) strand; PAM type: NRG; PAM sequence: AAG
actaaatatacaaccagggc

SEQ ID NO: 150339 - DNA, 20 bp, Artificial Sequence
  Description of Artificial Sequence: Synthetic oligonucleotide
  Target: ATXN1; (+) strand; PAM type: NRG; PAM sequence: CAG
cagggcaagcaacccatgaa

SEQ ID NO: 150340 - DNA, 20 bp, Artificial Sequence
  Description of Artificial Sequence: Synthetic oligonucleotide
  Target: ATXN1; (+) strand; PAM type: NRG; PAM sequence: AGG
agggcaagcaacccatgaac

SEQ ID NO: 150341 - DNA, 20 bp, Artificial Sequence
  Description of Artificial Sequence: Synthetic oligonucleotide
  Target: ATXN1; (+) strand; PAM type: NRG; PAM sequence: GGG
gggcaagcaacccatgaaca

SEQ ID NO: 150342 - DNA, 20 bp, Artificial Sequence
  Description of Artificial Sequence: Synthetic oligonucleotide
  Target: ATXN1; (+) strand; PAM type: NRG; PAM sequence: CAG
cccatgaacagggtgaaaaa

SEQ ID NO: 150343 - DNA, 20 bp, Artificial Sequence
  Description of Artificial Sequence: Synthetic oligonucleotide
  Target: ATXN1; (+) strand; PAM type: NRG; PAM sequence: TGG
acagggtgaaaaacagccac

SEQ ID NO: 150344 - DNA, 20 bp, Artificial Sequence
  Description of Artificial Sequence: Synthetic oligonucleotide
  Target: ATXN1; (+) strand; PAM type: NRG; PAM sequence: GAG
agggtgaaaaacagccactg

SEQ ID NO: 150345 - DNA, 20 bp, Artificial Sequence
  Description of Artificial Sequence: Synthetic oligonucleotide
  Target: ATXN1; (+) strand; PAM type: NRG; PAM sequence: TGG
tgaaaaacagccactggagc

SEQ ID NO: 150346 - DNA, 20 bp, Artificial Sequence
  Description of Artificial Sequence: Synthetic oligonucleotide
  Target: ATXN1; (+) strand; PAM type: NRG; PAM sequence: CGG
ctctgctctaaaactttcta

SEQ ID NO: 150347 - DNA, 20 bp, Artificial Sequence
  Description of Artificial Sequence: Synthetic oligonucleotide
  Target: ATXN1; (+) strand; PAM type: NRG; PAM sequence: GGG
tctgctctaaaactttctac

SEQ ID NO: 150348 - DNA, 20 bp, Artificial Sequence
  Description of Artificial Sequence: Synthetic oligonucleotide
  Target: ATXN1; (+) strand; PAM type: NRG; PAM sequence: CAG
ctttctacgggacaaccatt

SEQ ID NO: 150349 - DNA, 20 bp, Artificial Sequence
  Description of Artificial Sequence: Synthetic oligonucleotide
  Target: ATXN1; (+) strand; PAM type: NRG; PAM sequence: GAG
cgggacaaccattcagaccc

SEQ ID NO: 150350 - DNA, 20 bp, Artificial Sequence
  Description of Artificial Sequence: Synthetic oligonucleotide
  Target: ATXN1; (+) strand; PAM type: NRG; PAM sequence: TAG
gacccgagttctatgtacaa

SEQ ID NO: 150351 - DNA, 20 bp, Artificial Sequence
  Description of Artificial Sequence: Synthetic oligonucleotide
  Target: ATXN1; (+) strand; PAM type: NRG; PAM sequence: AGG
acccgagttctatgtacaat

SEQ ID NO: 150352 - DNA, 20 bp, Artificial Sequence
  Description of Artificial Sequence: Synthetic oligonucleotide
  Target: ATXN1; (+) strand; PAM type: NRG; PAM sequence: CAG
gttctatgtacaataggttt

SEQ ID NO: 150353 - DNA, 20 bp, Artificial Sequence
  Description of Artificial Sequence: Synthetic oligonucleotide
  Target: ATXN1; (+) strand; PAM type: NRG; PAM sequence: TAG
tgtacaataggtttcagcct

SEQ ID NO: 150354 - DNA, 20 bp, Artificial Sequence
  Description of Artificial Sequence: Synthetic oligonucleotide
  Target: ATXN1; (+) strand; PAM type: NRG; PAM sequence: TAG
aggtttcagccttagcaaat

SEQ ID NO: 150355 - DNA, 20 bp, Artificial Sequence
  Description of Artificial Sequence: Synthetic oligonucleotide
  Target: ATXN1; (+) strand; PAM type: NRG; PAM sequence: TAG
ttcagccttagcaaattaga

SEQ ID NO: 150356 - DNA, 20 bp, Artificial Sequence
  Description of Artificial Sequence: Synthetic oligonucleotide
  Target: ATXN1; (+) strand; PAM type: NRG; PAM sequence: AAG
atgcactgacttacttgcta

SEQ ID NO: 150357 - DNA, 20 bp, Artificial Sequence
  Description of Artificial Sequence: Synthetic oligonucleotide
  Target: ATXN1; (+) strand; PAM type: NRG; PAM sequence: GAG
acttacttgctaaagaacct

SEQ ID NO: 150358 - DNA, 20 bp, Artificial Sequence
  Description of Artificial Sequence: Synthetic oligonucleotide
  Target: ATXN1; (+) strand; PAM type: NRG; PAM sequence: AGG
cttacttgctaaagaacctg

SEQ ID NO: 150359 - DNA, 20 bp, Artificial Sequence
  Description of Artificial Sequence: Synthetic oligonucleotide
  Target: ATXN1; (+) strand; PAM type: NRG; PAM sequence: TAG
tgacgccttaatttttatta

SEQ ID NO: 150360 - DNA, 20 bp, Artificial Sequence
  Description of Artificial Sequence: Synthetic oligonucleotide
  Target: ATXN1; (+) strand; PAM type: NRG; PAM sequence: AGG
gacgccttaatttttattat

SEQ ID NO: 150361 - DNA, 20 bp, Artificial Sequence
  Description of Artificial Sequence: Synthetic oligonucleotide
  Target: ATXN1; (+) strand; PAM type: NRG; PAM sequence: TAG
tttattataggatatattaa

SEQ ID NO: 150362 - DNA, 20 bp, Artificial Sequence
  Description of Artificial Sequence: Synthetic oligonucleotide
  Target: ATXN1; (+) strand; PAM type: NRG; PAM sequence: TGG
taggatatattaatagtgtt

SEQ ID NO: 150363 - DNA, 20 bp, Artificial Sequence
  Description of Artificial Sequence: Synthetic oligonucleotide
  Target: ATXN1; (+) strand; PAM type: NRG; PAM sequence: AAG
tatattaatagtgtttggta

SEQ ID NO: 150364 - DNA, 20 bp, Artificial Sequence
  Description of Artificial Sequence: Synthetic oligonucleotide
  Target: ATXN1; (+) strand; PAM type: NRG; PAM sequence: TAG
agtgtttggtaaagctgata

SEQ ID NO: 150365 - DNA, 20 bp, Artificial Sequence
  Description of Artificial Sequence: Synthetic oligonucleotide
  Target: ATXN1; (+) strand; PAM type: NRG; PAM sequence: GAG
tgtttggtaaagctgatata

SEQ ID NO: 150366 - DNA, 20 bp, Artificial Sequence
  Description of Artificial Sequence: Synthetic oligonucleotide
  Target: ATXN1; (+) strand; PAM type: NRG; PAM sequence: CAG
tggtaaagctgatatagagt

SEQ ID NO: 150367 - DNA, 20 bp, Artificial Sequence
  Description of Artificial Sequence: Synthetic oligonucleotide
  Target: ATXN1; (+) strand; PAM type: NRG; PAM sequence: AGG
ggtaaagctgatatagagtc

SEQ ID NO: 150368 - DNA, 20 bp, Artificial Sequence
  Description of Artificial Sequence: Synthetic oligonucleotide
  Target: ATXN1; (+) strand; PAM type: NRG; PAM sequence: TAG
gtcaggtttgattgctgata

SEQ ID NO: 150369 - DNA, 20 bp, Artificial Sequence
  Description of Artificial Sequence: Synthetic oligonucleotide
  Target: ATXN1; (+) strand; PAM type: NRG; PAM sequence: CAG
tttgattgctgatatagaat

SEQ ID NO: 150370 - DNA, 20 bp, Artificial Sequence
  Description of Artificial Sequence: Synthetic oligonucleotide
  Target: ATXN1; (+) strand; PAM type: NRG; PAM sequence: AGG
ttgattgctgatatagaatc

SEQ ID NO: 150371 - DNA, 20 bp, Artificial Sequence
  Description of Artificial Sequence: Synthetic oligonucleotide
  Target: ATXN1; (+) strand; PAM type: NRG; PAM sequence: CAG
gtttgattactgtcatgact

SEQ ID NO: 150372 - DNA, 20 bp, Artificial Sequence
  Description of Artificial Sequence: Synthetic oligonucleotide
  Target: ATXN1; (+) strand; PAM type: NRG; PAM sequence: GAG
ttgattactgtcatgactca

SEQ ID NO: 150373 - DNA, 20 bp, Artificial Sequence
  Description of Artificial Sequence: Synthetic oligonucleotide
  Target: ATXN1; (+) strand; PAM type: NRG; PAM sequence: AGG
tgattactgtcatgactcag

SEQ ID NO: 150374 - DNA, 20 bp, Artificial Sequence
  Description of Artificial Sequence: Synthetic oligonucleotide
  Target: ATXN1; (+) strand; PAM type: NRG; PAM sequence: TGG
ataatttgacatattttatc

SEQ ID NO: 150375 - DNA, 20 bp, Artificial Sequence
  Description of Artificial Sequence: Synthetic oligonucleotide
  Target: ATXN1; (+) strand; PAM type: NRG; PAM sequence: TAG
atattttatctggataactt

SEQ ID NO: 150376 - DNA, 20 bp, Artificial Sequence
  Description of Artificial Sequence: Synthetic oligonucleotide
  Target: ATXN1; (+) strand; PAM type: NRG; PAM sequence: TGG
ttagatttttcctgttattt

SEQ ID NO: 150377 - DNA, 20 bp, Artificial Sequence
  Description of Artificial Sequence: Synthetic oligonucleotide
  Target: ATXN1; (+) strand; PAM type: NRG; PAM sequence: TGG
ttttcctgttattttggtac

SEQ ID NO: 150378 - DNA, 20 bp, Artificial Sequence
  Description of Artificial Sequence: Synthetic oligonucleotide
  Target: ATXN1; (+) strand; PAM type: NRG; PAM sequence: GGG
tttcctgttattttggtact

SEQ ID NO: 150379 - DNA, 20 bp, Artificial Sequence
  Description of Artificial Sequence: Synthetic oligonucleotide
  Target: ATXN1; (+) strand; PAM type: NRG; PAM sequence: CAG
gttattttggtactgggttg

SEQ ID NO: 150380 - DNA, 20 bp, Artificial Sequence
  Description of Artificial Sequence: Synthetic oligonucleotide
  Target: ATXN1; (+) strand; PAM type: NRG; PAM sequence: CAG
tggtactgggttgcagcaca

SEQ ID NO: 150381 - DNA, 20 bp, Artificial Sequence
  Description of Artificial Sequence: Synthetic oligonucleotide
  Target: ATXN1; (+) strand; PAM type: NRG; PAM sequence: AGG
ggtactgggttgcagcacac

SEQ ID NO: 150382 - DNA, 20 bp, Artificial Sequence
  Description of Artificial Sequence: Synthetic oligonucleotide
  Target: ATXN1; (+) strand; PAM type: NRG; PAM sequence: TGG
actgggttgcagcacacagg

SEQ ID NO: 150383 - DNA, 20 bp, Artificial Sequence
  Description of Artificial Sequence: Synthetic oligonucleotide
  Target: ATXN1; (+) strand; PAM type: NRG; PAM sequence: TAG
tgcagcacacaggtggcacc

SEQ ID NO: 150384 - DNA, 20 bp, Artificial Sequence
  Description of Artificial Sequence: Synthetic oligonucleotide
  Target: ATXN1; (+) strand; PAM type: NRG; PAM sequence: TAG
acacaggtggcacctagtct

SEQ ID NO: 150385 - DNA, 20 bp, Artificial Sequence
  Description of Artificial Sequence: Synthetic oligonucleotide
  Target: ATXN1; (+) strand; PAM type: NRG; PAM sequence: AGG
cacaggtggcacctagtctt

SEQ ID NO: 150386 - DNA, 20 bp, Artificial Sequence
  Description of Artificial Sequence: Synthetic oligonucleotide
  Target: ATXN1; (+) strand; PAM type: NRG; PAM sequence: GGG
acaggtggcacctagtctta

SEQ ID NO: 150387 - DNA, 20 bp, Artificial Sequence
  Description of Artificial Sequence: Synthetic oligonucleotide
  Target: ATXN1; (+) strand; PAM type: NRG; PAM sequence: GAG
gcacctagtcttagggctgt

SEQ ID NO: 150388 - DNA, 20 bp, Artificial Sequence
  Description of Artificial Sequence: Synthetic oligonucleotide
  Target: ATXN1; (+) strand; PAM type: NRG; PAM sequence: AGG
cacctagtcttagggctgtg

SEQ ID NO: 150389 - DNA, 20 bp, Artificial Sequence
  Description of Artificial Sequence: Synthetic oligonucleotide
  Target: ATXN1; (+) strand; PAM type: NRG; PAM sequence: TGG
gggctgtgaggatcccgcca

SEQ ID NO: 150390 - DNA, 20 bp, Artificial Sequence
  Description of Artificial Sequence: Synthetic oligonucleotide
  Target: ATXN1; (+) strand; PAM type: NRG; PAM sequence: GAG
tgaggatcccgccatggcct

SEQ ID NO: 150391 - DNA, 20 bp, Artificial Sequence
  Description of Artificial Sequence: Synthetic oligonucleotide
  Target: ATXN1; (+) strand; PAM type: NRG; PAM sequence: CAG
atcccgccatggcctgagct

SEQ ID NO: 150392 - DNA, 20 bp, Artificial Sequence
  Description of Artificial Sequence: Synthetic oligonucleotide
  Target: ATXN1; (+) strand; PAM type: NRG; PAM sequence: CAG
ctgagctcagtcactattac

SEQ ID NO: 150393 - DNA, 20 bp, Artificial Sequence
  Description of Artificial Sequence: Synthetic oligonucleotide
  Target: ATXN1; (+) strand; PAM type: NRG; PAM sequence: CAG
gtcactattaccagcttcac

SEQ ID NO: 150394 - DNA, 20 bp, Artificial Sequence
  Description of Artificial Sequence: Synthetic oligonucleotide
  Target: ATXN1; (+) strand; PAM type: NRG; PAM sequence: GAG
cactattaccagcttcacca

SEQ ID NO: 150395 - DNA, 20 bp, Artificial Sequence
  Description of Artificial Sequence: Synthetic oligonucleotide
  Target: ATXN1; (+) strand; PAM type: NRG; PAM sequence: AAG
attaccagcttcaccagaga

SEQ ID NO: 150396 - DNA, 20 bp, Artificial Sequence
  Description of Artificial Sequence: Synthetic oligonucleotide
  Target: ATXN1; (+) strand; PAM type: NRG; PAM sequence: CAG
ccagcttcaccagagaaaga

SEQ ID NO: 150397 - DNA, 20 bp, Artificial Sequence
  Description of Artificial Sequence: Synthetic oligonucleotide
  Target: ATXN1; (+) strand; PAM type: NRG; PAM sequence: AGG
cagcttcaccagagaaagac

SEQ ID NO: 150398 - DNA, 20 bp, Artificial Sequence
  Description of Artificial Sequence: Synthetic oligonucleotide
  Target: ATXN1; (+) strand; PAM type: NRG; PAM sequence: AAG
cttcaccagagaaagacagg

SEQ ID NO: 150399 - DNA, 20 bp, Artificial Sequence
  Description of Artificial Sequence: Synthetic oligonucleotide
  Target: ATXN1; (+) strand; PAM type: NRG; PAM sequence: TGG
caccagagaaagacaggaag

SEQ ID NO: 150400 - DNA, 20 bp, Artificial Sequence
  Description of Artificial Sequence: Synthetic oligonucleotide
  Target: ATXN1; (+) strand; PAM type: NRG; PAM sequence: GAG
ccagagaaagacaggaagtg

SEQ ID NO: 150401 - DNA, 20 bp, Artificial Sequence
  Description of Artificial Sequence: Synthetic oligonucleotide
  Target: ATXN1; (+) strand; PAM type: NRG; PAM sequence: AAG
gagaaagacaggaagtggag

SEQ ID NO: 150402 - DNA, 20 bp, Artificial Sequence
  Description of Artificial Sequence: Synthetic oligonucleotide
  Target: ATXN1; (+) strand; PAM type: NRG; PAM sequence: CAG
agacaggaagtggagaagtc

SEQ ID NO: 150403 - DNA, 20 bp, Artificial Sequence
  Description of Artificial Sequence: Synthetic oligonucleotide
  Target: ATXN1; (+) strand; PAM type: NRG; PAM sequence: AGG
gacaggaagtggagaagtcc

SEQ ID NO: 150404 - DNA, 20 bp, Artificial Sequence
  Description of Artificial Sequence: Synthetic oligonucleotide
  Target: ATXN1; (+) strand; PAM type: NRG; PAM sequence: GAG
ggagaagtccaggctaacat

SEQ ID NO: 150405 - DNA, 20 bp, Artificial Sequence
  Description of Artificial Sequence: Synthetic oligonucleotide
  Target: ATXN1; (+) strand; PAM type: NRG; PAM sequence: CAG
ccaggctaacatgagtttcc

SEQ ID NO: 150406 - DNA, 20 bp, Artificial Sequence
  Description of Artificial Sequence: Synthetic oligonucleotide
  Target: ATXN1; (+) strand; PAM type: NRG; PAM sequence: GAG
aggctaacatgagtttccca

SEQ ID NO: 150407 - DNA, 20 bp, Artificial Sequence
  Description of Artificial Sequence: Synthetic oligonucleotide
  Target: ATXN1; (+) strand; PAM type: NRG; PAM sequence: GAG
aactaaattatgatccattt

SEQ ID NO: 150408 - DNA, 20 bp, Artificial Sequence
  Description of Artificial Sequence: Synthetic oligonucleotide
  Target: ATXN1; (+) strand; PAM type: NRG; PAM sequence: GAG
ctaaattatgatccatttga

SEQ ID NO: 150409 - DNA, 20 bp, Artificial Sequence
  Description of Artificial Sequence: Synthetic oligonucleotide
  Target: ATXN1; (+) strand; PAM type: NRG; PAM sequence: AAG
aattatgatccatttgagag

SEQ ID NO: 150410 - DNA, 20 bp, Artificial Sequence
  Description of Artificial Sequence: Synthetic oligonucleotide
  Target: ATXN1; (+) strand; PAM type: NRG; PAM sequence: AGG
attatgatccatttgagaga

SEQ ID NO: 150411 - DNA, 20 bp, Artificial Sequence
  Description of Artificial Sequence: Synthetic oligonucleotide
  Target: ATXN1; (+) strand; PAM type: NRG; PAM sequence: CAG
atgatccatttgagagaagg

SEQ ID NO: 150412 - DNA, 20 bp, Artificial Sequence
  Description of Artificial Sequence: Synthetic oligonucleotide
  Target: ATXN1; (+) strand; PAM type: NRG; PAM sequence: AGG
tgatccatttgagagaaggc

SEQ ID NO: 150413 - DNA, 20 bp, Artificial Sequence
  Description of Artificial Sequence: Synthetic oligonucleotide
  Target: ATXN1; (+) strand; PAM type: NRG; PAM sequence: CAG
ccatttgagagaaggcaggt

SEQ ID NO: 150414 - DNA, 20 bp, Artificial Sequence
  Description of Artificial Sequence: Synthetic oligonucleotide
  Target: ATXN1; (+) strand; PAM type: NRG; PAM sequence: AAG
actaaaactaaccgtttatt

SEQ ID NO: 150415 - DNA, 20 bp, Artificial Sequence
  Description of Artificial Sequence: Synthetic oligonucleotide
  Target: ATXN1; (+) strand; PAM type: NRG; PAM sequence: AAG
taaccgtttattaagttttg

SEQ ID NO: 150416 - DNA, 20 bp, Artificial Sequence
  Description of Artificial Sequence: Synthetic oligonucleotide
  Target: ATXN1; (+) strand; PAM type: NRG; PAM sequence: TGG
gtttattaagttttgaagaa

SEQ ID NO: 150417 - DNA, 20 bp, Artificial Sequence
  Description of Artificial Sequence: Synthetic oligonucleotide
  Target: ATXN1; (+) strand; PAM type: NRG; PAM sequence: AAG
tattaagttttgaagaatgg

SEQ ID NO: 150418 - DNA, 20 bp, Artificial Sequence
  Description of Artificial Sequence: Synthetic oligonucleotide
  Target: ATXN1; (+) strand; PAM type: NRG; PAM sequence: TGG
taagttttgaagaatggaag

SEQ ID NO: 150419 - DNA, 20 bp, Artificial Sequence
  Description of Artificial Sequence: Synthetic oligonucleotide
  Target: ATXN1; (+) strand; PAM type: NRG; PAM sequence: TGG
gaagaatggaagtggctata

SEQ ID NO: 150420 - DNA, 20 bp, Artificial Sequence
  Description of Artificial Sequence: Synthetic oligonucleotide
  Target: ATXN1; (+) strand; PAM type: NRG; PAM sequence: TGG
ggttttataacatgatccct

SEQ ID NO: 150421 - DNA, 20 bp, Artificial Sequence
  Description of Artificial Sequence: Synthetic oligonucleotide
  Target: ATXN1; (+) strand; PAM type: NRG; PAM sequence: AAG
cccttggaaaattaaaatga

SEQ ID NO: 150422 - DNA, 20 bp, Artificial Sequence
  Description of Artificial Sequence: Synthetic oligonucleotide
  Target: ATXN1; (+) strand; PAM type: NRG; PAM sequence: TGG
gaaagtatgttaacttccta

SEQ ID NO: 150423 - DNA, 20 bp, Artificial Sequence
  Description of Artificial Sequence: Synthetic oligonucleotide
  Target: ATXN1; (+) strand; PAM type: NRG; PAM sequence: TGG
taacttcctatggctttaaa

SEQ ID NO: 150424 - DNA, 20 bp, Artificial Sequence
  Description of Artificial Sequence: Synthetic oligonucleotide
  Target: ATXN1; (+) strand; PAM type: NRG; PAM sequence: TGG
gtgtgtcttgcttgtaatgt

SEQ ID NO: 150425 - DNA, 20 bp, Artificial Sequence
  Description of Artificial Sequence: Synthetic oligonucleotide
  Target: ATXN1; (+) strand; PAM type: NRG; PAM sequence: TGG
ttgcttgtaatgttggacac

SEQ ID NO: 150426 - DNA, 20 bp, Artificial Sequence
  Description of Artificial Sequence: Synthetic oligonucleotide
  Target: ATXN1; (+) strand; PAM type: NRG; PAM sequence: TAG
tgttggacactggactcctc

SEQ ID NO: 150427 - DNA, 20 bp, Artificial Sequence
  Description of Artificial Sequence: Synthetic oligonucleotide
  Target: ATXN1; (+) strand; PAM type: NRG; PAM sequence: GAG
ttggacactggactcctcta

SEQ ID NO: 150428 - DNA, 20 bp, Artificial Sequence
  Description of Artificial Sequence: Synthetic oligonucleotide
  Target: ATXN1; (+) strand; PAM type: NRG; PAM sequence: AAG
gactcctctagagccttctt

SEQ ID NO: 150429 - DNA, 20 bp, Artificial Sequence
  Description of Artificial Sequence: Synthetic oligonucleotide
  Target: ATXN1; (+) strand; PAM type: NRG; PAM sequence: GAG
tctagagccttcttaagtac

SEQ ID NO: 150430 - DNA, 20 bp, Artificial Sequence
  Description of Artificial Sequence: Synthetic oligonucleotide
  Target: ATXN1; (+) strand; PAM type: NRG; PAM sequence: GAG
tagagccttcttaagtacga

SEQ ID NO: 150431 - DNA, 20 bp, Artificial Sequence
  Description of Artificial Sequence: Synthetic oligonucleotide
  Target: ATXN1; (+) strand; PAM type: NRG; PAM sequence: GAG
ccttcttaagtacgagagct

SEQ ID NO: 150432 - DNA, 20 bp, Artificial Sequence
  Description of Artificial Sequence: Synthetic oligonucleotide
  Target: ATXN1; (+) strand; PAM type: NRG; PAM sequence: TAG
ctgagttttctgtgtttatt

SEQ ID NO: 150433 - DNA, 20 bp, Artificial Sequence
  Description of Artificial Sequence: Synthetic oligonucleotide
  Target: ATXN1; (+) strand; PAM type: NRG; PAM sequence: AGG
tgagttttctgtgtttattt

SEQ ID NO: 150434 - DNA, 20 bp, Artificial Sequence
  Description of Artificial Sequence: Synthetic oligonucleotide
  Target: ATXN1; (+) strand; PAM type: NRG; PAM sequence: GAG
tctgtgtttatttaggtttc

SEQ ID NO: 150435 - DNA, 20 bp, Artificial Sequence
  Description of Artificial Sequence: Synthetic oligonucleotide
  Target: ATXN1; (+) strand; PAM type: NRG; PAM sequence: CAG
gatactgcgtgttttcattc

SEQ ID NO: 150436 - DNA, 20 bp, Artificial Sequence
  Description of Artificial Sequence: Synthetic oligonucleotide
  Target: ATXN1; (+) strand; PAM type: NRG; PAM sequence: GAG
tactgcgtgttttcattcca

SEQ ID NO: 150437 - DNA, 20 bp, Artificial Sequence
  Description of Artificial Sequence: Synthetic oligonucleotide
  Target: ATXN1; (+) strand; PAM type: NRG; PAM sequence: AGG
actgcgtgttttcattccag

SEQ ID NO: 150438 - DNA, 20 bp, Artificial Sequence
  Description of Artificial Sequence: Synthetic oligonucleotide
  Target: ATXN1; (+) strand; PAM type: NRG; PAM sequence: GAG
tgcgtgttttcattccagag

SEQ ID NO: 150439 - DNA, 20 bp, Artificial Sequence
  Description of Artificial Sequence: Synthetic oligonucleotide
  Target: ATXN1; (+) strand; PAM type: NRG; PAM sequence: GAG
gattgttaatttgttattgc

SEQ ID NO: 150440 - DNA, 20 bp, Artificial Sequence
  Description of Artificial Sequence: Synthetic oligonucleotide
  Target: ATXN1; (+) strand; PAM type: NRG; PAM sequence: AAG
tttgttattgcgagttcctt

SEQ ID NO: 150441 - DNA, 20 bp, Artificial Sequence
  Description of Artificial Sequence: Synthetic oligonucleotide
  Target: ATXN1; (+) strand; PAM type: NRG; PAM sequence: AGG
ttgttattgcgagttcctta

SEQ ID NO: 150442 - DNA, 20 bp, Artificial Sequence
  Description of Artificial Sequence: Synthetic oligonucleotide
  Target: ATXN1; (+) strand; PAM type: NRG; PAM sequence: GAG
gttattgcgagttccttaag

SEQ ID NO: 150443 - DNA, 20 bp, Artificial Sequence
  Description of Artificial Sequence: Synthetic oligonucleotide
  Target: ATXN1; (+) strand; PAM type: NRG; PAM sequence: CAG
ccttaaggagtcaaaacatc

SEQ ID NO: 150444 - DNA, 20 bp, Artificial Sequence
  Description of Artificial Sequence: Synthetic oligonucleotide
  Target: ATXN1; (+) strand; PAM type: NRG; PAM sequence: GAG
ttaaggagtcaaaacatcca

SEQ ID NO: 150445 - DNA, 20 bp, Artificial Sequence
  Description of Artificial Sequence: Synthetic oligonucleotide
  Target: ATXN1; (+) strand; PAM type: NRG; PAM sequence: AAG
gagtcaaaacatccagagaa

SEQ ID NO: 150446 - DNA, 20 bp, Artificial Sequence
  Description of Artificial Sequence: Synthetic oligonucleotide
  Target: ATXN1; (+) strand; PAM type: NRG; PAM sequence: CAG
agaaaagcatgaactacaca

SEQ ID NO: 150447 - DNA, 20 bp, Artificial Sequence
  Description of Artificial Sequence: Synthetic oligonucleotide
  Target: ATXN1; (+) strand; PAM type: NRG; PAM sequence: AAG
atgaactacacacagcaata

SEQ ID NO: 150448 - DNA, 20 bp, Artificial Sequence
  Description of Artificial Sequence: Synthetic oligonucleotide
  Target: ATXN1; (+) strand; PAM type: NRG; PAM sequence: AGG
tgaactacacacagcaataa

SEQ ID NO: 150449 - DNA, 20 bp, Artificial Sequence
  Description of Artificial Sequence: Synthetic oligonucleotide
  Target: ATXN1; (+) strand; PAM type: NRG; PAM sequence: TAG
ctacacacagcaataaaggc

SEQ ID NO: 150450 - DNA, 20 bp, Artificial Sequence
  Description of Artificial Sequence: Synthetic oligonucleotide
  Target: ATXN1; (+) strand; PAM type: NRG; PAM sequence: TGG
tagaaaatgtctcaacaaca

SEQ ID NO: 150451 - DNA, 20 bp, Artificial Sequence
  Description of Artificial Sequence: Synthetic oligonucleotide
  Target: ATXN1; (+) strand; PAM type: NRG; PAM sequence: AAG
atggaaatgactcactgcta

SEQ ID NO: 150452 - DNA, 20 bp, Artificial Sequence
  Description of Artificial Sequence: Synthetic oligonucleotide
  Target: ATXN1; (+) strand; PAM type: NRG; PAM sequence: TGG
atgactcactgctaaagaca

SEQ ID NO: 150453 - DNA, 20 bp, Artificial Sequence
  Description of Artificial Sequence: Synthetic oligonucleotide
  Target: ATXN1; (+) strand; PAM type: NRG; PAM sequence: GGG
tgactcactgctaaagacat

SEQ ID NO: 150454 - DNA, 20 bp, Artificial Sequence
  Description of Artificial Sequence: Synthetic oligonucleotide
  Target: ATXN1; (+) strand; PAM type: NRG; PAM sequence: GGG
gactcactgctaaagacatg

SEQ ID NO: 150455 - DNA, 20 bp, Artificial Sequence
  Description of Artificial Sequence: Synthetic oligonucleotide
  Target: ATXN1; (+) strand; PAM type: NRG; PAM sequence: GGG
actcactgctaaagacatgg

SEQ ID NO: 150456 - DNA, 20 bp, Artificial Sequence
  Description of Artificial Sequence: Synthetic oligonucleotide
  Target: ATXN1; (+) strand; PAM type: NRG; PAM sequence: AAG
tgctaaagacatgggggatt

SEQ ID NO: 150457 - DNA, 20 bp, Artificial Sequence
  Description of Artificial Sequence: Synthetic oligonucleotide
  Target: ATXN1; (+) strand; PAM type: NRG; PAM sequence: CAG
aaacactctcccattcaatt

SEQ ID NO: 150458 - DNA, 20 bp, Artificial Sequence
  Description of Artificial Sequence: Synthetic oligonucleotide
  Target: ATXN1; (+) strand; PAM type: NRG; PAM sequence: AGG
aacactctcccattcaattc

SEQ ID NO: 150459 - DNA, 20 bp, Artificial Sequence
  Description of Artificial Sequence: Synthetic oligonucleotide
  Target: ATXN1; (+) strand; PAM type: NRG; PAM sequence: GGG
acactctcccattcaattca

SEQ ID NO: 150460 - DNA, 20 bp, Artificial Sequence
  Description of Artificial Sequence: Synthetic oligonucleotide
  Target: ATXN1; (+) strand; PAM type: NRG; PAM sequence: CAG
caattcagggtaaatttgtt

SEQ ID NO: 150461 - DNA, 20 bp, Artificial Sequence
  Description of Artificial Sequence: Synthetic oligonucleotide
  Target: ATXN1; (+) strand; PAM type: NRG; PAM sequence: AAG
tttgttcagatgaaacaaac

SEQ ID NO: 150462 - DNA, 20 bp, Artificial Sequence
  Description of Artificial Sequence: Synthetic oligonucleotide
  Target: ATXN1; (+) strand; PAM type: NRG; PAM sequence: AAG
cagatgaaacaaacaagaaa

SEQ ID NO: 150463 - DNA, 20 bp, Artificial Sequence
  Description of Artificial Sequence: Synthetic oligonucleotide
  Target: ATXN1; (+) strand; PAM type: NRG; PAM sequence: GAG
gatgaaacaaacaagaaaaa

SEQ ID NO: 150464 - DNA, 20 bp, Artificial Sequence
  Description of Artificial Sequence: Synthetic oligonucleotide
  Target: ATXN1; (+) strand; PAM type: NRG; PAM sequence: CAG
acaagaaaaagagctaaatc

SEQ ID NO: 150465 - DNA, 20 bp, Artificial Sequence
  Description of Artificial Sequence: Synthetic oligonucleotide
  Target: ATXN1; (+) strand; PAM type: NRG; PAM sequence: CAG
gctaaatccagtttttgaat

SEQ ID NO: 150466 - DNA, 20 bp, Artificial Sequence
  Description of Artificial Sequence: Synthetic oligonucleotide
  Target: ATXN1; (+) strand; PAM type: NRG; PAM sequence: TAG
tttgaatcagaaaccgaatt

SEQ ID NO: 150467 - DNA, 20 bp, Artificial Sequence
  Description of Artificial Sequence: Synthetic oligonucleotide
  Target: ATXN1; (+) strand; PAM type: NRG; PAM sequence: TGG
ccgaatttagaaaaacatct

SEQ ID NO: 150468 - DNA, 20 bp, Artificial Sequence
  Description of Artificial Sequence: Synthetic oligonucleotide
  Target: ATXN1; (+) strand; PAM type: NRG; PAM sequence: TAG
gttgaaatgccctgtgaaaa

SEQ ID NO: 150469 - DNA, 20 bp, Artificial Sequence
  Description of Artificial Sequence: Synthetic oligonucleotide
  Target: ATXN1; (+) strand; PAM type: NRG; PAM sequence: AAG
gccctgtgaaaatagtttta

SEQ ID NO: 150470 - DNA, 20 bp, Artificial Sequence
  Description of Artificial Sequence: Synthetic oligonucleotide
  Target: ATXN1; (+) strand; PAM type: NRG; PAM sequence: CAG
tttctcttccttcctctcat

SEQ ID NO: 150471 - DNA, 20 bp, Artificial Sequence
  Description of Artificial Sequence: Synthetic oligonucleotide
  Target: ATXN1; (+) strand; PAM type: NRG; PAM sequence: AAG
tcttccttcctctcatcagt

SEQ ID NO: 150472 - DNA, 20 bp, Artificial Sequence
  Description of Artificial Sequence: Synthetic oligonucleotide
  Target: ATXN1; (+) strand; PAM type: NRG; PAM sequence: AGG
cttccttcctctcatcagta

SEQ ID NO: 150473 - DNA, 20 bp, Artificial Sequence
  Description of Artificial Sequence: Synthetic oligonucleotide
  Target: ATXN1; (+) strand; PAM type: NRG; PAM sequence: TGG
ttgcactcattgtgcatatt

SEQ ID NO: 150474 - DNA, 20 bp, Artificial Sequence
  Description of Artificial Sequence: Synthetic oligonucleotide
  Target: ATXN1; (+) strand; PAM type: NRG; PAM sequence: CAG
ctcattgtgcatatttggcc

SEQ ID NO: 150475 - DNA, 20 bp, Artificial Sequence
  Description of Artificial Sequence: Synthetic oligonucleotide
  Target: ATXN1; (+) strand; PAM type: NRG; PAM sequence: TAG
attgtgcatatttggcccag

SEQ ID NO: 150476 - DNA, 20 bp, Artificial Sequence
  Description of Artificial Sequence: Synthetic oligonucleotide
  Target: ATXN1; (+) strand; PAM type: NRG; PAM sequence: CAG
cattcaacaatatttatgcc

SEQ ID NO: 150477 - DNA, 20 bp, Artificial Sequence
  Description of Artificial Sequence: Synthetic oligonucleotide
  Target: ATXN1; (+) strand; PAM type: NRG; PAM sequence: AAG
aacaatatttatgcccagat

SEQ ID NO: 150478 - DNA, 20 bp, Artificial Sequence
  Description of Artificial Sequence: Synthetic oligonucleotide
  Target: ATXN1; (+) strand; PAM type: NRG; PAM sequence: AGG
acaatatttatgcccagata

SEQ ID NO: 150479 - DNA, 20 bp, Artificial Sequence
  Description of Artificial Sequence: Synthetic oligonucleotide
  Target: ATXN1; (+) strand; PAM type: NRG; PAM sequence: GGG
caatatttatgcccagataa

SEQ ID NO: 150480 - DNA, 20 bp, Artificial Sequence
  Description of Artificial Sequence: Synthetic oligonucleotide
  Target: ATXN1; (+) strand; PAM type: NRG; PAM sequence: GAG
atatttatgcccagataagg

SEQ ID NO: 150481 - DNA, 20 bp, Artificial Sequence
  Description of Artificial Sequence: Synthetic oligonucleotide
  Target: ATXN1; (+) strand; PAM type: NRG; PAM sequence: GAG
atttatgcccagataaggga

SEQ ID NO: 150482 - DNA, 20 bp, Artificial Sequence
  Description of Artificial Sequence: Synthetic oligonucleotide
  Target: ATXN1; (+) strand; PAM type: NRG; PAM sequence: AAG
ggagagaatcatcctttcac

SEQ ID NO: 150483 - DNA, 20 bp, Artificial Sequence
  Description of Artificial Sequence: Synthetic oligonucleotide
  Target: ATXN1; (+) strand; PAM type: NRG; PAM sequence: AAG
cattttcctgcaccatttta

SEQ ID NO: 150484 - DNA, 20 bp, Artificial Sequence
  Description of Artificial Sequence: Synthetic oligonucleotide
  Target: ATXN1; (+) strand; PAM type: NRG; PAM sequence: AGG
attttcctgcaccattttaa

SEQ ID NO: 150485 - DNA, 20 bp, Artificial Sequence
  Description of Artificial Sequence: Synthetic oligonucleotide
  Target: ATXN1; (+) strand; PAM type: NRG; PAM sequence: AAG
ttcctgcaccattttaaagg

SEQ ID NO: 150486 - DNA, 20 bp, Artificial Sequence
  Description of Artificial Sequence: Synthetic oligonucleotide
  Target: ATXN1; (+) strand; PAM type: NRG; PAM sequence: GAG
cctgcaccattttaaaggaa

SEQ ID NO: 150487 - DNA, 20 bp, Artificial Sequence
  Description of Artificial Sequence: Synthetic oligonucleotide
  Target: ATXN1; (+) strand; PAM type: NRG; PAM sequence: AAG
attttaaaggaagagaaaaa

SEQ ID NO: 150488 - DNA, 20 bp, Artificial Sequence
  Description of Artificial Sequence: Synthetic oligonucleotide
  Target: ATXN1; (+) strand; PAM type: NRG; PAM sequence: AAG
gaagagaaaaaaagcatcaa

SEQ ID NO: 150489 - DNA, 20 bp, Artificial Sequence
  Description of Artificial Sequence: Synthetic oligonucleotide
  Target: ATXN1; (+) strand; PAM type: NRG; PAM sequence: AAG
agaaaaaaagcatcaaaaga

SEQ ID NO: 150490 - DNA, 20 bp, Artificial Sequence
  Description of Artificial Sequence: Synthetic oligonucleotide
  Target: ATXN1; (+) strand; PAM type: NRG; PAM sequence: AAG
aaagcatcaaaagaaagctt

SEQ ID NO: 150491 - DNA, 20 bp, Artificial Sequence
  Description of Artificial Sequence: Synthetic oligonucleotide
  Target: ATXN1; (+) strand; PAM type: NRG; PAM sequence: AAG
aagaaagcttaagcgctcct

SEQ ID NO: 150492 - DNA, 20 bp, Artificial Sequence
  Description of Artificial Sequence: Synthetic oligonucleotide
  Target: ATXN1; (+) strand; PAM type: NRG; PAM sequence: AGG
agaaagcttaagcgctccta

SEQ ID NO: 150493 - DNA, 20 bp, Artificial Sequence
  Description of Artificial Sequence: Synthetic oligonucleotide
  Target: ATXN1; (+) strand; PAM type: NRG; PAM sequence: GGG
gaaagcttaagcgctcctaa

SEQ ID NO: 150494 - DNA, 20 bp, Artificial Sequence
  Description of Artificial Sequence: Synthetic oligonucleotide
  Target: ATXN1; (+) strand; PAM type: NRG; PAM sequence: AAG
cttaagcgctcctaagggaa

SEQ ID NO: 150495 - DNA, 20 bp, Artificial Sequence
  Description of Artificial Sequence: Synthetic oligonucleotide
  Target: ATXN1; (+) strand; PAM type: NRG; PAM sequence: CAG
gggaaaagactcaatacata

SEQ ID NO: 150496 - DNA, 20 bp, Artificial Sequence
  Description of Artificial Sequence: Synthetic oligonucleotide
  Target: ATXN1; (+) strand; PAM type: NRG; PAM sequence: CAG
acagacctttttaatcaatt

SEQ ID NO: 150497 - DNA, 20 bp, Artificial Sequence
  Description of Artificial Sequence: Synthetic oligonucleotide
  Target: ATXN1; (+) strand; PAM type: NRG; PAM sequence: AAG
tttttaatcaattcagatcc

SEQ ID NO: 150498 - DNA, 20 bp, Artificial Sequence
  Description of Artificial Sequence: Synthetic oligonucleotide
  Target: ATXN1; (+) strand; PAM type: NRG; PAM sequence: AAG
caattcagatccaagtacac

SEQ ID NO: 150499 - DNA, 20 bp, Artificial Sequence
  Description of Artificial Sequence: Synthetic oligonucleotide
  Target: ATXN1; (+) strand; PAM type: NRG; PAM sequence: AGG
aattcagatccaagtacaca

SEQ ID NO: 150500 - DNA, 20 bp, Artificial Sequence
  Description of Artificial Sequence: Synthetic oligonucleotide
  Target: ATXN1; (+) strand; PAM type: NRG; PAM sequence: AAG
gatccaagtacacaaggaac

SEQ ID NO: 150501 - DNA, 20 bp, Artificial Sequence
  Description of Artificial Sequence: Synthetic oligonucleotide
  Target: ATXN1; (+) strand; PAM type: NRG; PAM sequence: TGG
acacaaggaacaagtgcata

SEQ ID NO: 150502 - DNA, 20 bp, Artificial Sequence
  Description of Artificial Sequence: Synthetic oligonucleotide
  Target: ATXN1; (+) strand; PAM type: NRG; PAM sequence: GGG
cacaaggaacaagtgcatat

SEQ ID NO: 150503 - DNA, 20 bp, Artificial Sequence
  Description of Artificial Sequence: Synthetic oligonucleotide
  Target: ATXN1; (+) strand; PAM type: NRG; PAM sequence: CAG
aaggaacaagtgcatatggg

SEQ ID NO: 150504 - DNA, 20 bp, Artificial Sequence
  Description of Artificial Sequence: Synthetic oligonucleotide
  Target: ATXN1; (+) strand; PAM type: NRG; PAM sequence: AGG
aggaacaagtgcatatgggc

SEQ ID NO: 150505 - DNA, 20 bp, Artificial Sequence
  Description of Artificial Sequence: Synthetic oligonucleotide
  Target: ATXN1; (+) strand; PAM type: NRG; PAM sequence: TGG
tgcatatgggcaggaacgac

SEQ ID NO: 150506 - DNA, 20 bp, Artificial Sequence
  Description of Artificial Sequence: Synthetic oligonucleotide
  Target: ATXN1; (+) strand; PAM type: NRG; PAM sequence: AAG
tggtaaatatttgctaaata

SEQ ID NO: 150507 - DNA, 20 bp, Artificial Sequence
  Description of Artificial Sequence: Synthetic oligonucleotide
  Target: ATXN1; (+) strand; PAM type: NRG; PAM sequence: AGG
ggtaaatatttgctaaataa

SEQ ID NO: 150508 - DNA, 20 bp, Artificial Sequence
  Description of Artificial Sequence: Synthetic oligonucleotide
  Target: ATXN1; (+) strand; PAM type: NRG; PAM sequence: CAG
aaatatttgctaaataaagg

SEQ ID NO: 150509 - DNA, 20 bp, Artificial Sequence
  Description of Artificial Sequence: Synthetic oligonucleotide
  Target: ATXN1; (+) strand; PAM type: NRG; PAM sequence: TAG
ttctctgcccgctttgcccc

SEQ ID NO: 150510 - DNA, 20 bp, Artificial Sequence
  Description of Artificial Sequence: Synthetic oligonucleotide
  Target: ATXN1; (+) strand; PAM type: NRG; PAM sequence: TGG
tacccacataattttccttt

SEQ ID NO: 150511 - DNA, 20 bp, Artificial Sequence
  Description of Artificial Sequence: Synthetic oligonucleotide
  Target: ATXN1; (+) strand; PAM type: NRG; PAM sequence: TAG
ttttccttttggccataata

SEQ ID NO: 150512 - DNA, 20 bp, Artificial Sequence
  Description of Artificial Sequence: Synthetic oligonucleotide
  Target: ATXN1; (+) strand; PAM type: NRG; PAM sequence: AAG
tagaactcaatcaccatatt

SEQ ID NO: 150513 - DNA, 20 bp, Artificial Sequence
  Description of Artificial Sequence: Synthetic oligonucleotide
  Target: ATXN1; (+) strand; PAM type: NRG; PAM sequence: AAG
tcaatcaccatattaagatg

SEQ ID NO: 150514 - DNA, 20 bp, Artificial Sequence
  Description of Artificial Sequence: Synthetic oligonucleotide
  Target: ATXN1; (+) strand; PAM type: NRG; PAM sequence: TAG
accatattaagatgaagccc

SEQ ID NO: 150515 - DNA, 20 bp, Artificial Sequence
  Description of Artificial Sequence: Synthetic oligonucleotide
  Target: ATXN1; (+) strand; PAM type: NRG; PAM sequence: AAG
tattaagatgaagccctaga

SEQ ID NO: 150516 - DNA, 20 bp, Artificial Sequence
  Description of Artificial Sequence: Synthetic oligonucleotide
  Target: ATXN1; (+) strand; PAM type: NRG; PAM sequence: TAG
taagatgaagccctagaaag

SEQ ID NO: 150517 - DNA, 20 bp, Artificial Sequence
  Description of Artificial Sequence: Synthetic oligonucleotide
  Target: ATXN1; (+) strand; PAM type: NRG; PAM sequence: AAG
tcttataccctgtgaactgt

SEQ ID NO: 150518 - DNA, 20 bp, Artificial Sequence
  Description of Artificial Sequence: Synthetic oligonucleotide
  Target: ATXN1; (+) strand; PAM type: NRG; PAM sequence: GAG
ttataccctgtgaactgtaa

SEQ ID NO: 150519 - DNA, 20 bp, Artificial Sequence
  Description of Artificial Sequence: Synthetic oligonucleotide
  Target: ATXN1; (+) strand; PAM type: NRG; PAM sequence: AGG
tataccctgtgaactgtaag

SEQ ID NO: 150520 - DNA, 20 bp, Artificial Sequence
  Description of Artificial Sequence: Synthetic oligonucleotide
  Target: ATXN1; (+) strand; PAM type: NRG; PAM sequence: GGG
ataccctgtgaactgtaaga

SEQ ID NO: 150521 - DNA, 20 bp, Artificial Sequence
  Description of Artificial Sequence: Synthetic oligonucleotide
  Target: ATXN1; (+) strand; PAM type: NRG; PAM sequence: GAG
accctgtgaactgtaagagg

SEQ ID NO: 150522 - DNA, 20 bp, Artificial Sequence
  Description of Artificial Sequence: Synthetic oligonucleotide
  Target: ATXN1; (+) strand; PAM type: NRG; PAM sequence: AGG
ccctgtgaactgtaagaggg

SEQ ID NO: 150523 - DNA, 20 bp, Artificial Sequence
  Description of Artificial Sequence: Synthetic oligonucleotide
  Target: ATXN1; (+) strand; PAM type: NRG; PAM sequence: GGG
cctgtgaactgtaagaggga

SEQ ID NO: 150524 - DNA, 20 bp, Artificial Sequence
  Description of Artificial Sequence: Synthetic oligonucleotide
  Target: ATXN1; (+) strand; PAM type: NRG; PAM sequence: GGG
ctgtgaactgtaagagggag

SEQ ID NO: 150525 - DNA, 20 bp, Artificial Sequence
  Description of Artificial Sequence: Synthetic oligonucleotide
  Target: ATXN1; (+) strand; PAM type: NRG; PAM sequence: CAG
actgtaagagggaggggttc

SEQ ID NO: 150526 - DNA, 20 bp, Artificial Sequence
  Description of Artificial Sequence: Synthetic oligonucleotide
  Target: ATXN1; (+) strand; PAM type: NRG; PAM sequence: CGG
taagagggaggggttccagc

SEQ ID NO: 150527 - DNA, 20 bp, Artificial Sequence
  Description of Artificial Sequence: Synthetic oligonucleotide
  Target: ATXN1; (+) strand; PAM type: NRG; PAM sequence: GGG
aagagggaggggttccagcc

SEQ ID NO: 150528 - DNA, 20 bp, Artificial Sequence
  Description of Artificial Sequence: Synthetic oligonucleotide
  Target: ATXN1; (+) strand; PAM type: NRG; PAM sequence: CAG
ggaggggttccagccgggca

SEQ ID NO: 150529 - DNA, 20 bp, Artificial Sequence
  Description of Artificial Sequence: Synthetic oligonucleotide
  Target: ATXN1; (+) strand; PAM type: NRG; PAM sequence: TGG
ggggttccagccgggcacag

SEQ ID NO: 150530 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatcc

SEQ ID NO: 150531 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 150532 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 150533 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 150534 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 150535 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggaggcc

SEQ ID NO: 150536 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggcca

SEQ ID NO: 150537 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggccaagg

SEQ ID NO: 150538 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggccaaggc

SEQ ID NO: 150539 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggccaaggcagg

SEQ ID NO: 150540 - DNA, 20 bp, Artificial Sequence
  Description of Artificial Sequence: Synthetic oligonucleotide
  Target: ATXN1; (+) strand; PAM type: NRG; PAM sequence: GAG
ccaaggcaggcggatcacct

SEQ ID NO: 150541 - DNA, 20 bp, Artificial Sequence
  Description of Artificial Sequence: Synthetic oligonucleotide
  Target: ATXN1; (+) strand; PAM type: NRG; PAM sequence: AGG
caaggcaggcggatcacctg

SEQ ID NO: 150542 - DNA, 20 bp, Artificial Sequence
  Description of Artificial Sequence: Synthetic oligonucleotide
  Target: ATXN1; (+) strand; PAM type: NRG; PAM sequence: CAG
gcaggcggatcacctgaggt

SEQ ID NO: 150543 - DNA, 20 bp, Artificial Sequence
  Description of Artificial Sequence: Synthetic oligonucleotide
  Target: ATXN1; (+) strand; PAM type: NRG; PAM sequence: AGG
caggcggatcacctgaggtc

SEQ ID NO: 150544 - DNA, 20 bp, Artificial Sequence
  Description of Artificial Sequence: Synthetic oligonucleotide
  Target: ATXN1; (+) strand; PAM type: NRG; PAM sequence: GAG
ggcggatcacctgaggtcag

SEQ ID NO: 150545 - DNA, 20 bp, Artificial Sequence
  Description of Artificial Sequence: Synthetic oligonucleotide
  Target: ATXN1; (+) strand; PAM type: NRG; PAM sequence: AAG
tcacctgaggtcaggagttc

SEQ ID NO: 150546 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcaagac

SEQ ID NO: 150547 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcaagaccagcc

SEQ ID NO: 150548 - DNA, 20 bp, Artificial Sequence
  Description of Artificial Sequence: Synthetic oligonucleotide
  Target: ATXN1; (+) strand; PAM type: NRG; PAM sequence: TGG
caagaccagcctggccaaca

SEQ ID NO: 150549 - DNA, 20 bp, Artificial Sequence
  Description of Artificial Sequence: Synthetic oligonucleotide
  Target: ATXN1; (+) strand; PAM type: NRG; PAM sequence: TAG
ctctactaaaatacaaaaat

SEQ ID NO: 150550 - DNA, 20 bp, Artificial Sequence
  Description of Artificial Sequence: Synthetic oligonucleotide
  Target: ATXN1; (+) strand; PAM type: NRG; PAM sequence: TGG
actaaaatacaaaaattagc

SEQ ID NO: 150551 - DNA, 20 bp, Artificial Sequence
  Description of Artificial Sequence: Synthetic oligonucleotide
  Target: ATXN1; (+) strand; PAM type: NRG; PAM sequence: GGG
ctaaaatacaaaaattagct

SEQ ID NO: 150552 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagctgggcg

SEQ ID NO: 150553 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgggcgtgg

SEQ ID NO: 150554 - DNA, 20 bp, Artificial Sequence
  Description of Artificial Sequence: Synthetic oligonucleotide
  Target: ATXN1; (+) strand; PAM type: NRG; PAM sequence: CAG
gtggcgtgtgcctgtaatcc

SEQ ID NO: 150555 - DNA, 20 bp, Artificial Sequence
  Description of Artificial Sequence: Synthetic oligonucleotide
  Target: ATXN1; (+) strand; PAM type: NRG; PAM sequence: CAG
tgcctgtaatcccagctaca

SEQ ID NO: 150556 - DNA, 20 bp, Artificial Sequence
  Description of Artificial Sequence: Synthetic oligonucleotide
  Target: ATXN1; (+) strand; PAM type: NRG; PAM sequence: AGG
gcctgtaatcccagctacac

SEQ ID NO: 150557 - DNA, 20 bp, Artificial Sequence
  Description of Artificial Sequence: Synthetic oligonucleotide
  Target: ATXN1; (+) strand; PAM type: NRG; PAM sequence: TGG
tgtaatcccagctacacagg

SEQ ID NO: 150558 - DNA, 20 bp, Artificial Sequence
  Description of Artificial Sequence: Synthetic oligonucleotide
  Target: ATXN1; (+) strand; PAM type: NRG; PAM sequence: GAG
tcccagctacacaggtggct

SEQ ID NO: 150559 - DNA, 20 bp, Artificial Sequence
  Description of Artificial Sequence: Synthetic oligonucleotide
  Target: ATXN1; (+) strand; PAM type: NRG; PAM sequence: AGG
cccagctacacaggtggctg

SEQ ID NO: 150560 - DNA, 20 bp, Artificial Sequence
  Description of Artificial Sequence: Synthetic oligonucleotide
  Target: ATXN1; (+) strand; PAM type: NRG; PAM sequence: AAG
gctacacaggtggctgaggc

SEQ ID NO: 150561 - DNA, 20 bp, Artificial Sequence
  Description of Artificial Sequence: Synthetic oligonucleotide
  Target: ATXN1; (+) strand; PAM type: NRG; PAM sequence: GAG
tacacaggtggctgaggcaa

SEQ ID NO: 150562 - DNA, 20 bp, Artificial Sequence
  Description of Artificial Sequence: Synthetic oligonucleotide
  Target: ATXN1; (+) strand; PAM type: NRG; PAM sequence: TGG
ggctgaggcaagagaatcgc

SEQ ID NO: 150563 - DNA, 20 bp, Artificial Sequence
  Description of Artificial Sequence: Synthetic oligonucleotide
  Target: ATXN1; (+) strand; PAM type: NRG; PAM sequence: CGG
gcaagagaatcgctggaacc

SEQ ID NO: 150564 - DNA, 20 bp, Artificial Sequence
  Description of Artificial Sequence: Synthetic oligonucleotide
  Target: ATXN1; (+) strand; PAM type: NRG; PAM sequence: GGG
caagagaatcgctggaaccc

SEQ ID NO: 150565 - DNA, 20 bp, Artificial Sequence
  Description of Artificial Sequence: Synthetic oligonucleotide
  Target: ATXN1; (+) strand; PAM type: NRG; PAM sequence: GGG
aagagaatcgctggaacccg

SEQ ID NO: 150566 - DNA, 20 bp, Artificial Sequence
  Description of Artificial Sequence: Synthetic oligonucleotide
  Target: ATXN1; (+) strand; PAM type: NRG; PAM sequence: GGG
agagaatcgctggaacccgg

SEQ ID NO: 150567 - DNA, 20 bp, Artificial Sequence
  Description of Artificial Sequence: Synthetic oligonucleotide
  Target: ATXN1; (+) strand; PAM type: NRG; PAM sequence: GAG
agaatcgctggaacccgggg

SEQ ID NO: 150568 - DNA, 20 bp, Artificial Sequence
  Description of Artificial Sequence: Synthetic oligonucleotide
  Target: ATXN1; (+) strand; PAM type: NRG; PAM sequence: CAG
atcgctggaacccgggggag

SEQ ID NO: 150569 - DNA, 20 bp, Artificial Sequence
  Description of Artificial Sequence: Synthetic oligonucleotide
  Target: ATXN1; (+) strand; PAM type: NRG; PAM sequence: GAG
cgctggaacccgggggagca

SEQ ID NO: 150570 - DNA, 20 bp, Artificial Sequence
  Description of Artificial Sequence: Synthetic oligonucleotide
  Target: ATXN1; (+) strand; PAM type: NRG; PAM sequence: AGG
gctggaacccgggggagcag

SEQ ID NO: 150571 - DNA, 20 bp, Artificial Sequence
  Description of Artificial Sequence: Synthetic oligonucleotide
  Target: ATXN1; (+) strand; PAM type: NRG; PAM sequence: CAG
acccgggggagcagaggctg

SEQ ID NO: 150572 - DNA, 20 bp, Artificial Sequence
  Description of Artificial Sequence: Synthetic oligonucleotide
  Target: ATXN1; (+) strand; PAM type: NRG; PAM sequence: GAG
gggggagcagaggctgcagt

SEQ ID NO: 150573 - DNA, 20 bp, Artificial Sequence
  Description of Artificial Sequence: Synthetic oligonucleotide
  Target: ATXN1; (+) strand; PAM type: NRG; PAM sequence: AAG
agcagaggctgcagtgagtc

SEQ ID NO: 150574 - DNA, 20 bp, Artificial Sequence
  Description of Artificial Sequence: Synthetic oligonucleotide
  Target: ATXN1; (+) strand; PAM type: NRG; PAM sequence: CAG
aagattgcatcactgcactc

SEQ ID NO: 150575 - DNA, 20 bp, Artificial Sequence
  Description of Artificial Sequence: Synthetic oligonucleotide
  Target: ATXN1; (+) strand; PAM type: NRG; PAM sequence: TGG
tgcatcactgcactccagtc

SEQ ID NO: 150576 - DNA, 20 bp, Artificial Sequence
  Description of Artificial Sequence: Synthetic oligonucleotide
  Target: ATXN1; (+) strand; PAM type: NRG; PAM sequence: GGG
gcatcactgcactccagtct

SEQ ID NO: 150577 - DNA, 20 bp, Artificial Sequence
  Description of Artificial Sequence: Synthetic oligonucleotide
  Target: ATXN1; (+) strand; PAM type: NRG; PAM sequence: TGG
tcactgcactccagtctggg

SEQ ID NO: 150578 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagtctgggtgg

SEQ ID NO: 150579 - DNA, 20 bp, Artificial Sequence
  Description of Artificial Sequence: Synthetic oligonucleotide
  Target: ATXN1; (+) strand; PAM type: NRG; PAM sequence: GAG
gcactccagtctgggtggca

SEQ ID NO: 150580 - DNA, 20 bp, Artificial Sequence
  Description of Artificial Sequence: Synthetic oligonucleotide
  Target: ATXN1; (+) strand; PAM type: NRG; PAM sequence: AAG
tccagtctgggtggcagagc

SEQ ID NO: 150581 - DNA, 20 bp, Artificial Sequence
  Description of Artificial Sequence: Synthetic oligonucleotide
  Target: ATXN1; (+) strand; PAM type: NRG; PAM sequence: AAG
gtctcaaaaaaaaaaaaaaa

SEQ ID NO: 150582 - DNA, 20 bp, Artificial Sequence
  Description of Artificial Sequence: Synthetic oligonucleotide
  Target: ATXN1; (+) strand; PAM type: NRG; PAM sequence: AGG
tctcaaaaaaaaaaaaaaaa

SEQ ID NO: 150583 - DNA, 20 bp, Artificial Sequence
  Description of Artificial Sequence: Synthetic oligonucleotide
  Target: ATXN1; (+) strand; PAM type: NRG; PAM sequence: GGG
ctcaaaaaaaaaaaaaaaaa

SEQ ID NO: 150584 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaaaaaaggg

SEQ ID NO: 150585 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaaaaaaaaggga

SEQ ID NO: 150586 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaaaaaaaaagggaa

SEQ ID NO: 150587 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaagggaagggttcc

SEQ ID NO: 150588 - DNA, 20 bp, Artificial Sequence
  Description of Artificial Sequence: Synthetic oligonucleotide
  Target: ATXN1; (+) strand; PAM type: NRG; PAM sequence: AAG
cagttctgcccactaacatt

SEQ ID NO: 150589 - DNA, 20 bp, Artificial Sequence
  Description of Artificial Sequence: Synthetic oligonucleotide
  Target: ATXN1; (+) strand; PAM type: NRG; PAM sequence: GAG
gttctgcccactaacattaa

SEQ ID NO: 150590 - DNA, 20 bp, Artificial Sequence
  Description of Artificial Sequence: Synthetic oligonucleotide
  Target: ATXN1; (+) strand; PAM type: NRG; PAM sequence: TAG
ttttcatatgtataatatct

SEQ ID NO: 150591 - DNA, 20 bp, Artificial Sequence
  Description of Artificial Sequence: Synthetic oligonucleotide
  Target: ATXN1; (+) strand; PAM type: NRG; PAM sequence: AAG
cactgctaaactaaaacact

SEQ ID NO: 150592 - DNA, 20 bp, Artificial Sequence
  Description of Artificial Sequence: Synthetic oligonucleotide
  Target: ATXN1; (+) strand; PAM type: NRG; PAM sequence: AGG
actgctaaactaaaacacta

SEQ ID NO: 150593 - DNA, 20 bp, Artificial Sequence
  Description of Artificial Sequence: Synthetic oligonucleotide
  Target: ATXN1; (+) strand; PAM type: NRG; PAM sequence: TAG
gctaaactaaaacactaagg

SEQ ID NO: 150594 - DNA, 20 bp, Artificial Sequence
  Description of Artificial Sequence: Synthetic oligonucleotide
  Target: ATXN1; (+) strand; PAM type: NRG; PAM sequence: TAG
taaggtagaacttctcttcg

SEQ ID NO: 150595 - DNA, 20 bp, Artificial Sequence
  Description of Artificial Sequence: Synthetic oligonucleotide
  Target: ATXN1; (+) strand; PAM type: NRG; PAM sequence: AAG
attttaaaatgcaaattact

SEQ ID NO: 150596 - DNA, 20 bp, Artificial Sequence
  Description of Artificial Sequence: Synthetic oligonucleotide
  Target: ATXN1; (+) strand; PAM type: NRG; PAM sequence: TAG
gcacccaattatgtatgaca

SEQ ID NO: 150597 - DNA, 20 bp, Artificial Sequence
  Description of Artificial Sequence: Synthetic oligonucleotide
  Target: ATXN1; (+) strand; PAM type: NRG; PAM sequence: TGG
tatgacatagaataatttct

SEQ ID NO: 150598 - DNA, 20 bp, Artificial Sequence
  Description of Artificial Sequence: Synthetic oligonucleotide
  Target: ATXN1; (+) strand; PAM type: NRG; PAM sequence: CGG
acatagaataatttcttggc

SEQ ID NO: 150599 - DNA, 20 bp, Artificial Sequence
  Description of Artificial Sequence: Synthetic oligonucleotide
  Target: ATXN1; (+) strand; PAM type: NRG; PAM sequence: GGG
catagaataatttcttggcc

SEQ ID NO: 150600 - DNA, 20 bp, Artificial Sequence
  Description of Artificial Sequence: Synthetic oligonucleotide
  Target: ATXN1; (+) strand; PAM type: NRG; PAM sequence: CGG
aataatttcttggccgggcc

SEQ ID NO: 150601 - DNA, 20 bp, Artificial Sequence
  Description of Artificial Sequence: Synthetic oligonucleotide
  Target: ATXN1; (+) strand; PAM type: NRG; PAM sequence: TAG
aatttcttggccgggcccgg

SEQ ID NO: 150602 - DNA, 20 bp, Artificial Sequence
  Description of Artificial Sequence: Synthetic oligonucleotide
  Target: ATXN1; (+) strand; PAM type: NRG; PAM sequence: TAG
ggcccggtagctcacaccta

SEQ ID NO: 150603 - DNA, 20 bp, Artificial Sequence
  Description of Artificial Sequence: Synthetic oligonucleotide
  Target: ATXN1; (+) strand; PAM type: NRG; PAM sequence: CAG
gtagctcacacctatagtcc

SEQ ID NO: 150604 - DNA, 20 bp, Artificial Sequence
  Description of Artificial Sequence: Synthetic oligonucleotide
  Target: ATXN1; (+) strand; PAM type: NRG; PAM sequence: TGG
cacctatagtcccagcactt

SEQ ID NO: 150605 - DNA, 20 bp, Artificial Sequence
  Description of Artificial Sequence: Synthetic oligonucleotide
  Target: ATXN1; (+) strand; PAM type: NRG; PAM sequence: GGG
acctatagtcccagcacttt

SEQ ID NO: 150606 - DNA, 20 bp, Artificial Sequence
  Description of Artificial Sequence: Synthetic oligonucleotide
  Target: ATXN1; (+) strand; PAM type: NRG; PAM sequence: GAG
ctatagtcccagcactttgg

SEQ ID NO: 150607 - DNA, 20 bp, Artificial Sequence
  Description of Artificial Sequence: Synthetic oligonucleotide
  Target: ATXN1; (+) strand; PAM type: NRG; PAM sequence: AGG
tatagtcccagcactttggg

SEQ ID NO: 150608 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 150609 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 150610 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggccgagg

SEQ ID NO: 150611 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccgaggc

SEQ ID NO: 150612 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccgaggcggg

SEQ ID NO: 150613 - DNA, 20 bp, Artificial Sequence
  Description of Artificial Sequence: Synthetic oligonucleotide
  Target: ATXN1; (+) strand; PAM type: NRG; PAM sequence: GAG
ccgaggcgggtggatcactt

SEQ ID NO: 150614 - DNA, 20 bp, Artificial Sequence
  Description of Artificial Sequence: Synthetic oligonucleotide
  Target: ATXN1; (+) strand; PAM type: NRG; PAM sequence: AGG
cgaggcgggtggatcacttg

SEQ ID NO: 150615 - DNA, 20 bp, Artificial Sequence
  Description of Artificial Sequence: Synthetic oligonucleotide
  Target: ATXN1; (+) strand; PAM type: NRG; PAM sequence: CAG
gcgggtggatcacttgaggt

SEQ ID NO: 150616 - DNA, 20 bp, Artificial Sequence
  Description of Artificial Sequence: Synthetic oligonucleotide
  Target: ATXN1; (+) strand; PAM type: NRG; PAM sequence: AGG
cgggtggatcacttgaggtc

SEQ ID NO: 150617 - DNA, 20 bp, Artificial Sequence
  Description of Artificial Sequence: Synthetic oligonucleotide
  Target: ATXN1; (+) strand; PAM type: NRG; PAM sequence: GAG
ggtggatcacttgaggtcag

SEQ ID NO: 150618 - DNA, 20 bp, Artificial Sequence
  Description of Artificial Sequence: Synthetic oligonucleotide
  Target: ATXN1; (+) strand; PAM type: NRG; PAM sequence: AAG
tcacttgaggtcaggagttc

SEQ ID NO: 150619 - DNA, 20 bp, Artificial Sequence
  Description of Artificial Sequence: Synthetic oligonucleotide
  Target: ATXN1; (+) strand; PAM type: NRG; PAM sequence: TAG
tgaggtcaggagttcaagac

SEQ ID NO: 150620 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcaagactagcc

SEQ ID NO: 150621 - DNA, 20 bp, Artificial Sequence
  Description of Artificial Sequence: Synthetic oligonucleotide
  Target: ATXN1; (+) strand; PAM type: NRG; PAM sequence: CGG
caagactagcctggccaaca

SEQ ID NO: 150622 - DNA, 20 bp, Artificial Sequence
  Description of Artificial Sequence: Synthetic oligonucleotide
  Target: ATXN1; (+) strand; PAM type: NRG; PAM sequence: AAG
gaaactccatctctactaaa

SEQ ID NO: 150623 - DNA, 20 bp, Artificial Sequence
  Description of Artificial Sequence: Synthetic oligonucleotide
  Target: ATXN1; (+) strand; PAM type: NRG; PAM sequence: CAG
tctactaaaaagacaaaaaa

SEQ ID NO: 150624 - DNA, 20 bp, Artificial Sequence
  Description of Artificial Sequence: Synthetic oligonucleotide
  Target: ATXN1; (+) strand; PAM type: NRG; PAM sequence: TGG
ctaaaaagacaaaaaacagc

SEQ ID NO: 150625 - DNA, 20 bp, Artificial Sequence
  Description of Artificial Sequence: Synthetic oligonucleotide
  Target: ATXN1; (+) strand; PAM type: NRG; PAM sequence: GGG
taaaaagacaaaaaacagct

SEQ ID NO: 150626 - DNA, 20 bp, Artificial Sequence
  Description of Artificial Sequence: Synthetic oligonucleotide
  Target: ATXN1; (+) strand; PAM type: NRG; PAM sequence: CAG
cagctgggtgcctgtaatcc

SEQ ID NO: 150627 - DNA, 20 bp, Artificial Sequence
  Description of Artificial Sequence: Synthetic oligonucleotide
  Target: ATXN1; (+) strand; PAM type: NRG; PAM sequence: CAG
gtaatcccagctactctact

SEQ ID NO: 150628 - DNA, 20 bp, Artificial Sequence
  Description of Artificial Sequence: Synthetic oligonucleotide
  Target: ATXN1; (+) strand; PAM type: NRG; PAM sequence: AGG
taatcccagctactctactc

SEQ ID NO: 150629 - DNA, 20 bp, Artificial Sequence
  Description of Artificial Sequence: Synthetic oligonucleotide
  Target: ATXN1; (+) strand; PAM type: NRG; PAM sequence: GAG
atcccagctactctactcag

SEQ ID NO: 150630 - DNA, 20 bp, Artificial Sequence
  Description of Artificial Sequence: Synthetic oligonucleotide
  Target: ATXN1; (+) strand; PAM type: NRG; PAM sequence: AGG
tcccagctactctactcagg

SEQ ID NO: 150631 - DNA, 20 bp, Artificial Sequence
  Description of Artificial Sequence: Synthetic oligonucleotide
  Target: ATXN1; (+) strand; PAM type: NRG; PAM sequence: GAG
gctactctactcaggaggct

SEQ ID NO: 150632 - DNA, 20 bp, Artificial Sequence
  Description of Artificial Sequence: Synthetic oligonucleotide
  Target: ATXN1; (+) strand; PAM type: NRG; PAM sequence: AGG
ctactctactcaggaggctg

SEQ ID NO: 150633 - DNA, 20 bp, Artificial Sequence
  Description of Artificial Sequence: Synthetic oligonucleotide
  Target: ATXN1; (+) strand; PAM type: NRG; PAM sequence: CAG
ctctactcaggaggctgagg

SEQ ID NO: 150634 - DNA, 20 bp, Artificial Sequence
  Description of Artificial Sequence: Synthetic oligonucleotide
  Target: ATXN1; (+) strand; PAM type: NRG; PAM sequence: AAG
tactcaggaggctgaggcag

SEQ ID NO: 150635 - DNA, 20 bp, Artificial Sequence
  Description of Artificial Sequence: Synthetic oligonucleotide
  Target: ATXN1; (+) strand; PAM type: NRG; PAM sequence: AAG
tgaggcagaagaatcgcttg

SEQ ID NO: 150636 - DNA, 20 bp, Artificial Sequence
  Description of Artificial Sequence: Synthetic oligonucleotide
  Target: ATXN1; (+) strand; PAM type: NRG; PAM sequence: CGG
gcagaagaatcgcttgaagc

SEQ ID NO: 150637 - DNA, 20 bp, Artificial Sequence
  Description of Artificial Sequence: Synthetic oligonucleotide
  Target: ATXN1; (+) strand; PAM type: NRG; PAM sequence: GGG
cagaagaatcgcttgaagcc

SEQ ID NO: 150638 - DNA, 20 bp, Artificial Sequence
  Description of Artificial Sequence: Synthetic oligonucleotide
  Target: ATXN1; (+) strand; PAM type: NRG; PAM sequence: GAG
gaagaatcgcttgaagccgg

SEQ ID NO: 150639 - DNA, 20 bp, Artificial Sequence
  Description of Artificial Sequence: Synthetic oligonucleotide
  Target: ATXN1; (+) strand; PAM type: NRG; PAM sequence: AGG
aagaatcgcttgaagccggg

SEQ ID NO: 150640 - DNA, 20 bp, Artificial Sequence
  Description of Artificial Sequence: Synthetic oligonucleotide
  Target: ATXN1; (+) strand; PAM type: NRG; PAM sequence: TGG
aatcgcttgaagccgggagg

SEQ ID NO: 150641 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaagccgggaggtg

SEQ ID NO: 150642 - DNA, 20 bp, Artificial Sequence
  Description of Artificial Sequence: Synthetic oligonucleotide
  Target: ATXN1; (+) strand; PAM type: NRG; PAM sequence: AGG
cgcttgaagccgggaggtgg

SEQ ID NO: 150643 - DNA, 20 bp, Artificial Sequence
  Description of Artificial Sequence: Synthetic oligonucleotide
  Target: ATXN1; (+) strand; PAM type: NRG; PAM sequence: CAG
aagccgggaggtggaggttg

SEQ ID NO: 150644 - DNA, 20 bp, Artificial Sequence
  Description of Artificial Sequence: Synthetic oligonucleotide
  Target: ATXN1; (+) strand; PAM type: NRG; PAM sequence: GAG
cgggaggtggaggttgcagt

SEQ ID NO: 150645 - DNA, 20 bp, Artificial Sequence
  Description of Artificial Sequence: Synthetic oligonucleotide
  Target: ATXN1; (+) strand; PAM type: NRG; PAM sequence: AAG
ggtggaggttgcagtgagcc

SEQ ID NO: 150646 - DNA, 20 bp, Artificial Sequence
  Description of Artificial Sequence: Synthetic oligonucleotide
  Target: ATXN1; (+) strand; PAM type: NRG; PAM sequence: CAG
aagatcatgccattgcactc

SEQ ID NO: 150647 - DNA, 20 bp, Artificial Sequence
  Description of Artificial Sequence: Synthetic oligonucleotide
  Target: ATXN1; (+) strand; PAM type: NRG; PAM sequence: TGG
catgccattgcactccagcc

SEQ ID NO: 150648 - DNA, 20 bp, Artificial Sequence
  Description of Artificial Sequence: Synthetic oligonucleotide
  Target: ATXN1; (+) strand; PAM type: NRG; PAM sequence: GGG
atgccattgcactccagcct

SEQ ID NO: 150649 - DNA, 20 bp, Artificial Sequence
  Description of Artificial Sequence: Synthetic oligonucleotide
  Target: ATXN1; (+) strand; PAM type: NRG; PAM sequence: AAG
tgcactccagcctgggcgac

SEQ ID NO: 150650 - DNA, 20 bp, Artificial Sequence
  Description of Artificial Sequence: Synthetic oligonucleotide
  Target: ATXN1; (+) strand; PAM type: NRG; PAM sequence: GAG
cactccagcctgggcgacaa

SEQ ID NO: 150651 - DNA, 20 bp, Artificial Sequence
  Description of Artificial Sequence: Synthetic oligonucleotide
  Target: ATXN1; (+) strand; PAM type: NRG; PAM sequence: AAG
cttcatctcaaaaaaaaaca

SEQ ID NO: 150652 - DNA, 20 bp, Artificial Sequence
  Description of Artificial Sequence: Synthetic oligonucleotide
  Target: ATXN1; (+) strand; PAM type: NRG; PAM sequence: CAG
aacaaagaataatttcttaa

SEQ ID NO: 150653 - DNA, 20 bp, Artificial Sequence
  Description of Artificial Sequence: Synthetic oligonucleotide
  Target: ATXN1; (+) strand; PAM type: NRG; PAM sequence: AGG
acaaagaataatttcttaac

SEQ ID NO: 150654 - DNA, 20 bp, Artificial Sequence
  Description of Artificial Sequence: Synthetic oligonucleotide
  Target: ATXN1; (+) strand; PAM type: NRG; PAM sequence: GGG
caaagaataatttcttaaca

SEQ ID NO: 150655 - DNA, 20 bp, Artificial Sequence
  Description of Artificial Sequence: Synthetic oligonucleotide
  Target: ATXN1; (+) strand; PAM type: NRG; PAM sequence: CAG
ttcttaacagggtcctactt

SEQ ID NO: 150656 - DNA, 20 bp, Artificial Sequence
  Description of Artificial Sequence: Synthetic oligonucleotide
  Target: ATXN1; (+) strand; PAM type: NRG; PAM sequence: TGG
taacagggtcctacttcaga

SEQ ID NO: 150657 - DNA, 20 bp, Artificial Sequence
  Description of Artificial Sequence: Synthetic oligonucleotide
  Target: ATXN1; (+) strand; PAM type: NRG; PAM sequence: AAG
ctacttcagatggattgctc

SEQ ID NO: 150658 - DNA, 20 bp, Artificial Sequence
  Description of Artificial Sequence: Synthetic oligonucleotide
  Target: ATXN1; (+) strand; PAM type: NRG; PAM sequence: GAG
acttcagatggattgctcaa

SEQ ID NO: 150659 - DNA, 20 bp, Artificial Sequence
  Description of Artificial Sequence: Synthetic oligonucleotide
  Target: ATXN1; (+) strand; PAM type: NRG; PAM sequence: CAG
agatggattgctcaagagtt

SEQ ID NO: 150660 - DNA, 20 bp, Artificial Sequence
  Description of Artificial Sequence: Synthetic oligonucleotide
  Target: ATXN1; (+) strand; PAM type: NRG; PAM sequence: AGG
gatggattgctcaagagttc

SEQ ID NO: 150661 - DNA, 20 bp, Artificial Sequence
  Description of Artificial Sequence: Synthetic oligonucleotide
  Target: ATXN1; (+) strand; PAM type: NRG; PAM sequence: TGG
gctcaagagttcaggccata

SEQ ID NO: 150662 - DNA, 20 bp, Artificial Sequence
  Description of Artificial Sequence: Synthetic oligonucleotide
  Target: ATXN1; (+) strand; PAM type: NRG; PAM sequence: GAG
tcaagagttcaggccatatg

SEQ ID NO: 150663 - DNA, 20 bp, Artificial Sequence
  Description of Artificial Sequence: Synthetic oligonucleotide
  Target: ATXN1; (+) strand; PAM type: NRG; PAM sequence: TAG
caggccatatggagtacaat

SEQ ID NO: 150664 - DNA, 20 bp, Artificial Sequence
  Description of Artificial Sequence: Synthetic oligonucleotide
  Target: ATXN1; (+) strand; PAM type: NRG; PAM sequence: TGG
acactgaacatactactttc

SEQ ID NO: 150665 - DNA, 20 bp, Artificial Sequence
  Description of Artificial Sequence: Synthetic oligonucleotide
  Target: ATXN1; (+) strand; PAM type: NRG; PAM sequence: TGG
aacatactactttctggatc

SEQ ID NO: 150666 - DNA, 20 bp, Artificial Sequence
  Description of Artificial Sequence: Synthetic oligonucleotide
  Target: ATXN1; (+) strand; PAM type: NRG; PAM sequence: GGG
acatactactttctggatct

SEQ ID NO: 150667 - DNA, 20 bp, Artificial Sequence
  Description of Artificial Sequence: Synthetic oligonucleotide
  Target: ATXN1; (+) strand; PAM type: NRG; PAM sequence: CAG
actactttctggatctgggc

SEQ ID NO: 150668 - DNA, 20 bp, Artificial Sequence
  Description of Artificial Sequence: Synthetic oligonucleotide
  Target: ATXN1; (+) strand; PAM type: NRG; PAM sequence: AAG
cagtatgacaaatattacaa

SEQ ID NO: 150669 - DNA, 20 bp, Artificial Sequence
  Description of Artificial Sequence: Synthetic oligonucleotide
  Target: ATXN1; (+) strand; PAM type: NRG; PAM sequence: CAG
attacaaaagctattttttc

SEQ ID NO: 150670 - DNA, 20 bp, Artificial Sequence
  Description of Artificial Sequence: Synthetic oligonucleotide
  Target: ATXN1; (+) strand; PAM type: NRG; PAM sequence: AAG
caaaagctattttttccaga

SEQ ID NO: 150671 - DNA, 20 bp, Artificial Sequence
  Description of Artificial Sequence: Synthetic oligonucleotide
  Target: ATXN1; (+) strand; PAM type: NRG; PAM sequence: CAG
ttttttccagaaagtcatca

SEQ ID NO: 150672 - DNA, 20 bp, Artificial Sequence
  Description of Artificial Sequence: Synthetic oligonucleotide
  Target: ATXN1; (+) strand; PAM type: NRG; PAM sequence: CAG
aaagtcatcacagtttgaaa

SEQ ID NO: 150673 - DNA, 20 bp, Artificial Sequence
  Description of Artificial Sequence: Synthetic oligonucleotide
  Target: ATXN1; (+) strand; PAM type: NRG; PAM sequence: CAG
tcatcacagtttgaaacaga

SEQ ID NO: 150674 - DNA, 20 bp, Artificial Sequence
  Description of Artificial Sequence: Synthetic oligonucleotide
  Target: ATXN1; (+) strand; PAM type: NRG; PAM sequence: AAG
gacagtgacttattacccta

SEQ ID NO: 150675 - DNA, 20 bp, Artificial Sequence
  Description of Artificial Sequence: Synthetic oligonucleotide
  Target: ATXN1; (+) strand; PAM type: NRG; PAM sequence: AAG
ctaaagccttttcaattatg

SEQ ID NO: 150676 - DNA, 20 bp, Artificial Sequence
  Description of Artificial Sequence: Synthetic oligonucleotide
  Target: ATXN1; (+) strand; PAM type: NRG; PAM sequence: TGG
caattatgaagtgcctgctc

SEQ ID NO: 150677 - DNA, 20 bp, Artificial Sequence
  Description of Artificial Sequence: Synthetic oligonucleotide
  Target: ATXN1; (+) strand; PAM type: NRG; PAM sequence: AAG
ctggtgttactacatataca

SEQ ID NO: 150678 - DNA, 20 bp, Artificial Sequence
  Description of Artificial Sequence: Synthetic oligonucleotide
  Target: ATXN1; (+) strand; PAM type: NRG; PAM sequence: AGG
tggtgttactacatatacaa

SEQ ID NO: 150679 - DNA, 20 bp, Artificial Sequence
  Description of Artificial Sequence: Synthetic oligonucleotide
  Target: ATXN1; (+) strand; PAM type: NRG; PAM sequence: TGG
tgttactacatatacaaagg

SEQ ID NO: 150680 - DNA, 20 bp, Artificial Sequence
  Description of Artificial Sequence: Synthetic oligonucleotide
  Target: ATXN1; (+) strand; PAM type: NRG; PAM sequence: AAG
aggtggttacaaacataaat

SEQ ID NO: 150681 - DNA, 20 bp, Artificial Sequence
  Description of Artificial Sequence: Synthetic oligonucleotide
  Target: ATXN1; (+) strand; PAM type: NRG; PAM sequence: AAG
acaaacataaataagtaacc

SEQ ID NO: 150682 - DNA, 20 bp, Artificial Sequence
  Description of Artificial Sequence: Synthetic oligonucleotide
  Target: ATXN1; (+) strand; PAM type: NRG; PAM sequence: TAG
tgttttctctttctctcctc

SEQ ID NO: 150683 - DNA, 20 bp, Artificial Sequence
  Description of Artificial Sequence: Synthetic oligonucleotide
  Target: ATXN1; (+) strand; PAM type: NRG; PAM sequence: AAG
tctagtaaattatgttaatt

SEQ ID NO: 150684 - DNA, 20 bp, Artificial Sequence
  Description of Artificial Sequence: Synthetic oligonucleotide
  Target: ATXN1; (+) strand; PAM type: NRG; PAM sequence: AAG
ttatgttaattaagcaaatt

SEQ ID NO: 150685 - DNA, 20 bp, Artificial Sequence
  Description of Artificial Sequence: Synthetic oligonucleotide
  Target: ATXN1; (+) strand; PAM type: NRG; PAM sequence: AAG
taagcaaattaagatgatta

SEQ ID NO: 150686 - DNA, 20 bp, Artificial Sequence
  Description of Artificial Sequence: Synthetic oligonucleotide
  Target: ATXN1; (+) strand; PAM type: NRG; PAM sequence: AAG
cataattgtttacaattttc

SEQ ID NO: 150687 - DNA, 20 bp, Artificial Sequence
  Description of Artificial Sequence: Synthetic oligonucleotide
  Target: ATXN1; (+) strand; PAM type: NRG; PAM sequence: CAG
tgtttacaattttcaagtat

SEQ ID NO: 150688 - DNA, 20 bp, Artificial Sequence
  Description of Artificial Sequence: Synthetic oligonucleotide
  Target: ATXN1; (+) strand; PAM type: NRG; PAM sequence: AAG
caagtatcagtaaaaccaca

SEQ ID NO: 150689 - DNA, 20 bp, Artificial Sequence
  Description of Artificial Sequence: Synthetic oligonucleotide
  Target: ATXN1; (+) strand; PAM type: NRG; PAM sequence: TAG
cagtaaaaccacaaagcaaa

SEQ ID NO: 150690 - DNA, 20 bp, Artificial Sequence
  Description of Artificial Sequence: Synthetic oligonucleotide
  Target: ATXN1; (+) strand; PAM type: NRG; PAM sequence: AAG
atgtattaaatataataaaa

SEQ ID NO: 150691 - DNA, 20 bp, Artificial Sequence
  Description of Artificial Sequence: Synthetic oligonucleotide
  Target: ATXN1; (+) strand; PAM type: NRG; PAM sequence: TGG
aataaaaaagcaattaattt

SEQ ID NO: 150692 - DNA, 20 bp, Artificial Sequence
  Description of Artificial Sequence: Synthetic oligonucleotide
  Target: ATXN1; (+) strand; PAM type: NRG; PAM sequence: TAG
aattttggatccatatatac

SEQ ID NO: 150693 - DNA, 20 bp, Artificial Sequence
  Description of Artificial Sequence: Synthetic oligonucleotide
  Target: ATXN1; (+) strand; PAM type: NRG; PAM sequence: TAG
tttggatccatatatactag

SEQ ID NO: 150694 - DNA, 20 bp, Artificial Sequence
  Description of Artificial Sequence: Synthetic oligonucleotide
  Target: ATXN1; (+) strand; PAM type: NRG; PAM sequence: AGG
ttggatccatatatactagt

SEQ ID NO: 150695 - DNA, 20 bp, Artificial Sequence
  Description of Artificial Sequence: Synthetic oligonucleotide
  Target: ATXN1; (+) strand; PAM type: NRG; PAM sequence: AAG
atccatatatactagtaggt

SEQ ID NO: 150696 - DNA, 20 bp, Artificial Sequence
  Description of Artificial Sequence: Synthetic oligonucleotide
  Target: ATXN1; (+) strand; PAM type: NRG; PAM sequence: GAG
ccatatatactagtaggtaa

SEQ ID NO: 150697 - DNA, 20 bp, Artificial Sequence
  Description of Artificial Sequence: Synthetic oligonucleotide
  Target: ATXN1; (+) strand; PAM type: NRG; PAM sequence: TGG
ctagtaggtaagagaaaaaa

SEQ ID NO: 150698 - DNA, 20 bp, Artificial Sequence
  Description of Artificial Sequence: Synthetic oligonucleotide
  Target: ATXN1; (+) strand; PAM type: NRG; PAM sequence: AAG
aatggaaataaataattcca

SEQ ID NO: 150699 - DNA, 20 bp, Artificial Sequence
  Description of Artificial Sequence: Synthetic oligonucleotide
  Target: ATXN1; (+) strand; PAM type: NRG; PAM sequence: GAG
gaaataaataattccaaagt

SEQ ID NO: 150700 - DNA, 20 bp, Artificial Sequence
  Description of Artificial Sequence: Synthetic oligonucleotide
  Target: ATXN1; (+) strand; PAM type: NRG; PAM sequence: AGG
aaataaataattccaaagtg

SEQ ID NO: 150701 - DNA, 20 bp, Artificial Sequence
  Description of Artificial Sequence: Synthetic oligonucleotide
  Target: ATXN1; (+) strand; PAM type: NRG; PAM sequence: AAG
aattattgtaacacacaaaa

SEQ ID NO: 150702 - DNA, 20 bp, Artificial Sequence
  Description of Artificial Sequence: Synthetic oligonucleotide
  Target: ATXN1; (+) strand; PAM type: NRG; PAM sequence: CAG
caaaaaagttactacatact

SEQ ID NO: 150703 - DNA, 20 bp, Artificial Sequence
  Description of Artificial Sequence: Synthetic oligonucleotide
  Target: ATXN1; (+) strand; PAM type: NRG; PAM sequence: TGG
gttactacatactcagtaac

SEQ ID NO: 150704 - DNA, 20 bp, Artificial Sequence
  Description of Artificial Sequence: Synthetic oligonucleotide
  Target: ATXN1; (+) strand; PAM type: NRG; PAM sequence: GGG
ttactacatactcagtaact

SEQ ID NO: 150705 - DNA, 20 bp, Artificial Sequence
  Description of Artificial Sequence: Synthetic oligonucleotide
  Target: ATXN1; (+) strand; PAM type: NRG; PAM sequence: CAG
acatactcagtaactgggct

SEQ ID NO: 150706 - DNA, 20 bp, Artificial Sequence
  Description of Artificial Sequence: Synthetic oligonucleotide
  Target: ATXN1; (+) strand; PAM type: NRG; PAM sequence: GAG
atactcagtaactgggctca

SEQ ID NO: 150707 - DNA, 20 bp, Artificial Sequence
  Description of Artificial Sequence: Synthetic oligonucleotide
  Target: ATXN1; (+) strand; PAM type: NRG; PAM sequence: AAG
ctcagtaactgggctcagag

SEQ ID NO: 150708 - DNA, 20 bp, Artificial Sequence
  Description of Artificial Sequence: Synthetic oligonucleotide
  Target: ATXN1; (+) strand; PAM type: NRG; PAM sequence: AAG
agaagacatctaatatgaat

SEQ ID NO: 150709 - DNA, 20 bp, Artificial Sequence
  Description of Artificial Sequence: Synthetic oligonucleotide
  Target: ATXN1; (+) strand; PAM type: NRG; PAM sequence: AAG
tctaatatgaataagaaaac

SEQ ID NO: 150710 - DNA, 20 bp, Artificial Sequence
  Description of Artificial Sequence: Synthetic oligonucleotide
  Target: ATXN1; (+) strand; PAM type: NRG; PAM sequence: AAG
agtccaaattacaatgtttc

SEQ ID NO: 150711 - DNA, 20 bp, Artificial Sequence
  Description of Artificial Sequence: Synthetic oligonucleotide
  Target: ATXN1; (+) strand; PAM type: NRG; PAM sequence: AAG
ccaaattacaatgtttcaag

SEQ ID NO: 150712 - DNA, 20 bp, Artificial Sequence
  Description of Artificial Sequence: Synthetic oligonucleotide
  Target: ATXN1; (+) strand; PAM type: NRG; PAM sequence: TAG
caatgtttcaagaagaaata

SEQ ID NO: 150713 - DNA, 20 bp, Artificial Sequence
  Description of Artificial Sequence: Synthetic oligonucleotide
  Target: ATXN1; (+) strand; PAM type: NRG; PAM sequence: AAG
aatatagttttaactctctt

SEQ ID NO: 150714 - DNA, 20 bp, Artificial Sequence
  Description of Artificial Sequence: Synthetic oligonucleotide
  Target: ATXN1; (+) strand; PAM type: NRG; PAM sequence: TAG
tcatcaaattacttaatgaa

SEQ ID NO: 150715 - DNA, 20 bp, Artificial Sequence
  Description of Artificial Sequence: Synthetic oligonucleotide
  Target: ATXN1; (+) strand; PAM type: NRG; PAM sequence: AAG
aattacttaatgaatagact

SEQ ID NO: 150716 - DNA, 20 bp, Artificial Sequence
  Description of Artificial Sequence: Synthetic oligonucleotide
  Target: ATXN1; (+) strand; PAM type: NRG; PAM sequence: GAG
ttacttaatgaatagactaa

SEQ ID NO: 150717 - DNA, 20 bp, Artificial Sequence
  Description of Artificial Sequence: Synthetic oligonucleotide
  Target: ATXN1; (+) strand; PAM type: NRG; PAM sequence: GAG
acttaatgaatagactaaga

SEQ ID NO: 150718 - DNA, 20 bp, Artificial Sequence
  Description of Artificial Sequence: Synthetic oligonucleotide
  Target: ATXN1; (+) strand; PAM type: NRG; PAM sequence: CAG
aatcatataatgcatgcaaa

SEQ ID NO: 150719 - DNA, 20 bp, Artificial Sequence
  Description of Artificial Sequence: Synthetic oligonucleotide
  Target: ATXN1; (+) strand; PAM type: NRG; PAM sequence: AGG
atcatataatgcatgcaaac

SEQ ID NO: 150720 - DNA, 20 bp, Artificial Sequence
  Description of Artificial Sequence: Synthetic oligonucleotide
  Target: ATXN1; (+) strand; PAM type: NRG; PAM sequence: AAG
catgcaaacaggaacttcca

SEQ ID NO: 150721 - DNA, 20 bp, Artificial Sequence
  Description of Artificial Sequence: Synthetic oligonucleotide
  Target: ATXN1; (+) strand; PAM type: NRG; PAM sequence: TAG
tttcctttattactgactct

SEQ ID NO: 150722 - DNA, 20 bp, Artificial Sequence
  Description of Artificial Sequence: Synthetic oligonucleotide
  Target: ATXN1; (+) strand; PAM type: NRG; PAM sequence: TAG
tactgactcttagctgttat

SEQ ID NO: 150723 - DNA, 20 bp, Artificial Sequence
  Description of Artificial Sequence: Synthetic oligonucleotide
  Target: ATXN1; (+) strand; PAM type: NRG; PAM sequence: TAG
acattatttatattatttgt

SEQ ID NO: 150724 - DNA, 20 bp, Artificial Sequence
  Description of Artificial Sequence: Synthetic oligonucleotide
  Target: ATXN1; (+) strand; PAM type: NRG; PAM sequence: TAG
cataaaaaatcttttcttct

SEQ ID NO: 150725 - DNA, 20 bp, Artificial Sequence
  Description of Artificial Sequence: Synthetic oligonucleotide
  Target: ATXN1; (+) strand; PAM type: NRG; PAM sequence: CGG
attcaatgtgtccacaaatt

SEQ ID NO: 150726 - DNA, 20 bp, Artificial Sequence
  Description of Artificial Sequence: Synthetic oligonucleotide
  Target: ATXN1; (+) strand; PAM type: NRG; PAM sequence: AAG
acaaaatttctgtctactga

SEQ ID NO: 150727 - DNA, 20 bp, Artificial Sequence
  Description of Artificial Sequence: Synthetic oligonucleotide
  Target: ATXN1; (+) strand; PAM type: NRG; PAM sequence: CAG
tactgaaagtgaaaattcgt

SEQ ID NO: 150728 - DNA, 20 bp, Artificial Sequence
  Description of Artificial Sequence: Synthetic oligonucleotide
  Target: ATXN1; (+) strand; PAM type: NRG; PAM sequence: GAG
ctgaaagtgaaaattcgtca

SEQ ID NO: 150729 - DNA, 20 bp, Artificial Sequence
  Description of Artificial Sequence: Synthetic oligonucleotide
  Target: ATXN1; (+) strand; PAM type: NRG; PAM sequence: AAG
gaccgtttcctccatttacc

SEQ ID NO: 150730 - DNA, 20 bp, Artificial Sequence
  Description of Artificial Sequence: Synthetic oligonucleotide
  Target: ATXN1; (+) strand; PAM type: NRG; PAM sequence: GAG
tttcctccatttaccaagcc

SEQ ID NO: 150731 - DNA, 20 bp, Artificial Sequence
  Description of Artificial Sequence: Synthetic oligonucleotide
  Target: ATXN1; (+) strand; PAM type: NRG; PAM sequence: CAG
catttaccaagccgagatgc

SEQ ID NO: 150732 - DNA, 20 bp, Artificial Sequence
  Description of Artificial Sequence: Synthetic oligonucleotide
  Target: ATXN1; (+) strand; PAM type: NRG; PAM sequence: TGG
ttaccaagccgagatgccag

SEQ ID NO: 150733 - DNA, 20 bp, Artificial Sequence
  Description of Artificial Sequence: Synthetic oligonucleotide
  Target: ATXN1; (+) strand; PAM type: NRG; PAM sequence: GGG
taccaagccgagatgccagt

SEQ ID NO: 150734 - DNA, 20 bp, Artificial Sequence
  Description of Artificial Sequence: Synthetic oligonucleotide
  Target: ATXN1; (+) strand; PAM type: NRG; PAM sequence: AAG
agtgggcacaaaaataattt

SEQ ID NO: 150735 - DNA, 20 bp, Artificial Sequence
  Description of Artificial Sequence: Synthetic oligonucleotide
  Target: ATXN1; (+) strand; PAM type: NRG; PAM sequence: GAG
aagccacaactgaccaactt

SEQ ID NO: 150736 - DNA, 20 bp, Artificial Sequence
  Description of Artificial Sequence: Synthetic oligonucleotide
  Target: ATXN1; (+) strand; PAM type: NRG; PAM sequence: CGG
tgcacatttgttcattcatt

SEQ ID NO: 150737 - DNA, 20 bp, Artificial Sequence
  Description of Artificial Sequence: Synthetic oligonucleotide
  Target: ATXN1; (+) strand; PAM type: NRG; PAM sequence: GGG
gcacatttgttcattcattc

SEQ ID NO: 150738 - DNA, 20 bp, Artificial Sequence
  Description of Artificial Sequence: Synthetic oligonucleotide
  Target: ATXN1; (+) strand; PAM type: NRG; PAM sequence: TGG
caccatctactactctaaaa

SEQ ID NO: 150739 - DNA, 20 bp, Artificial Sequence
  Description of Artificial Sequence: Synthetic oligonucleotide
  Target: ATXN1; (+) strand; PAM type: NRG; PAM sequence: GGG
accatctactactctaaaat

SEQ ID NO: 150740 - DNA, 20 bp, Artificial Sequence
  Description of Artificial Sequence: Synthetic oligonucleotide
  Target: ATXN1; (+) strand; PAM type: NRG; PAM sequence: GGG
ccatctactactctaaaatg

SEQ ID NO: 150741 - DNA, 20 bp, Artificial Sequence
  Description of Artificial Sequence: Synthetic oligonucleotide
  Target: ATXN1; (+) strand; PAM type: NRG; PAM sequence: AAG
tctactactctaaaatgggg

SEQ ID NO: 150742 - DNA, 20 bp, Artificial Sequence
  Description of Artificial Sequence: Synthetic oligonucleotide
  Target: ATXN1; (+) strand; PAM type: NRG; PAM sequence: AAG
ctctaaaatggggaagctgc

SEQ ID NO: 150743 - DNA, 20 bp, Artificial Sequence
  Description of Artificial Sequence: Synthetic oligonucleotide
  Target: ATXN1; (+) strand; PAM type: NRG; PAM sequence: AGG
tctaaaatggggaagctgca

SEQ ID NO: 150744 - DNA, 20 bp, Artificial Sequence
  Description of Artificial Sequence: Synthetic oligonucleotide
  Target: ATXN1; (+) strand; PAM type: NRG; PAM sequence: GGG
ctaaaatggggaagctgcaa

SEQ ID NO: 150745 - DNA, 20 bp, Artificial Sequence
  Description of Artificial Sequence: Synthetic oligonucleotide
  Target: ATXN1; (+) strand; PAM type: NRG; PAM sequence: CAG
aaatggggaagctgcaaggg

SEQ ID NO: 150746 - DNA, 20 bp, Artificial Sequence
  Description of Artificial Sequence: Synthetic oligonucleotide
  Target: ATXN1; (+) strand; PAM type: NRG; PAM sequence: TAG
ggaagctgcaagggcagctg

SEQ ID NO: 150747 - DNA, 20 bp, Artificial Sequence
  Description of Artificial Sequence: Synthetic oligonucleotide
  Target: ATXN1; (+) strand; PAM type: NRG; PAM sequence: GAG
aagctgcaagggcagctgta

SEQ ID NO: 150748 - DNA, 20 bp, Artificial Sequence
  Description of Artificial Sequence: Synthetic oligonucleotide
  Target: ATXN1; (+) strand; PAM type: NRG; PAM sequence: AGG
agctgcaagggcagctgtag

SEQ ID NO: 150749 - DNA, 20 bp, Artificial Sequence
  Description of Artificial Sequence: Synthetic oligonucleotide
  Target: ATXN1; (+) strand; PAM type: NRG; PAM sequence: TGG
gggcagctgtagaggtcact

SEQ ID NO: 150750 - DNA, 20 bp, Artificial Sequence
  Description of Artificial Sequence: Synthetic oligonucleotide
  Target: ATXN1; (+) strand; PAM type: NRG; PAM sequence: TAG
gctgtagaggtcacttggtc

SEQ ID NO: 150751 - DNA, 20 bp, Artificial Sequence
  Description of Artificial Sequence: Synthetic oligonucleotide
  Target: ATXN1; (+) strand; PAM type: NRG; PAM sequence: GAG
tctagaccctcattttgcat

SEQ ID NO: 150752 - DNA, 20 bp, Artificial Sequence
  Description of Artificial Sequence: Synthetic oligonucleotide
  Target: ATXN1; (+) strand; PAM type: NRG; PAM sequence: AGG
ctagaccctcattttgcatg

SEQ ID NO: 150753 - DNA, 20 bp, Artificial Sequence
  Description of Artificial Sequence: Synthetic oligonucleotide
  Target: ATXN1; (+) strand; PAM type: NRG; PAM sequence: GAG
agaccctcattttgcatgag

SEQ ID NO: 150754 - DNA, 20 bp, Artificial Sequence
  Description of Artificial Sequence: Synthetic oligonucleotide
  Target: ATXN1; (+) strand; PAM type: NRG; PAM sequence: AGG
gaccctcattttgcatgagg

SEQ ID NO: 150755 - DNA, 20 bp, Artificial Sequence
  Description of Artificial Sequence: Synthetic oligonucleotide
  Target: ATXN1; (+) strand; PAM type: NRG; PAM sequence: GAG
attttgcatgaggaggctgt

SEQ ID NO: 150756 - DNA, 20 bp, Artificial Sequence
  Description of Artificial Sequence: Synthetic oligonucleotide
  Target: ATXN1; (+) strand; PAM type: NRG; PAM sequence: AGG
ttttgcatgaggaggctgtg

SEQ ID NO: 150757 - DNA, 20 bp, Artificial Sequence
  Description of Artificial Sequence: Synthetic oligonucleotide
  Target: ATXN1; (+) strand; PAM type: NRG; PAM sequence: CAG
tgaggaggctgtgaggatta

SEQ ID NO: 150758 - DNA, 20 bp, Artificial Sequence
  Description of Artificial Sequence: Synthetic oligonucleotide
  Target: ATXN1; (+) strand; PAM type: NRG; PAM sequence: GAG
aggaggctgtgaggattaca

SEQ ID NO: 150759 - DNA, 20 bp, Artificial Sequence
  Description of Artificial Sequence: Synthetic oligonucleotide
  Target: ATXN1; (+) strand; PAM type: NRG; PAM sequence: TGG
gattacagagattaaacgcc

SEQ ID NO: 150760 - DNA, 20 bp, Artificial Sequence
  Description of Artificial Sequence: Synthetic oligonucleotide
  Target: ATXN1; (+) strand; PAM type: NRG; PAM sequence: GAG
ttacagagattaaacgcctg

SEQ ID NO: 150761 - DNA, 20 bp, Artificial Sequence
  Description of Artificial Sequence: Synthetic oligonucleotide
  Target: ATXN1; (+) strand; PAM type: NRG; PAM sequence: GAG
ttaaacgcctggagcatgct

SEQ ID NO: 150762 - DNA, 20 bp, Artificial Sequence
  Description of Artificial Sequence: Synthetic oligonucleotide
  Target: ATXN1; (+) strand; PAM type: NRG; PAM sequence: CAG
ggagcatgctgagtttatca

SEQ ID NO: 150763 - DNA, 20 bp, Artificial Sequence
  Description of Artificial Sequence: Synthetic oligonucleotide
  Target: ATXN1; (+) strand; PAM type: NRG; PAM sequence: GAG
agcatgctgagtttatcaca

SEQ ID NO: 150764 - DNA, 20 bp, Artificial Sequence
  Description of Artificial Sequence: Synthetic oligonucleotide
  Target: ATXN1; (+) strand; PAM type: NRG; PAM sequence: AAG
tgctgagtttatcacagaga

SEQ ID NO: 150765 - DNA, 20 bp, Artificial Sequence
  Description of Artificial Sequence: Synthetic oligonucleotide
  Target: ATXN1; (+) strand; PAM type: NRG; PAM sequence: AGG
gctgagtttatcacagagaa

SEQ ID NO: 150766 - DNA, 20 bp, Artificial Sequence
  Description of Artificial Sequence: Synthetic oligonucleotide
  Target: ATXN1; (+) strand; PAM type: NRG; PAM sequence: GGG
ctgagtttatcacagagaaa

SEQ ID NO: 150767 - DNA, 20 bp, Artificial Sequence
  Description of Artificial Sequence: Synthetic oligonucleotide
  Target: ATXN1; (+) strand; PAM type: NRG; PAM sequence: TGG
gtttatcacagagaaagggc

SEQ ID NO: 150768 - DNA, 20 bp, Artificial Sequence
  Description of Artificial Sequence: Synthetic oligonucleotide
  Target: ATXN1; (+) strand; PAM type: NRG; PAM sequence: GAG
ttatcacagagaaagggctg

SEQ ID NO: 150769 - DNA, 20 bp, Artificial Sequence
  Description of Artificial Sequence: Synthetic oligonucleotide
  Target: ATXN1; (+) strand; PAM type: NRG; PAM sequence: AAG
tcacagagaaagggctggag

SEQ ID NO: 150770 - DNA, 20 bp, Artificial Sequence
  Description of Artificial Sequence: Synthetic oligonucleotide
  Target: ATXN1; (+) strand; PAM type: NRG; PAM sequence: GAG
acagagaaagggctggagaa

SEQ ID NO: 150771 - DNA, 20 bp, Artificial Sequence
  Description of Artificial Sequence: Synthetic oligonucleotide
  Target: ATXN1; (+) strand; PAM type: NRG; PAM sequence: GAG
agagaaagggctggagaaga

SEQ ID NO: 150772 - DNA, 20 bp, Artificial Sequence
  Description of Artificial Sequence: Synthetic oligonucleotide
  Target: ATXN1; (+) strand; PAM type: NRG; PAM sequence: CAG
gaaagggctggagaagagag

SEQ ID NO: 150773 - DNA, 20 bp, Artificial Sequence
  Description of Artificial Sequence: Synthetic oligonucleotide
  Target: ATXN1; (+) strand; PAM type: NRG; PAM sequence: AGG
aaagggctggagaagagagc

SEQ ID NO: 150774 - DNA, 20 bp, Artificial Sequence
  Description of Artificial Sequence: Synthetic oligonucleotide
  Target: ATXN1; (+) strand; PAM type: NRG; PAM sequence: TGG
ctctttctgccacactaccc

SEQ ID NO: 150775 - DNA, 20 bp, Artificial Sequence
  Description of Artificial Sequence: Synthetic oligonucleotide
  Target: ATXN1; (+) strand; PAM type: NRG; PAM sequence: GAG
ctttctgccacactaccctg

SEQ ID NO: 150776 - DNA, 20 bp, Artificial Sequence
  Description of Artificial Sequence: Synthetic oligonucleotide
  Target: ATXN1; (+) strand; PAM type: NRG; PAM sequence: AAG
ccacactaccctggagctga

SEQ ID NO: 150777 - DNA, 20 bp, Artificial Sequence
  Description of Artificial Sequence: Synthetic oligonucleotide
  Target: ATXN1; (+) strand; PAM type: NRG; PAM sequence: AGG
cacactaccctggagctgaa

SEQ ID NO: 150778 - DNA, 20 bp, Artificial Sequence
  Description of Artificial Sequence: Synthetic oligonucleotide
  Target: ATXN1; (+) strand; PAM type: NRG; PAM sequence: GAG
cactaccctggagctgaaag

SEQ ID NO: 150779 - DNA, 20 bp, Artificial Sequence
  Description of Artificial Sequence: Synthetic oligonucleotide
  Target: ATXN1; (+) strand; PAM type: NRG; PAM sequence: AGG
actaccctggagctgaaagg

SEQ ID NO: 150780 - DNA, 20 bp, Artificial Sequence
  Description of Artificial Sequence: Synthetic oligonucleotide
  Target: ATXN1; (+) strand; PAM type: NRG; PAM sequence: AAG
cctggagctgaaaggaggca

SEQ ID NO: 150781 - DNA, 20 bp, Artificial Sequence
  Description of Artificial Sequence: Synthetic oligonucleotide
  Target: ATXN1; (+) strand; PAM type: NRG; PAM sequence: AGG
ctggagctgaaaggaggcaa

SEQ ID NO: 150782 - DNA, 20 bp, Artificial Sequence
  Description of Artificial Sequence: Synthetic oligonucleotide
  Target: ATXN1; (+) strand; PAM type: NRG; PAM sequence: CAG
tgaaaggaggcaaaggcctc

SEQ ID NO: 150783 - DNA, 20 bp, Artificial Sequence
  Description of Artificial Sequence: Synthetic oligonucleotide
  Target: ATXN1; (+) strand; PAM type: NRG; PAM sequence: TGG
ggcaaaggcctccagtcaca

SEQ ID NO: 150784 - DNA, 20 bp, Artificial Sequence
  Description of Artificial Sequence: Synthetic oligonucleotide
  Target: ATXN1; (+) strand; PAM type: NRG; PAM sequence: GAG
caaaggcctccagtcacatg

SEQ ID NO: 150785 - DNA, 20 bp, Artificial Sequence
  Description of Artificial Sequence: Synthetic oligonucleotide
  Target: ATXN1; (+) strand; PAM type: NRG; PAM sequence: TGG
ccagtcacatggagtctgac

SEQ ID NO: 150786 - DNA, 20 bp, Artificial Sequence
  Description of Artificial Sequence: Synthetic oligonucleotide
  Target: ATXN1; (+) strand; PAM type: NRG; PAM sequence: GGG
cagtcacatggagtctgact

SEQ ID NO: 150787 - DNA, 20 bp, Artificial Sequence
  Description of Artificial Sequence: Synthetic oligonucleotide
  Target: ATXN1; (+) strand; PAM type: NRG; PAM sequence: AAG
atggagtctgactgggacgc

SEQ ID NO: 150788 - DNA, 20 bp, Artificial Sequence
  Description of Artificial Sequence: Synthetic oligonucleotide
  Target: ATXN1; (+) strand; PAM type: NRG; PAM sequence: AAG
gactgggacgcaagacatct

SEQ ID NO: 150789 - DNA, 20 bp, Artificial Sequence
  Description of Artificial Sequence: Synthetic oligonucleotide
  Target: ATXN1; (+) strand; PAM type: NRG; PAM sequence: AAG
gacatctaagccacaaaatg

SEQ ID NO: 150790 - DNA, 20 bp, Artificial Sequence
  Description of Artificial Sequence: Synthetic oligonucleotide
  Target: ATXN1; (+) strand; PAM type: NRG; PAM sequence: AAG
aataaatgacatgatcaaat

SEQ ID NO: 150791 - DNA, 20 bp, Artificial Sequence
  Description of Artificial Sequence: Synthetic oligonucleotide
  Target: ATXN1; (+) strand; PAM type: NRG; PAM sequence: CAG
gatcaaataagctgtgcgca

SEQ ID NO: 150792 - DNA, 20 bp, Artificial Sequence
  Description of Artificial Sequence: Synthetic oligonucleotide
  Target: ATXN1; (+) strand; PAM type: NRG; PAM sequence: AGG
atcaaataagctgtgcgcac

SEQ ID NO: 150793 - DNA, 20 bp, Artificial Sequence
  Description of Artificial Sequence: Synthetic oligonucleotide
  Target: ATXN1; (+) strand; PAM type: NRG; PAM sequence: GGG
tcaaataagctgtgcgcaca

SEQ ID NO: 150794 - DNA, 20 bp, Artificial Sequence
  Description of Artificial Sequence: Synthetic oligonucleotide
  Target: ATXN1; (+) strand; PAM type: NRG; PAM sequence: CAG
aataagctgtgcgcacaggg

SEQ ID NO: 150795 - DNA, 20 bp, Artificial Sequence
  Description of Artificial Sequence: Synthetic oligonucleotide
  Target: ATXN1; (+) strand; PAM type: NRG; PAM sequence: TGG
aagctgtgcgcacagggcag

SEQ ID NO: 150796 - DNA, 20 bp, Artificial Sequence
  Description of Artificial Sequence: Synthetic oligonucleotide
  Target: ATXN1; (+) strand; PAM type: NRG; PAM sequence: GGG
agctgtgcgcacagggcagt

SEQ ID NO: 150797 - DNA, 20 bp, Artificial Sequence
  Description of Artificial Sequence: Synthetic oligonucleotide
  Target: ATXN1; (+) strand; PAM type: NRG; PAM sequence: GGG
gctgtgcgcacagggcagtg

SEQ ID NO: 150798 - DNA, 20 bp, Artificial Sequence
  Description of Artificial Sequence: Synthetic oligonucleotide
  Target: ATXN1; (+) strand; PAM type: NRG; PAM sequence: GAG
tgtgcgcacagggcagtggg

SEQ ID NO: 150799 - DNA, 20 bp, Artificial Sequence
  Description of Artificial Sequence: Synthetic oligonucleotide
  Target: ATXN1; (+) strand; PAM type: NRG; PAM sequence: AGG
gtgcgcacagggcagtgggg

SEQ ID NO: 150800 - DNA, 20 bp, Artificial Sequence
  Description of Artificial Sequence: Synthetic oligonucleotide
  Target: ATXN1; (+) strand; PAM type: NRG; PAM sequence: GGG
tgcgcacagggcagtgggga

SEQ ID NO: 150801 - DNA, 20 bp, Artificial Sequence
  Description of Artificial Sequence: Synthetic oligonucleotide
  Target: ATXN1; (+) strand; PAM type: NRG; PAM sequence: AAG
gcacagggcagtggggaggg

SEQ ID NO: 150802 - DNA, 20 bp, Artificial Sequence
  Description of Artificial Sequence: Synthetic oligonucleotide
  Target: ATXN1; (+) strand; PAM type: NRG; PAM sequence: TGG
agggcagtggggagggaagt

SEQ ID NO: 150803 - DNA, 20 bp, Artificial Sequence
  Description of Artificial Sequence: Synthetic oligonucleotide
  Target: ATXN1; (+) strand; PAM type: NRG; PAM sequence: TGG
agtggggagggaagttggtt

SEQ ID NO: 150804 - DNA, 20 bp, Artificial Sequence
  Description of Artificial Sequence: Synthetic oligonucleotide
  Target: ATXN1; (+) strand; PAM type: NRG; PAM sequence: GGG
gtggggagggaagttggttt

SEQ ID NO: 150805 - DNA, 20 bp, Artificial Sequence
  Description of Artificial Sequence: Synthetic oligonucleotide
  Target: ATXN1; (+) strand; PAM type: NRG; PAM sequence: AAG
agggaagttggtttgggctg

SEQ ID NO: 150806 - DNA, 20 bp, Artificial Sequence
  Description of Artificial Sequence: Synthetic oligonucleotide
  Target: ATXN1; (+) strand; PAM type: NRG; PAM sequence: CAG
gaagttggtttgggctgaag

SEQ ID NO: 150807 - DNA, 20 bp, Artificial Sequence
  Description of Artificial Sequence: Synthetic oligonucleotide
  Target: ATXN1; (+) strand; PAM type: NRG; PAM sequence: TGG
ttggtttgggctgaagcagc

SEQ ID NO: 150808 - DNA, 20 bp, Artificial Sequence
  Description of Artificial Sequence: Synthetic oligonucleotide
  Target: ATXN1; (+) strand; PAM type: NRG; PAM sequence: GGG
tggtttgggctgaagcagct

SEQ ID NO: 150809 - DNA, 20 bp, Artificial Sequence
  Description of Artificial Sequence: Synthetic oligonucleotide
  Target: ATXN1; (+) strand; PAM type: NRG; PAM sequence: GGG
ggtttgggctgaagcagctg

SEQ ID NO: 150810 - DNA, 20 bp, Artificial Sequence
  Description of Artificial Sequence: Synthetic oligonucleotide
  Target: ATXN1; (+) strand; PAM type: NRG; PAM sequence: CGG
ctggggaaaactttccgtcc

SEQ ID NO: 150811 - DNA, 20 bp, Artificial Sequence
  Description of Artificial Sequence: Synthetic oligonucleotide
  Target: ATXN1; (+) strand; PAM type: NRG; PAM sequence: GAG
ggggaaaactttccgtcccg

SEQ ID NO: 150812 - DNA, 20 bp, Artificial Sequence
  Description of Artificial Sequence: Synthetic oligonucleotide
  Target: ATXN1; (+) strand; PAM type: NRG; PAM sequence: AAG
gaaaactttccgtcccggag

SEQ ID NO: 150813 - DNA, 20 bp, Artificial Sequence
  Description of Artificial Sequence: Synthetic oligonucleotide
  Target: ATXN1; (+) strand; PAM type: NRG; PAM sequence: TGG
aactttccgtcccggagaag

SEQ ID NO: 150814 - DNA, 20 bp, Artificial Sequence
  Description of Artificial Sequence: Synthetic oligonucleotide
  Target: ATXN1; (+) strand; PAM type: NRG; PAM sequence: GAG
ctttccgtcccggagaagtg

SEQ ID NO: 150815 - DNA, 20 bp, Artificial Sequence
  Description of Artificial Sequence: Synthetic oligonucleotide
  Target: ATXN1; (+) strand; PAM type: NRG; PAM sequence: TGG
ggagaagtggagattcatgc

SEQ ID NO: 150816 - DNA, 20 bp, Artificial Sequence
  Description of Artificial Sequence: Synthetic oligonucleotide
  Target: ATXN1; (+) strand; PAM type: NRG; PAM sequence: GGG
gagaagtggagattcatgct

SEQ ID NO: 150817 - DNA, 20 bp, Artificial Sequence
  Description of Artificial Sequence: Synthetic oligonucleotide
  Target: ATXN1; (+) strand; PAM type: NRG; PAM sequence: TGG
gtggagattcatgctgggca

SEQ ID NO: 150818 - DNA, 20 bp, Artificial Sequence
  Description of Artificial Sequence: Synthetic oligonucleotide
  Target: ATXN1; (+) strand; PAM type: NRG; PAM sequence: CAG
agattcatgctgggcatgga

SEQ ID NO: 150819 - DNA, 20 bp, Artificial Sequence
  Description of Artificial Sequence: Synthetic oligonucleotide
  Target: ATXN1; (+) strand; PAM type: NRG; PAM sequence: TGG
ttcatgctgggcatggacag

SEQ ID NO: 150820 - DNA, 20 bp, Artificial Sequence
  Description of Artificial Sequence: Synthetic oligonucleotide
  Target: ATXN1; (+) strand; PAM type: NRG; PAM sequence: GGG
tcatgctgggcatggacagt

SEQ ID NO: 150821 - DNA, 20 bp, Artificial Sequence
  Description of Artificial Sequence: Synthetic oligonucleotide
  Target: ATXN1; (+) strand; PAM type: NRG; PAM sequence: GGG
catgctgggcatggacagtg

SEQ ID NO: 150822 - DNA, 20 bp, Artificial Sequence
  Description of Artificial Sequence: Synthetic oligonucleotide
  Target: ATXN1; (+) strand; PAM type: NRG; PAM sequence: CAG
gctgggcatggacagtgggg

SEQ ID NO: 150823 - DNA, 20 bp, Artificial Sequence
  Description of Artificial Sequence: Synthetic oligonucleotide
  Target: ATXN1; (+) strand; PAM type: NRG; PAM sequence: GAG
catggacagtggggcagaat

SEQ ID NO: 150824 - DNA, 20 bp, Artificial Sequence
  Description of Artificial Sequence: Synthetic oligonucleotide
  Target: ATXN1; (+) strand; PAM type: NRG; PAM sequence: AGG
atggacagtggggcagaatg

SEQ ID NO: 150825 - DNA, 20 bp, Artificial Sequence
  Description of Artificial Sequence: Synthetic oligonucleotide
  Target: ATXN1; (+) strand; PAM type: NRG; PAM sequence: CAG
acagtggggcagaatgagga

SEQ ID NO: 150826 - DNA, 20 bp, Artificial Sequence
  Description of Artificial Sequence: Synthetic oligonucleotide
  Target: ATXN1; (+) strand; PAM type: NRG; PAM sequence: AGG
cagtggggcagaatgaggac

SEQ ID NO: 150827 - DNA, 20 bp, Artificial Sequence
  Description of Artificial Sequence: Synthetic oligonucleotide
  Target: ATXN1; (+) strand; PAM type: NRG; PAM sequence: AAG
gggcagaatgaggacaggta

SEQ ID NO: 150828 - DNA, 20 bp, Artificial Sequence
  Description of Artificial Sequence: Synthetic oligonucleotide
  Target: ATXN1; (+) strand; PAM type: NRG; PAM sequence: AGG
ggcagaatgaggacaggtaa

SEQ ID NO: 150829 - DNA, 20 bp, Artificial Sequence
  Description of Artificial Sequence: Synthetic oligonucleotide
  Target: ATXN1; (+) strand; PAM type: NRG; PAM sequence: CAG
agaatgaggacaggtaaagg

SEQ ID NO: 150830 - DNA, 20 bp, Artificial Sequence
  Description of Artificial Sequence: Synthetic oligonucleotide
  Target: ATXN1; (+) strand; PAM type: NRG; PAM sequence: GAG
aatgaggacaggtaaaggca

SEQ ID NO: 150831 - DNA, 20 bp, Artificial Sequence
  Description of Artificial Sequence: Synthetic oligonucleotide
  Target: ATXN1; (+) strand; PAM type: NRG; PAM sequence: AGG
atgaggacaggtaaaggcag

SEQ ID NO: 150832 - DNA, 20 bp, Artificial Sequence
  Description of Artificial Sequence: Synthetic oligonucleotide
  Target: ATXN1; (+) strand; PAM type: NRG; PAM sequence: GGG
tgaggacaggtaaaggcaga

SEQ ID NO: 150833 - DNA, 20 bp, Artificial Sequence
  Description of Artificial Sequence: Synthetic oligonucleotide
  Target: ATXN1; (+) strand; PAM type: NRG; PAM sequence: GGG
gaggacaggtaaaggcagag

SEQ ID NO: 150834 - DNA, 20 bp, Artificial Sequence
  Description of Artificial Sequence: Synthetic oligonucleotide
  Target: ATXN1; (+) strand; PAM type: NRG; PAM sequence: TGG
acaggtaaaggcagaggggc

SEQ ID NO: 150835 - DNA, 20 bp, Artificial Sequence
  Description of Artificial Sequence: Synthetic oligonucleotide
  Target: ATXN1; (+) strand; PAM type: NRG; PAM sequence: GGG
caggtaaaggcagaggggct

SEQ ID NO: 150836 - DNA, 20 bp, Artificial Sequence
  Description of Artificial Sequence: Synthetic oligonucleotide
  Target: ATXN1; (+) strand; PAM type: NRG; PAM sequence: CAG
agaggggctgggaaccctca

SEQ ID NO: 150837 - DNA, 20 bp, Artificial Sequence
  Description of Artificial Sequence: Synthetic oligonucleotide
  Target: ATXN1; (+) strand; PAM type: NRG; PAM sequence: AAG
ggctgggaaccctcacagca

SEQ ID NO: 150838 - DNA, 20 bp, Artificial Sequence
  Description of Artificial Sequence: Synthetic oligonucleotide
  Target: ATXN1; (+) strand; PAM type: NRG; PAM sequence: CAG
tgggaaccctcacagcaaag

SEQ ID NO: 150839 - DNA, 20 bp, Artificial Sequence
  Description of Artificial Sequence: Synthetic oligonucleotide
  Target: ATXN1; (+) strand; PAM type: NRG; PAM sequence: AGG
gggaaccctcacagcaaagc

SEQ ID NO: 150840 - DNA, 20 bp, Artificial Sequence
  Description of Artificial Sequence: Synthetic oligonucleotide
  Target: ATXN1; (+) strand; PAM type: NRG; PAM sequence: GGG
ggaaccctcacagcaaagca

SEQ ID NO: 150841 - DNA, 20 bp, Artificial Sequence
  Description of Artificial Sequence: Synthetic oligonucleotide
  Target: ATXN1; (+) strand; PAM type: NRG; PAM sequence: TGG
accctcacagcaaagcaggg

SEQ ID NO: 150842 - DNA, 20 bp, Artificial Sequence
  Description of Artificial Sequence: Synthetic oligonucleotide
  Target: ATXN1; (+) strand; PAM type: NRG; PAM sequence: CAG
tcacagcaaagcagggtggt

SEQ ID NO: 150843 - DNA, 20 bp, Artificial Sequence
  Description of Artificial Sequence: Synthetic oligonucleotide
  Target: ATXN1; (+) strand; PAM type: NRG; PAM sequence: CAG
gcagggtggtcagaaacaaa

SEQ ID NO: 150844 - DNA, 20 bp, Artificial Sequence
  Description of Artificial Sequence: Synthetic oligonucleotide
  Target: ATXN1; (+) strand; PAM type: NRG; PAM sequence: AGG
cagggtggtcagaaacaaac

SEQ ID NO: 150845 - DNA, 20 bp, Artificial Sequence
  Description of Artificial Sequence: Synthetic oligonucleotide
  Target: ATXN1; (+) strand; PAM type: NRG; PAM sequence: TGG
agaaacaaacaggatatgta

SEQ ID NO: 150846 - DNA, 20 bp, Artificial Sequence
  Description of Artificial Sequence: Synthetic oligonucleotide
  Target: ATXN1; (+) strand; PAM type: NRG; PAM sequence: GGG
gaaacaaacaggatatgtat

SEQ ID NO: 150847 - DNA, 20 bp, Artificial Sequence
  Description of Artificial Sequence: Synthetic oligonucleotide
  Target: ATXN1; (+) strand; PAM type: NRG; PAM sequence: TGG
ggatatgtatgggcaacatc

SEQ ID NO: 150848 - DNA, 20 bp, Artificial Sequence
  Description of Artificial Sequence: Synthetic oligonucleotide
  Target: ATXN1; (+) strand; PAM type: NRG; PAM sequence: GGG
gatatgtatgggcaacatct

SEQ ID NO: 150849 - DNA, 20 bp, Artificial Sequence
  Description of Artificial Sequence: Synthetic oligonucleotide
  Target: ATXN1; (+) strand; PAM type: NRG; PAM sequence: TAG
tatgggcaacatctgggatg

SEQ ID NO: 150850 - DNA, 20 bp, Artificial Sequence
  Description of Artificial Sequence: Synthetic oligonucleotide
  Target: ATXN1; (+) strand; PAM type: NRG; PAM sequence: AGG
atgggcaacatctgggatgt

SEQ ID NO: 150851 - DNA, 20 bp, Artificial Sequence
  Description of Artificial Sequence: Synthetic oligonucleotide
  Target: ATXN1; (+) strand; PAM type: NRG; PAM sequence: CAG
gcaacatctgggatgtagga

SEQ ID NO: 150852 - DNA, 20 bp, Artificial Sequence
  Description of Artificial Sequence: Synthetic oligonucleotide
  Target: ATXN1; (+) strand; PAM type: NRG; PAM sequence: CAG
ctgggatgtaggacagaaac

SEQ ID NO: 150853 - DNA, 20 bp, Artificial Sequence
  Description of Artificial Sequence: Synthetic oligonucleotide
  Target: ATXN1; (+) strand; PAM type: NRG; PAM sequence: AGG
tgggatgtaggacagaaacc

SEQ ID NO: 150854 - DNA, 20 bp, Artificial Sequence
  Description of Artificial Sequence: Synthetic oligonucleotide
  Target: ATXN1; (+) strand; PAM type: NRG; PAM sequence: AAG
gcccaccctttctacaactc

SEQ ID NO: 150855 - DNA, 20 bp, Artificial Sequence
  Description of Artificial Sequence: Synthetic oligonucleotide
  Target: ATXN1; (+) strand; PAM type: NRG; PAM sequence: AGG
cccaccctttctacaactca

SEQ ID NO: 150856 - DNA, 20 bp, Artificial Sequence
  Description of Artificial Sequence: Synthetic oligonucleotide
  Target: ATXN1; (+) strand; PAM type: NRG; PAM sequence: TGG
cacgccatcacccatatgcc

SEQ ID NO: 150857 - DNA, 20 bp, Artificial Sequence
  Description of Artificial Sequence: Synthetic oligonucleotide
  Target: ATXN1; (+) strand; PAM type: NRG; PAM sequence: AAG
gccctaaatgctacacaaat

SEQ ID NO: 150858 - DNA, 20 bp, Artificial Sequence
  Description of Artificial Sequence: Synthetic oligonucleotide
  Target: ATXN1; (+) strand; PAM type: NRG; PAM sequence: TAG
taaatgctacacaaataagt

SEQ ID NO: 150859 - DNA, 20 bp, Artificial Sequence
  Description of Artificial Sequence: Synthetic oligonucleotide
  Target: ATXN1; (+) strand; PAM type: NRG; PAM sequence: AAG
aaataagttagaaaactcca

SEQ ID NO: 150860 - DNA, 20 bp, Artificial Sequence
  Description of Artificial Sequence: Synthetic oligonucleotide
  Target: ATXN1; (+) strand; PAM type: NRG; PAM sequence: AGG
aataagttagaaaactccaa

SEQ ID NO: 150861 - DNA, 20 bp, Artificial Sequence
  Description of Artificial Sequence: Synthetic oligonucleotide
  Target: ATXN1; (+) strand; PAM type: NRG; PAM sequence: GAG
taagttagaaaactccaaag

SEQ ID NO: 150862 - DNA, 20 bp, Artificial Sequence
  Description of Artificial Sequence: Synthetic oligonucleotide
  Target: ATXN1; (+) strand; PAM type: NRG; PAM sequence: TGG
tagaaaactccaaaggagaa

SEQ ID NO: 150863 - DNA, 20 bp, Artificial Sequence
  Description of Artificial Sequence: Synthetic oligonucleotide
  Target: ATXN1; (+) strand; PAM type: NRG; PAM sequence: TAG
ggagaatggtaatatcatca

SEQ ID NO: 150864 - DNA, 20 bp, Artificial Sequence
  Description of Artificial Sequence: Synthetic oligonucleotide
  Target: ATXN1; (+) strand; PAM type: NRG; PAM sequence: CAG
gaatggtaatatcatcatag

SEQ ID NO: 150865 - DNA, 20 bp, Artificial Sequence
  Description of Artificial Sequence: Synthetic oligonucleotide
  Target: ATXN1; (+) strand; PAM type: NRG; PAM sequence: AGG
aatggtaatatcatcatagc

SEQ ID NO: 150866 - DNA, 20 bp, Artificial Sequence
  Description of Artificial Sequence: Synthetic oligonucleotide
  Target: ATXN1; (+) strand; PAM type: NRG; PAM sequence: AAG
taatatcatcatagcaggtg

SEQ ID NO: 150867 - DNA, 20 bp, Artificial Sequence
  Description of Artificial Sequence: Synthetic oligonucleotide
  Target: ATXN1; (+) strand; PAM type: NRG; PAM sequence: TAG
agcaggtgaagtgtgaatac

SEQ ID NO: 150868 - DNA, 20 bp, Artificial Sequence
  Description of Artificial Sequence: Synthetic oligonucleotide
  Target: ATXN1; (+) strand; PAM type: NRG; PAM sequence: AGG
gcaggtgaagtgtgaatact

SEQ ID NO: 150869 - DNA, 20 bp, Artificial Sequence
  Description of Artificial Sequence: Synthetic oligonucleotide
  Target: ATXN1; (+) strand; PAM type: NRG; PAM sequence: GGG
caggtgaagtgtgaatacta

SEQ ID NO: 150870 - DNA, 20 bp, Artificial Sequence
  Description of Artificial Sequence: Synthetic oligonucleotide
  Target: ATXN1; (+) strand; PAM type: NRG; PAM sequence: GGG
aggtgaagtgtgaatactag

SEQ ID NO: 150871 - DNA, 20 bp, Artificial Sequence
  Description of Artificial Sequence: Synthetic oligonucleotide
  Target: ATXN1; (+) strand; PAM type: NRG; PAM sequence: TAG
attacgtatattgattttct

SEQ ID NO: 150872 - DNA, 20 bp, Artificial Sequence
  Description of Artificial Sequence: Synthetic oligonucleotide
  Target: ATXN1; (+) strand; PAM type: NRG; PAM sequence: CAG
tgactataatccccactctt

SEQ ID NO: 150873 - DNA, 20 bp, Artificial Sequence
  Description of Artificial Sequence: Synthetic oligonucleotide
  Target: ATXN1; (+) strand; PAM type: NRG; PAM sequence: AAG
taatccccactcttcagatg

SEQ ID NO: 150874 - DNA, 20 bp, Artificial Sequence
  Description of Artificial Sequence: Synthetic oligonucleotide
  Target: ATXN1; (+) strand; PAM type: NRG; PAM sequence: GAG
actcttcagatgaagaaact

SEQ ID NO: 150875 - DNA, 20 bp, Artificial Sequence
  Description of Artificial Sequence: Synthetic oligonucleotide
  Target: ATXN1; (+) strand; PAM type: NRG; PAM sequence: AGG
ctcttcagatgaagaaactg

SEQ ID NO: 150876 - DNA, 20 bp, Artificial Sequence
  Description of Artificial Sequence: Synthetic oligonucleotide
  Target: ATXN1; (+) strand; PAM type: NRG; PAM sequence: CAG
cagatgaagaaactgaggca

SEQ ID NO: 150877 - DNA, 20 bp, Artificial Sequence
  Description of Artificial Sequence: Synthetic oligonucleotide
  Target: ATXN1; (+) strand; PAM type: NRG; PAM sequence: TAG
tgaagaaactgaggcacaga

SEQ ID NO: 150878 - DNA, 20 bp, Artificial Sequence
  Description of Artificial Sequence: Synthetic oligonucleotide
  Target: ATXN1; (+) strand; PAM type: NRG; PAM sequence: AGG
gaagaaactgaggcacagat

SEQ ID NO: 150879 - DNA, 20 bp, Artificial Sequence
  Description of Artificial Sequence: Synthetic oligonucleotide
  Target: ATXN1; (+) strand; PAM type: NRG; PAM sequence: CAG
aactgaggcacagataggtt

SEQ ID NO: 150880 - DNA, 20 bp, Artificial Sequence
  Description of Artificial Sequence: Synthetic oligonucleotide
  Target: ATXN1; (+) strand; PAM type: NRG; PAM sequence: AGG
actgaggcacagataggttc

SEQ ID NO: 150881 - DNA, 20 bp, Artificial Sequence
  Description of Artificial Sequence: Synthetic oligonucleotide
  Target: ATXN1; (+) strand; PAM type: NRG; PAM sequence: GGG
ctgaggcacagataggttca

SEQ ID NO: 150882 - DNA, 20 bp, Artificial Sequence
  Description of Artificial Sequence: Synthetic oligonucleotide
  Target: ATXN1; (+) strand; PAM type: NRG; PAM sequence: TGG
cacagataggttcagggact

SEQ ID NO: 150883 - DNA, 20 bp, Artificial Sequence
  Description of Artificial Sequence: Synthetic oligonucleotide
  Target: ATXN1; (+) strand; PAM type: NRG; PAM sequence: AAG
ataggttcagggacttggcc

SEQ ID NO: 150884 - DNA, 20 bp, Artificial Sequence
  Description of Artificial Sequence: Synthetic oligonucleotide
  Target: ATXN1; (+) strand; PAM type: NRG; PAM sequence: AGG
taggttcagggacttggcca

SEQ ID NO: 150885 - DNA, 20 bp, Artificial Sequence
  Description of Artificial Sequence: Synthetic oligonucleotide
  Target: ATXN1; (+) strand; PAM type: NRG; PAM sequence: TGG
gttcagggacttggccaagg

SEQ ID NO: 150886 - DNA, 20 bp, Artificial Sequence
  Description of Artificial Sequence: Synthetic oligonucleotide
  Target: ATXN1; (+) strand; PAM type: NRG; PAM sequence: AAG
tggccaaggtggtaaatgtc

SEQ ID NO: 150887 - DNA, 20 bp, Artificial Sequence
  Description of Artificial Sequence: Synthetic oligonucleotide
  Target: ATXN1; (+) strand; PAM type: NRG; PAM sequence: AGG
ggccaaggtggtaaatgtca

SEQ ID NO: 150888 - DNA, 20 bp, Artificial Sequence
  Description of Artificial Sequence: Synthetic oligonucleotide
  Target: ATXN1; (+) strand; PAM type: NRG; PAM sequence: TGG
aaggtggtaaatgtcaaggc

SEQ ID NO: 150889 - DNA, 20 bp, Artificial Sequence
  Description of Artificial Sequence: Synthetic oligonucleotide
  Target: ATXN1; (+) strand; PAM type: NRG; PAM sequence: TAG
gtcaaggctggtattcgaac

SEQ ID NO: 150890 - DNA, 20 bp, Artificial Sequence
  Description of Artificial Sequence: Synthetic oligonucleotide
  Target: ATXN1; (+) strand; PAM type: NRG; PAM sequence: GAG
caaggctggtattcgaacta

SEQ ID NO: 150891 - DNA, 20 bp, Artificial Sequence
  Description of Artificial Sequence: Synthetic oligonucleotide
  Target: ATXN1; (+) strand; PAM type: NRG; PAM sequence: GAG
aggctggtattcgaactaga

SEQ ID NO: 150892 - DNA, 20 bp, Artificial Sequence
  Description of Artificial Sequence: Synthetic oligonucleotide
  Target: ATXN1; (+) strand; PAM type: NRG; PAM sequence: TGG
ctagagagatatcaaaattc

SEQ ID NO: 150893 - DNA, 20 bp, Artificial Sequence
  Description of Artificial Sequence: Synthetic oligonucleotide
  Target: ATXN1; (+) strand; PAM type: NRG; PAM sequence: CAG
aattctggtatacccaacca

SEQ ID NO: 150894 - DNA, 20 bp, Artificial Sequence
  Description of Artificial Sequence: Synthetic oligonucleotide
  Target: ATXN1; (+) strand; PAM type: NRG; PAM sequence: GAG
tggtatacccaaccacagat

SEQ ID NO: 150895 - DNA, 20 bp, Artificial Sequence
  Description of Artificial Sequence: Synthetic oligonucleotide
  Target: ATXN1; (+) strand; PAM type: NRG; PAM sequence: AGG
ggtatacccaaccacagatg

SEQ ID NO: 150896 - DNA, 20 bp, Artificial Sequence
  Description of Artificial Sequence: Synthetic oligonucleotide
  Target: ATXN1; (+) strand; PAM type: NRG; PAM sequence: GGG
gtatacccaaccacagatga

SEQ ID NO: 150897 - DNA, 20 bp, Artificial Sequence
  Description of Artificial Sequence: Synthetic oligonucleotide
  Target: ATXN1; (+) strand; PAM type: NRG; PAM sequence: CAG
ccaaccacagatgagggacg

SEQ ID NO: 150898 - DNA, 20 bp, Artificial Sequence
  Description of Artificial Sequence: Synthetic oligonucleotide
  Target: ATXN1; (+) strand; PAM type: NRG; PAM sequence: AGG
caaccacagatgagggacgc

SEQ ID NO: 150899 - DNA, 20 bp, Artificial Sequence
  Description of Artificial Sequence: Synthetic oligonucleotide
  Target: ATXN1; (+) strand; PAM type: NRG; PAM sequence: AAG
acgcaggcacaaccttcacc

SEQ ID NO: 150900 - DNA, 20 bp, Artificial Sequence
  Description of Artificial Sequence: Synthetic oligonucleotide
  Target: ATXN1; (+) strand; PAM type: NRG; PAM sequence: TGG
ggcacaaccttcaccaagtg

SEQ ID NO: 150901 - DNA, 20 bp, Artificial Sequence
  Description of Artificial Sequence: Synthetic oligonucleotide
  Target: ATXN1; (+) strand; PAM type: NRG; PAM sequence: CAG
ccttcaccaagtgtggatcc

SEQ ID NO: 150902 - DNA, 20 bp, Artificial Sequence
  Description of Artificial Sequence: Synthetic oligonucleotide
  Target: ATXN1; (+) strand; PAM type: NRG; PAM sequence: CAG
ccaagtgtggatcccagctg

SEQ ID NO: 150903 - DNA, 20 bp, Artificial Sequence
  Description of Artificial Sequence: Synthetic oligonucleotide
  Target: ATXN1; (+) strand; PAM type: NRG; PAM sequence: AGG
caagtgtggatcccagctgc

SEQ ID NO: 150904 - DNA, 20 bp, Artificial Sequence
  Description of Artificial Sequence: Synthetic oligonucleotide
  Target: ATXN1; (+) strand; PAM type: NRG; PAM sequence: CAG
tgtggatcccagctgcagga

SEQ ID NO: 150905 - DNA, 20 bp, Artificial Sequence
  Description of Artificial Sequence: Synthetic oligonucleotide
  Target: ATXN1; (+) strand; PAM type: NRG; PAM sequence: TGG
atcccagctgcaggacagct

SEQ ID NO: 150906 - DNA, 20 bp, Artificial Sequence
  Description of Artificial Sequence: Synthetic oligonucleotide
  Target: ATXN1; (+) strand; PAM type: NRG; PAM sequence: CAG
gcattcccttccccgtcacc

SEQ ID NO: 150907 - DNA, 20 bp, Artificial Sequence
  Description of Artificial Sequence: Synthetic oligonucleotide
  Target: ATXN1; (+) strand; PAM type: NRG; PAM sequence: TAG
attctccttctatttattcc

SEQ ID NO: 150908 - DNA, 20 bp, Artificial Sequence
  Description of Artificial Sequence: Synthetic oligonucleotide
  Target: ATXN1; (+) strand; PAM type: NRG; PAM sequence: AAG
tctatttattcctagttact

SEQ ID NO: 150909 - DNA, 20 bp, Artificial Sequence
  Description of Artificial Sequence: Synthetic oligonucleotide
  Target: ATXN1; (+) strand; PAM type: NRG; PAM sequence: AAG
cctagttactaagaattttt

SEQ ID NO: 150910 - DNA, 20 bp, Artificial Sequence
  Description of Artificial Sequence: Synthetic oligonucleotide
  Target: ATXN1; (+) strand; PAM type: NRG; PAM sequence: AGG
ctagttactaagaattttta

SEQ ID NO: 150911 - DNA, 20 bp, Artificial Sequence
  Description of Artificial Sequence: Synthetic oligonucleotide
  Target: ATXN1; (+) strand; PAM type: NRG; PAM sequence: CAG
ttaaggtgctatcacacctc

SEQ ID NO: 150912 - DNA, 20 bp, Artificial Sequence
  Description of Artificial Sequence: Synthetic oligonucleotide
  Target: ATXN1; (+) strand; PAM type: NRG; PAM sequence: AGG
taaggtgctatcacacctcc

SEQ ID NO: 150913 - DNA, 20 bp, Artificial Sequence
  Description of Artificial Sequence: Synthetic oligonucleotide
  Target: ATXN1; (+) strand; PAM type: NRG; PAM sequence: GGG
aaggtgctatcacacctcca

SEQ ID NO: 150914 - DNA, 20 bp, Artificial Sequence
  Description of Artificial Sequence: Synthetic oligonucleotide
  Target: ATXN1; (+) strand; PAM type: NRG; PAM sequence: AAG
acctccagggctacttccaa

SEQ ID NO: 150915 - DNA, 20 bp, Artificial Sequence
  Description of Artificial Sequence: Synthetic oligonucleotide
  Target: ATXN1; (+) strand; PAM type: NRG; PAM sequence: TAG
cagggctacttccaaaagcc

SEQ ID NO: 150916 - DNA, 20 bp, Artificial Sequence
  Description of Artificial Sequence: Synthetic oligonucleotide
  Target: ATXN1; (+) strand; PAM type: NRG; PAM sequence: GAG
ctacttccaaaagcctagtc

SEQ ID NO: 150917 - DNA, 20 bp, Artificial Sequence
  Description of Artificial Sequence: Synthetic oligonucleotide
  Target: ATXN1; (+) strand; PAM type: NRG; PAM sequence: AAG
agcctagtcgagctgactca

SEQ ID NO: 150918 - DNA, 20 bp, Artificial Sequence
  Description of Artificial Sequence: Synthetic oligonucleotide
  Target: ATXN1; (+) strand; PAM type: NRG; PAM sequence: AGG
gcctagtcgagctgactcaa

SEQ ID NO: 150919 - DNA, 20 bp, Artificial Sequence
  Description of Artificial Sequence: Synthetic oligonucleotide
  Target: ATXN1; (+) strand; PAM type: NRG; PAM sequence: GGG
cctagtcgagctgactcaaa

SEQ ID NO: 150920 - DNA, 20 bp, Artificial Sequence
  Description of Artificial Sequence: Synthetic oligonucleotide
  Target: ATXN1; (+) strand; PAM type: NRG; PAM sequence: AAG
agtcgagctgactcaaaggg

SEQ ID NO: 150921 - DNA, 20 bp, Artificial Sequence
  Description of Artificial Sequence: Synthetic oligonucleotide
  Target: ATXN1; (+) strand; PAM type: NRG; PAM sequence: AGG
gtcgagctgactcaaaggga

SEQ ID NO: 150922 - DNA, 20 bp, Artificial Sequence
  Description of Artificial Sequence: Synthetic oligonucleotide
  Target: ATXN1; (+) strand; PAM type: NRG; PAM sequence: TAG
gactcaaagggaaggttctt

SEQ ID NO: 150923 - DNA, 20 bp, Artificial Sequence
  Description of Artificial Sequence: Synthetic oligonucleotide
  Target: ATXN1; (+) strand; PAM type: NRG; PAM sequence: AGG
actcaaagggaaggttcttt

SEQ ID NO: 150924 - DNA, 20 bp, Artificial Sequence
  Description of Artificial Sequence: Synthetic oligonucleotide
  Target: ATXN1; (+) strand; PAM type: NRG; PAM sequence: GGG
ctcaaagggaaggttcttta

SEQ ID NO: 150925 - DNA, 20 bp, Artificial Sequence
  Description of Artificial Sequence: Synthetic oligonucleotide
  Target: ATXN1; (+) strand; PAM type: NRG; PAM sequence: CAG
ggaaggttctttagggacct

SEQ ID NO: 150926 - DNA, 20 bp, Artificial Sequence
  Description of Artificial Sequence: Synthetic oligonucleotide
  Target: ATXN1; (+) strand; PAM type: NRG; PAM sequence: CAG
ggacctcagcaatccaaaca

SEQ ID NO: 150927 - DNA, 20 bp, Artificial Sequence
  Description of Artificial Sequence: Synthetic oligonucleotide
  Target: ATXN1; (+) strand; PAM type: NRG; PAM sequence: CAG
cctcagcaatccaaacacag

SEQ ID NO: 150928 - DNA, 20 bp, Artificial Sequence
  Description of Artificial Sequence: Synthetic oligonucleotide
  Target: ATXN1; (+) strand; PAM type: NRG; PAM sequence: GAG
tccaaacacagcagacatct

SEQ ID NO: 150929 - DNA, 20 bp, Artificial Sequence
  Description of Artificial Sequence: Synthetic oligonucleotide
  Target: ATXN1; (+) strand; PAM type: NRG; PAM sequence: AAG
catctgagaaatcctgaaac

SEQ ID NO: 150930 - DNA, 20 bp, Artificial Sequence
  Description of Artificial Sequence: Synthetic oligonucleotide
  Target: ATXN1; (+) strand; PAM type: NRG; PAM sequence: CAG
tcctgaaacaagtcttccta

SEQ ID NO: 150931 - DNA, 20 bp, Artificial Sequence
  Description of Artificial Sequence: Synthetic oligonucleotide
  Target: ATXN1; (+) strand; PAM type: NRG; PAM sequence: TGG
atgatgactgcctgcctctc

SEQ ID NO: 150932 - DNA, 20 bp, Artificial Sequence
  Description of Artificial Sequence: Synthetic oligonucleotide
  Target: ATXN1; (+) strand; PAM type: NRG; PAM sequence: GAG
tgcctgcctctctggcaact

SEQ ID NO: 150933 - DNA, 20 bp, Artificial Sequence
  Description of Artificial Sequence: Synthetic oligonucleotide
  Target: ATXN1; (+) strand; PAM type: NRG; PAM sequence: TGG
gcctctctggcaactgagaa

SEQ ID NO: 150934 - DNA, 20 bp, Artificial Sequence
  Description of Artificial Sequence: Synthetic oligonucleotide
  Target: ATXN1; (+) strand; PAM type: NRG; PAM sequence: GGG
cctctctggcaactgagaat

SEQ ID NO: 150935 - DNA, 20 bp, Artificial Sequence
  Description of Artificial Sequence: Synthetic oligonucleotide
  Target: ATXN1; (+) strand; PAM type: NRG; PAM sequence: AAG
acatcctcctttactgtaca

SEQ ID NO: 150936 - DNA, 20 bp, Artificial Sequence
  Description of Artificial Sequence: Synthetic oligonucleotide
  Target: ATXN1; (+) strand; PAM type: NRG; PAM sequence: TGG
cctttactgtacaaagtatc

SEQ ID NO: 150937 - DNA, 20 bp, Artificial Sequence
  Description of Artificial Sequence: Synthetic oligonucleotide
  Target: ATXN1; (+) strand; PAM type: NRG; PAM sequence: AAG
gtacaaagtatctggtcaca

SEQ ID NO: 150938 - DNA, 20 bp, Artificial Sequence
  Description of Artificial Sequence: Synthetic oligonucleotide
  Target: ATXN1; (+) strand; PAM type: NRG; PAM sequence: TGG
ctggtcacaaagtttgttat

SEQ ID NO: 150939 - DNA, 20 bp, Artificial Sequence
  Description of Artificial Sequence: Synthetic oligonucleotide
  Target: ATXN1; (+) strand; PAM type: NRG; PAM sequence: CAG
gtcacaaagtttgttattgg

SEQ ID NO: 150940 - DNA, 20 bp, Artificial Sequence
  Description of Artificial Sequence: Synthetic oligonucleotide
  Target: ATXN1; (+) strand; PAM type: NRG; PAM sequence: CAG
aagtttgttattggcagaac

SEQ ID NO: 150941 - DNA, 20 bp, Artificial Sequence
  Description of Artificial Sequence: Synthetic oligonucleotide
  Target: ATXN1; (+) strand; PAM type: NRG; PAM sequence: AGG
agtttgttattggcagaacc

SEQ ID NO: 150942 - DNA, 20 bp, Artificial Sequence
  Description of Artificial Sequence: Synthetic oligonucleotide
  Target: ATXN1; (+) strand; PAM type: NRG; PAM sequence: AAG
tctctcacccttattctccc

SEQ ID NO: 150943 - DNA, 20 bp, Artificial Sequence
  Description of Artificial Sequence: Synthetic oligonucleotide
  Target: ATXN1; (+) strand; PAM type: NRG; PAM sequence: AGG
ctctcacccttattctccca

SEQ ID NO: 150944 - DNA, 20 bp, Artificial Sequence
  Description of Artificial Sequence: Synthetic oligonucleotide
  Target: ATXN1; (+) strand; PAM type: NRG; PAM sequence: AAG
gtatatttatatgttttgca

SEQ ID NO: 150945 - DNA, 20 bp, Artificial Sequence
  Description of Artificial Sequence: Synthetic oligonucleotide
  Target: ATXN1; (+) strand; PAM type: NRG; PAM sequence: TAG
tatttatatgttttgcaaag

SEQ ID NO: 150946 - DNA, 20 bp, Artificial Sequence
  Description of Artificial Sequence: Synthetic oligonucleotide
  Target: ATXN1; (+) strand; PAM type: NRG; PAM sequence: AAG
tatgttttgcaaagtagcca

SEQ ID NO: 150947 - DNA, 20 bp, Artificial Sequence
  Description of Artificial Sequence: Synthetic oligonucleotide
  Target: ATXN1; (+) strand; PAM type: NRG; PAM sequence: AGG
atgttttgcaaagtagccaa

SEQ ID NO: 150948 - DNA, 20 bp, Artificial Sequence
  Description of Artificial Sequence: Synthetic oligonucleotide
  Target: ATXN1; (+) strand; PAM type: NRG; PAM sequence: CAG
ttttgcaaagtagccaaagg

SEQ ID NO: 150949 - DNA, 20 bp, Artificial Sequence
  Description of Artificial Sequence: Synthetic oligonucleotide
  Target: ATXN1; (+) strand; PAM type: NRG; PAM sequence: AAG
tagccaaaggcagacttcaa

SEQ ID NO: 150950 - DNA, 20 bp, Artificial Sequence
  Description of Artificial Sequence: Synthetic oligonucleotide
  Target: ATXN1; (+) strand; PAM type: NRG; PAM sequence: AGG
agccaaaggcagacttcaaa

SEQ ID NO: 150951 - DNA, 20 bp, Artificial Sequence
  Description of Artificial Sequence: Synthetic oligonucleotide
  Target: ATXN1; (+) strand; PAM type: NRG; PAM sequence: GAG
ccaaaggcagacttcaaaag

SEQ ID NO: 150952 - DNA, 20 bp, Artificial Sequence
  Description of Artificial Sequence: Synthetic oligonucleotide
  Target: ATXN1; (+) strand; PAM type: NRG; PAM sequence: TGG
cttcaaaaggagctttcctg

SEQ ID NO: 150953 - DNA, 20 bp, Artificial Sequence
  Description of Artificial Sequence: Synthetic oligonucleotide
  Target: ATXN1; (+) strand; PAM type: NRG; PAM sequence: GGG
ttcaaaaggagctttcctgt

SEQ ID NO: 150954 - DNA, 20 bp, Artificial Sequence
  Description of Artificial Sequence: Synthetic oligonucleotide
  Target: ATXN1; (+) strand; PAM type: NRG; PAM sequence: GGG
tcaaaaggagctttcctgtg

SEQ ID NO: 150955 - DNA, 20 bp, Artificial Sequence
  Description of Artificial Sequence: Synthetic oligonucleotide
  Target: ATXN1; (+) strand; PAM type: NRG; PAM sequence: GAG
aaggagctttcctgtggggt

SEQ ID NO: 150956 - DNA, 20 bp, Artificial Sequence
  Description of Artificial Sequence: Synthetic oligonucleotide
  Target: ATXN1; (+) strand; PAM type: NRG; PAM sequence: CGG
gagctttcctgtggggtgag

SEQ ID NO: 150957 - DNA, 20 bp, Artificial Sequence
  Description of Artificial Sequence: Synthetic oligonucleotide
  Target: ATXN1; (+) strand; PAM type: NRG; PAM sequence: CGG
ggtgagcggtaaatgaataa

SEQ ID NO: 150958 - DNA, 20 bp, Artificial Sequence
  Description of Artificial Sequence: Synthetic oligonucleotide
  Target: ATXN1; (+) strand; PAM type: NRG; PAM sequence: TGG
agcggtaaatgaataacggc

SEQ ID NO: 150959 - DNA, 20 bp, Artificial Sequence
  Description of Artificial Sequence: Synthetic oligonucleotide
  Target: ATXN1; (+) strand; PAM type: NRG; PAM sequence: GAG
aaatgaataacggctggact

SEQ ID NO: 150960 - DNA, 20 bp, Artificial Sequence
  Description of Artificial Sequence: Synthetic oligonucleotide
  Target: ATXN1; (+) strand; PAM type: NRG; PAM sequence: GAG
atgaataacggctggactga

SEQ ID NO: 150961 - DNA, 20 bp, Artificial Sequence
  Description of Artificial Sequence: Synthetic oligonucleotide
  Target: ATXN1; (+) strand; PAM type: NRG; PAM sequence: GAG
gaataacggctggactgaga

SEQ ID NO: 150962 - DNA, 20 bp, Artificial Sequence
  Description of Artificial Sequence: Synthetic oligonucleotide
  Target: ATXN1; (+) strand; PAM type: NRG; PAM sequence: AAG
acggctggactgagagagca

SEQ ID NO: 150963 - DNA, 20 bp, Artificial Sequence
  Description of Artificial Sequence: Synthetic oligonucleotide
  Target: ATXN1; (+) strand; PAM type: NRG; PAM sequence: GAG
ggctggactgagagagcaaa

SEQ ID NO: 150964 - DNA, 20 bp, Artificial Sequence
  Description of Artificial Sequence: Synthetic oligonucleotide
  Target: ATXN1; (+) strand; PAM type: NRG; PAM sequence: GAG
tgagagagcaaagagaaaat

SEQ ID NO: 150965 - DNA, 20 bp, Artificial Sequence
  Description of Artificial Sequence: Synthetic oligonucleotide
  Target: ATXN1; (+) strand; PAM type: NRG; PAM sequence: TGG
agcaaagagaaaatgagtca

SEQ ID NO: 150966 - DNA, 20 bp, Artificial Sequence
  Description of Artificial Sequence: Synthetic oligonucleotide
  Target: ATXN1; (+) strand; PAM type: NRG; PAM sequence: AAG
ggatattgtgttaaatatat

SEQ ID NO: 150967 - DNA, 20 bp, Artificial Sequence
  Description of Artificial Sequence: Synthetic oligonucleotide
  Target: ATXN1; (+) strand; PAM type: NRG; PAM sequence: TGG
ttaaatatataagcgttcgc

SEQ ID NO: 150968 - DNA, 20 bp, Artificial Sequence
  Description of Artificial Sequence: Synthetic oligonucleotide
  Target: ATXN1; (+) strand; PAM type: NRG; PAM sequence: TGG
aatgttttctcatctaaact

SEQ ID NO: 150969 - DNA, 20 bp, Artificial Sequence
  Description of Artificial Sequence: Synthetic oligonucleotide
  Target: ATXN1; (+) strand; PAM type: NRG; PAM sequence: GGG
atgttttctcatctaaactt

SEQ ID NO: 150970 - DNA, 20 bp, Artificial Sequence
  Description of Artificial Sequence: Synthetic oligonucleotide
  Target: ATXN1; (+) strand; PAM type: NRG; PAM sequence: GAG
gttttctcatctaaacttgg

SEQ ID NO: 150971 - DNA, 20 bp, Artificial Sequence
  Description of Artificial Sequence: Synthetic oligonucleotide
  Target: ATXN1; (+) strand; PAM type: NRG; PAM sequence: TGG
catctaaacttgggagctgc

SEQ ID NO: 150972 - DNA, 20 bp, Artificial Sequence
  Description of Artificial Sequence: Synthetic oligonucleotide
  Target: ATXN1; (+) strand; PAM type: NRG; PAM sequence: TGG
actcaccctgaaactgcatc

SEQ ID NO: 150973 - DNA, 20 bp, Artificial Sequence
  Description of Artificial Sequence: Synthetic oligonucleotide
  Target: ATXN1; (+) strand; PAM type: NRG; PAM sequence: GGG
ctcaccctgaaactgcatct

SEQ ID NO: 150974 - DNA, 20 bp, Artificial Sequence
  Description of Artificial Sequence: Synthetic oligonucleotide
  Target: ATXN1; (+) strand; PAM type: NRG; PAM sequence: CGG
tgaaactgcatctgggactc

SEQ ID NO: 150975 - DNA, 20 bp, Artificial Sequence
  Description of Artificial Sequence: Synthetic oligonucleotide
  Target: ATXN1; (+) strand; PAM type: NRG; PAM sequence: GAG
aaactgcatctgggactccg

SEQ ID NO: 150976 - DNA, 20 bp, Artificial Sequence
  Description of Artificial Sequence: Synthetic oligonucleotide
  Target: ATXN1; (+) strand; PAM type: NRG; PAM sequence: AAG
gcatctgggactccggagtc

SEQ ID NO: 150977 - DNA, 20 bp, Artificial Sequence
  Description of Artificial Sequence: Synthetic oligonucleotide
  Target: ATXN1; (+) strand; PAM type: NRG; PAM sequence: AAG
caagctctgaataacattca

SEQ ID NO: 150978 - DNA, 20 bp, Artificial Sequence
  Description of Artificial Sequence: Synthetic oligonucleotide
  Target: ATXN1; (+) strand; PAM type: NRG; PAM sequence: TAG
gtattctttcgttcgaattt

SEQ ID NO: 150979 - DNA, 20 bp, Artificial Sequence
  Description of Artificial Sequence: Synthetic oligonucleotide
  Target: ATXN1; (+) strand; PAM type: NRG; PAM sequence: AGG
tattctttcgttcgaatttt

SEQ ID NO: 150980 - DNA, 20 bp, Artificial Sequence
  Description of Artificial Sequence: Synthetic oligonucleotide
  Target: ATXN1; (+) strand; PAM type: NRG; PAM sequence: CAG
tgtcatacctatgtctttta

SEQ ID NO: 150981 - DNA, 20 bp, Artificial Sequence
  Description of Artificial Sequence: Synthetic oligonucleotide
  Target: ATXN1; (+) strand; PAM type: NRG; PAM sequence: GAG
tacagcaatgcaacttaaat

SEQ ID NO: 150982 - DNA, 20 bp, Artificial Sequence
  Description of Artificial Sequence: Synthetic oligonucleotide
  Target: ATXN1; (+) strand; PAM type: NRG; PAM sequence: AGG
acagcaatgcaacttaaatg

SEQ ID NO: 150983 - DNA, 20 bp, Artificial Sequence
  Description of Artificial Sequence: Synthetic oligonucleotide
  Target: ATXN1; (+) strand; PAM type: NRG; PAM sequence: TGG
aaatgaggcaataactgaaa

SEQ ID NO: 150984 - DNA, 20 bp, Artificial Sequence
  Description of Artificial Sequence: Synthetic oligonucleotide
  Target: ATXN1; (+) strand; PAM type: NRG; PAM sequence: CAG
aataactgaaatggcttaac

SEQ ID NO: 150985 - DNA, 20 bp, Artificial Sequence
  Description of Artificial Sequence: Synthetic oligonucleotide
  Target: ATXN1; (+) strand; PAM type: NRG; PAM sequence: AGG
ataactgaaatggcttaacc

SEQ ID NO: 150986 - DNA, 20 bp, Artificial Sequence
  Description of Artificial Sequence: Synthetic oligonucleotide
  Target: ATXN1; (+) strand; PAM type: NRG; PAM sequence: GGG
taactgaaatggcttaacca

SEQ ID NO: 150987 - DNA, 20 bp, Artificial Sequence
  Description of Artificial Sequence: Synthetic oligonucleotide
  Target: ATXN1; (+) strand; PAM type: NRG; PAM sequence: GAG
actgaaatggcttaaccagg

SEQ ID NO: 150988 - DNA, 20 bp, Artificial Sequence
  Description of Artificial Sequence: Synthetic oligonucleotide
  Target: ATXN1; (+) strand; PAM type: NRG; PAM sequence: TGG
atggcttaaccagggagatg

SEQ ID NO: 150989 - DNA, 20 bp, Artificial Sequence
  Description of Artificial Sequence: Synthetic oligonucleotide
  Target: ATXN1; (+) strand; PAM type: NRG; PAM sequence: TAG
ttaaccagggagatgtggtt

SEQ ID NO: 150990 - DNA, 20 bp, Artificial Sequence
  Description of Artificial Sequence: Synthetic oligonucleotide
  Target: ATXN1; (+) strand; PAM type: NRG; PAM sequence: CAG
tttagcaccatgttgcaatc

SEQ ID NO: 150991 - DNA, 20 bp, Artificial Sequence
  Description of Artificial Sequence: Synthetic oligonucleotide
  Target: ATXN1; (+) strand; PAM type: NRG; PAM sequence: TGG
atccagccatccaaccctca

SEQ ID NO: 150992 - DNA, 20 bp, Artificial Sequence
  Description of Artificial Sequence: Synthetic oligonucleotide
  Target: ATXN1; (+) strand; PAM type: NRG; PAM sequence: GAG
ccagccatccaaccctcatg

SEQ ID NO: 150993 - DNA, 20 bp, Artificial Sequence
  Description of Artificial Sequence: Synthetic oligonucleotide
  Target: ATXN1; (+) strand; PAM type: NRG; PAM sequence: AGG
cagccatccaaccctcatgg

SEQ ID NO: 150994 - DNA, 20 bp, Artificial Sequence
  Description of Artificial Sequence: Synthetic oligonucleotide
  Target: ATXN1; (+) strand; PAM type: NRG; PAM sequence: GAG
caaccctcatggaggtctct

SEQ ID NO: 150995 - DNA, 20 bp, Artificial Sequence
  Description of Artificial Sequence: Synthetic oligonucleotide
  Target: ATXN1; (+) strand; PAM type: NRG; PAM sequence: TGG
cctcatggaggtctctgagt

SEQ ID NO: 150996 - DNA, 20 bp, Artificial Sequence
  Description of Artificial Sequence: Synthetic oligonucleotide
  Target: ATXN1; (+) strand; PAM type: NRG; PAM sequence: GGG
ctcatggaggtctctgagtt

SEQ ID NO: 150997 - DNA, 20 bp, Artificial Sequence
  Description of Artificial Sequence: Synthetic oligonucleotide
  Target: ATXN1; (+) strand; PAM type: NRG; PAM sequence: GGG
tcatggaggtctctgagttg

SEQ ID NO: 150998 - DNA, 20 bp, Artificial Sequence
  Description of Artificial Sequence: Synthetic oligonucleotide
  Target: ATXN1; (+) strand; PAM type: NRG; PAM sequence: GGG
catggaggtctctgagttgg

SEQ ID NO: 150999 - DNA, 20 bp, Artificial Sequence
  Description of Artificial Sequence: Synthetic oligonucleotide
  Target: ATXN1; (+) strand; PAM type: NRG; PAM sequence: TGG
tgggggaacctaccaacaac

SEQ ID NO: 151000 - DNA, 20 bp, Artificial Sequence
  Description of Artificial Sequence: Synthetic oligonucleotide
  Target: ATXN1; (+) strand; PAM type: NRG; PAM sequence: GAG
ctaccaacaactggtttact

SEQ ID NO: 151001 - DNA, 20 bp, Artificial Sequence
  Description of Artificial Sequence: Synthetic oligonucleotide
  Target: ATXN1; (+) strand; PAM type: NRG; PAM sequence: CAG
actggtttactgagatctca

SEQ ID NO: 151002 - DNA, 20 bp, Artificial Sequence
  Description of Artificial Sequence: Synthetic oligonucleotide
  Target: ATXN1; (+) strand; PAM type: NRG; PAM sequence: TGG
cagcccacactatgatgctt

SEQ ID NO: 151003 - DNA, 20 bp, Artificial Sequence
  Description of Artificial Sequence: Synthetic oligonucleotide
  Target: ATXN1; (+) strand; PAM type: NRG; PAM sequence: GGG
agcccacactatgatgcttt

SEQ ID NO: 151004 - DNA, 20 bp, Artificial Sequence
  Description of Artificial Sequence: Synthetic oligonucleotide
  Target: ATXN1; (+) strand; PAM type: NRG; PAM sequence: AAG
ctttgggtgccactaactaa

SEQ ID NO: 151005 - DNA, 20 bp, Artificial Sequence
  Description of Artificial Sequence: Synthetic oligonucleotide
  Target: ATXN1; (+) strand; PAM type: NRG; PAM sequence: AGG
tttgggtgccactaactaaa

SEQ ID NO: 151006 - DNA, 20 bp, Artificial Sequence
  Description of Artificial Sequence: Synthetic oligonucleotide
  Target: ATXN1; (+) strand; PAM type: NRG; PAM sequence: CGG
tttttaattatctattgcaa

SEQ ID NO: 151007 - DNA, 20 bp, Artificial Sequence
  Description of Artificial Sequence: Synthetic oligonucleotide
  Target: ATXN1; (+) strand; PAM type: NRG; PAM sequence: TGG
acggttatatttttgttcta

SEQ ID NO: 151008 - DNA, 20 bp, Artificial Sequence
  Description of Artificial Sequence: Synthetic oligonucleotide
  Target: ATXN1; (+) strand; PAM type: NRG; PAM sequence: TGG
tatttttgttctatggattc

SEQ ID NO: 151009 - DNA, 20 bp, Artificial Sequence
  Description of Artificial Sequence: Synthetic oligonucleotide
  Target: ATXN1; (+) strand; PAM type: NRG; PAM sequence: CAG
ctcccacctgattcctgaca

SEQ ID NO: 151010 - DNA, 20 bp, Artificial Sequence
  Description of Artificial Sequence: Synthetic oligonucleotide
  Target: ATXN1; (+) strand; PAM type: NRG; PAM sequence: GAG
cccacctgattcctgacaca

SEQ ID NO: 151011 - DNA, 20 bp, Artificial Sequence
  Description of Artificial Sequence: Synthetic oligonucleotide
  Target: ATXN1; (+) strand; PAM type: NRG; PAM sequence: TGG
gattcctgacacagagaaaa

SEQ ID NO: 151012 - DNA, 20 bp, Artificial Sequence
  Description of Artificial Sequence: Synthetic oligonucleotide
  Target: ATXN1; (+) strand; PAM type: NRG; PAM sequence: CAG
gaaaatggccctctgaacat

SEQ ID NO: 151013 - DNA, 20 bp, Artificial Sequence
  Description of Artificial Sequence: Synthetic oligonucleotide
  Target: ATXN1; (+) strand; PAM type: NRG; PAM sequence: TAG
ccctctgaacatcagtcacg

SEQ ID NO: 151014 - DNA, 20 bp, Artificial Sequence
  Description of Artificial Sequence: Synthetic oligonucleotide
  Target: ATXN1; (+) strand; PAM type: NRG; PAM sequence: AGG
cctctgaacatcagtcacgt

SEQ ID NO: 151015 - DNA, 20 bp, Artificial Sequence
  Description of Artificial Sequence: Synthetic oligonucleotide
  Target: ATXN1; (+) strand; PAM type: NRG; PAM sequence: GGG
ctctgaacatcagtcacgta

SEQ ID NO: 151016 - DNA, 20 bp, Artificial Sequence
  Description of Artificial Sequence: Synthetic oligonucleotide
  Target: ATXN1; (+) strand; PAM type: NRG; PAM sequence: AAG
atcagtcacgtagggtactt

SEQ ID NO: 151017 - DNA, 20 bp, Artificial Sequence
  Description of Artificial Sequence: Synthetic oligonucleotide
  Target: ATXN1; (+) strand; PAM type: NRG; PAM sequence: AGG
tcagtcacgtagggtactta

SEQ ID NO: 151018 - DNA, 20 bp, Artificial Sequence
  Description of Artificial Sequence: Synthetic oligonucleotide
  Target: ATXN1; (+) strand; PAM type: NRG; PAM sequence: AAG
acgtagggtacttaaggact

SEQ ID NO: 151019 - DNA, 20 bp, Artificial Sequence
  Description of Artificial Sequence: Synthetic oligonucleotide
  Target: ATXN1; (+) strand; PAM type: NRG; PAM sequence: TAG
gtacttaaggactaagtgct

SEQ ID NO: 151020 - DNA, 20 bp, Artificial Sequence
  Description of Artificial Sequence: Synthetic oligonucleotide
  Target: ATXN1; (+) strand; PAM type: NRG; PAM sequence: CAG
cttaaggactaagtgcttag

SEQ ID NO: 151021 - DNA, 20 bp, Artificial Sequence
  Description of Artificial Sequence: Synthetic oligonucleotide
  Target: ATXN1; (+) strand; PAM type: NRG; PAM sequence: TGG
taagtgcttagcagtctgtt

SEQ ID NO: 151022 - DNA, 20 bp, Artificial Sequence
  Description of Artificial Sequence: Synthetic oligonucleotide
  Target: ATXN1; (+) strand; PAM type: NRG; PAM sequence: CAG
ttagcagtctgtttggcaca

SEQ ID NO: 151023 - DNA, 20 bp, Artificial Sequence
  Description of Artificial Sequence: Synthetic oligonucleotide
  Target: ATXN1; (+) strand; PAM type: NRG; PAM sequence: TAG
gcagtctgtttggcacacag

SEQ ID NO: 151024 - DNA, 20 bp, Artificial Sequence
  Description of Artificial Sequence: Synthetic oligonucleotide
  Target: ATXN1; (+) strand; PAM type: NRG; PAM sequence: AGG
cagtctgtttggcacacagt

SEQ ID NO: 151025 - DNA, 20 bp, Artificial Sequence
  Description of Artificial Sequence: Synthetic oligonucleotide
  Target: ATXN1; (+) strand; PAM type: NRG; PAM sequence: CAG
gaatgaaaaacctctcatct

SEQ ID NO: 151026 - DNA, 20 bp, Artificial Sequence
  Description of Artificial Sequence: Synthetic oligonucleotide
  Target: ATXN1; (+) strand; PAM type: NRG; PAM sequence: GAG
atgaaaaacctctcatctca

SEQ ID NO: 151027 - DNA, 20 bp, Artificial Sequence
  Description of Artificial Sequence: Synthetic oligonucleotide
  Target: ATXN1; (+) strand; PAM type: NRG; PAM sequence: TGG
aaaacctctcatctcagaga

SEQ ID NO: 151028 - DNA, 20 bp, Artificial Sequence
  Description of Artificial Sequence: Synthetic oligonucleotide
  Target: ATXN1; (+) strand; PAM type: NRG; PAM sequence: CAG
tctcatctcagagatggcaa

SEQ ID NO: 151029 - DNA, 20 bp, Artificial Sequence
  Description of Artificial Sequence: Synthetic oligonucleotide
  Target: ATXN1; (+) strand; PAM type: NRG; PAM sequence: AAG
agatggcaacagattaaaaa

SEQ ID NO: 151030 - DNA, 20 bp, Artificial Sequence
  Description of Artificial Sequence: Synthetic oligonucleotide
  Target: ATXN1; (+) strand; PAM type: NRG; PAM sequence: TGG
aaaaaagaaacttcaaaaat

SEQ ID NO: 151031 - DNA, 20 bp, Artificial Sequence
  Description of Artificial Sequence: Synthetic oligonucleotide
  Target: ATXN1; (+) strand; PAM type: NRG; PAM sequence: AAG
agaaacttcaaaaattggcc

SEQ ID NO: 151032 - DNA, 20 bp, Artificial Sequence
  Description of Artificial Sequence: Synthetic oligonucleotide
  Target: ATXN1; (+) strand; PAM type: NRG; PAM sequence: TGG
caaaaattggccaagcgcga

SEQ ID NO: 151033 - DNA, 20 bp, Artificial Sequence
  Description of Artificial Sequence: Synthetic oligonucleotide
  Target: ATXN1; (+) strand; PAM type: NRG; PAM sequence: CAG
atggcgcacgcctgtaatcc

SEQ ID NO: 151034 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcaatt

SEQ ID NO: 151035 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcaattt

SEQ ID NO: 151036 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcaatttgg

SEQ ID NO: 151037 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcaatttggg

SEQ ID NO: 151038 - DNA, 20 bp, Artificial Sequence
  Description of Artificial Sequence: Synthetic oligonucleotide
  Target: ATXN1; (+) strand; PAM type: NRG; PAM sequence: GAG
tcccagcaatttgggaggct

SEQ ID NO: 151039 - DNA, 20 bp, Artificial Sequence
  Description of Artificial Sequence: Synthetic oligonucleotide
  Target: ATXN1; (+) strand; PAM type: NRG; PAM sequence: AGG
cccagcaatttgggaggctg

SEQ ID NO: 151040 - DNA, 20 bp, Artificial Sequence
  Description of Artificial Sequence: Synthetic oligonucleotide
  Target: ATXN1; (+) strand; PAM type: NRG; PAM sequence: CAG
agcaatttgggaggctgagg

SEQ ID NO: 151041 - DNA, 20 bp, Artificial Sequence
  Description of Artificial Sequence: Synthetic oligonucleotide
  Target: ATXN1; (+) strand; PAM type: NRG; PAM sequence: AGG
gcaatttgggaggctgaggc

SEQ ID NO: 151042 - DNA, 20 bp, Artificial Sequence
  Description of Artificial Sequence: Synthetic oligonucleotide
  Target: ATXN1; (+) strand; PAM type: NRG; PAM sequence: CAG
atttgggaggctgaggcagg

SEQ ID NO: 151043 - DNA, 20 bp, Artificial Sequence
  Description of Artificial Sequence: Synthetic oligonucleotide
  Target: ATXN1; (+) strand; PAM type: NRG; PAM sequence: GAG
ctgaggcaggcagatcactt

SEQ ID NO: 151044 - DNA, 20 bp, Artificial Sequence
  Description of Artificial Sequence: Synthetic oligonucleotide
  Target: ATXN1; (+) strand; PAM type: NRG; PAM sequence: AGG
tgaggcaggcagatcacttg

SEQ ID NO: 151045 - DNA, 20 bp, Artificial Sequence
  Description of Artificial Sequence: Synthetic oligonucleotide
  Target: ATXN1; (+) strand; PAM type: NRG; PAM sequence: CAG
gcaggcagatcacttgaggt

SEQ ID NO: 151046 - DNA, 20 bp, Artificial Sequence
  Description of Artificial Sequence: Synthetic oligonucleotide
  Target: ATXN1; (+) strand; PAM type: NRG; PAM sequence: AGG
caggcagatcacttgaggtc

SEQ ID NO: 151047 - DNA, 20 bp, Artificial Sequence
  Description of Artificial Sequence: Synthetic oligonucleotide
  Target: ATXN1; (+) strand; PAM type: NRG; PAM sequence: GAG
ggcagatcacttgaggtcag

SEQ ID NO: 151048 - DNA, 20 bp, Artificial Sequence
  Description of Artificial Sequence: Synthetic oligonucleotide
  Target: ATXN1; (+) strand; PAM type: NRG; PAM sequence: AAG
tcacttgaggtcaggagttc

SEQ ID NO: 151049 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcaagac

SEQ ID NO: 151050 - DNA, 20 bp, Artificial Sequence
  Description of Artificial Sequence: Synthetic oligonucleotide
  Target: ATXN1; (+) strand; PAM type: NRG; PAM sequence: CGG
caagaccagcctgaccaaca

SEQ ID NO: 151051 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 151052 - DNA, 20 bp, Artificial Sequence
  Description of Artificial Sequence: Synthetic oligonucleotide
  Target: ATXN1; (+) strand; PAM type: NRG; PAM sequence: CGG
ctaaaaatacaaaaattagt

SEQ ID NO: 151053 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattagtc

SEQ ID NO: 151054 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagtcgggca

SEQ ID NO: 151055 - DNA, 20 bp, Artificial Sequence
  Description of Artificial Sequence: Synthetic oligonucleotide
  Target: ATXN1; (+) strand; PAM type: NRG; PAM sequence: TGG
caaaaattagtcgggcatgg

SEQ ID NO: 151056 - DNA, 20 bp, Artificial Sequence
  Description of Artificial Sequence: Synthetic oligonucleotide
  Target: ATXN1; (+) strand; PAM type: NRG; PAM sequence: CAG
catggtggtgcacgcctgta

SEQ ID NO: 151057 - DNA, 20 bp, Artificial Sequence
  Description of Artificial Sequence: Synthetic oligonucleotide
  Target: ATXN1; (+) strand; PAM type: NRG; PAM sequence: CAG
tgcacgcctgtacagctact

SEQ ID NO: 151058 - DNA, 20 bp, Artificial Sequence
  Description of Artificial Sequence: Synthetic oligonucleotide
  Target: ATXN1; (+) strand; PAM type: NRG; PAM sequence: AGG
gcacgcctgtacagctactc

SEQ ID NO: 151059 - DNA, 20 bp, Artificial Sequence
  Description of Artificial Sequence: Synthetic oligonucleotide
  Target: ATXN1; (+) strand; PAM type: NRG; PAM sequence: GAG
acgcctgtacagctactcag

SEQ ID NO: 151060 - DNA, 20 bp, Artificial Sequence
  Description of Artificial Sequence: Synthetic oligonucleotide
  Target: ATXN1; (+) strand; PAM type: NRG; PAM sequence: AGG
cgcctgtacagctactcagg

SEQ ID NO: 151061 - DNA, 20 bp, Artificial Sequence
  Description of Artificial Sequence: Synthetic oligonucleotide
  Target: ATXN1; (+) strand; PAM type: NRG; PAM sequence: TGG
tgtacagctactcaggaggc

SEQ ID NO: 151062 - DNA, 20 bp, Artificial Sequence
  Description of Artificial Sequence: Synthetic oligonucleotide
  Target: ATXN1; (+) strand; PAM type: NRG; PAM sequence: GGG
gtacagctactcaggaggct

SEQ ID NO: 151063 - DNA, 20 bp, Artificial Sequence
  Description of Artificial Sequence: Synthetic oligonucleotide
  Target: ATXN1; (+) strand; PAM type: NRG; PAM sequence: GGG
tacagctactcaggaggctg

SEQ ID NO: 151064 - DNA, 20 bp, Artificial Sequence
  Description of Artificial Sequence: Synthetic oligonucleotide
  Target: ATXN1; (+) strand; PAM type: NRG; PAM sequence: CAG
agctactcaggaggctgggg

SEQ ID NO: 151065 - DNA, 20 bp, Artificial Sequence
  Description of Artificial Sequence: Synthetic oligonucleotide
  Target: ATXN1; (+) strand; PAM type: NRG; PAM sequence: AGG
gctactcaggaggctggggc

SEQ ID NO: 151066 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctggggcag

SEQ ID NO: 151067 - DNA, 20 bp, Artificial Sequence
  Description of Artificial Sequence: Synthetic oligonucleotide
  Target: ATXN1; (+) strand; PAM type: NRG; PAM sequence: CGG
gcaggagaatcacctgaacc

SEQ ID NO: 151068 - DNA, 20 bp, Artificial Sequence
  Description of Artificial Sequence: Synthetic oligonucleotide
  Target: ATXN1; (+) strand; PAM type: NRG; PAM sequence: GGG
caggagaatcacctgaaccc

SEQ ID NO: 151069 - DNA, 20 bp, Artificial Sequence
  Description of Artificial Sequence: Synthetic oligonucleotide
  Target: ATXN1; (+) strand; PAM type: NRG; PAM sequence: GAG
ggagaatcacctgaacccgg

SEQ ID NO: 151070 - DNA, 20 bp, Artificial Sequence
  Description of Artificial Sequence: Synthetic oligonucleotide
  Target: ATXN1; (+) strand; PAM type: NRG; PAM sequence: TGG
aatcacctgaacccgggaga

SEQ ID NO: 151071 - DNA, 20 bp, Artificial Sequence
  Description of Artificial Sequence: Synthetic oligonucleotide
  Target: ATXN1; (+) strand; PAM type: NRG; PAM sequence: CAG
aacccgggagatggacatta

SEQ ID NO: 151072 - DNA, 20 bp, Artificial Sequence
  Description of Artificial Sequence: Synthetic oligonucleotide
  Target: ATXN1; (+) strand; PAM type: NRG; PAM sequence: GAG
gatggacattacagtgacgt

SEQ ID NO: 151073 - DNA, 20 bp, Artificial Sequence
  Description of Artificial Sequence: Synthetic oligonucleotide
  Target: ATXN1; (+) strand; PAM type: NRG; PAM sequence: CAG
gagattgtgccattgcaccc

SEQ ID NO: 151074 - DNA, 20 bp, Artificial Sequence
  Description of Artificial Sequence: Synthetic oligonucleotide
  Target: ATXN1; (+) strand; PAM type: NRG; PAM sequence: TGG
tgtgccattgcaccccagcc

SEQ ID NO: 151075 - DNA, 20 bp, Artificial Sequence
  Description of Artificial Sequence: Synthetic oligonucleotide
  Target: ATXN1; (+) strand; PAM type: NRG; PAM sequence: GGG
gtgccattgcaccccagcct

SEQ ID NO: 151076 - DNA, 20 bp, Artificial Sequence
  Description of Artificial Sequence: Synthetic oligonucleotide
  Target: ATXN1; (+) strand; PAM type: NRG; PAM sequence: CAG
ttgcaccccagcctgggcaa

SEQ ID NO: 151077 - DNA, 20 bp, Artificial Sequence
  Description of Artificial Sequence: Synthetic oligonucleotide
  Target: ATXN1; (+) strand; PAM type: NRG; PAM sequence: GAG
gcaccccagcctgggcaaca

SEQ ID NO: 151078 - DNA, 20 bp, Artificial Sequence
  Description of Artificial Sequence: Synthetic oligonucleotide
  Target: ATXN1; (+) strand; PAM type: NRG; PAM sequence: GAG
cccagcctgggcaacagagt

SEQ ID NO: 151079 - DNA, 20 bp, Artificial Sequence
  Description of Artificial Sequence: Synthetic oligonucleotide
  Target: ATXN1; (+) strand; PAM type: NRG; PAM sequence: GAG
gcctgggcaacagagtgagt

SEQ ID NO: 151080 - DNA, 20 bp, Artificial Sequence
  Description of Artificial Sequence: Synthetic oligonucleotide
  Target: ATXN1; (+) strand; PAM type: NRG; PAM sequence: AGG
cctgggcaacagagtgagtg

SEQ ID NO: 151081 - DNA, 20 bp, Artificial Sequence
  Description of Artificial Sequence: Synthetic oligonucleotide
  Target: ATXN1; (+) strand; PAM type: NRG; PAM sequence: TGG
aaaataaataaattaataaa

SEQ ID NO: 151082 - DNA, 20 bp, Artificial Sequence
  Description of Artificial Sequence: Synthetic oligonucleotide
  Target: ATXN1; (+) strand; PAM type: NRG; PAM sequence: TGG
aatggaaatgaacaataact

SEQ ID NO: 151083 - DNA, 20 bp, Artificial Sequence
  Description of Artificial Sequence: Synthetic oligonucleotide
  Target: ATXN1; (+) strand; PAM type: NRG; PAM sequence: TAG
tggaatttcctttataaaat

SEQ ID NO: 151084 - DNA, 20 bp, Artificial Sequence
  Description of Artificial Sequence: Synthetic oligonucleotide
  Target: ATXN1; (+) strand; PAM type: NRG; PAM sequence: AAG
agatgtctgcatattaaatg

SEQ ID NO: 151085 - DNA, 20 bp, Artificial Sequence
  Description of Artificial Sequence: Synthetic oligonucleotide
  Target: ATXN1; (+) strand; PAM type: NRG; PAM sequence: AAG
cttgattacaatttaaattc

SEQ ID NO: 151086 - DNA, 20 bp, Artificial Sequence
  Description of Artificial Sequence: Synthetic oligonucleotide
  Target: ATXN1; (+) strand; PAM type: NRG; PAM sequence: TAG
tatcactaaaaatcccttta

SEQ ID NO: 151087 - DNA, 20 bp, Artificial Sequence
  Description of Artificial Sequence: Synthetic oligonucleotide
  Target: ATXN1; (+) strand; PAM type: NRG; PAM sequence: AGG
atcactaaaaatccctttat

SEQ ID NO: 151088 - DNA, 20 bp, Artificial Sequence
  Description of Artificial Sequence: Synthetic oligonucleotide
  Target: ATXN1; (+) strand; PAM type: NRG; PAM sequence: TAG
actaaaaatccctttatagg

SEQ ID NO: 151089 - DNA, 20 bp, Artificial Sequence
  Description of Artificial Sequence: Synthetic oligonucleotide
  Target: ATXN1; (+) strand; PAM type: NRG; PAM sequence: AAG
aaaaatccctttataggtag

SEQ ID NO: 151090 - DNA, 20 bp, Artificial Sequence
  Description of Artificial Sequence: Synthetic oligonucleotide
  Target: ATXN1; (+) strand; PAM type: NRG; PAM sequence: TAG
atccctttataggtagaagt

SEQ ID NO: 151091 - DNA, 20 bp, Artificial Sequence
  Description of Artificial Sequence: Synthetic oligonucleotide
  Target: ATXN1; (+) strand; PAM type: NRG; PAM sequence: AGG
tccctttataggtagaagtt

SEQ ID NO: 151092 - DNA, 20 bp, Artificial Sequence
  Description of Artificial Sequence: Synthetic oligonucleotide
  Target: ATXN1; (+) strand; PAM type: NRG; PAM sequence: GGG
ccctttataggtagaagtta

SEQ ID NO: 151093 - DNA, 20 bp, Artificial Sequence
  Description of Artificial Sequence: Synthetic oligonucleotide
  Target: ATXN1; (+) strand; PAM type: NRG; PAM sequence: AAG
ataggtagaagttagggaaa

SEQ ID NO: 151094 - DNA, 20 bp, Artificial Sequence
  Description of Artificial Sequence: Synthetic oligonucleotide
  Target: ATXN1; (+) strand; PAM type: NRG; PAM sequence: AAG
gaaaaagatgtgtgaacgca

SEQ ID NO: 151095 - DNA, 20 bp, Artificial Sequence
  Description of Artificial Sequence: Synthetic oligonucleotide
  Target: ATXN1; (+) strand; PAM type: NRG; PAM sequence: TGG
tgtgtgaacgcaaagctttc

SEQ ID NO: 151096 - DNA, 20 bp, Artificial Sequence
  Description of Artificial Sequence: Synthetic oligonucleotide
  Target: ATXN1; (+) strand; PAM type: NRG; PAM sequence: GAG
tgtgaacgcaaagctttctg

SEQ ID NO: 151097 - DNA, 20 bp, Artificial Sequence
  Description of Artificial Sequence: Synthetic oligonucleotide
  Target: ATXN1; (+) strand; PAM type: NRG; PAM sequence: AAG
cgcaaagctttctggagtta

SEQ ID NO: 151098 - DNA, 20 bp, Artificial Sequence
  Description of Artificial Sequence: Synthetic oligonucleotide
  Target: ATXN1; (+) strand; PAM type: NRG; PAM sequence: AGG
gcaaagctttctggagttaa

SEQ ID NO: 151099 - DNA, 20 bp, Artificial Sequence
  Description of Artificial Sequence: Synthetic oligonucleotide
  Target: ATXN1; (+) strand; PAM type: NRG; PAM sequence: GGG
caaagctttctggagttaaa

SEQ ID NO: 151100 - DNA, 20 bp, Artificial Sequence
  Description of Artificial Sequence: Synthetic oligonucleotide
  Target: ATXN1; (+) strand; PAM type: NRG; PAM sequence: CAG
tctggagttaaagggtaaaa

SEQ ID NO: 151101 - DNA, 20 bp, Artificial Sequence
  Description of Artificial Sequence: Synthetic oligonucleotide
  Target: ATXN1; (+) strand; PAM type: NRG; PAM sequence: CAG
tttcttaattctacaaaata

SEQ ID NO: 151102 - DNA, 20 bp, Artificial Sequence
  Description of Artificial Sequence: Synthetic oligonucleotide
  Target: ATXN1; (+) strand; PAM type: NRG; PAM sequence: AAG
ttaattctacaaaatacaga

SEQ ID NO: 151103 - DNA, 20 bp, Artificial Sequence
  Description of Artificial Sequence: Synthetic oligonucleotide
  Target: ATXN1; (+) strand; PAM type: NRG; PAM sequence: AAG
aaatacagaaagaatattat

SEQ ID NO: 151104 - DNA, 20 bp, Artificial Sequence
  Description of Artificial Sequence: Synthetic oligonucleotide
  Target: ATXN1; (+) strand; PAM type: NRG; PAM sequence: TAG
agaaaatgtcccaccttcct

SEQ ID NO: 151105 - DNA, 20 bp, Artificial Sequence
  Description of Artificial Sequence: Synthetic oligonucleotide
  Target: ATXN1; (+) strand; PAM type: NRG; PAM sequence: AGG
gaaaatgtcccaccttcctt

SEQ ID NO: 151106 - DNA, 20 bp, Artificial Sequence
  Description of Artificial Sequence: Synthetic oligonucleotide
  Target: ATXN1; (+) strand; PAM type: NRG; PAM sequence: AAG
ccttaggaaccatgtgtacc

SEQ ID NO: 151107 - DNA, 20 bp, Artificial Sequence
  Description of Artificial Sequence: Synthetic oligonucleotide
  Target: ATXN1; (+) strand; PAM type: NRG; PAM sequence: TAG
ccatgtgtaccaagactttt

SEQ ID NO: 151108 - DNA, 20 bp, Artificial Sequence
  Description of Artificial Sequence: Synthetic oligonucleotide
  Target: ATXN1; (+) strand; PAM type: NRG; PAM sequence: AGG
catgtgtaccaagacttttt

SEQ ID NO: 151109 - DNA, 20 bp, Artificial Sequence
  Description of Artificial Sequence: Synthetic oligonucleotide
  Target: ATXN1; (+) strand; PAM type: NRG; PAM sequence: TAG
gtaccaagactttttaggaa

SEQ ID NO: 151110 - DNA, 20 bp, Artificial Sequence
  Description of Artificial Sequence: Synthetic oligonucleotide
  Target: ATXN1; (+) strand; PAM type: NRG; PAM sequence: AAG
taggaatagcaccctgcctg

SEQ ID NO: 151111 - DNA, 20 bp, Artificial Sequence
  Description of Artificial Sequence: Synthetic oligonucleotide
  Target: ATXN1; (+) strand; PAM type: NRG; PAM sequence: AAG
tcctaacaaaatttcccttc

SEQ ID NO: 151112 - DNA, 20 bp, Artificial Sequence
  Description of Artificial Sequence: Synthetic oligonucleotide
  Target: ATXN1; (+) strand; PAM type: NRG; PAM sequence: CAG
tctcctttcgttgtgaactt

SEQ ID NO: 151113 - DNA, 20 bp, Artificial Sequence
  Description of Artificial Sequence: Synthetic oligonucleotide
  Target: ATXN1; (+) strand; PAM type: NRG; PAM sequence: TGG
ttcagttattgcctttccac

SEQ ID NO: 151114 - DNA, 20 bp, Artificial Sequence
  Description of Artificial Sequence: Synthetic oligonucleotide
  Target: ATXN1; (+) strand; PAM type: NRG; PAM sequence: AAG
caaccacacatatctttcaa

SEQ ID NO: 151115 - DNA, 20 bp, Artificial Sequence
  Description of Artificial Sequence: Synthetic oligonucleotide
  Target: ATXN1; (+) strand; PAM type: NRG; PAM sequence: AAG
tatctttcaaaagctaattg

SEQ ID NO: 151116 - DNA, 20 bp, Artificial Sequence
  Description of Artificial Sequence: Synthetic oligonucleotide
  Target: ATXN1; (+) strand; PAM type: NRG; PAM sequence: AAG
caaaagctaattgaagcata

SEQ ID NO: 151117 - DNA, 20 bp, Artificial Sequence
  Description of Artificial Sequence: Synthetic oligonucleotide
  Target: ATXN1; (+) strand; PAM type: NRG; PAM sequence: AAG
aagctaattgaagcataaag

SEQ ID NO: 151118 - DNA, 20 bp, Artificial Sequence
  Description of Artificial Sequence: Synthetic oligonucleotide
  Target: ATXN1; (+) strand; PAM type: NRG; PAM sequence: CAG
aagttaaacatgatttattc

SEQ ID NO: 151119 - DNA, 20 bp, Artificial Sequence
  Description of Artificial Sequence: Synthetic oligonucleotide
  Target: ATXN1; (+) strand; PAM type: NRG; PAM sequence: AGG
agttaaacatgatttattcc

SEQ ID NO: 151120 - DNA, 20 bp, Artificial Sequence
  Description of Artificial Sequence: Synthetic oligonucleotide
  Target: ATXN1; (+) strand; PAM type: NRG; PAM sequence: AAG
tttattccaggtcaaatttc

SEQ ID NO: 151121 - DNA, 20 bp, Artificial Sequence
  Description of Artificial Sequence: Synthetic oligonucleotide
  Target: ATXN1; (+) strand; PAM type: NRG; PAM sequence: CAG
ttccaggtcaaatttcaagt

SEQ ID NO: 151122 - DNA, 20 bp, Artificial Sequence
  Description of Artificial Sequence: Synthetic oligonucleotide
  Target: ATXN1; (+) strand; PAM type: NRG; PAM sequence: TGG
caggtcaaatttcaagtcag

SEQ ID NO: 151123 - DNA, 20 bp, Artificial Sequence
  Description of Artificial Sequence: Synthetic oligonucleotide
  Target: ATXN1; (+) strand; PAM type: NRG; PAM sequence: AAG
caaatttcaagtcagtggaa

SEQ ID NO: 151124 - DNA, 20 bp, Artificial Sequence
  Description of Artificial Sequence: Synthetic oligonucleotide
  Target: ATXN1; (+) strand; PAM type: NRG; PAM sequence: CAG
cagtggaaaagccataaata

SEQ ID NO: 151125 - DNA, 20 bp, Artificial Sequence
  Description of Artificial Sequence: Synthetic oligonucleotide
  Target: ATXN1; (+) strand; PAM type: NRG; PAM sequence: GAG
atacagaccttcctcttgct

SEQ ID NO: 151126 - DNA, 20 bp, Artificial Sequence
  Description of Artificial Sequence: Synthetic oligonucleotide
  Target: ATXN1; (+) strand; PAM type: NRG; PAM sequence: TGG
cttcctcttgctgagtgttc

SEQ ID NO: 151127 - DNA, 20 bp, Artificial Sequence
  Description of Artificial Sequence: Synthetic oligonucleotide
  Target: ATXN1; (+) strand; PAM type: NRG; PAM sequence: GGG
ttcctcttgctgagtgttct

SEQ ID NO: 151128 - DNA, 20 bp, Artificial Sequence
  Description of Artificial Sequence: Synthetic oligonucleotide
  Target: ATXN1; (+) strand; PAM type: NRG; PAM sequence: CGG
ttgctgagtgttctgggtgc

SEQ ID NO: 151129 - DNA, 20 bp, Artificial Sequence
  Description of Artificial Sequence: Synthetic oligonucleotide
  Target: ATXN1; (+) strand; PAM type: NRG; PAM sequence: GGG
tgctgagtgttctgggtgcc

SEQ ID NO: 151130 - DNA, 20 bp, Artificial Sequence
  Description of Artificial Sequence: Synthetic oligonucleotide
  Target: ATXN1; (+) strand; PAM type: NRG; PAM sequence: CAG
ctgggtgccgggccatgctg

SEQ ID NO: 151131 - DNA, 20 bp, Artificial Sequence
  Description of Artificial Sequence: Synthetic oligonucleotide
  Target: ATXN1; (+) strand; PAM type: NRG; PAM sequence: AGG
tgggtgccgggccatgctgc

SEQ ID NO: 151132 - DNA, 20 bp, Artificial Sequence
  Description of Artificial Sequence: Synthetic oligonucleotide
  Target: ATXN1; (+) strand; PAM type: NRG; PAM sequence: GGG
gggtgccgggccatgctgca

SEQ ID NO: 151133 - DNA, 20 bp, Artificial Sequence
  Description of Artificial Sequence: Synthetic oligonucleotide
  Target: ATXN1; (+) strand; PAM type: NRG; PAM sequence: TGG
gtgaaattttgacttttgat

SEQ ID NO: 151134 - DNA, 20 bp, Artificial Sequence
  Description of Artificial Sequence: Synthetic oligonucleotide
  Target: ATXN1; (+) strand; PAM type: NRG; PAM sequence: AAG
aaattcctttgtgtatttaa

SEQ ID NO: 151135 - DNA, 20 bp, Artificial Sequence
  Description of Artificial Sequence: Synthetic oligonucleotide
  Target: ATXN1; (+) strand; PAM type: NRG; PAM sequence: TAG
ttcctttgtgtatttaaaag

SEQ ID NO: 151136 - DNA, 20 bp, Artificial Sequence
  Description of Artificial Sequence: Synthetic oligonucleotide
  Target: ATXN1; (+) strand; PAM type: NRG; PAM sequence: AAG
taaaagtagctcatattgac

SEQ ID NO: 151137 - DNA, 20 bp, Artificial Sequence
  Description of Artificial Sequence: Synthetic oligonucleotide
  Target: ATXN1; (+) strand; PAM type: NRG; PAM sequence: TAG
agtagctcatattgacaaga

SEQ ID NO: 151138 - DNA, 20 bp, Artificial Sequence
  Description of Artificial Sequence: Synthetic oligonucleotide
  Target: ATXN1; (+) strand; PAM type: NRG; PAM sequence: AAG
agctcatattgacaagatag

SEQ ID NO: 151139 - DNA, 20 bp, Artificial Sequence
  Description of Artificial Sequence: Synthetic oligonucleotide
  Target: ATXN1; (+) strand; PAM type: NRG; PAM sequence: AGG
gctcatattgacaagataga

SEQ ID NO: 151140 - DNA, 20 bp, Artificial Sequence
  Description of Artificial Sequence: Synthetic oligonucleotide
  Target: ATXN1; (+) strand; PAM type: NRG; PAM sequence: AAG
catattgacaagatagaagg

SEQ ID NO: 151141 - DNA, 20 bp, Artificial Sequence
  Description of Artificial Sequence: Synthetic oligonucleotide
  Target: ATXN1; (+) strand; PAM type: NRG; PAM sequence: AAG
attgacaagatagaaggaag

SEQ ID NO: 151142 - DNA, 20 bp, Artificial Sequence
  Description of Artificial Sequence: Synthetic oligonucleotide
  Target: ATXN1; (+) strand; PAM type: NRG; PAM sequence: TGG
caagatagaaggaagaagct

SEQ ID NO: 151143 - DNA, 20 bp, Artificial Sequence
  Description of Artificial Sequence: Synthetic oligonucleotide
  Target: ATXN1; (+) strand; PAM type: NRG; PAM sequence: TGG
gttgcacaatttcacattcc

SEQ ID NO: 151144 - DNA, 20 bp, Artificial Sequence
  Description of Artificial Sequence: Synthetic oligonucleotide
  Target: ATXN1; (+) strand; PAM type: NRG; PAM sequence: CAG
tcacattcctggacctatca

SEQ ID NO: 151145 - DNA, 20 bp, Artificial Sequence
  Description of Artificial Sequence: Synthetic oligonucleotide
  Target: ATXN1; (+) strand; PAM type: NRG; PAM sequence: AGG
cacattcctggacctatcac

SEQ ID NO: 151146 - DNA, 20 bp, Artificial Sequence
  Description of Artificial Sequence: Synthetic oligonucleotide
  Target: ATXN1; (+) strand; PAM type: NRG; PAM sequence: TGG
ggacctatcacaggtgccac

SEQ ID NO: 151147 - DNA, 20 bp, Artificial Sequence
  Description of Artificial Sequence: Synthetic oligonucleotide
  Target: ATXN1; (+) strand; PAM type: NRG; PAM sequence: AAG
atgcatgtaaaactccctga

SEQ ID NO: 151148 - DNA, 20 bp, Artificial Sequence
  Description of Artificial Sequence: Synthetic oligonucleotide
  Target: ATXN1; (+) strand; PAM type: NRG; PAM sequence: TGG
cctgaaagacactgtataac

SEQ ID NO: 151149 - DNA, 20 bp, Artificial Sequence
  Description of Artificial Sequence: Synthetic oligonucleotide
  Target: ATXN1; (+) strand; PAM type: NRG; PAM sequence: TGG
ctggctcaaatgcctacaaa

SEQ ID NO: 151150 - DNA, 20 bp, Artificial Sequence
  Description of Artificial Sequence: Synthetic oligonucleotide
  Target: ATXN1; (+) strand; PAM type: NRG; PAM sequence: AAG
gctcaaatgcctacaaatgg

SEQ ID NO: 151151 - DNA, 20 bp, Artificial Sequence
  Description of Artificial Sequence: Synthetic oligonucleotide
  Target: ATXN1; (+) strand; PAM type: NRG; PAM sequence: AGG
ctcaaatgcctacaaatgga

SEQ ID NO: 151152 - DNA, 20 bp, Artificial Sequence
  Description of Artificial Sequence: Synthetic oligonucleotide
  Target: ATXN1; (+) strand; PAM type: NRG; PAM sequence: GAG
caaatgcctacaaatggaag

SEQ ID NO: 151153 - DNA, 20 bp, Artificial Sequence
  Description of Artificial Sequence: Synthetic oligonucleotide
  Target: ATXN1; (+) strand; PAM type: NRG; PAM sequence: AGG
aaatgcctacaaatggaagg

SEQ ID NO: 151154 - DNA, 20 bp, Artificial Sequence
  Description of Artificial Sequence: Synthetic oligonucleotide
  Target: ATXN1; (+) strand; PAM type: NRG; PAM sequence: TAG
cctacaaatggaaggaggtt

SEQ ID NO: 151155 - DNA, 20 bp, Artificial Sequence
  Description of Artificial Sequence: Synthetic oligonucleotide
  Target: ATXN1; (+) strand; PAM type: NRG; PAM sequence: TAG
acaaatggaaggaggtttag

SEQ ID NO: 151156 - DNA, 20 bp, Artificial Sequence
  Description of Artificial Sequence: Synthetic oligonucleotide
  Target: ATXN1; (+) strand; PAM type: NRG; PAM sequence: AAG
tatactctatttttcccttt

SEQ ID NO: 151157 - DNA, 20 bp, Artificial Sequence
  Description of Artificial Sequence: Synthetic oligonucleotide
  Target: ATXN1; (+) strand; PAM type: NRG; PAM sequence: GAG
gcaactgaatcacaatccac

SEQ ID NO: 151158 - DNA, 20 bp, Artificial Sequence
  Description of Artificial Sequence: Synthetic oligonucleotide
  Target: ATXN1; (+) strand; PAM type: NRG; PAM sequence: AAG
actgaatcacaatccacgag

SEQ ID NO: 151159 - DNA, 20 bp, Artificial Sequence
  Description of Artificial Sequence: Synthetic oligonucleotide
  Target: ATXN1; (+) strand; PAM type: NRG; PAM sequence: CAG
gaatcacaatccacgagaag

SEQ ID NO: 151160 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaatgctctgcatgt

SEQ ID NO: 151161 - DNA, 20 bp, Artificial Sequence
  Description of Artificial Sequence: Synthetic oligonucleotide
  Target: ATXN1; (+) strand; PAM type: NRG; PAM sequence: GAG
aaaaaatgctctgcatgtaa

SEQ ID NO: 151162 - DNA, 20 bp, Artificial Sequence
  Description of Artificial Sequence: Synthetic oligonucleotide
  Target: ATXN1; (+) strand; PAM type: NRG; PAM sequence: TAG
agagctacactaaactgcac

SEQ ID NO: 151163 - DNA, 20 bp, Artificial Sequence
  Description of Artificial Sequence: Synthetic oligonucleotide
  Target: ATXN1; (+) strand; PAM type: NRG; PAM sequence: AAG
actgcactagaccccgttct

SEQ ID NO: 151164 - DNA, 20 bp, Artificial Sequence
  Description of Artificial Sequence: Synthetic oligonucleotide
  Target: ATXN1; (+) strand; PAM type: NRG; PAM sequence: AAG
actagaccccgttctaagat

SEQ ID NO: 151165 - DNA, 20 bp, Artificial Sequence
  Description of Artificial Sequence: Synthetic oligonucleotide
  Target: ATXN1; (+) strand; PAM type: NRG; PAM sequence: CAG
taagataagacccgtattaa

SEQ ID NO: 151166 - DNA, 20 bp, Artificial Sequence
  Description of Artificial Sequence: Synthetic oligonucleotide
  Target: ATXN1; (+) strand; PAM type: NRG; PAM sequence: GAG
agataagacccgtattaaca

SEQ ID NO: 151167 - DNA, 20 bp, Artificial Sequence
  Description of Artificial Sequence: Synthetic oligonucleotide
  Target: ATXN1; (+) strand; PAM type: NRG; PAM sequence: CAG
aagacccgtattaacagagc

SEQ ID NO: 151168 - DNA, 20 bp, Artificial Sequence
  Description of Artificial Sequence: Synthetic oligonucleotide
  Target: ATXN1; (+) strand; PAM type: NRG; PAM sequence: AGG
agacccgtattaacagagcc

SEQ ID NO: 151169 - DNA, 20 bp, Artificial Sequence
  Description of Artificial Sequence: Synthetic oligonucleotide
  Target: ATXN1; (+) strand; PAM type: NRG; PAM sequence: GGG
gacccgtattaacagagcca

SEQ ID NO: 151170 - DNA, 20 bp, Artificial Sequence
  Description of Artificial Sequence: Synthetic oligonucleotide
  Target: ATXN1; (+) strand; PAM type: NRG; PAM sequence: AAG
ccgtattaacagagccaggg

SEQ ID NO: 151171 - DNA, 20 bp, Artificial Sequence
  Description of Artificial Sequence: Synthetic oligonucleotide
  Target: ATXN1; (+) strand; PAM type: NRG; PAM sequence: AAG
cagagccagggaagaatgaa

SEQ ID NO: 151172 - DNA, 20 bp, Artificial Sequence
  Description of Artificial Sequence: Synthetic oligonucleotide
  Target: ATXN1; (+) strand; PAM type: NRG; PAM sequence: AAG
agccagggaagaatgaaaag

SEQ ID NO: 151173 - DNA, 20 bp, Artificial Sequence
  Description of Artificial Sequence: Synthetic oligonucleotide
  Target: ATXN1; (+) strand; PAM type: NRG; PAM sequence: TGG
gaagaatgaaaagaagattc

SEQ ID NO: 151174 - DNA, 20 bp, Artificial Sequence
  Description of Artificial Sequence: Synthetic oligonucleotide
  Target: ATXN1; (+) strand; PAM type: NRG; PAM sequence: GGG
aagaatgaaaagaagattct

SEQ ID NO: 151175 - DNA, 20 bp, Artificial Sequence
  Description of Artificial Sequence: Synthetic oligonucleotide
  Target: ATXN1; (+) strand; PAM type: NRG; PAM sequence: GAG
gaatgaaaagaagattctgg

SEQ ID NO: 151176 - DNA, 20 bp, Artificial Sequence
  Description of Artificial Sequence: Synthetic oligonucleotide
  Target: ATXN1; (+) strand; PAM type: NRG; PAM sequence: AAG
aaagaagattctgggagtgc

SEQ ID NO: 151177 - DNA, 20 bp, Artificial Sequence
  Description of Artificial Sequence: Synthetic oligonucleotide
  Target: ATXN1; (+) strand; PAM type: NRG; PAM sequence: CAG
ctgggagtgcaagatgcatt

SEQ ID NO: 151178 - DNA, 20 bp, Artificial Sequence
  Description of Artificial Sequence: Synthetic oligonucleotide
  Target: ATXN1; (+) strand; PAM type: NRG; PAM sequence: AGG
tgggagtgcaagatgcattc

SEQ ID NO: 151179 - DNA, 20 bp, Artificial Sequence
  Description of Artificial Sequence: Synthetic oligonucleotide
  Target: ATXN1; (+) strand; PAM type: NRG; PAM sequence: GGG
gggagtgcaagatgcattca

SEQ ID NO: 151180 - DNA, 20 bp, Artificial Sequence
  Description of Artificial Sequence: Synthetic oligonucleotide
  Target: ATXN1; (+) strand; PAM type: NRG; PAM sequence: GGG
ggagtgcaagatgcattcag

SEQ ID NO: 151181 - DNA, 20 bp, Artificial Sequence
  Description of Artificial Sequence: Synthetic oligonucleotide
  Target: ATXN1; (+) strand; PAM type: NRG; PAM sequence: AAG
tcaggggaaaaaaacatcac

SEQ ID NO: 151182 - DNA, 20 bp, Artificial Sequence
  Description of Artificial Sequence: Synthetic oligonucleotide
  Target: ATXN1; (+) strand; PAM type: NRG; PAM sequence: GAG
aaaaaaacatcacaagcact

SEQ ID NO: 151183 - DNA, 20 bp, Artificial Sequence
  Description of Artificial Sequence: Synthetic oligonucleotide
  Target: ATXN1; (+) strand; PAM type: NRG; PAM sequence: GAG
cacaagcactgagctgcaat

SEQ ID NO: 151184 - DNA, 20 bp, Artificial Sequence
  Description of Artificial Sequence: Synthetic oligonucleotide
  Target: ATXN1; (+) strand; PAM type: NRG; PAM sequence: GAG
actgagctgcaatgagaaat

SEQ ID NO: 151185 - DNA, 20 bp, Artificial Sequence
  Description of Artificial Sequence: Synthetic oligonucleotide
  Target: ATXN1; (+) strand; PAM type: NRG; PAM sequence: AGG
ctgagctgcaatgagaaatg

SEQ ID NO: 151186 - DNA, 20 bp, Artificial Sequence
  Description of Artificial Sequence: Synthetic oligonucleotide
  Target: ATXN1; (+) strand; PAM type: NRG; PAM sequence: GGG
tgagctgcaatgagaaatga

SEQ ID NO: 151187 - DNA, 20 bp, Artificial Sequence
  Description of Artificial Sequence: Synthetic oligonucleotide
  Target: ATXN1; (+) strand; PAM type: NRG; PAM sequence: CAG
gcaatgagaaatgagggcat

SEQ ID NO: 151188 - DNA, 20 bp, Artificial Sequence
  Description of Artificial Sequence: Synthetic oligonucleotide
  Target: ATXN1; (+) strand; PAM type: NRG; PAM sequence: GAG
aatgagaaatgagggcatca

SEQ ID NO: 151189 - DNA, 20 bp, Artificial Sequence
  Description of Artificial Sequence: Synthetic oligonucleotide
  Target: ATXN1; (+) strand; PAM type: NRG; PAM sequence: AAG
tcgtcataaaaaaaaatcac

SEQ ID NO: 151190 - DNA, 20 bp, Artificial Sequence
  Description of Artificial Sequence: Synthetic oligonucleotide
  Target: ATXN1; (+) strand; PAM type: NRG; PAM sequence: CAG
aaaaaaatcacaagcatgtg

SEQ ID NO: 151191 - DNA, 20 bp, Artificial Sequence
  Description of Artificial Sequence: Synthetic oligonucleotide
  Target: ATXN1; (+) strand; PAM type: NRG; PAM sequence: TAG
aatcacaagcatgtgcagat

SEQ ID NO: 151192 - DNA, 20 bp, Artificial Sequence
  Description of Artificial Sequence: Synthetic oligonucleotide
  Target: ATXN1; (+) strand; PAM type: NRG; PAM sequence: CAG
acaagcatgtgcagattaga

SEQ ID NO: 151193 - DNA, 20 bp, Artificial Sequence
  Description of Artificial Sequence: Synthetic oligonucleotide
  Target: ATXN1; (+) strand; PAM type: NRG; PAM sequence: GAG
gtgcagattagacagataac

SEQ ID NO: 151194 - DNA, 20 bp, Artificial Sequence
  Description of Artificial Sequence: Synthetic oligonucleotide
  Target: ATXN1; (+) strand; PAM type: NRG; PAM sequence: GAG
gcagattagacagataacga

SEQ ID NO: 151195 - DNA, 20 bp, Artificial Sequence
  Description of Artificial Sequence: Synthetic oligonucleotide
  Target: ATXN1; (+) strand; PAM type: NRG; PAM sequence: GAG
agattagacagataacgaga

SEQ ID NO: 151196 - DNA, 20 bp, Artificial Sequence
  Description of Artificial Sequence: Synthetic oligonucleotide
  Target: ATXN1; (+) strand; PAM type: NRG; PAM sequence: AGG
gattagacagataacgagag

SEQ ID NO: 151197 - DNA, 20 bp, Artificial Sequence
  Description of Artificial Sequence: Synthetic oligonucleotide
  Target: ATXN1; (+) strand; PAM type: NRG; PAM sequence: CGG
ttttttttttttaataaaaa

SEQ ID NO: 151198 - DNA, 20 bp, Artificial Sequence
  Description of Artificial Sequence: Synthetic oligonucleotide
  Target: ATXN1; (+) strand; PAM type: NRG; PAM sequence: GAG
ttttttttttaataaaaacg

SEQ ID NO: 151199 - DNA, 20 bp, Artificial Sequence
  Description of Artificial Sequence: Synthetic oligonucleotide
  Target: ATXN1; (+) strand; PAM type: NRG; PAM sequence: AGG
tttttttttaataaaaacgg

SEQ ID NO: 151200 - DNA, 20 bp, Artificial Sequence
  Description of Artificial Sequence: Synthetic oligonucleotide
  Target: ATXN1; (+) strand; PAM type: NRG; PAM sequence: CAG
gaggtcattcctcttgcttt

SEQ ID NO: 151201 - DNA, 20 bp, Artificial Sequence
  Description of Artificial Sequence: Synthetic oligonucleotide
  Target: ATXN1; (+) strand; PAM type: NRG; PAM sequence: AGG
aggtcattcctcttgctttc

SEQ ID NO: 151202 - DNA, 20 bp, Artificial Sequence
  Description of Artificial Sequence: Synthetic oligonucleotide
  Target: ATXN1; (+) strand; PAM type: NRG; PAM sequence: GAG
gtcattcctcttgctttcag

SEQ ID NO: 151203 - DNA, 20 bp, Artificial Sequence
  Description of Artificial Sequence: Synthetic oligonucleotide
  Target: ATXN1; (+) strand; PAM type: NRG; PAM sequence: CAG
caggagcttgaaaaataaac

SEQ ID NO: 151204 - DNA, 20 bp, Artificial Sequence
  Description of Artificial Sequence: Synthetic oligonucleotide
  Target: ATXN1; (+) strand; PAM type: NRG; PAM sequence: GAG
ggagcttgaaaaataaacca

SEQ ID NO: 151205 - DNA, 20 bp, Artificial Sequence
  Description of Artificial Sequence: Synthetic oligonucleotide
  Target: ATXN1; (+) strand; PAM type: NRG; PAM sequence: AAG
aaaaataaaccagagcgacc

SEQ ID NO: 151206 - DNA, 20 bp, Artificial Sequence
  Description of Artificial Sequence: Synthetic oligonucleotide
  Target: ATXN1; (+) strand; PAM type: NRG; PAM sequence: AGG
aaaataaaccagagcgacca

SEQ ID NO: 151207 - DNA, 20 bp, Artificial Sequence
  Description of Artificial Sequence: Synthetic oligonucleotide
  Target: ATXN1; (+) strand; PAM type: NRG; PAM sequence: GGG
aaataaaccagagcgaccaa

SEQ ID NO: 151208 - DNA, 20 bp, Artificial Sequence
  Description of Artificial Sequence: Synthetic oligonucleotide
  Target: ATXN1; (+) strand; PAM type: NRG; PAM sequence: AAG
ccagagcgaccaagggctgc

SEQ ID NO: 151209 - DNA, 20 bp, Artificial Sequence
  Description of Artificial Sequence: Synthetic oligonucleotide
  Target: ATXN1; (+) strand; PAM type: NRG; PAM sequence: AGG
cagagcgaccaagggctgca

SEQ ID NO: 151210 - DNA, 20 bp, Artificial Sequence
  Description of Artificial Sequence: Synthetic oligonucleotide
  Target: ATXN1; (+) strand; PAM type: NRG; PAM sequence: TGG
gctgcaaggctttgaccttc

SEQ ID NO: 151211 - DNA, 20 bp, Artificial Sequence
  Description of Artificial Sequence: Synthetic oligonucleotide
  Target: ATXN1; (+) strand; PAM type: NRG; PAM sequence: AAG
aaggctttgaccttctggtg

SEQ ID NO: 151212 - DNA, 20 bp, Artificial Sequence
  Description of Artificial Sequence: Synthetic oligonucleotide
  Target: ATXN1; (+) strand; PAM type: NRG; PAM sequence: CAG
ctttgaccttctggtgaaga

SEQ ID NO: 151213 - DNA, 20 bp, Artificial Sequence
  Description of Artificial Sequence: Synthetic oligonucleotide
  Target: ATXN1; (+) strand; PAM type: NRG; PAM sequence: TAG
cttctggtgaagacagcctt

SEQ ID NO: 151214 - DNA, 20 bp, Artificial Sequence
  Description of Artificial Sequence: Synthetic oligonucleotide
  Target: ATXN1; (+) strand; PAM type: NRG; PAM sequence: CAG
ctggtgaagacagcctttag

SEQ ID NO: 151215 - DNA, 20 bp, Artificial Sequence
  Description of Artificial Sequence: Synthetic oligonucleotide
  Target: ATXN1; (+) strand; PAM type: NRG; PAM sequence: AGG
tggtgaagacagcctttagc

SEQ ID NO: 151216 - DNA, 20 bp, Artificial Sequence
  Description of Artificial Sequence: Synthetic oligonucleotide
  Target: ATXN1; (+) strand; PAM type: NRG; PAM sequence: GAG
gtgaagacagcctttagcag

SEQ ID NO: 151217 - DNA, 20 bp, Artificial Sequence
  Description of Artificial Sequence: Synthetic oligonucleotide
  Target: ATXN1; (+) strand; PAM type: NRG; PAM sequence: AGG
tgaagacagcctttagcagg

SEQ ID NO: 151218 - DNA, 20 bp, Artificial Sequence
  Description of Artificial Sequence: Synthetic oligonucleotide
  Target: ATXN1; (+) strand; PAM type: NRG; PAM sequence: CAG
tagcaggaggaacctaatcc

SEQ ID NO: 151219 - DNA, 20 bp, Artificial Sequence
  Description of Artificial Sequence: Synthetic oligonucleotide
  Target: ATXN1; (+) strand; PAM type: NRG; PAM sequence: AGG
agcaggaggaacctaatccc

SEQ ID NO: 151220 - DNA, 20 bp, Artificial Sequence
  Description of Artificial Sequence: Synthetic oligonucleotide
  Target: ATXN1; (+) strand; PAM type: NRG; PAM sequence: AAG
aggaggaacctaatcccagg

SEQ ID NO: 151221 - DNA, 20 bp, Artificial Sequence
  Description of Artificial Sequence: Synthetic oligonucleotide
  Target: ATXN1; (+) strand; PAM type: NRG; PAM sequence: TAG
tttgctttctgctaccacac

SEQ ID NO: 151222 - DNA, 20 bp, Artificial Sequence
  Description of Artificial Sequence: Synthetic oligonucleotide
  Target: ATXN1; (+) strand; PAM type: NRG; PAM sequence: AAG
gctttctgctaccacactag

SEQ ID NO: 151223 - DNA, 20 bp, Artificial Sequence
  Description of Artificial Sequence: Synthetic oligonucleotide
  Target: ATXN1; (+) strand; PAM type: NRG; PAM sequence: TGG
agattacttgatcaaacaaa

SEQ ID NO: 151224 - DNA, 20 bp, Artificial Sequence
  Description of Artificial Sequence: Synthetic oligonucleotide
  Target: ATXN1; (+) strand; PAM type: NRG; PAM sequence: GGG
gattacttgatcaaacaaat

SEQ ID NO: 151225 - DNA, 20 bp, Artificial Sequence
  Description of Artificial Sequence: Synthetic oligonucleotide
  Target: ATXN1; (+) strand; PAM type: NRG; PAM sequence: AAG
gatatctctgtatcatgaaa

SEQ ID NO: 151226 - DNA, 20 bp, Artificial Sequence
  Description of Artificial Sequence: Synthetic oligonucleotide
  Target: ATXN1; (+) strand; PAM type: NRG; PAM sequence: TGG
tacccccacccctcctacac

SEQ ID NO: 151227 - DNA, 20 bp, Artificial Sequence
  Description of Artificial Sequence: Synthetic oligonucleotide
  Target: ATXN1; (+) strand; PAM type: NRG; PAM sequence: TGG
tcctacactggcattctctg

SEQ ID NO: 151228 - DNA, 20 bp, Artificial Sequence
  Description of Artificial Sequence: Synthetic oligonucleotide
  Target: ATXN1; (+) strand; PAM type: NRG; PAM sequence: AAG
actggcattctctgtggtca

SEQ ID NO: 151229 - DNA, 20 bp, Artificial Sequence
  Description of Artificial Sequence: Synthetic oligonucleotide
  Target: ATXN1; (+) strand; PAM type: NRG; PAM sequence: CAG
tgtggtcaaagaatctgttt

SEQ ID NO: 151230 - DNA, 20 bp, Artificial Sequence
  Description of Artificial Sequence: Synthetic oligonucleotide
  Target: ATXN1; (+) strand; PAM type: NRG; PAM sequence: TAG
caaagaatctgtttcagtat

SEQ ID NO: 151231 - DNA, 20 bp, Artificial Sequence
  Description of Artificial Sequence: Synthetic oligonucleotide
  Target: ATXN1; (+) strand; PAM type: NRG; PAM sequence: TAG
ttcagtattagtgttcaata

SEQ ID NO: 151232 - DNA, 20 bp, Artificial Sequence
  Description of Artificial Sequence: Synthetic oligonucleotide
  Target: ATXN1; (+) strand; PAM type: NRG; PAM sequence: AAG
tgttcaatatagcaaatgtc

SEQ ID NO: 151233 - DNA, 20 bp, Artificial Sequence
  Description of Artificial Sequence: Synthetic oligonucleotide
  Target: ATXN1; (+) strand; PAM type: NRG; PAM sequence: AAG
cacatttcctgtgctattta

SEQ ID NO: 151234 - DNA, 20 bp, Artificial Sequence
  Description of Artificial Sequence: Synthetic oligonucleotide
  Target: ATXN1; (+) strand; PAM type: NRG; PAM sequence: AAG
tgtgctatttaaagcaccct

SEQ ID NO: 151235 - DNA, 20 bp, Artificial Sequence
  Description of Artificial Sequence: Synthetic oligonucleotide
  Target: ATXN1; (+) strand; PAM type: NRG; PAM sequence: AAG
ctaagcaattatttgctcta

SEQ ID NO: 151236 - DNA, 20 bp, Artificial Sequence
  Description of Artificial Sequence: Synthetic oligonucleotide
  Target: ATXN1; (+) strand; PAM type: NRG; PAM sequence: TAG
tattaaactgtaaattttct

SEQ ID NO: 151237 - DNA, 20 bp, Artificial Sequence
  Description of Artificial Sequence: Synthetic oligonucleotide
  Target: ATXN1; (+) strand; PAM type: NRG; PAM sequence: TGG
aaactgtaaattttcttagc

SEQ ID NO: 151238 - DNA, 20 bp, Artificial Sequence
  Description of Artificial Sequence: Synthetic oligonucleotide
  Target: ATXN1; (+) strand; PAM type: NRG; PAM sequence: TAG
ttagctggtgccaattccta

SEQ ID NO: 151239 - DNA, 20 bp, Artificial Sequence
  Description of Artificial Sequence: Synthetic oligonucleotide
  Target: ATXN1; (+) strand; PAM type: NRG; PAM sequence: TAG
ggtgccaattcctatagtaa

SEQ ID NO: 151240 - DNA, 20 bp, Artificial Sequence
  Description of Artificial Sequence: Synthetic oligonucleotide
  Target: ATXN1; (+) strand; PAM type: NRG; PAM sequence: CAG
tcctatagtaatagctgtca

SEQ ID NO: 151241 - DNA, 20 bp, Artificial Sequence
  Description of Artificial Sequence: Synthetic oligonucleotide
  Target: ATXN1; (+) strand; PAM type: NRG; PAM sequence: AAG
tagtaatagctgtcacagaa

SEQ ID NO: 151242 - DNA, 20 bp, Artificial Sequence
  Description of Artificial Sequence: Synthetic oligonucleotide
  Target: ATXN1; (+) strand; PAM type: NRG; PAM sequence: TAG
gctgtcacagaaaagtactt

SEQ ID NO: 151243 - DNA, 20 bp, Artificial Sequence
  Description of Artificial Sequence: Synthetic oligonucleotide
  Target: ATXN1; (+) strand; PAM type: NRG; PAM sequence: GAG
tgtcacagaaaagtacttta

SEQ ID NO: 151244 - DNA, 20 bp, Artificial Sequence
  Description of Artificial Sequence: Synthetic oligonucleotide
  Target: ATXN1; (+) strand; PAM type: NRG; PAM sequence: CGG
tactttagagtactcaaaca

SEQ ID NO: 151245 - DNA, 20 bp, Artificial Sequence
  Description of Artificial Sequence: Synthetic oligonucleotide
  Target: ATXN1; (+) strand; PAM type: NRG; PAM sequence: CGG
ctcaaacacggcttttaaac

SEQ ID NO: 151246 - DNA, 20 bp, Artificial Sequence
  Description of Artificial Sequence: Synthetic oligonucleotide
  Target: ATXN1; (+) strand; PAM type: NRG; PAM sequence: AAG
acactcatgctacatttgcc

SEQ ID NO: 151247 - DNA, 20 bp, Artificial Sequence
  Description of Artificial Sequence: Synthetic oligonucleotide
  Target: ATXN1; (+) strand; PAM type: NRG; PAM sequence: TAG
tacatttgccaagacttttc

SEQ ID NO: 151248 - DNA, 20 bp, Artificial Sequence
  Description of Artificial Sequence: Synthetic oligonucleotide
  Target: ATXN1; (+) strand; PAM type: NRG; PAM sequence: TAG
ttctagttgtcatattttta

SEQ ID NO: 151249 - DNA, 20 bp, Artificial Sequence
  Description of Artificial Sequence: Synthetic oligonucleotide
  Target: ATXN1; (+) strand; PAM type: NRG; PAM sequence: GAG
tatttttatagcatgttttt

SEQ ID NO: 151250 - DNA, 20 bp, Artificial Sequence
  Description of Artificial Sequence: Synthetic oligonucleotide
  Target: ATXN1; (+) strand; PAM type: NRG; PAM sequence: TGG
atagcatgtttttgagacaa

SEQ ID NO: 151251 - DNA, 20 bp, Artificial Sequence
  Description of Artificial Sequence: Synthetic oligonucleotide
  Target: ATXN1; (+) strand; PAM type: NRG; PAM sequence: AAG
acaatggactaactgcaaca

SEQ ID NO: 151252 - DNA, 20 bp, Artificial Sequence
  Description of Artificial Sequence: Synthetic oligonucleotide
  Target: ATXN1; (+) strand; PAM type: NRG; PAM sequence: TAG
ctgcaacaaagtgtcatatg

SEQ ID NO: 151253 - DNA, 20 bp, Artificial Sequence
  Description of Artificial Sequence: Synthetic oligonucleotide
  Target: ATXN1; (+) strand; PAM type: NRG; PAM sequence: AAG
tagctcttttttcatatttg

SEQ ID NO: 151254 - DNA, 20 bp, Artificial Sequence
  Description of Artificial Sequence: Synthetic oligonucleotide
  Target: ATXN1; (+) strand; PAM type: NRG; PAM sequence: TAG
ttttcatatttgaagcttta

SEQ ID NO: 151255 - DNA, 20 bp, Artificial Sequence
  Description of Artificial Sequence: Synthetic oligonucleotide
  Target: ATXN1; (+) strand; PAM type: NRG; PAM sequence: AGG
tttcatatttgaagctttat

SEQ ID NO: 151256 - DNA, 20 bp, Artificial Sequence
  Description of Artificial Sequence: Synthetic oligonucleotide
  Target: ATXN1; (+) strand; PAM type: NRG; PAM sequence: TAG
gaagctttataggcacactg

SEQ ID NO: 151257 - DNA, 20 bp, Artificial Sequence
  Description of Artificial Sequence: Synthetic oligonucleotide
  Target: ATXN1; (+) strand; PAM type: NRG; PAM sequence: AAG
tttcaacataatttttctcc

SEQ ID NO: 151258 - DNA, 20 bp, Artificial Sequence
  Description of Artificial Sequence: Synthetic oligonucleotide
  Target: ATXN1; (+) strand; PAM type: NRG; PAM sequence: AAG
ataatttttctccaagcaaa

SEQ ID NO: 151259 - DNA, 20 bp, Artificial Sequence
  Description of Artificial Sequence: Synthetic oligonucleotide
  Target: ATXN1; (+) strand; PAM type: NRG; PAM sequence: GAG
ttttctccaagcaaaaagat

SEQ ID NO: 151260 - DNA, 20 bp, Artificial Sequence
  Description of Artificial Sequence: Synthetic oligonucleotide
  Target: ATXN1; (+) strand; PAM type: NRG; PAM sequence: TAG
ctccaagcaaaaagatgaga

SEQ ID NO: 151261 - DNA, 20 bp, Artificial Sequence
  Description of Artificial Sequence: Synthetic oligonucleotide
  Target: ATXN1; (+) strand; PAM type: NRG; PAM sequence: TAG
gatgagatagaacataaaaa

SEQ ID NO: 151262 - DNA, 20 bp, Artificial Sequence
  Description of Artificial Sequence: Synthetic oligonucleotide
  Target: ATXN1; (+) strand; PAM type: NRG; PAM sequence: AGG
atgagatagaacataaaaat

SEQ ID NO: 151263 - DNA, 20 bp, Artificial Sequence
  Description of Artificial Sequence: Synthetic oligonucleotide
  Target: ATXN1; (+) strand; PAM type: NRG; PAM sequence: CAG
agatagaacataaaaatagg

SEQ ID NO: 151264 - DNA, 20 bp, Artificial Sequence
  Description of Artificial Sequence: Synthetic oligonucleotide
  Target: ATXN1; (+) strand; PAM type: NRG; PAM sequence: TGG
taaaaataggcagacgcaca

SEQ ID NO: 151265 - DNA, 20 bp, Artificial Sequence
  Description of Artificial Sequence: Synthetic oligonucleotide
  Target: ATXN1; (+) strand; PAM type: NRG; PAM sequence: TGG
aatctcatcgttatactgct

SEQ ID NO: 151266 - DNA, 20 bp, Artificial Sequence
  Description of Artificial Sequence: Synthetic oligonucleotide
  Target: ATXN1; (+) strand; PAM type: NRG; PAM sequence: CAG
cgttatactgcttggtgtta

SEQ ID NO: 151267 - DNA, 20 bp, Artificial Sequence
  Description of Artificial Sequence: Synthetic oligonucleotide
  Target: ATXN1; (+) strand; PAM type: NRG; PAM sequence: AGG
gttatactgcttggtgttac

SEQ ID NO: 151268 - DNA, 20 bp, Artificial Sequence
  Description of Artificial Sequence: Synthetic oligonucleotide
  Target: ATXN1; (+) strand; PAM type: NRG; PAM sequence: CAG
tactgcttggtgttacaggc

SEQ ID NO: 151269 - DNA, 20 bp, Artificial Sequence
  Description of Artificial Sequence: Synthetic oligonucleotide
  Target: ATXN1; (+) strand; PAM type: NRG; PAM sequence: TGG
caggccagaatcatgaccat

SEQ ID NO: 151270 - DNA, 20 bp, Artificial Sequence
  Description of Artificial Sequence: Synthetic oligonucleotide
  Target: ATXN1; (+) strand; PAM type: NRG; PAM sequence: CGG
accattggaaaatatcactc

SEQ ID NO: 151271 - DNA, 20 bp, Artificial Sequence
  Description of Artificial Sequence: Synthetic oligonucleotide
  Target: ATXN1; (+) strand; PAM type: NRG; PAM sequence: CGG
ttggaaaatatcactccggc

SEQ ID NO: 151272 - DNA, 20 bp, Artificial Sequence
  Description of Artificial Sequence: Synthetic oligonucleotide
  Target: ATXN1; (+) strand; PAM type: NRG; PAM sequence: GGG
tggaaaatatcactccggcc

SEQ ID NO: 151273 - DNA, 20 bp, Artificial Sequence
  Description of Artificial Sequence: Synthetic oligonucleotide
  Target: ATXN1; (+) strand; PAM type: NRG; PAM sequence: TGG
aatatcactccggccgggtg

SEQ ID NO: 151274 - DNA, 20 bp, Artificial Sequence
  Description of Artificial Sequence: Synthetic oligonucleotide
  Target: ATXN1; (+) strand; PAM type: NRG; PAM sequence: TGG
atcactccggccgggtgtgg

SEQ ID NO: 151275 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 151276 - DNA, 20 bp, Artificial Sequence
  Description of Artificial Sequence: Synthetic oligonucleotide
  Target: ATXN1; (+) strand; PAM type: NRG; PAM sequence: TAG
cgcctgtaatcccagcactt

SEQ ID NO: 151277 - DNA, 20 bp, Artificial Sequence
  Description of Artificial Sequence: Synthetic oligonucleotide
  Target: ATXN1; (+) strand; PAM type: NRG; PAM sequence: AGG
gcctgtaatcccagcacttt

SEQ ID NO: 151278 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttag

SEQ ID NO: 151279 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttagg

SEQ ID NO: 151280 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttaggaggcc

SEQ ID NO: 151281 - DNA, 20 bp, Artificial Sequence
  Description of Artificial Sequence: Synthetic oligonucleotide
  Target: ATXN1; (+) strand; PAM type: NRG; PAM sequence: AGG
cccagcactttaggaggccg

SEQ ID NO: 151282 - DNA, 20 bp, Artificial Sequence
  Description of Artificial Sequence: Synthetic oligonucleotide
  Target: ATXN1; (+) strand; PAM type: NRG; PAM sequence: CAG
agcactttaggaggccgagg

SEQ ID NO: 151283 - DNA, 20 bp, Artificial Sequence
  Description of Artificial Sequence: Synthetic oligonucleotide
  Target: ATXN1; (+) strand; PAM type: NRG; PAM sequence: AGG
gcactttaggaggccgaggc

SEQ ID NO: 151284 - DNA, 20 bp, Artificial Sequence
  Description of Artificial Sequence: Synthetic oligonucleotide
  Target: ATXN1; (+) strand; PAM type: NRG; PAM sequence: TGG
ctttaggaggccgaggcagg

SEQ ID NO: 151285 - DNA, 20 bp, Artificial Sequence
  Description of Artificial Sequence: Synthetic oligonucleotide
  Target: ATXN1; (+) strand; PAM type: NRG; PAM sequence: GAG
ccgaggcaggtggatcactt

SEQ ID NO: 151286 - DNA, 20 bp, Artificial Sequence
  Description of Artificial Sequence: Synthetic oligonucleotide
  Target: ATXN1; (+) strand; PAM type: NRG; PAM sequence: AGG
cgaggcaggtggatcacttg

SEQ ID NO: 151287 - DNA, 20 bp, Artificial Sequence
  Description of Artificial Sequence: Synthetic oligonucleotide
  Target: ATXN1; (+) strand; PAM type: NRG; PAM sequence: CAG
gcaggtggatcacttgaggt

SEQ ID NO: 151288 - DNA, 20 bp, Artificial Sequence
  Description of Artificial Sequence: Synthetic oligonucleotide
  Target: ATXN1; (+) strand; PAM type: NRG; PAM sequence: AGG
caggtggatcacttgaggtc

SEQ ID NO: 151289 - DNA, 20 bp, Artificial Sequence
  Description of Artificial Sequence: Synthetic oligonucleotide
  Target: ATXN1; (+) strand; PAM type: NRG; PAM sequence: GAG
ggtggatcacttgaggtcag

SEQ ID NO: 151290 - DNA, 20 bp, Artificial Sequence
  Description of Artificial Sequence: Synthetic oligonucleotide
  Target: ATXN1; (+) strand; PAM type: NRG; PAM sequence: GAG
tcacttgaggtcaggagttt

SEQ ID NO: 151291 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagtttgagac

SEQ ID NO: 151292 - DNA, 20 bp, Artificial Sequence
  Description of Artificial Sequence: Synthetic oligonucleotide
  Target: ATXN1; (+) strand; PAM type: NRG; PAM sequence: TGG
tcaggagtttgagaccagcc

SEQ ID NO: 151293 - DNA, 20 bp, Artificial Sequence
  Description of Artificial Sequence: Synthetic oligonucleotide
  Target: ATXN1; (+) strand; PAM type: NRG; PAM sequence: TGG
tgagaccagcctggccaaca

SEQ ID NO: 151294 - DNA, 20 bp, Artificial Sequence
  Description of Artificial Sequence: Synthetic oligonucleotide
  Target: ATXN1; (+) strand; PAM type: NRG; PAM sequence: CAG
ctgaaaatacaaaaattaac

SEQ ID NO: 151295 - DNA, 20 bp, Artificial Sequence
  Description of Artificial Sequence: Synthetic oligonucleotide
  Target: ATXN1; (+) strand; PAM type: NRG; PAM sequence: AGG
tgaaaatacaaaaattaacc

SEQ ID NO: 151296 - DNA, 20 bp, Artificial Sequence
  Description of Artificial Sequence: Synthetic oligonucleotide
  Target: ATXN1; (+) strand; PAM type: NRG; PAM sequence: TGG
aaattaaccaggcgtgctaa

SEQ ID NO: 151297 - DNA, 20 bp, Artificial Sequence
  Description of Artificial Sequence: Synthetic oligonucleotide
  Target: ATXN1; (+) strand; PAM type: NRG; PAM sequence: GGG
aattaaccaggcgtgctaat

SEQ ID NO: 151298 - DNA, 20 bp, Artificial Sequence
  Description of Artificial Sequence: Synthetic oligonucleotide
  Target: ATXN1; (+) strand; PAM type: NRG; PAM sequence: CAG
ctaatgggtgcctgtaattc

SEQ ID NO: 151299 - DNA, 20 bp, Artificial Sequence
  Description of Artificial Sequence: Synthetic oligonucleotide
  Target: ATXN1; (+) strand; PAM type: NRG; PAM sequence: TGG
gcctgtaattccagctactt

SEQ ID NO: 151300 - DNA, 20 bp, Artificial Sequence
  Description of Artificial Sequence: Synthetic oligonucleotide
  Target: ATXN1; (+) strand; PAM type: NRG; PAM sequence: GAG
ctgtaattccagctactttg

SEQ ID NO: 151301 - DNA, 20 bp, Artificial Sequence
  Description of Artificial Sequence: Synthetic oligonucleotide
  Target: ATXN1; (+) strand; PAM type: NRG; PAM sequence: AGG
tgtaattccagctactttgg

SEQ ID NO: 151302 - DNA, 20 bp, Artificial Sequence
  Description of Artificial Sequence: Synthetic oligonucleotide
  Target: ATXN1; (+) strand; PAM type: NRG; PAM sequence: GAG
ttccagctactttggaggct

SEQ ID NO: 151303 - DNA, 20 bp, Artificial Sequence
  Description of Artificial Sequence: Synthetic oligonucleotide
  Target: ATXN1; (+) strand; PAM type: NRG; PAM sequence: AGG
tccagctactttggaggctg

SEQ ID NO: 151304 - DNA, 20 bp, Artificial Sequence
  Description of Artificial Sequence: Synthetic oligonucleotide
  Target: ATXN1; (+) strand; PAM type: NRG; PAM sequence: CAG
agctactttggaggctgagg

SEQ ID NO: 151305 - DNA, 20 bp, Artificial Sequence
  Description of Artificial Sequence: Synthetic oligonucleotide
  Target: ATXN1; (+) strand; PAM type: NRG; PAM sequence: AGG
gctactttggaggctgaggc

SEQ ID NO: 151306 - DNA, 20 bp, Artificial Sequence
  Description of Artificial Sequence: Synthetic oligonucleotide
  Target: ATXN1; (+) strand; PAM type: NRG; PAM sequence: GAG
tactttggaggctgaggcag

SEQ ID NO: 151307 - DNA, 20 bp, Artificial Sequence
  Description of Artificial Sequence: Synthetic oligonucleotide
  Target: ATXN1; (+) strand; PAM type: NRG; PAM sequence: CAG
gcaggagaattgcttgaact

SEQ ID NO: 151308 - DNA, 20 bp, Artificial Sequence
  Description of Artificial Sequence: Synthetic oligonucleotide
  Target: ATXN1; (+) strand; PAM type: NRG; PAM sequence: AGG
caggagaattgcttgaactc

SEQ ID NO: 151309 - DNA, 20 bp, Artificial Sequence
  Description of Artificial Sequence: Synthetic oligonucleotide
  Target: ATXN1; (+) strand; PAM type: NRG; PAM sequence: GAG
ggagaattgcttgaactcag

SEQ ID NO: 151310 - DNA, 20 bp, Artificial Sequence
  Description of Artificial Sequence: Synthetic oligonucleotide
  Target: ATXN1; (+) strand; PAM type: NRG; PAM sequence: AGG
gagaattgcttgaactcagg

SEQ ID NO: 151311 - DNA, 20 bp, Artificial Sequence
  Description of Artificial Sequence: Synthetic oligonucleotide
  Target: ATXN1; (+) strand; PAM type: NRG; PAM sequence: CAG
aattgcttgaactcaggagg

SEQ ID NO: 151312 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaactcaggaggca

SEQ ID NO: 151313 - DNA, 20 bp, Artificial Sequence
  Description of Artificial Sequence: Synthetic oligonucleotide
  Target: ATXN1; (+) strand; PAM type: NRG; PAM sequence: AGG
tgcttgaactcaggaggcag

SEQ ID NO: 151314 - DNA, 20 bp, Artificial Sequence
  Description of Artificial Sequence: Synthetic oligonucleotide
  Target: ATXN1; (+) strand; PAM type: NRG; PAM sequence: AAG
caggaggcagaggttgcaat

SEQ ID NO: 151315 - DNA, 20 bp, Artificial Sequence
  Description of Artificial Sequence: Synthetic oligonucleotide
  Target: ATXN1; (+) strand; PAM type: NRG; PAM sequence: GAG
ggcagaggttgcaataagcc

SEQ ID NO: 151316 - DNA, 20 bp, Artificial Sequence
  Description of Artificial Sequence: Synthetic oligonucleotide
  Target: ATXN1; (+) strand; PAM type: NRG; PAM sequence: TGG
gaggttgcaataagccgaga

SEQ ID NO: 151317 - DNA, 20 bp, Artificial Sequence
  Description of Artificial Sequence: Synthetic oligonucleotide
  Target: ATXN1; (+) strand; PAM type: NRG; PAM sequence: AAG
gagatggcaccactccactc

SEQ ID NO: 151318 - DNA, 20 bp, Artificial Sequence
  Description of Artificial Sequence: Synthetic oligonucleotide
  Target: ATXN1; (+) strand; PAM type: NRG; PAM sequence: TGG
ggcaccactccactcaagtc

SEQ ID NO: 151319 - DNA, 20 bp, Artificial Sequence
  Description of Artificial Sequence: Synthetic oligonucleotide
  Target: ATXN1; (+) strand; PAM type: NRG; PAM sequence: GGG
gcaccactccactcaagtct

SEQ ID NO: 151320 - DNA, 20 bp, Artificial Sequence
  Description of Artificial Sequence: Synthetic oligonucleotide
  Target: ATXN1; (+) strand; PAM type: NRG; PAM sequence: CAG
ctccactcaagtctgggtaa

SEQ ID NO: 151321 - DNA, 20 bp, Artificial Sequence
  Description of Artificial Sequence: Synthetic oligonucleotide
  Target: ATXN1; (+) strand; PAM type: NRG; PAM sequence: GAG
ccactcaagtctgggtaaca

SEQ ID NO: 151322 - DNA, 20 bp, Artificial Sequence
  Description of Artificial Sequence: Synthetic oligonucleotide
  Target: ATXN1; (+) strand; PAM type: NRG; PAM sequence: GAG
tcaagtctgggtaacagagt

SEQ ID NO: 151323 - DNA, 20 bp, Artificial Sequence
  Description of Artificial Sequence: Synthetic oligonucleotide
  Target: ATXN1; (+) strand; PAM type: NRG; PAM sequence: AAG
aaaaatcactccatttgata

SEQ ID NO: 151324 - DNA, 20 bp, Artificial Sequence
  Description of Artificial Sequence: Synthetic oligonucleotide
  Target: ATXN1; (+) strand; PAM type: NRG; PAM sequence: TAG
gataaagctccaaatcataa

SEQ ID NO: 151325 - DNA, 20 bp, Artificial Sequence
  Description of Artificial Sequence: Synthetic oligonucleotide
  Target: ATXN1; (+) strand; PAM type: NRG; PAM sequence: AAG
caaatcataatagctgataa

SEQ ID NO: 151326 - DNA, 20 bp, Artificial Sequence
  Description of Artificial Sequence: Synthetic oligonucleotide
  Target: ATXN1; (+) strand; PAM type: NRG; PAM sequence: GAG
aatcataatagctgataaaa

SEQ ID NO: 151327 - DNA, 20 bp, Artificial Sequence
  Description of Artificial Sequence: Synthetic oligonucleotide
  Target: ATXN1; (+) strand; PAM type: NRG; PAM sequence: TAG
ataaaagagtcccccaacac

SEQ ID NO: 151328 - DNA, 20 bp, Artificial Sequence
  Description of Artificial Sequence: Synthetic oligonucleotide
  Target: ATXN1; (+) strand; PAM type: NRG; PAM sequence: AAG
cccccaacactagttctata

SEQ ID NO: 151329 - DNA, 20 bp, Artificial Sequence
  Description of Artificial Sequence: Synthetic oligonucleotide
  Target: ATXN1; (+) strand; PAM type: NRG; PAM sequence: AGG
ccccaacactagttctataa

SEQ ID NO: 151330 - DNA, 20 bp, Artificial Sequence
  Description of Artificial Sequence: Synthetic oligonucleotide
  Target: ATXN1; (+) strand; PAM type: NRG; PAM sequence: GGG
cccaacactagttctataaa

SEQ ID NO: 151331 - DNA, 20 bp, Artificial Sequence
  Description of Artificial Sequence: Synthetic oligonucleotide
  Target: ATXN1; (+) strand; PAM type: NRG; PAM sequence: CAG
tttacacatacaaatgcatg

SEQ ID NO: 151332 - DNA, 20 bp, Artificial Sequence
  Description of Artificial Sequence: Synthetic oligonucleotide
  Target: ATXN1; (+) strand; PAM type: NRG; PAM sequence: AAG
tgcagcacttgaaaaatatt

SEQ ID NO: 151333 - DNA, 20 bp, Artificial Sequence
  Description of Artificial Sequence: Synthetic oligonucleotide
  Target: ATXN1; (+) strand; PAM type: NRG; PAM sequence: AAG
tacatatgtaaatatgtgca

SEQ ID NO: 151334 - DNA, 20 bp, Artificial Sequence
  Description of Artificial Sequence: Synthetic oligonucleotide
  Target: ATXN1; (+) strand; PAM type: NRG; PAM sequence: AAG
tctacatgtatgcccttatt

SEQ ID NO: 151335 - DNA, 20 bp, Artificial Sequence
  Description of Artificial Sequence: Synthetic oligonucleotide
  Target: ATXN1; (+) strand; PAM type: NRG; PAM sequence: TAG
taagtacttttatgtttgac

SEQ ID NO: 151336 - DNA, 20 bp, Artificial Sequence
  Description of Artificial Sequence: Synthetic oligonucleotide
  Target: ATXN1; (+) strand; PAM type: NRG; PAM sequence: TAG
tgcttcttttgaaatctttt

SEQ ID NO: 151337 - DNA, 20 bp, Artificial Sequence
  Description of Artificial Sequence: Synthetic oligonucleotide
  Target: ATXN1; (+) strand; PAM type: NRG; PAM sequence: TGG
tacatgtttttgtaatttca

SEQ ID NO: 151338 - DNA, 20 bp, Artificial Sequence
  Description of Artificial Sequence: Synthetic oligonucleotide
  Target: ATXN1; (+) strand; PAM type: NRG; PAM sequence: AAG
atgtttttgtaatttcatgg

SEQ ID NO: 151339 - DNA, 20 bp, Artificial Sequence
  Description of Artificial Sequence: Synthetic oligonucleotide
  Target: ATXN1; (+) strand; PAM type: NRG; PAM sequence: AAG
atttcatggaagtaaattaa

SEQ ID NO: 151340 - DNA, 20 bp, Artificial Sequence
  Description of Artificial Sequence: Synthetic oligonucleotide
  Target: ATXN1; (+) strand; PAM type: NRG; PAM sequence: TAG
gaagtaaattaaaagtaaca

SEQ ID NO: 151341 - DNA, 20 bp, Artificial Sequence
  Description of Artificial Sequence: Synthetic oligonucleotide
  Target: ATXN1; (+) strand; PAM type: NRG; PAM sequence: CAG
acatagttctaaatcctaaa

SEQ ID NO: 151342 - DNA, 20 bp, Artificial Sequence
  Description of Artificial Sequence: Synthetic oligonucleotide
  Target: ATXN1; (+) strand; PAM type: NRG; PAM sequence: AAG
gttctaaatcctaaacagct

SEQ ID NO: 151343 - DNA, 20 bp, Artificial Sequence
  Description of Artificial Sequence: Synthetic oligonucleotide
  Target: ATXN1; (+) strand; PAM type: NRG; PAM sequence: CAG
taaattgccacctccatcta

SEQ ID NO: 151344 - DNA, 20 bp, Artificial Sequence
  Description of Artificial Sequence: Synthetic oligonucleotide
  Target: ATXN1; (+) strand; PAM type: NRG; PAM sequence: TGG
cctccatctacagaattgta

SEQ ID NO: 151345 - DNA, 20 bp, Artificial Sequence
  Description of Artificial Sequence: Synthetic oligonucleotide
  Target: ATXN1; (+) strand; PAM type: NRG; PAM sequence: TGG
tggcccttgaaaaacttcca

SEQ ID NO: 151346 - DNA, 20 bp, Artificial Sequence
  Description of Artificial Sequence: Synthetic oligonucleotide
  Target: ATXN1; (+) strand; PAM type: NRG; PAM sequence: GAG
cttgaaaaacttccatggat

SEQ ID NO: 151347 - DNA, 20 bp, Artificial Sequence
  Description of Artificial Sequence: Synthetic oligonucleotide
  Target: ATXN1; (+) strand; PAM type: NRG; PAM sequence: AAG
caatttgcaaccaaaaccaa

SEQ ID NO: 151348 - DNA, 20 bp, Artificial Sequence
  Description of Artificial Sequence: Synthetic oligonucleotide
  Target: ATXN1; (+) strand; PAM type: NRG; PAM sequence: TAG
ctttacctattttttaaatg

SEQ ID NO: 151349 - DNA, 20 bp, Artificial Sequence
  Description of Artificial Sequence: Synthetic oligonucleotide
  Target: ATXN1; (+) strand; PAM type: NRG; PAM sequence: AAG
acatattttccaaccgatga

SEQ ID NO: 151350 - DNA, 20 bp, Artificial Sequence
  Description of Artificial Sequence: Synthetic oligonucleotide
  Target: ATXN1; (+) strand; PAM type: NRG; PAM sequence: CGG
ttctcttattcctgccatgc

SEQ ID NO: 151351 - DNA, 20 bp, Artificial Sequence
  Description of Artificial Sequence: Synthetic oligonucleotide
  Target: ATXN1; (+) strand; PAM type: NRG; PAM sequence: GGG
tctcttattcctgccatgcc

SEQ ID NO: 151352 - DNA, 20 bp, Artificial Sequence
  Description of Artificial Sequence: Synthetic oligonucleotide
  Target: ATXN1; (+) strand; PAM type: NRG; PAM sequence: GAG
gccatgccgggacccattct

SEQ ID NO: 151353 - DNA, 20 bp, Artificial Sequence
  Description of Artificial Sequence: Synthetic oligonucleotide
  Target: ATXN1; (+) strand; PAM type: NRG; PAM sequence: CAG
gagttttacacccaccatac

SEQ ID NO: 151354 - DNA, 20 bp, Artificial Sequence
  Description of Artificial Sequence: Synthetic oligonucleotide
  Target: ATXN1; (+) strand; PAM type: NRG; PAM sequence: AGG
agttttacacccaccatacc

SEQ ID NO: 151355 - DNA, 20 bp, Artificial Sequence
  Description of Artificial Sequence: Synthetic oligonucleotide
  Target: ATXN1; (+) strand; PAM type: NRG; PAM sequence: AAG
caggtattactacttgctga

SEQ ID NO: 151356 - DNA, 20 bp, Artificial Sequence
  Description of Artificial Sequence: Synthetic oligonucleotide
  Target: ATXN1; (+) strand; PAM type: NRG; PAM sequence: AAG
cttgctgaaagcctgcatta

SEQ ID NO: 151357 - DNA, 20 bp, Artificial Sequence
  Description of Artificial Sequence: Synthetic oligonucleotide
  Target: ATXN1; (+) strand; PAM type: NRG; PAM sequence: AAG
aaagcctgcattaaagcatt

SEQ ID NO: 151358 - DNA, 20 bp, Artificial Sequence
  Description of Artificial Sequence: Synthetic oligonucleotide
  Target: ATXN1; (+) strand; PAM type: NRG; PAM sequence: AGG
aagcctgcattaaagcatta

SEQ ID NO: 151359 - DNA, 20 bp, Artificial Sequence
  Description of Artificial Sequence: Synthetic oligonucleotide
  Target: ATXN1; (+) strand; PAM type: NRG; PAM sequence: GGG
agcctgcattaaagcattaa

SEQ ID NO: 151360 - DNA, 20 bp, Artificial Sequence
  Description of Artificial Sequence: Synthetic oligonucleotide
  Target: ATXN1; (+) strand; PAM type: NRG; PAM sequence: AAG
aagcattaagggacaacaac

SEQ ID NO: 151361 - DNA, 20 bp, Artificial Sequence
  Description of Artificial Sequence: Synthetic oligonucleotide
  Target: ATXN1; (+) strand; PAM type: NRG; PAM sequence: AGG
agcattaagggacaacaaca

SEQ ID NO: 151362 - DNA, 20 bp, Artificial Sequence
  Description of Artificial Sequence: Synthetic oligonucleotide
  Target: ATXN1; (+) strand; PAM type: NRG; PAM sequence: TGG
tcttaacatattccacttaa

SEQ ID NO: 151363 - DNA, 20 bp, Artificial Sequence
  Description of Artificial Sequence: Synthetic oligonucleotide
  Target: ATXN1; (+) strand; PAM type: NRG; PAM sequence: AAG
tggtttttgattgtgttatg

SEQ ID NO: 151364 - DNA, 20 bp, Artificial Sequence
  Description of Artificial Sequence: Synthetic oligonucleotide
  Target: ATXN1; (+) strand; PAM type: NRG; PAM sequence: TGG
gttatgaagtgccctcacat

SEQ ID NO: 151365 - DNA, 20 bp, Artificial Sequence
  Description of Artificial Sequence: Synthetic oligonucleotide
  Target: ATXN1; (+) strand; PAM type: NRG; PAM sequence: AAG
ccaaaaatgtttgctatttt

SEQ ID NO: 151366 - DNA, 20 bp, Artificial Sequence
  Description of Artificial Sequence: Synthetic oligonucleotide
  Target: ATXN1; (+) strand; PAM type: NRG; PAM sequence: GAG
aaaaatgtttgctattttaa

SEQ ID NO: 151367 - DNA, 20 bp, Artificial Sequence
  Description of Artificial Sequence: Synthetic oligonucleotide
  Target: ATXN1; (+) strand; PAM type: NRG; PAM sequence: AAG
attttaagagccacactatt

SEQ ID NO: 151368 - DNA, 20 bp, Artificial Sequence
  Description of Artificial Sequence: Synthetic oligonucleotide
  Target: ATXN1; (+) strand; PAM type: NRG; PAM sequence: AAG
gccacactattaagaaccac

SEQ ID NO: 151369 - DNA, 20 bp, Artificial Sequence
  Description of Artificial Sequence: Synthetic oligonucleotide
  Target: ATXN1; (+) strand; PAM type: NRG; PAM sequence: CAG
cactattaagaaccacaagt

SEQ ID NO: 151370 - DNA, 20 bp, Artificial Sequence
  Description of Artificial Sequence: Synthetic oligonucleotide
  Target: ATXN1; (+) strand; PAM type: NRG; PAM sequence: CAG
attaagaaccacaagtcagc

SEQ ID NO: 151371 - DNA, 20 bp, Artificial Sequence
  Description of Artificial Sequence: Synthetic oligonucleotide
  Target: ATXN1; (+) strand; PAM type: NRG; PAM sequence: AGG
ttaagaaccacaagtcagcc

SEQ ID NO: 151372 - DNA, 20 bp, Artificial Sequence
  Description of Artificial Sequence: Synthetic oligonucleotide
  Target: ATXN1; (+) strand; PAM type: NRG; PAM sequence: CGG
aaccacaagtcagccaggca

SEQ ID NO: 151373 - DNA, 20 bp, Artificial Sequence
  Description of Artificial Sequence: Synthetic oligonucleotide
  Target: ATXN1; (+) strand; PAM type: NRG; PAM sequence: CAG
cacaagtcagccaggcacgg

SEQ ID NO: 151374 - DNA, 20 bp, Artificial Sequence
  Description of Artificial Sequence: Synthetic oligonucleotide
  Target: ATXN1; (+) strand; PAM type: NRG; PAM sequence: TGG
tgtctgtaatcccaacactt

SEQ ID NO: 151375 - DNA, 20 bp, Artificial Sequence
  Description of Artificial Sequence: Synthetic oligonucleotide
  Target: ATXN1; (+) strand; PAM type: NRG; PAM sequence: GGG
gtctgtaatcccaacacttt

SEQ ID NO: 151376 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccaacactttgg

SEQ ID NO: 151377 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccaacactttggg

SEQ ID NO: 151378 - DNA, 20 bp, Artificial Sequence
  Description of Artificial Sequence: Synthetic oligonucleotide
  Target: ATXN1; (+) strand; PAM type: NRG; PAM sequence: GAG
tcccaacactttgggaggcc

SEQ ID NO: 151379 - DNA, 20 bp, Artificial Sequence
  Description of Artificial Sequence: Synthetic oligonucleotide
  Target: ATXN1; (+) strand; PAM type: NRG; PAM sequence: AGG
cccaacactttgggaggccg

SEQ ID NO: 151380 - DNA, 20 bp, Artificial Sequence
  Description of Artificial Sequence: Synthetic oligonucleotide
  Target: ATXN1; (+) strand; PAM type: NRG; PAM sequence: CGG
aacactttgggaggccgagg

SEQ ID NO: 151381 - DNA, 20 bp, Artificial Sequence
  Description of Artificial Sequence: Synthetic oligonucleotide
  Target: ATXN1; (+) strand; PAM type: NRG; PAM sequence: GGG
acactttgggaggccgaggc

SEQ ID NO: 151382 - DNA, 20 bp, Artificial Sequence
  Description of Artificial Sequence: Synthetic oligonucleotide
  Target: ATXN1; (+) strand; PAM type: NRG; PAM sequence: GAG
actttgggaggccgaggcgg

SEQ ID NO: 151383 - DNA, 20 bp, Artificial Sequence
  Description of Artificial Sequence: Synthetic oligonucleotide
  Target: ATXN1; (+) strand; PAM type: NRG; PAM sequence: AGG
ctttgggaggccgaggcggg

SEQ ID NO: 151384 - DNA, 20 bp, Artificial Sequence
  Description of Artificial Sequence: Synthetic oligonucleotide
  Target: ATXN1; (+) strand; PAM type: NRG; PAM sequence: TGG
gggaggccgaggcgggagga

SEQ ID NO: 151385 - DNA, 20 bp, Artificial Sequence
  Description of Artificial Sequence: Synthetic oligonucleotide
  Target: ATXN1; (+) strand; PAM type: NRG; PAM sequence: GAG
ccgaggcgggaggatggctt

SEQ ID NO: 151386 - DNA, 20 bp, Artificial Sequence
  Description of Artificial Sequence: Synthetic oligonucleotide
  Target: ATXN1; (+) strand; PAM type: NRG; PAM sequence: AGG
cgaggcgggaggatggcttg

SEQ ID NO: 151387 - DNA, 20 bp, Artificial Sequence
  Description of Artificial Sequence: Synthetic oligonucleotide
  Target: ATXN1; (+) strand; PAM type: NRG; PAM sequence: AAG
cgggaggatggcttgaggcc

SEQ ID NO: 151388 - DNA, 20 bp, Artificial Sequence
  Description of Artificial Sequence: Synthetic oligonucleotide
  Target: ATXN1; (+) strand; PAM type: NRG; PAM sequence: GAG
ggaggatggcttgaggccaa

SEQ ID NO: 151389 - DNA, 20 bp, Artificial Sequence
  Description of Artificial Sequence: Synthetic oligonucleotide
  Target: ATXN1; (+) strand; PAM type: NRG; PAM sequence: GAG
tggcttgaggccaagagttc

SEQ ID NO: 151390 - DNA, 20 bp, Artificial Sequence
  Description of Artificial Sequence: Synthetic oligonucleotide
  Target: ATXN1; (+) strand; PAM type: NRG; PAM sequence: AAG
tgaggccaagagttcgagac

SEQ ID NO: 151391 - DNA, 20 bp, Artificial Sequence
  Description of Artificial Sequence: Synthetic oligonucleotide
  Target: ATXN1; (+) strand; PAM type: NRG; PAM sequence: TGG
caagagttcgagacaagctt

SEQ ID NO: 151392 - DNA, 20 bp, Artificial Sequence
  Description of Artificial Sequence: Synthetic oligonucleotide
  Target: ATXN1; (+) strand; PAM type: NRG; PAM sequence: TAG
cgagacaagctttggcaaca

SEQ ID NO: 151393 - DNA, 20 bp, Artificial Sequence
  Description of Artificial Sequence: Synthetic oligonucleotide
  Target: ATXN1; (+) strand; PAM type: NRG; PAM sequence: AAG
acaagctttggcaacatagc

SEQ ID NO: 151394 - DNA, 20 bp, Artificial Sequence
  Description of Artificial Sequence: Synthetic oligonucleotide
  Target: ATXN1; (+) strand; PAM type: NRG; PAM sequence: TAG
tacaaaaaaattttaaaaat

SEQ ID NO: 151395 - DNA, 20 bp, Artificial Sequence
  Description of Artificial Sequence: Synthetic oligonucleotide
  Target: ATXN1; (+) strand; PAM type: NRG; PAM sequence: TGG
aaaaaattttaaaaattagt

SEQ ID NO: 151396 - DNA, 20 bp, Artificial Sequence
  Description of Artificial Sequence: Synthetic oligonucleotide
  Target: ATXN1; (+) strand; PAM type: NRG; PAM sequence: GGG
aaaaattttaaaaattagtt

SEQ ID NO: 151397 - DNA, 20 bp, Artificial Sequence
  Description of Artificial Sequence: Synthetic oligonucleotide
  Target: ATXN1; (+) strand; PAM type: NRG; PAM sequence: TGG
ttttaaaaattagttgggtg

SEQ ID NO: 151398 - DNA, 20 bp, Artificial Sequence
  Description of Artificial Sequence: Synthetic oligonucleotide
  Target: ATXN1; (+) strand; PAM type: NRG; PAM sequence: TGG
taaaaattagttgggtgtgg

SEQ ID NO: 151399 - DNA, 20 bp, Artificial Sequence
  Description of Artificial Sequence: Synthetic oligonucleotide
  Target: ATXN1; (+) strand; PAM type: NRG; PAM sequence: CAG
tagttgggtgtggtggtgca

SEQ ID NO: 151400 - DNA, 20 bp, Artificial Sequence
  Description of Artificial Sequence: Synthetic oligonucleotide
  Target: ATXN1; (+) strand; PAM type: NRG; PAM sequence: CGG
ttgggtgtggtggtgcacag

SEQ ID NO: 151401 - DNA, 20 bp, Artificial Sequence
  Description of Artificial Sequence: Synthetic oligonucleotide
  Target: ATXN1; (+) strand; PAM type: NRG; PAM sequence: CAG
ggtgtggtggtgcacagcgg

SEQ ID NO: 151402 - DNA, 20 bp, Artificial Sequence
  Description of Artificial Sequence: Synthetic oligonucleotide
  Target: ATXN1; (+) strand; PAM type: NRG; PAM sequence: CAG
gtggtgcacagcggcagtcc

SEQ ID NO: 151403 - DNA, 20 bp, Artificial Sequence
  Description of Artificial Sequence: Synthetic oligonucleotide
  Target: ATXN1; (+) strand; PAM type: NRG; PAM sequence: CGG
cagcggcagtcccagctaat

SEQ ID NO: 151404 - DNA, 20 bp, Artificial Sequence
  Description of Artificial Sequence: Synthetic oligonucleotide
  Target: ATXN1; (+) strand; PAM type: NRG; PAM sequence: GGG
agcggcagtcccagctaatc

SEQ ID NO: 151405 - DNA, 20 bp, Artificial Sequence
  Description of Artificial Sequence: Synthetic oligonucleotide
  Target: ATXN1; (+) strand; PAM type: NRG; PAM sequence: GAG
cggcagtcccagctaatcgg

SEQ ID NO: 151406 - DNA, 20 bp, Artificial Sequence
  Description of Artificial Sequence: Synthetic oligonucleotide
  Target: ATXN1; (+) strand; PAM type: NRG; PAM sequence: AGG
ggcagtcccagctaatcggg

SEQ ID NO: 151407 - DNA, 20 bp, Artificial Sequence
  Description of Artificial Sequence: Synthetic oligonucleotide
  Target: ATXN1; (+) strand; PAM type: NRG; PAM sequence: GAG
tcccagctaatcgggaggct

SEQ ID NO: 151408 - DNA, 20 bp, Artificial Sequence
  Description of Artificial Sequence: Synthetic oligonucleotide
  Target: ATXN1; (+) strand; PAM type: NRG; PAM sequence: AGG
cccagctaatcgggaggctg

SEQ ID NO: 151409 - DNA, 20 bp, Artificial Sequence
  Description of Artificial Sequence: Synthetic oligonucleotide
  Target: ATXN1; (+) strand; PAM type: NRG; PAM sequence: TAG
agctaatcgggaggctgagg

SEQ ID NO: 151410 - DNA, 20 bp, Artificial Sequence
  Description of Artificial Sequence: Synthetic oligonucleotide
  Target: ATXN1; (+) strand; PAM type: NRG; PAM sequence: AGG
gctaatcgggaggctgaggt

SEQ ID NO: 151411 - DNA, 20 bp, Artificial Sequence
  Description of Artificial Sequence: Synthetic oligonucleotide
  Target: ATXN1; (+) strand; PAM type: NRG; PAM sequence: GAG
taatcgggaggctgaggtag

SEQ ID NO: 151412 - DNA, 20 bp, Artificial Sequence
  Description of Artificial Sequence: Synthetic oligonucleotide
  Target: ATXN1; (+) strand; PAM type: NRG; PAM sequence: AGG
aatcgggaggctgaggtagg

SEQ ID NO: 151413 - DNA, 20 bp, Artificial Sequence
  Description of Artificial Sequence: Synthetic oligonucleotide
  Target: ATXN1; (+) strand; PAM type: NRG; PAM sequence: GAG
ctgaggtaggaggatcactt

SEQ ID NO: 151414 - DNA, 20 bp, Artificial Sequence
  Description of Artificial Sequence: Synthetic oligonucleotide
  Target: ATXN1; (+) strand; PAM type: NRG; PAM sequence: AAG
taggaggatcacttgagccc

SEQ ID NO: 151415 - DNA, 20 bp, Artificial Sequence
  Description of Artificial Sequence: Synthetic oligonucleotide
  Target: ATXN1; (+) strand; PAM type: NRG; PAM sequence: AGG
aggaggatcacttgagccca

SEQ ID NO: 151416 - DNA, 20 bp, Artificial Sequence
  Description of Artificial Sequence: Synthetic oligonucleotide
  Target: ATXN1; (+) strand; PAM type: NRG; PAM sequence: GGG
ggaggatcacttgagcccaa

SEQ ID NO: 151417 - DNA, 20 bp, Artificial Sequence
  Description of Artificial Sequence: Synthetic oligonucleotide
  Target: ATXN1; (+) strand; PAM type: NRG; PAM sequence: AAG
tcacttgagcccaagggttc

SEQ ID NO: 151418 - DNA, 20 bp, Artificial Sequence
  Description of Artificial Sequence: Synthetic oligonucleotide
  Target: ATXN1; (+) strand; PAM type: NRG; PAM sequence: AGG
cacttgagcccaagggttca

SEQ ID NO: 151419 - DNA, 20 bp, Artificial Sequence
  Description of Artificial Sequence: Synthetic oligonucleotide
  Target: ATXN1; (+) strand; PAM type: NRG; PAM sequence: CAG
agcccaagggttcaaggctg

SEQ ID NO: 151420 - DNA, 20 bp, Artificial Sequence
  Description of Artificial Sequence: Synthetic oligonucleotide
  Target: ATXN1; (+) strand; PAM type: NRG; PAM sequence: AAG
aagggttcaaggctgcagta

SEQ ID NO: 151421 - DNA, 20 bp, Artificial Sequence
  Description of Artificial Sequence: Synthetic oligonucleotide
  Target: ATXN1; (+) strand; PAM type: NRG; PAM sequence: CAG
gtgatcatgccactgcactc

SEQ ID NO: 151422 - DNA, 20 bp, Artificial Sequence
  Description of Artificial Sequence: Synthetic oligonucleotide
  Target: ATXN1; (+) strand; PAM type: NRG; PAM sequence: CGG
catgccactgcactccagtt

SEQ ID NO: 151423 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagttcggacaa

SEQ ID NO: 151424 - DNA, 20 bp, Artificial Sequence
  Description of Artificial Sequence: Synthetic oligonucleotide
  Target: ATXN1; (+) strand; PAM type: NRG; PAM sequence: GAG
tccagttcggacaacagact

SEQ ID NO: 151425 - DNA, 20 bp, Artificial Sequence
  Description of Artificial Sequence: Synthetic oligonucleotide
  Target: ATXN1; (+) strand; PAM type: NRG; PAM sequence: TGG
cagactgagaactgacctct

SEQ ID NO: 151426 - DNA, 20 bp, Artificial Sequence
  Description of Artificial Sequence: Synthetic oligonucleotide
  Target: ATXN1; (+) strand; PAM type: NRG; PAM sequence: AAG
ctgacctcttggaaaaaaaa

SEQ ID NO: 151427 - DNA, 20 bp, Artificial Sequence
  Description of Artificial Sequence: Synthetic oligonucleotide
  Target: ATXN1; (+) strand; PAM type: NRG; PAM sequence: CAG
tcttggaaaaaaaaaagaaa

SEQ ID NO: 151428 - DNA, 20 bp, Artificial Sequence
  Description of Artificial Sequence: Synthetic oligonucleotide
  Target: ATXN1; (+) strand; PAM type: NRG; PAM sequence: AGG
cttggaaaaaaaaaagaaac

SEQ ID NO: 151429 - DNA, 20 bp, Artificial Sequence
  Description of Artificial Sequence: Synthetic oligonucleotide
  Target: ATXN1; (+) strand; PAM type: NRG; PAM sequence: CAG
gaaaaaaaaaagaaacaggc

SEQ ID NO: 151430 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaagaaacaggcc

SEQ ID NO: 151431 - DNA, 20 bp, Artificial Sequence
  Description of Artificial Sequence: Synthetic oligonucleotide
  Target: ATXN1; (+) strand; PAM type: NRG; PAM sequence: TGG
aaaaagaaacaggccaggca

SEQ ID NO: 151432 - DNA, 20 bp, Artificial Sequence
  Description of Artificial Sequence: Synthetic oligonucleotide
  Target: ATXN1; (+) strand; PAM type: NRG; PAM sequence: TGG
aagaaacaggccaggcatgg

SEQ ID NO: 151433 - DNA, 20 bp, Artificial Sequence
  Description of Artificial Sequence: Synthetic oligonucleotide
  Target: ATXN1; (+) strand; PAM type: NRG; PAM sequence: CGG
gtggttcacacctataatcc

SEQ ID NO: 151434 - DNA, 20 bp, Artificial Sequence
  Description of Artificial Sequence: Synthetic oligonucleotide
  Target: ATXN1; (+) strand; PAM type: NRG; PAM sequence: TGG
cacctataatcccggtactt

SEQ ID NO: 151435 - DNA, 20 bp, Artificial Sequence
  Description of Artificial Sequence: Synthetic oligonucleotide
  Target: ATXN1; (+) strand; PAM type: NRG; PAM sequence: GGG
acctataatcccggtacttt

SEQ ID NO: 151436 - DNA, 20 bp, Artificial Sequence
  Description of Artificial Sequence: Synthetic oligonucleotide
  Target: ATXN1; (+) strand; PAM type: NRG; PAM sequence: GAG
ctataatcccggtactttgg

SEQ ID NO: 151437 - DNA, 20 bp, Artificial Sequence
  Description of Artificial Sequence: Synthetic oligonucleotide
  Target: ATXN1; (+) strand; PAM type: NRG; PAM sequence: AGG
tataatcccggtactttggg

SEQ ID NO: 151438 - DNA, 20 bp, Artificial Sequence
  Description of Artificial Sequence: Synthetic oligonucleotide
  Target: ATXN1; (+) strand; PAM type: NRG; PAM sequence: GAG
tcccggtactttgggaggcc

SEQ ID NO: 151439 - DNA, 20 bp, Artificial Sequence
  Description of Artificial Sequence: Synthetic oligonucleotide
  Target: ATXN1; (+) strand; PAM type: NRG; PAM sequence: AGG
cccggtactttgggaggccg

SEQ ID NO: 151440 - DNA, 20 bp, Artificial Sequence
  Description of Artificial Sequence: Synthetic oligonucleotide
  Target: ATXN1; (+) strand; PAM type: NRG; PAM sequence: CGG
gtactttgggaggccgaggt

SEQ ID NO: 151441 - DNA, 20 bp, Artificial Sequence
  Description of Artificial Sequence: Synthetic oligonucleotide
  Target: ATXN1; (+) strand; PAM type: NRG; PAM sequence: GGG
tactttgggaggccgaggtc

SEQ ID NO: 151442 - DNA, 20 bp, Artificial Sequence
  Description of Artificial Sequence: Synthetic oligonucleotide
  Target: ATXN1; (+) strand; PAM type: NRG; PAM sequence: GAG
ctttgggaggccgaggtcgg

SEQ ID NO: 151443 - DNA, 20 bp, Artificial Sequence
  Description of Artificial Sequence: Synthetic oligonucleotide
  Target: ATXN1; (+) strand; PAM type: NRG; PAM sequence: AAG
gaggccgaggtcgggagttc

SEQ ID NO: 151444 - DNA, 20 bp, Artificial Sequence
  Description of Artificial Sequence: Synthetic oligonucleotide
  Target: ATXN1; (+) strand; PAM type: NRG; PAM sequence: CAG
cgaggtcgggagttcaagac

SEQ ID NO: 151445 - DNA, 20 bp, Artificial Sequence
  Description of Artificial Sequence: Synthetic oligonucleotide
  Target: ATXN1; (+) strand; PAM type: NRG; PAM sequence: TGG
caagaccagcttgaccaaca

SEQ ID NO: 151446 - DNA, 20 bp, Artificial Sequence
  Description of Artificial Sequence: Synthetic oligonucleotide
  Target: ATXN1; (+) strand; PAM type: NRG; PAM sequence: GAG
agaccagcttgaccaacatg

SEQ ID NO: 151447 - DNA, 20 bp, Artificial Sequence
  Description of Artificial Sequence: Synthetic oligonucleotide
  Target: ATXN1; (+) strand; PAM type: NRG; PAM sequence: TAG
cttgactaaaaatacaaaat

SEQ ID NO: 151448 - DNA, 20 bp, Artificial Sequence
  Description of Artificial Sequence: Synthetic oligonucleotide
  Target: ATXN1; (+) strand; PAM type: NRG; PAM sequence: TGG
actaaaaatacaaaattagc

SEQ ID NO: 151449 - DNA, 20 bp, Artificial Sequence
  Description of Artificial Sequence: Synthetic oligonucleotide
  Target: ATXN1; (+) strand; PAM type: NRG; PAM sequence: GGG
ctaaaaatacaaaattagct

SEQ ID NO: 151450 - DNA, 20 bp, Artificial Sequence
  Description of Artificial Sequence: Synthetic oligonucleotide
  Target: ATXN1; (+) strand; PAM type: NRG; PAM sequence: TGG
aatacaaaattagctgggtg

SEQ ID NO: 151451 - DNA, 20 bp, Artificial Sequence
  Description of Artificial Sequence: Synthetic oligonucleotide
  Target: ATXN1; (+) strand; PAM type: NRG; PAM sequence: TGG
acaaaattagctgggtgtgg

SEQ ID NO: 151452 - DNA, 20 bp, Artificial Sequence
  Description of Artificial Sequence: Synthetic oligonucleotide
  Target: ATXN1; (+) strand; PAM type: NRG; PAM sequence: CAG
gtggcatatgcctgtaatcc

SEQ ID NO: 151453 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagctact

SEQ ID NO: 151454 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagctactt

SEQ ID NO: 151455 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctacttgg

SEQ ID NO: 151456 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctacttggg

SEQ ID NO: 151457 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 151458 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggctg

SEQ ID NO: 151459 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgagg

SEQ ID NO: 151460 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggctgaggc

SEQ ID NO: 151461 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctgaggcag

SEQ ID NO: 151462 - DNA, 20 bp, Artificial Sequence
  Description of Artificial Sequence: Synthetic oligonucleotide
  Target: ATXN1; (+) strand; PAM type: NRG; PAM sequence: CGG
gcaggagaatcacttgaatc

SEQ ID NO: 151463 - DNA, 20 bp, Artificial Sequence
  Description of Artificial Sequence: Synthetic oligonucleotide
  Target: ATXN1; (+) strand; PAM type: NRG; PAM sequence: GGG
caggagaatcacttgaatcc

SEQ ID NO: 151464 - DNA, 20 bp, Artificial Sequence
  Description of Artificial Sequence: Synthetic oligonucleotide
  Target: ATXN1; (+) strand; PAM type: NRG; PAM sequence: GAG
ggagaatcacttgaatccgg

SEQ ID NO: 151465 - DNA, 20 bp, Artificial Sequence
  Description of Artificial Sequence: Synthetic oligonucleotide
  Target: ATXN1; (+) strand; PAM type: NRG; PAM sequence: AGG
gagaatcacttgaatccggg

SEQ ID NO: 151466 - DNA, 20 bp, Artificial Sequence
  Description of Artificial Sequence: Synthetic oligonucleotide
  Target: ATXN1; (+) strand; PAM type: NRG; PAM sequence: GGG
agaatcacttgaatccggga

SEQ ID NO: 151467 - DNA, 20 bp, Artificial Sequence
  Description of Artificial Sequence: Synthetic oligonucleotide
  Target: ATXN1; (+) strand; PAM type: NRG; PAM sequence: GAG
aatcacttgaatccgggagg

SEQ ID NO: 151468 - DNA, 20 bp, Artificial Sequence
  Description of Artificial Sequence: Synthetic oligonucleotide
  Target: ATXN1; (+) strand; PAM type: NRG; PAM sequence: GAG
tcacttgaatccgggaggga

SEQ ID NO: 151469 - DNA, 20 bp, Artificial Sequence
  Description of Artificial Sequence: Synthetic oligonucleotide
  Target: ATXN1; (+) strand; PAM type: NRG; PAM sequence: AGG
cacttgaatccgggagggag

SEQ ID NO: 151470 - DNA, 20 bp, Artificial Sequence
  Description of Artificial Sequence: Synthetic oligonucleotide
  Target: ATXN1; (+) strand; PAM type: NRG; PAM sequence: CAG
aatccgggagggagaggtta

SEQ ID NO: 151471 - DNA, 20 bp, Artificial Sequence
  Description of Artificial Sequence: Synthetic oligonucleotide
  Target: ATXN1; (+) strand; PAM type: NRG; PAM sequence: GAG
cgggagggagaggttacagt

SEQ ID NO: 151472 - DNA, 20 bp, Artificial Sequence
  Description of Artificial Sequence: Synthetic oligonucleotide
  Target: ATXN1; (+) strand; PAM type: NRG; PAM sequence: AAG
gggagaggttacagtgagcc

SEQ ID NO: 151473 - DNA, 20 bp, Artificial Sequence
  Description of Artificial Sequence: Synthetic oligonucleotide
  Target: ATXN1; (+) strand; PAM type: NRG; PAM sequence: CAG
aagatcgtgccattgcactc

SEQ ID NO: 151474 - DNA, 20 bp, Artificial Sequence
  Description of Artificial Sequence: Synthetic oligonucleotide
  Target: ATXN1; (+) strand; PAM type: NRG; PAM sequence: TGG
cgtgccattgcactccagcc

SEQ ID NO: 151475 - DNA, 20 bp, Artificial Sequence
  Description of Artificial Sequence: Synthetic oligonucleotide
  Target: ATXN1; (+) strand; PAM type: NRG; PAM sequence: GGG
gtgccattgcactccagcct

SEQ ID NO: 151476 - DNA, 20 bp, Artificial Sequence
  Description of Artificial Sequence: Synthetic oligonucleotide
  Target: ATXN1; (+) strand; PAM type: NRG; PAM sequence: AAG
tgcactccagcctgggcaac

SEQ ID NO: 151477 - DNA, 20 bp, Artificial Sequence
  Description of Artificial Sequence: Synthetic oligonucleotide
  Target: ATXN1; (+) strand; PAM type: NRG; PAM sequence: GAG
cactccagcctgggcaacaa

SEQ ID NO: 151478 - DNA, 20 bp, Artificial Sequence
  Description of Artificial Sequence: Synthetic oligonucleotide
  Target: ATXN1; (+) strand; PAM type: NRG; PAM sequence: AAG
aaactccatctcaaatgaaa

SEQ ID NO: 151479 - DNA, 20 bp, Artificial Sequence
  Description of Artificial Sequence: Synthetic oligonucleotide
  Target: ATXN1; (+) strand; PAM type: NRG; PAM sequence: TGG
ctcaaatgaaaaagaaccac

SEQ ID NO: 151480 - DNA, 20 bp, Artificial Sequence
  Description of Artificial Sequence: Synthetic oligonucleotide
  Target: ATXN1; (+) strand; PAM type: NRG; PAM sequence: TGG
aatgaaaaagaaccactggc

SEQ ID NO: 151481 - DNA, 20 bp, Artificial Sequence
  Description of Artificial Sequence: Synthetic oligonucleotide
  Target: ATXN1; (+) strand; PAM type: NRG; PAM sequence: GGG
atgaaaaagaaccactggct

SEQ ID NO: 151482 - DNA, 20 bp, Artificial Sequence
  Description of Artificial Sequence: Synthetic oligonucleotide
  Target: ATXN1; (+) strand; PAM type: NRG; PAM sequence: TGG
aaaaagaaccactggctggg

SEQ ID NO: 151483 - DNA, 20 bp, Artificial Sequence
  Description of Artificial Sequence: Synthetic oligonucleotide
  Target: ATXN1; (+) strand; PAM type: NRG; PAM sequence: GAG
aaagaaccactggctgggtg

SEQ ID NO: 151484 - DNA, 20 bp, Artificial Sequence
  Description of Artificial Sequence: Synthetic oligonucleotide
  Target: ATXN1; (+) strand; PAM type: NRG; PAM sequence: TGG
gaaccactggctgggtggag

SEQ ID NO: 151485 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatct

SEQ ID NO: 151486 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatctcagcactt

SEQ ID NO: 151487 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatctcagcacttt

SEQ ID NO: 151488 - DNA, 20 bp, Artificial Sequence
  Description of Artificial Sequence: Synthetic oligonucleotide
  Target: ATXN1; (+) strand; PAM type: NRG; PAM sequence: GAG
ctgtaatctcagcactttgg

SEQ ID NO: 151489 - DNA, 20 bp, Artificial Sequence
  Description of Artificial Sequence: Synthetic oligonucleotide
  Target: ATXN1; (+) strand; PAM type: NRG; PAM sequence: AGG
tgtaatctcagcactttggg

SEQ ID NO: 151490 - DNA, 20 bp, Artificial Sequence
  Description of Artificial Sequence: Synthetic oligonucleotide
  Target: ATXN1; (+) strand; PAM type: NRG; PAM sequence: AAG
tctcagcactttgggaggcc

SEQ ID NO: 151491 - DNA, 20 bp, Artificial Sequence
  Description of Artificial Sequence: Synthetic oligonucleotide
  Target: ATXN1; (+) strand; PAM type: NRG; PAM sequence: AGG
ctcagcactttgggaggcca

SEQ ID NO: 151492 - DNA, 20 bp, Artificial Sequence
  Description of Artificial Sequence: Synthetic oligonucleotide
  Target: ATXN1; (+) strand; PAM type: NRG; PAM sequence: TAG
agcactttgggaggccaagg

SEQ ID NO: 151493 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggccaaggt

SEQ ID NO: 151494 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccaaggtagg

SEQ ID NO: 151495 - DNA, 20 bp, Artificial Sequence
  Description of Artificial Sequence: Synthetic oligonucleotide
  Target: ATXN1; (+) strand; PAM type: NRG; PAM sequence: TGG
caaggtaggtggatttcttg

SEQ ID NO: 151496 - DNA, 20 bp, Artificial Sequence
  Description of Artificial Sequence: Synthetic oligonucleotide
  Target: ATXN1; (+) strand; PAM type: NRG; PAM sequence: CAG
gtaggtggatttcttgtggt

SEQ ID NO: 151497 - DNA, 20 bp, Artificial Sequence
  Description of Artificial Sequence: Synthetic oligonucleotide
  Target: ATXN1; (+) strand; PAM type: NRG; PAM sequence: AGG
taggtggatttcttgtggtc

SEQ ID NO: 151498 - DNA, 20 bp, Artificial Sequence
  Description of Artificial Sequence: Synthetic oligonucleotide
  Target: ATXN1; (+) strand; PAM type: NRG; PAM sequence: GAG
ggtggatttcttgtggtcag

SEQ ID NO: 151499 - DNA, 20 bp, Artificial Sequence
  Description of Artificial Sequence: Synthetic oligonucleotide
  Target: ATXN1; (+) strand; PAM type: NRG; PAM sequence: CAG
tgtggtcaggagttcaaaac

SEQ ID NO: 151500 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcaaaaccagcc

SEQ ID NO: 151501 - DNA, 20 bp, Artificial Sequence
  Description of Artificial Sequence: Synthetic oligonucleotide
  Target: ATXN1; (+) strand; PAM type: NRG; PAM sequence: TGG
caaaaccagcctggccaaca

SEQ ID NO: 151502 - DNA, 20 bp, Artificial Sequence
  Description of Artificial Sequence: Synthetic oligonucleotide
  Target: ATXN1; (+) strand; PAM type: NRG; PAM sequence: CAG
tggccaacatggtgaaaccc

SEQ ID NO: 151503 - DNA, 20 bp, Artificial Sequence
  Description of Artificial Sequence: Synthetic oligonucleotide
  Target: ATXN1; (+) strand; PAM type: NRG; PAM sequence: CGG
tggtgaaaccccagccactc

SEQ ID NO: 151504 - DNA, 20 bp, Artificial Sequence
  Description of Artificial Sequence: Synthetic oligonucleotide
  Target: ATXN1; (+) strand; PAM type: NRG; PAM sequence: GAG
gtgaaaccccagccactccg

SEQ ID NO: 151505 - DNA, 20 bp, Artificial Sequence
  Description of Artificial Sequence: Synthetic oligonucleotide
  Target: ATXN1; (+) strand; PAM type: NRG; PAM sequence: AGG
tgaaaccccagccactccgg

SEQ ID NO: 151506 - DNA, 20 bp, Artificial Sequence
  Description of Artificial Sequence: Synthetic oligonucleotide
  Target: ATXN1; (+) strand; PAM type: NRG; PAM sequence: CAG
agccactccggaggctgacg

SEQ ID NO: 151507 - DNA, 20 bp, Artificial Sequence
  Description of Artificial Sequence: Synthetic oligonucleotide
  Target: ATXN1; (+) strand; PAM type: NRG; PAM sequence: AGG
gccactccggaggctgacgc

SEQ ID NO: 151508 - DNA, 20 bp, Artificial Sequence
  Description of Artificial Sequence: Synthetic oligonucleotide
  Target: ATXN1; (+) strand; PAM type: NRG; PAM sequence: GAG
cactccggaggctgacgcag

SEQ ID NO: 151509 - DNA, 20 bp, Artificial Sequence
  Description of Artificial Sequence: Synthetic oligonucleotide
  Target: ATXN1; (+) strand; PAM type: NRG; PAM sequence: AAG
caggagaatcgcttgaaccc

SEQ ID NO: 151510 - DNA, 20 bp, Artificial Sequence
  Description of Artificial Sequence: Synthetic oligonucleotide
  Target: ATXN1; (+) strand; PAM type: NRG; PAM sequence: GAG
ggagaatcgcttgaacccaa

SEQ ID NO: 151511 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacccaag

SEQ ID NO: 151512 - DNA, 20 bp, Artificial Sequence
  Description of Artificial Sequence: Synthetic oligonucleotide
  Target: ATXN1; (+) strand; PAM type: NRG; PAM sequence: CGG
aatcgcttgaacccaagagg

SEQ ID NO: 151513 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacccaagaggcg

SEQ ID NO: 151514 - DNA, 20 bp, Artificial Sequence
  Description of Artificial Sequence: Synthetic oligonucleotide
  Target: ATXN1; (+) strand; PAM type: NRG; PAM sequence: CAG
aacccaagaggcggagattg

SEQ ID NO: 151515 - DNA, 20 bp, Artificial Sequence
  Description of Artificial Sequence: Synthetic oligonucleotide
  Target: ATXN1; (+) strand; PAM type: NRG; PAM sequence: GAG
caagaggcggagattgcagt

SEQ ID NO: 151516 - DNA, 20 bp, Artificial Sequence
  Description of Artificial Sequence: Synthetic oligonucleotide
  Target: ATXN1; (+) strand; PAM type: NRG; PAM sequence: AAG
ggcggagattgcagtgagcc

SEQ ID NO: 151517 - DNA, 20 bp, Artificial Sequence
  Description of Artificial Sequence: Synthetic oligonucleotide
  Target: ATXN1; (+) strand; PAM type: NRG; PAM sequence: CAG
aagatctcaccactgcactc

SEQ ID NO: 151518 - DNA, 20 bp, Artificial Sequence
  Description of Artificial Sequence: Synthetic oligonucleotide
  Target: ATXN1; (+) strand; PAM type: NRG; PAM sequence: TAG
ctcaccactgcactccagcc

SEQ ID NO: 151519 - DNA, 20 bp, Artificial Sequence
  Description of Artificial Sequence: Synthetic oligonucleotide
  Target: ATXN1; (+) strand; PAM type: NRG; PAM sequence: AGG
tcaccactgcactccagcct

SEQ ID NO: 151520 - DNA, 20 bp, Artificial Sequence
  Description of Artificial Sequence: Synthetic oligonucleotide
  Target: ATXN1; (+) strand; PAM type: NRG; PAM sequence: CAG
actccagcctaggcaaccga

SEQ ID NO: 151521 - DNA, 20 bp, Artificial Sequence
  Description of Artificial Sequence: Synthetic oligonucleotide
  Target: ATXN1; (+) strand; PAM type: NRG; PAM sequence: GAG
tccagcctaggcaaccgaca

SEQ ID NO: 151522 - DNA, 20 bp, Artificial Sequence
  Description of Artificial Sequence: Synthetic oligonucleotide
  Target: ATXN1; (+) strand; PAM type: NRG; PAM sequence: GAG
gcctaggcaaccgacagagt

SEQ ID NO: 151523 - DNA, 20 bp, Artificial Sequence
  Description of Artificial Sequence: Synthetic oligonucleotide
  Target: ATXN1; (+) strand; PAM type: NRG; PAM sequence: TAG
atataaaaaaaaaatgtcta

SEQ ID NO: 151524 - DNA, 20 bp, Artificial Sequence
  Description of Artificial Sequence: Synthetic oligonucleotide
  Target: ATXN1; (+) strand; PAM type: NRG; PAM sequence: TAG
aaaaaaatgtctatagacta

SEQ ID NO: 151525 - DNA, 20 bp, Artificial Sequence
  Description of Artificial Sequence: Synthetic oligonucleotide
  Target: ATXN1; (+) strand; PAM type: NRG; PAM sequence: GAG
aaaaatgtctatagactata

SEQ ID NO: 151526 - DNA, 20 bp, Artificial Sequence
  Description of Artificial Sequence: Synthetic oligonucleotide
  Target: ATXN1; (+) strand; PAM type: NRG; PAM sequence: AAG
tgtctatagactatagagtt

SEQ ID NO: 151527 - DNA, 20 bp, Artificial Sequence
  Description of Artificial Sequence: Synthetic oligonucleotide
  Target: ATXN1; (+) strand; PAM type: NRG; PAM sequence: AAG
tttgtgaattataacctgac

SEQ ID NO: 151528 - DNA, 20 bp, Artificial Sequence
  Description of Artificial Sequence: Synthetic oligonucleotide
  Target: ATXN1; (+) strand; PAM type: NRG; PAM sequence: GAG
ttataacctgacaagcttgt

SEQ ID NO: 151529 - DNA, 20 bp, Artificial Sequence
  Description of Artificial Sequence: Synthetic oligonucleotide
  Target: ATXN1; (+) strand; PAM type: NRG; PAM sequence: GAG
ataacctgacaagcttgtga

SEQ ID NO: 151530 - DNA, 20 bp, Artificial Sequence
  Description of Artificial Sequence: Synthetic oligonucleotide
  Target: ATXN1; (+) strand; PAM type: NRG; PAM sequence: TGG
caagcttgtgagagatctgt

SEQ ID NO: 151531 - DNA, 20 bp, Artificial Sequence
  Description of Artificial Sequence: Synthetic oligonucleotide
  Target: ATXN1; (+) strand; PAM type: NRG; PAM sequence: CAG
ttgtgagagatctgttggca

SEQ ID NO: 151532 - DNA, 20 bp, Artificial Sequence
  Description of Artificial Sequence: Synthetic oligonucleotide
  Target: ATXN1; (+) strand; PAM type: NRG; PAM sequence: CAG
tcatatgaaatcatccttct

SEQ ID NO: 151533 - DNA, 20 bp, Artificial Sequence
  Description of Artificial Sequence: Synthetic oligonucleotide
  Target: ATXN1; (+) strand; PAM type: NRG; PAM sequence: AGG
catatgaaatcatccttctc

SEQ ID NO: 151534 - DNA, 20 bp, Artificial Sequence
  Description of Artificial Sequence: Synthetic oligonucleotide
  Target: ATXN1; (+) strand; PAM type: NRG; PAM sequence: TAG
gttctgtttgctacaaaaca

SEQ ID NO: 151535 - DNA, 20 bp, Artificial Sequence
  Description of Artificial Sequence: Synthetic oligonucleotide
  Target: ATXN1; (+) strand; PAM type: NRG; PAM sequence: TGG
aaaacatagcatgctttact

SEQ ID NO: 151536 - DNA, 20 bp, Artificial Sequence
  Description of Artificial Sequence: Synthetic oligonucleotide
  Target: ATXN1; (+) strand; PAM type: NRG; PAM sequence: AAG
acatagcatgctttacttgg

SEQ ID NO: 151537 - DNA, 20 bp, Artificial Sequence
  Description of Artificial Sequence: Synthetic oligonucleotide
  Target: ATXN1; (+) strand; PAM type: NRG; PAM sequence: AGG
catagcatgctttacttgga

SEQ ID NO: 151538 - DNA, 20 bp, Artificial Sequence
  Description of Artificial Sequence: Synthetic oligonucleotide
  Target: ATXN1; (+) strand; PAM type: NRG; PAM sequence: GGG
atagcatgctttacttggaa

SEQ ID NO: 151539 - DNA, 20 bp, Artificial Sequence
  Description of Artificial Sequence: Synthetic oligonucleotide
  Target: ATXN1; (+) strand; PAM type: NRG; PAM sequence: GAG
tggaagggcatgcctcattt

SEQ ID NO: 151540 - DNA, 20 bp, Artificial Sequence
  Description of Artificial Sequence: Synthetic oligonucleotide
  Target: ATXN1; (+) strand; PAM type: NRG; PAM sequence: GAG
agggcatgcctcatttgagt

SEQ ID NO: 151541 - DNA, 20 bp, Artificial Sequence
  Description of Artificial Sequence: Synthetic oligonucleotide
  Target: ATXN1; (+) strand; PAM type: NRG; PAM sequence: AGG
gggcatgcctcatttgagtg

SEQ ID NO: 151542 - DNA, 20 bp, Artificial Sequence
  Description of Artificial Sequence: Synthetic oligonucleotide
  Target: ATXN1; (+) strand; PAM type: NRG; PAM sequence: AAG
aaaaatattgtcatctcacc

SEQ ID NO: 151543 - DNA, 20 bp, Artificial Sequence
  Description of Artificial Sequence: Synthetic oligonucleotide
  Target: ATXN1; (+) strand; PAM type: NRG; PAM sequence: TAG
tcaccaagaattcccaacac

SEQ ID NO: 151544 - DNA, 20 bp, Artificial Sequence
  Description of Artificial Sequence: Synthetic oligonucleotide
  Target: ATXN1; (+) strand; PAM type: NRG; PAM sequence: TGG
cccaacactagtcatgacac

SEQ ID NO: 151545 - DNA, 20 bp, Artificial Sequence
  Description of Artificial Sequence: Synthetic oligonucleotide
  Target: ATXN1; (+) strand; PAM type: NRG; PAM sequence: GGG
ccaacactagtcatgacact

SEQ ID NO: 151546 - DNA, 20 bp, Artificial Sequence
  Description of Artificial Sequence: Synthetic oligonucleotide
  Target: ATXN1; (+) strand; PAM type: NRG; PAM sequence: AAG
atgacactgggcatccccgc

SEQ ID NO: 151547 - DNA, 20 bp, Artificial Sequence
  Description of Artificial Sequence: Synthetic oligonucleotide
  Target: ATXN1; (+) strand; PAM type: NRG; PAM sequence: AGG
tgacactgggcatccccgca

SEQ ID NO: 151548 - DNA, 20 bp, Artificial Sequence
  Description of Artificial Sequence: Synthetic oligonucleotide
  Target: ATXN1; (+) strand; PAM type: NRG; PAM sequence: AAG
acgctcgccttcacttttta

SEQ ID NO: 151549 - DNA, 20 bp, Artificial Sequence
  Description of Artificial Sequence: Synthetic oligonucleotide
  Target: ATXN1; (+) strand; PAM type: NRG; PAM sequence: AGG
cgctcgccttcactttttaa

SEQ ID NO: 151550 - DNA, 20 bp, Artificial Sequence
  Description of Artificial Sequence: Synthetic oligonucleotide
  Target: ATXN1; (+) strand; PAM type: NRG; PAM sequence: CAG
tttaaaggtttgttctgacc

SEQ ID NO: 151551 - DNA, 20 bp, Artificial Sequence
  Description of Artificial Sequence: Synthetic oligonucleotide
  Target: ATXN1; (+) strand; PAM type: NRG; PAM sequence: TGG
ttcttctttgttctccatga

SEQ ID NO: 151552 - DNA, 20 bp, Artificial Sequence
  Description of Artificial Sequence: Synthetic oligonucleotide
  Target: ATXN1; (+) strand; PAM type: NRG; PAM sequence: GAG
tttgttctccatgatggtgc

SEQ ID NO: 151553 - DNA, 20 bp, Artificial Sequence
  Description of Artificial Sequence: Synthetic oligonucleotide
  Target: ATXN1; (+) strand; PAM type: NRG; PAM sequence: AAG
tctccatgatggtgcgagaa

SEQ ID NO: 151554 - DNA, 20 bp, Artificial Sequence
  Description of Artificial Sequence: Synthetic oligonucleotide
  Target: ATXN1; (+) strand; PAM type: NRG; PAM sequence: AAG
ccatgatggtgcgagaaaag

SEQ ID NO: 151555 - DNA, 20 bp, Artificial Sequence
  Description of Artificial Sequence: Synthetic oligonucleotide
  Target: ATXN1; (+) strand; PAM type: NRG; PAM sequence: AGG
catgatggtgcgagaaaaga

SEQ ID NO: 151556 - DNA, 20 bp, Artificial Sequence
  Description of Artificial Sequence: Synthetic oligonucleotide
  Target: ATXN1; (+) strand; PAM type: NRG; PAM sequence: AAG
gatggtgcgagaaaagaagg

SEQ ID NO: 151557 - DNA, 20 bp, Artificial Sequence
  Description of Artificial Sequence: Synthetic oligonucleotide
  Target: ATXN1; (+) strand; PAM type: NRG; PAM sequence: AAG
ggtgcgagaaaagaaggaag

SEQ ID NO: 151558 - DNA, 20 bp, Artificial Sequence
  Description of Artificial Sequence: Synthetic oligonucleotide
  Target: ATXN1; (+) strand; PAM type: NRG; PAM sequence: AGG
gtgcgagaaaagaaggaaga

SEQ ID NO: 151559 - DNA, 20 bp, Artificial Sequence
  Description of Artificial Sequence: Synthetic oligonucleotide
  Target: ATXN1; (+) strand; PAM type: NRG; PAM sequence: GAG
agaaaagaaggaagaaggat

SEQ ID NO: 151560 - DNA, 20 bp, Artificial Sequence
  Description of Artificial Sequence: Synthetic oligonucleotide
  Target: ATXN1; (+) strand; PAM type: NRG; PAM sequence: GAG
aaaagaaggaagaaggatga

SEQ ID NO: 151561 - DNA, 20 bp, Artificial Sequence
  Description of Artificial Sequence: Synthetic oligonucleotide
  Target: ATXN1; (+) strand; PAM type: NRG; PAM sequence: AAG
aagaaggatgagagatgaaa

SEQ ID NO: 151562 - DNA, 20 bp, Artificial Sequence
  Description of Artificial Sequence: Synthetic oligonucleotide
  Target: ATXN1; (+) strand; PAM type: NRG; PAM sequence: TAG
aaggatgagagatgaaaaag

SEQ ID NO: 151563 - DNA, 20 bp, Artificial Sequence
  Description of Artificial Sequence: Synthetic oligonucleotide
  Target: ATXN1; (+) strand; PAM type: NRG; PAM sequence: AGG
aggatgagagatgaaaaagt

SEQ ID NO: 151564 - DNA, 20 bp, Artificial Sequence
  Description of Artificial Sequence: Synthetic oligonucleotide
  Target: ATXN1; (+) strand; PAM type: NRG; PAM sequence: GGG
ggatgagagatgaaaaagta

SEQ ID NO: 151565 - DNA, 20 bp, Artificial Sequence
  Description of Artificial Sequence: Synthetic oligonucleotide
  Target: ATXN1; (+) strand; PAM type: NRG; PAM sequence: AAG
agatgaaaaagtagggaaaa

SEQ ID NO: 151566 - DNA, 20 bp, Artificial Sequence
  Description of Artificial Sequence: Synthetic oligonucleotide
  Target: ATXN1; (+) strand; PAM type: NRG; PAM sequence: AAG
tgaaaaagtagggaaaaaag

SEQ ID NO: 151567 - DNA, 20 bp, Artificial Sequence
  Description of Artificial Sequence: Synthetic oligonucleotide
  Target: ATXN1; (+) strand; PAM type: NRG; PAM sequence: GAG
aaaaagtagggaaaaaagaa

SEQ ID NO: 151568 - DNA, 20 bp, Artificial Sequence
  Description of Artificial Sequence: Synthetic oligonucleotide
  Target: ATXN1; (+) strand; PAM type: NRG; PAM sequence: AAG
tagggaaaaaagaagagaaa

SEQ ID NO: 151569 - DNA, 20 bp, Artificial Sequence
  Description of Artificial Sequence: Synthetic oligonucleotide
  Target: ATXN1; (+) strand; PAM type: NRG; PAM sequence: AGG
agggaaaaaagaagagaaaa

SEQ ID NO: 151570 - DNA, 20 bp, Artificial Sequence
  Description of Artificial Sequence: Synthetic oligonucleotide
  Target: ATXN1; (+) strand; PAM type: NRG; PAM sequence: GAG
ggaaaaaagaagagaaaaag

SEQ ID NO: 151571 - DNA, 20 bp, Artificial Sequence
  Description of Artificial Sequence: Synthetic oligonucleotide
  Target: ATXN1; (+) strand; PAM type: NRG; PAM sequence: GAG
aaaaaagaagagaaaaagga

SEQ ID NO: 151572 - DNA, 20 bp, Artificial Sequence
  Description of Artificial Sequence: Synthetic oligonucleotide
  Target: ATXN1; (+) strand; PAM type: NRG; PAM sequence: CAG
gaaaaaggagagaaaacaaa

SEQ ID NO: 151573 - DNA, 20 bp, Artificial Sequence
  Description of Artificial Sequence: Synthetic oligonucleotide
  Target: ATXN1; (+) strand; PAM type: NRG; PAM sequence: TGG
agagaaaacaaacagtgatc

SEQ ID NO: 151574 - DNA, 20 bp, Artificial Sequence
  Description of Artificial Sequence: Synthetic oligonucleotide
  Target: ATXN1; (+) strand; PAM type: NRG; PAM sequence: TGG
aaaacaaacagtgatctggc

SEQ ID NO: 151575 - DNA, 20 bp, Artificial Sequence
  Description of Artificial Sequence: Synthetic oligonucleotide
  Target: ATXN1; (+) strand; PAM type: NRG; PAM sequence: GAG
aaatatatgtatactttttt

SEQ ID NO: 151576 - DNA, 20 bp, Artificial Sequence
  Description of Artificial Sequence: Synthetic oligonucleotide
  Target: ATXN1; (+) strand; PAM type: NRG; PAM sequence: TGG
atatgtatacttttttgaga

SEQ ID NO: 151577 - DNA, 20 bp, Artificial Sequence
  Description of Artificial Sequence: Synthetic oligonucleotide
  Target: ATXN1; (+) strand; PAM type: NRG; PAM sequence: GAG
atgtatacttttttgagatg

SEQ ID NO: 151578 - DNA, 20 bp, Artificial Sequence
  Description of Artificial Sequence: Synthetic oligonucleotide
  Target: ATXN1; (+) strand; PAM type: NRG; PAM sequence: CAG
tggagtctcactctgtcgct

SEQ ID NO: 151579 - DNA, 20 bp, Artificial Sequence
  Description of Artificial Sequence: Synthetic oligonucleotide
  Target: ATXN1; (+) strand; PAM type: NRG; PAM sequence: AGG
ggagtctcactctgtcgctc

SEQ ID NO: 151580 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcgctcaggc

SEQ ID NO: 151581 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcgctcaggctg

SEQ ID NO: 151582 - DNA, 20 bp, Artificial Sequence
  Description of Artificial Sequence: Synthetic oligonucleotide
  Target: ATXN1; (+) strand; PAM type: NRG; PAM sequence: TAG
ctgtcgctcaggctggagtg

SEQ ID NO: 151583 - DNA, 20 bp, Artificial Sequence
  Description of Artificial Sequence: Synthetic oligonucleotide
  Target: ATXN1; (+) strand; PAM type: NRG; PAM sequence: TGG
tcgctcaggctggagtgtag

SEQ ID NO: 151584 - DNA, 20 bp, Artificial Sequence
  Description of Artificial Sequence: Synthetic oligonucleotide
  Target: ATXN1; (+) strand; PAM type: NRG; PAM sequence: CAG
ggagtgtagtggtgcaatct

SEQ ID NO: 151585 - DNA, 20 bp, Artificial Sequence
  Description of Artificial Sequence: Synthetic oligonucleotide
  Target: ATXN1; (+) strand; PAM type: NRG; PAM sequence: CAG
ggtgcaatctcagctcactg

SEQ ID NO: 151586 - DNA, 20 bp, Artificial Sequence
  Description of Artificial Sequence: Synthetic oligonucleotide
  Target: ATXN1; (+) strand; PAM type: NRG; PAM sequence: CAG
tcactgcagcctcgacctcc

SEQ ID NO: 151587 - DNA, 20 bp, Artificial Sequence
  Description of Artificial Sequence: Synthetic oligonucleotide
  Target: ATXN1; (+) strand; PAM type: NRG; PAM sequence: AGG
cactgcagcctcgacctccc

SEQ ID NO: 151588 - DNA, 20 bp, Artificial Sequence
  Description of Artificial Sequence: Synthetic oligonucleotide
  Target: ATXN1; (+) strand; PAM type: NRG; PAM sequence: AAG
agcctcgacctcccaggttc

SEQ ID NO: 151589 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaattctcctgcct

SEQ ID NO: 151590 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctcct

SEQ ID NO: 151591 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcctgag

SEQ ID NO: 151592 - DNA, 20 bp, Artificial Sequence
  Description of Artificial Sequence: Synthetic oligonucleotide
  Target: ATXN1; (+) strand; PAM type: NRG; PAM sequence: CGG
tgcctcagcctcctgagtag

SEQ ID NO: 151593 - DNA, 20 bp, Artificial Sequence
  Description of Artificial Sequence: Synthetic oligonucleotide
  Target: ATXN1; (+) strand; PAM type: NRG; PAM sequence: GGG
gcctcagcctcctgagtagc

SEQ ID NO: 151594 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcctgagtagcg

SEQ ID NO: 151595 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtagcggggacca

SEQ ID NO: 151596 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagcggggaccac

SEQ ID NO: 151597 - DNA, 20 bp, Artificial Sequence
  Description of Artificial Sequence: Synthetic oligonucleotide
  Target: ATXN1; (+) strand; PAM type: NRG; PAM sequence: TAG
gtgtgctaatttttgtattt

SEQ ID NO: 151598 - DNA, 20 bp, Artificial Sequence
  Description of Artificial Sequence: Synthetic oligonucleotide
  Target: ATXN1; (+) strand; PAM type: NRG; PAM sequence: AAG
ctaatttttgtattttagta

SEQ ID NO: 151599 - DNA, 20 bp, Artificial Sequence
  Description of Artificial Sequence: Synthetic oligonucleotide
  Target: ATXN1; (+) strand; PAM type: NRG; PAM sequence: CAG
tttttgtattttagtaaaga

SEQ ID NO: 151600 - DNA, 20 bp, Artificial Sequence
  Description of Artificial Sequence: Synthetic oligonucleotide
  Target: ATXN1; (+) strand; PAM type: NRG; PAM sequence: AGG
ttttgtattttagtaaagac

SEQ ID NO: 151601 - DNA, 20 bp, Artificial Sequence
  Description of Artificial Sequence: Synthetic oligonucleotide
  Target: ATXN1; (+) strand; PAM type: NRG; PAM sequence: TGG
aagacaggattttaccatgt

SEQ ID NO: 151602 - DNA, 20 bp, Artificial Sequence
  Description of Artificial Sequence: Synthetic oligonucleotide
  Target: ATXN1; (+) strand; PAM type: NRG; PAM sequence: CAG
caggattttaccatgttggt

SEQ ID NO: 151603 - DNA, 20 bp, Artificial Sequence
  Description of Artificial Sequence: Synthetic oligonucleotide
  Target: ATXN1; (+) strand; PAM type: NRG; PAM sequence: AGG
aggattttaccatgttggtc

SEQ ID NO: 151604 - DNA, 20 bp, Artificial Sequence
  Description of Artificial Sequence: Synthetic oligonucleotide
  Target: ATXN1; (+) strand; PAM type: NRG; PAM sequence: TGG
ttttaccatgttggtcaggc

SEQ ID NO: 151605 - DNA, 20 bp, Artificial Sequence
  Description of Artificial Sequence: Synthetic oligonucleotide
  Target: ATXN1; (+) strand; PAM type: NRG; PAM sequence: TGG
gtcaggctggtctcgaacta

SEQ ID NO: 151606 - DNA, 20 bp, Artificial Sequence
  Description of Artificial Sequence: Synthetic oligonucleotide
  Target: ATXN1; (+) strand; PAM type: NRG; PAM sequence: TGG
ctcaaataatccacctgcct

SEQ ID NO: 151607 - DNA, 20 bp, Artificial Sequence
  Description of Artificial Sequence: Synthetic oligonucleotide
  Target: ATXN1; (+) strand; PAM type: NRG; PAM sequence: AAG
ccacctgccttggcctctca

SEQ ID NO: 151608 - DNA, 20 bp, Artificial Sequence
  Description of Artificial Sequence: Synthetic oligonucleotide
  Target: ATXN1; (+) strand; PAM type: NRG; PAM sequence: TGG
gccttggcctctcaaagtgc

SEQ ID NO: 151609 - DNA, 20 bp, Artificial Sequence
  Description of Artificial Sequence: Synthetic oligonucleotide
  Target: ATXN1; (+) strand; PAM type: NRG; PAM sequence: GGG
ccttggcctctcaaagtgct

SEQ ID NO: 151610 - DNA, 20 bp, Artificial Sequence
  Description of Artificial Sequence: Synthetic oligonucleotide
  Target: ATXN1; (+) strand; PAM type: NRG; PAM sequence: CAG
ctctcaaagtgctgggatta

SEQ ID NO: 151611 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacagacgt

SEQ ID NO: 151612 - DNA, 20 bp, Artificial Sequence
  Description of Artificial Sequence: Synthetic oligonucleotide
  Target: ATXN1; (+) strand; PAM type: NRG; PAM sequence: TAG
cagacgtgagccaccgtgcc

SEQ ID NO: 151613 - DNA, 20 bp, Artificial Sequence
  Description of Artificial Sequence: Synthetic oligonucleotide
  Target: ATXN1; (+) strand; PAM type: NRG; PAM sequence: TAG
tttaaaacgtcatgtttcta

SEQ ID NO: 151614 - DNA, 20 bp, Artificial Sequence
  Description of Artificial Sequence: Synthetic oligonucleotide
  Target: ATXN1; (+) strand; PAM type: NRG; PAM sequence: TGG
aaaacgtcatgtttctatag

SEQ ID NO: 151615 - DNA, 20 bp, Artificial Sequence
  Description of Artificial Sequence: Synthetic oligonucleotide
  Target: ATXN1; (+) strand; PAM type: NRG; PAM sequence: GAG
tttctatagtggttccttct

SEQ ID NO: 151616 - DNA, 20 bp, Artificial Sequence
  Description of Artificial Sequence: Synthetic oligonucleotide
  Target: ATXN1; (+) strand; PAM type: NRG; PAM sequence: AGG
ttctatagtggttccttctg

SEQ ID NO: 151617 - DNA, 20 bp, Artificial Sequence
  Description of Artificial Sequence: Synthetic oligonucleotide
  Target: ATXN1; (+) strand; PAM type: NRG; PAM sequence: TGG
tatagtggttccttctgagg

SEQ ID NO: 151618 - DNA, 20 bp, Artificial Sequence
  Description of Artificial Sequence: Synthetic oligonucleotide
  Target: ATXN1; (+) strand; PAM type: NRG; PAM sequence: GGG
atagtggttccttctgaggt

SEQ ID NO: 151619 - DNA, 20 bp, Artificial Sequence
  Description of Artificial Sequence: Synthetic oligonucleotide
  Target: ATXN1; (+) strand; PAM type: NRG; PAM sequence: AAG
gtggttccttctgaggtggg

SEQ ID NO: 151620 - DNA, 20 bp, Artificial Sequence
  Description of Artificial Sequence: Synthetic oligonucleotide
  Target: ATXN1; (+) strand; PAM type: NRG; PAM sequence: AAG
tgaggtgggaagaatgtgac

SEQ ID NO: 151621 - DNA, 20 bp, Artificial Sequence
  Description of Artificial Sequence: Synthetic oligonucleotide
  Target: ATXN1; (+) strand; PAM type: NRG; PAM sequence: TGG
tgggaagaatgtgacaagat

SEQ ID NO: 151622 - DNA, 20 bp, Artificial Sequence
  Description of Artificial Sequence: Synthetic oligonucleotide
  Target: ATXN1; (+) strand; PAM type: NRG; PAM sequence: GGG
gggaagaatgtgacaagatt

SEQ ID NO: 151623 - DNA, 20 bp, Artificial Sequence
  Description of Artificial Sequence: Synthetic oligonucleotide
  Target: ATXN1; (+) strand; PAM type: NRG; PAM sequence: GGG
ggaagaatgtgacaagattg

SEQ ID NO: 151624 - DNA, 20 bp, Artificial Sequence
  Description of Artificial Sequence: Synthetic oligonucleotide
  Target: ATXN1; (+) strand; PAM type: NRG; PAM sequence: GAG
aagaatgtgacaagattggg

SEQ ID NO: 151625 - DNA, 20 bp, Artificial Sequence
  Description of Artificial Sequence: Synthetic oligonucleotide
  Target: ATXN1; (+) strand; PAM type: NRG; PAM sequence: AGG
agaatgtgacaagattgggg

SEQ ID NO: 151626 - DNA, 20 bp, Artificial Sequence
  Description of Artificial Sequence: Synthetic oligonucleotide
  Target: ATXN1; (+) strand; PAM type: NRG; PAM sequence: TAG
caagattggggaggtccaca

SEQ ID NO: 151627 - DNA, 20 bp, Artificial Sequence
  Description of Artificial Sequence: Synthetic oligonucleotide
  Target: ATXN1; (+) strand; PAM type: NRG; PAM sequence: GAG
agattggggaggtccacata

SEQ ID NO: 151628 - DNA, 20 bp, Artificial Sequence
  Description of Artificial Sequence: Synthetic oligonucleotide
  Target: ATXN1; (+) strand; PAM type: NRG; PAM sequence: AGG
gattggggaggtccacatag

SEQ ID NO: 151629 - DNA, 20 bp, Artificial Sequence
  Description of Artificial Sequence: Synthetic oligonucleotide
  Target: ATXN1; (+) strand; PAM type: NRG; PAM sequence: CAG
aggtccacatagaggacatc

SEQ ID NO: 151630 - DNA, 20 bp, Artificial Sequence
  Description of Artificial Sequence: Synthetic oligonucleotide
  Target: ATXN1; (+) strand; PAM type: NRG; PAM sequence: TGG
catagaggacatccagttga

SEQ ID NO: 151631 - DNA, 20 bp, Artificial Sequence
  Description of Artificial Sequence: Synthetic oligonucleotide
  Target: ATXN1; (+) strand; PAM type: NRG; PAM sequence: TGG
ttgatggtaattttaaaata

SEQ ID NO: 151632 - DNA, 20 bp, Artificial Sequence
  Description of Artificial Sequence: Synthetic oligonucleotide
  Target: ATXN1; (+) strand; PAM type: NRG; PAM sequence: GGG
tgatggtaattttaaaatat

SEQ ID NO: 151633 - DNA, 20 bp, Artificial Sequence
  Description of Artificial Sequence: Synthetic oligonucleotide
  Target: ATXN1; (+) strand; PAM type: NRG; PAM sequence: TAG
gtaattttaaaatatgggtg

SEQ ID NO: 151634 - DNA, 20 bp, Artificial Sequence
  Description of Artificial Sequence: Synthetic oligonucleotide
  Target: ATXN1; (+) strand; PAM type: NRG; PAM sequence: GAG
aattttaaaatatgggtgta

SEQ ID NO: 151635 - DNA, 20 bp, Artificial Sequence
  Description of Artificial Sequence: Synthetic oligonucleotide
  Target: ATXN1; (+) strand; PAM type: NRG; PAM sequence: AAG
aaaatatgggtgtagagtta

SEQ ID NO: 151636 - DNA, 20 bp, Artificial Sequence
  Description of Artificial Sequence: Synthetic oligonucleotide
  Target: ATXN1; (+) strand; PAM type: NRG; PAM sequence: AGG
aaatatgggtgtagagttaa

SEQ ID NO: 151637 - DNA, 20 bp, Artificial Sequence
  Description of Artificial Sequence: Synthetic oligonucleotide
  Target: ATXN1; (+) strand; PAM type: NRG; PAM sequence: GAG
atatgggtgtagagttaaag

SEQ ID NO: 151638 - DNA, 20 bp, Artificial Sequence
  Description of Artificial Sequence: Synthetic oligonucleotide
  Target: ATXN1; (+) strand; PAM type: NRG; PAM sequence: TAG
actgtattttattttatatt

SEQ ID NO: 151639 - DNA, 20 bp, Artificial Sequence
  Description of Artificial Sequence: Synthetic oligonucleotide
  Target: ATXN1; (+) strand; PAM type: NRG; PAM sequence: AAG
atttttgaacataattttgc

SEQ ID NO: 151640 - DNA, 20 bp, Artificial Sequence
  Description of Artificial Sequence: Synthetic oligonucleotide
  Target: ATXN1; (+) strand; PAM type: NRG; PAM sequence: CAG
ttgcaagttctacaatgaca

SEQ ID NO: 151641 - DNA, 20 bp, Artificial Sequence
  Description of Artificial Sequence: Synthetic oligonucleotide
  Target: ATXN1; (+) strand; PAM type: NRG; PAM sequence: AGG
tgcaagttctacaatgacac

SEQ ID NO: 151642 - DNA, 20 bp, Artificial Sequence
  Description of Artificial Sequence: Synthetic oligonucleotide
  Target: ATXN1; (+) strand; PAM type: NRG; PAM sequence: TGG
aagttctacaatgacacagg

SEQ ID NO: 151643 - DNA, 20 bp, Artificial Sequence
  Description of Artificial Sequence: Synthetic oligonucleotide
  Target: ATXN1; (+) strand; PAM type: NRG; PAM sequence: TAG
ttctacaatgacacaggtgg

SEQ ID NO: 151644 - DNA, 20 bp, Artificial Sequence
  Description of Artificial Sequence: Synthetic oligonucleotide
  Target: ATXN1; (+) strand; PAM type: NRG; PAM sequence: AGG
tctacaatgacacaggtggt

SEQ ID NO: 151645 - DNA, 20 bp, Artificial Sequence
  Description of Artificial Sequence: Synthetic oligonucleotide
  Target: ATXN1; (+) strand; PAM type: NRG; PAM sequence: TAG
atgacacaggtggtaggcaa

SEQ ID NO: 151646 - DNA, 20 bp, Artificial Sequence
  Description of Artificial Sequence: Synthetic oligonucleotide
  Target: ATXN1; (+) strand; PAM type: NRG; PAM sequence: GAG
gacacaggtggtaggcaata

SEQ ID NO: 151647 - DNA, 20 bp, Artificial Sequence
  Description of Artificial Sequence: Synthetic oligonucleotide
  Target: ATXN1; (+) strand; PAM type: NRG; PAM sequence: TAG
ggtaggcaatagagtataat

SEQ ID NO: 151648 - DNA, 20 bp, Artificial Sequence
  Description of Artificial Sequence: Synthetic oligonucleotide
  Target: ATXN1; (+) strand; PAM type: NRG; PAM sequence: AAG
aatagagtataattagttaa

SEQ ID NO: 151649 - DNA, 20 bp, Artificial Sequence
  Description of Artificial Sequence: Synthetic oligonucleotide
  Target: ATXN1; (+) strand; PAM type: NRG; PAM sequence: CAG
agtataattagttaaaagca

SEQ ID NO: 151650 - DNA, 20 bp, Artificial Sequence
  Description of Artificial Sequence: Synthetic oligonucleotide
  Target: ATXN1; (+) strand; PAM type: NRG; PAM sequence: AGG
gtataattagttaaaagcac

SEQ ID NO: 151651 - DNA, 20 bp, Artificial Sequence
  Description of Artificial Sequence: Synthetic oligonucleotide
  Target: ATXN1; (+) strand; PAM type: NRG; PAM sequence: GGG
tataattagttaaaagcaca

SEQ ID NO: 151652 - DNA, 20 bp, Artificial Sequence
  Description of Artificial Sequence: Synthetic oligonucleotide
  Target: ATXN1; (+) strand; PAM type: NRG; PAM sequence: AAG
tagttaaaagcacagggtct

SEQ ID NO: 151653 - DNA, 20 bp, Artificial Sequence
  Description of Artificial Sequence: Synthetic oligonucleotide
  Target: ATXN1; (+) strand; PAM type: NRG; PAM sequence: AGG
agttaaaagcacagggtcta

SEQ ID NO: 151654 - DNA, 20 bp, Artificial Sequence
  Description of Artificial Sequence: Synthetic oligonucleotide
  Target: ATXN1; (+) strand; PAM type: NRG; PAM sequence: TGG
cacagggtctaaggttaaaa

SEQ ID NO: 151655 - DNA, 20 bp, Artificial Sequence
  Description of Artificial Sequence: Synthetic oligonucleotide
  Target: ATXN1; (+) strand; PAM type: NRG; PAM sequence: AAG
aggttaaaatggcatgcatg

SEQ ID NO: 151656 - DNA, 20 bp, Artificial Sequence
  Description of Artificial Sequence: Synthetic oligonucleotide
  Target: ATXN1; (+) strand; PAM type: NRG; PAM sequence: CAG
aaaatggcatgcatgaagcc

SEQ ID NO: 151657 - DNA, 20 bp, Artificial Sequence
  Description of Artificial Sequence: Synthetic oligonucleotide
  Target: ATXN1; (+) strand; PAM type: NRG; PAM sequence: TAG
agcccagtcccaccacttac

SEQ ID NO: 151658 - DNA, 20 bp, Artificial Sequence
  Description of Artificial Sequence: Synthetic oligonucleotide
  Target: ATXN1; (+) strand; PAM type: NRG; PAM sequence: TGG
acttactagctctgtgacct

SEQ ID NO: 151659 - DNA, 20 bp, Artificial Sequence
  Description of Artificial Sequence: Synthetic oligonucleotide
  Target: ATXN1; (+) strand; PAM type: NRG; PAM sequence: GGG
cttactagctctgtgacctt

SEQ ID NO: 151660 - DNA, 20 bp, Artificial Sequence
  Description of Artificial Sequence: Synthetic oligonucleotide
  Target: ATXN1; (+) strand; PAM type: NRG; PAM sequence: AAG
ctagctctgtgaccttgggc

SEQ ID NO: 151661 - DNA, 20 bp, Artificial Sequence
  Description of Artificial Sequence: Synthetic oligonucleotide
  Target: ATXN1; (+) strand; PAM type: NRG; PAM sequence: CGG
ccttgggcaagctactaacc

SEQ ID NO: 151662 - DNA, 20 bp, Artificial Sequence
  Description of Artificial Sequence: Synthetic oligonucleotide
  Target: ATXN1; (+) strand; PAM type: NRG; PAM sequence: AAG
aacccggttacctcatctgt

SEQ ID NO: 151663 - DNA, 20 bp, Artificial Sequence
  Description of Artificial Sequence: Synthetic oligonucleotide
  Target: ATXN1; (+) strand; PAM type: NRG; PAM sequence: AGG
acccggttacctcatctgta

SEQ ID NO: 151664 - DNA, 20 bp, Artificial Sequence
  Description of Artificial Sequence: Synthetic oligonucleotide
  Target: ATXN1; (+) strand; PAM type: NRG; PAM sequence: TGG
cggttacctcatctgtaagg

SEQ ID NO: 151665 - DNA, 20 bp, Artificial Sequence
  Description of Artificial Sequence: Synthetic oligonucleotide
  Target: ATXN1; (+) strand; PAM type: NRG; PAM sequence: GAG
gttacctcatctgtaaggtg

SEQ ID NO: 151666 - DNA, 20 bp, Artificial Sequence
  Description of Artificial Sequence: Synthetic oligonucleotide
  Target: ATXN1; (+) strand; PAM type: NRG; PAM sequence: TAG
ggagataataatgacctatg

SEQ ID NO: 151667 - DNA, 20 bp, Artificial Sequence
  Description of Artificial Sequence: Synthetic oligonucleotide
  Target: ATXN1; (+) strand; PAM type: NRG; PAM sequence: AGG
gagataataatgacctatgt

SEQ ID NO: 151668 - DNA, 20 bp, Artificial Sequence
  Description of Artificial Sequence: Synthetic oligonucleotide
  Target: ATXN1; (+) strand; PAM type: NRG; PAM sequence: GAG
gacctatgtaggtttactgt

SEQ ID NO: 151669 - DNA, 20 bp, Artificial Sequence
  Description of Artificial Sequence: Synthetic oligonucleotide
  Target: ATXN1; (+) strand; PAM type: NRG; PAM sequence: AGG
acctatgtaggtttactgtg

SEQ ID NO: 151670 - DNA, 20 bp, Artificial Sequence
  Description of Artificial Sequence: Synthetic oligonucleotide
  Target: ATXN1; (+) strand; PAM type: NRG; PAM sequence: AAG
gtaggtttactgtgaggatt

SEQ ID NO: 151671 - DNA, 20 bp, Artificial Sequence
  Description of Artificial Sequence: Synthetic oligonucleotide
  Target: ATXN1; (+) strand; PAM type: NRG; PAM sequence: TAG
tactgtgaggattaagtgat

SEQ ID NO: 151672 - DNA, 20 bp, Artificial Sequence
  Description of Artificial Sequence: Synthetic oligonucleotide
  Target: ATXN1; (+) strand; PAM type: NRG; PAM sequence: CAG
tgaggattaagtgattagta

SEQ ID NO: 151673 - DNA, 20 bp, Artificial Sequence
  Description of Artificial Sequence: Synthetic oligonucleotide
  Target: ATXN1; (+) strand; PAM type: NRG; PAM sequence: CAG
atcctaaatcctcaatatgc

SEQ ID NO: 151674 - DNA, 20 bp, Artificial Sequence
  Description of Artificial Sequence: Synthetic oligonucleotide
  Target: ATXN1; (+) strand; PAM type: NRG; PAM sequence: CAG
taaatcctcaatatgccagc

SEQ ID NO: 151675 - DNA, 20 bp, Artificial Sequence
  Description of Artificial Sequence: Synthetic oligonucleotide
  Target: ATXN1; (+) strand; PAM type: NRG; PAM sequence: TAG
cagccagccattattattgt

SEQ ID NO: 151676 - DNA, 20 bp, Artificial Sequence
  Description of Artificial Sequence: Synthetic oligonucleotide
  Target: ATXN1; (+) strand; PAM type: NRG; PAM sequence: AAG
ccagccattattattgttag

SEQ ID NO: 151677 - DNA, 20 bp, Artificial Sequence
  Description of Artificial Sequence: Synthetic oligonucleotide
  Target: ATXN1; (+) strand; PAM type: NRG; PAM sequence: CAG
cattattattgttagaagaa

SEQ ID NO: 151678 - DNA, 20 bp, Artificial Sequence
  Description of Artificial Sequence: Synthetic oligonucleotide
  Target: ATXN1; (+) strand; PAM type: NRG; PAM sequence: AGG
attattattgttagaagaac

SEQ ID NO: 151679 - DNA, 20 bp, Artificial Sequence
  Description of Artificial Sequence: Synthetic oligonucleotide
  Target: ATXN1; (+) strand; PAM type: NRG; PAM sequence: TGG
agaacaggctccctgcattg

SEQ ID NO: 151680 - DNA, 20 bp, Artificial Sequence
  Description of Artificial Sequence: Synthetic oligonucleotide
  Target: ATXN1; (+) strand; PAM type: NRG; PAM sequence: GGG
gaacaggctccctgcattgt

SEQ ID NO: 151681 - DNA, 20 bp, Artificial Sequence
  Description of Artificial Sequence: Synthetic oligonucleotide
  Target: ATXN1; (+) strand; PAM type: NRG; PAM sequence: GAG
cctgcattgtgggcttttct

SEQ ID NO: 151682 - DNA, 20 bp, Artificial Sequence
  Description of Artificial Sequence: Synthetic oligonucleotide
  Target: ATXN1; (+) strand; PAM type: NRG; PAM sequence: CAG
gatttattgaataaaactat

SEQ ID NO: 151683 - DNA, 20 bp, Artificial Sequence
  Description of Artificial Sequence: Synthetic oligonucleotide
  Target: ATXN1; (+) strand; PAM type: NRG; PAM sequence: AAG
gaataaaactatcagcaatc

SEQ ID NO: 151684 - DNA, 20 bp, Artificial Sequence
  Description of Artificial Sequence: Synthetic oligonucleotide
  Target: ATXN1; (+) strand; PAM type: NRG; PAM sequence: AAG
caatcaagttccactttttt

SEQ ID NO: 151685 - DNA, 20 bp, Artificial Sequence
  Description of Artificial Sequence: Synthetic oligonucleotide
  Target: ATXN1; (+) strand; PAM type: NRG; PAM sequence: GAG
atcaagttccacttttttaa

SEQ ID NO: 151686 - DNA, 20 bp, Artificial Sequence
  Description of Artificial Sequence: Synthetic oligonucleotide
  Target: ATXN1; (+) strand; PAM type: NRG; PAM sequence: TAG
agagccactccgtgtgtcac

SEQ ID NO: 151687 - DNA, 20 bp, Artificial Sequence
  Description of Artificial Sequence: Synthetic oligonucleotide
  Target: ATXN1; (+) strand; PAM type: NRG; PAM sequence: AAG
gccactccgtgtgtcactag

SEQ ID NO: 151688 - DNA, 20 bp, Artificial Sequence
  Description of Artificial Sequence: Synthetic oligonucleotide
  Target: ATXN1; (+) strand; PAM type: NRG; PAM sequence: TGG
ctagaagatgcccaaatgaa

SEQ ID NO: 151689 - DNA, 20 bp, Artificial Sequence
  Description of Artificial Sequence: Synthetic oligonucleotide
  Target: ATXN1; (+) strand; PAM type: NRG; PAM sequence: GAG
agaagatgcccaaatgaatg

SEQ ID NO: 151690 - DNA, 20 bp, Artificial Sequence
  Description of Artificial Sequence: Synthetic oligonucleotide
  Target: ATXN1; (+) strand; PAM type: NRG; PAM sequence: AGG
gaagatgcccaaatgaatgg

SEQ ID NO: 151691 - DNA, 20 bp, Artificial Sequence
  Description of Artificial Sequence: Synthetic oligonucleotide
  Target: ATXN1; (+) strand; PAM type: NRG; PAM sequence: TGG
aatggaggaaacaaatctaa

SEQ ID NO: 151692 - DNA, 20 bp, Artificial Sequence
  Description of Artificial Sequence: Synthetic oligonucleotide
  Target: ATXN1; (+) strand; PAM type: NRG; PAM sequence: AAG
aaacaaatctaatggtttat

SEQ ID NO: 151693 - DNA, 20 bp, Artificial Sequence
  Description of Artificial Sequence: Synthetic oligonucleotide
  Target: ATXN1; (+) strand; PAM type: NRG; PAM sequence: AAG
aatctaatggtttataagaa

SEQ ID NO: 151694 - DNA, 20 bp, Artificial Sequence
  Description of Artificial Sequence: Synthetic oligonucleotide
  Target: ATXN1; (+) strand; PAM type: NRG; PAM sequence: AAG
tggtttataagaaaagtgtg

SEQ ID NO: 151695 - DNA, 20 bp, Artificial Sequence
  Description of Artificial Sequence: Synthetic oligonucleotide
  Target: ATXN1; (+) strand; PAM type: NRG; PAM sequence: CAG
gtgtgaagaatctgaatatc

SEQ ID NO: 151696 - DNA, 20 bp, Artificial Sequence
  Description of Artificial Sequence: Synthetic oligonucleotide
  Target: ATXN1; (+) strand; PAM type: NRG; PAM sequence: AGG
tgtgaagaatctgaatatcc

SEQ ID NO: 151697 - DNA, 20 bp, Artificial Sequence
  Description of Artificial Sequence: Synthetic oligonucleotide
  Target: ATXN1; (+) strand; PAM type: NRG; PAM sequence: CAG
tgaatatccaggaacccttt

SEQ ID NO: 151698 - DNA, 20 bp, Artificial Sequence
  Description of Artificial Sequence: Synthetic oligonucleotide
  Target: ATXN1; (+) strand; PAM type: NRG; PAM sequence: AGG
gaatatccaggaaccctttc

SEQ ID NO: 151699 - DNA, 20 bp, Artificial Sequence
  Description of Artificial Sequence: Synthetic oligonucleotide
  Target: ATXN1; (+) strand; PAM type: NRG; PAM sequence: GGG
aatatccaggaaccctttca

SEQ ID NO: 151700 - DNA, 20 bp, Artificial Sequence
  Description of Artificial Sequence: Synthetic oligonucleotide
  Target: ATXN1; (+) strand; PAM type: NRG; PAM sequence: AAG
atccaggaaccctttcaggg

SEQ ID NO: 151701 - DNA, 20 bp, Artificial Sequence
  Description of Artificial Sequence: Synthetic oligonucleotide
  Target: ATXN1; (+) strand; PAM type: NRG; PAM sequence: AAG
taatattaactgctatatat

SEQ ID NO: 151702 - DNA, 20 bp, Artificial Sequence
  Description of Artificial Sequence: Synthetic oligonucleotide
  Target: ATXN1; (+) strand; PAM type: NRG; PAM sequence: GAG
atattaactgctatatataa

SEQ ID NO: 151703 - DNA, 20 bp, Artificial Sequence
  Description of Artificial Sequence: Synthetic oligonucleotide
  Target: ATXN1; (+) strand; PAM type: NRG; PAM sequence: AAG
ttaactgctatatataagag

SEQ ID NO: 151704 - DNA, 20 bp, Artificial Sequence
  Description of Artificial Sequence: Synthetic oligonucleotide
  Target: ATXN1; (+) strand; PAM type: NRG; PAM sequence: CGG
agaagaccaaaattctgtct

SEQ ID NO: 151705 - DNA, 20 bp, Artificial Sequence
  Description of Artificial Sequence: Synthetic oligonucleotide
  Target: ATXN1; (+) strand; PAM type: NRG; PAM sequence: GGG
gaagaccaaaattctgtctc

SEQ ID NO: 151706 - DNA, 20 bp, Artificial Sequence
  Description of Artificial Sequence: Synthetic oligonucleotide
  Target: ATXN1; (+) strand; PAM type: NRG; PAM sequence: GGG
aagaccaaaattctgtctcg

SEQ ID NO: 151707 - DNA, 20 bp, Artificial Sequence
  Description of Artificial Sequence: Synthetic oligonucleotide
  Target: ATXN1; (+) strand; PAM type: NRG; PAM sequence: CAG
caaaattctgtctcggggta

SEQ ID NO: 151708 - DNA, 20 bp, Artificial Sequence
  Description of Artificial Sequence: Synthetic oligonucleotide
  Target: ATXN1; (+) strand; PAM type: NRG; PAM sequence: CAG
ctcggggtacagacaaaatc

SEQ ID NO: 151709 - DNA, 20 bp, Artificial Sequence
  Description of Artificial Sequence: Synthetic oligonucleotide
  Target: ATXN1; (+) strand; PAM type: NRG; PAM sequence: CAG
ggggtacagacaaaatccag

SEQ ID NO: 151710 - DNA, 20 bp, Artificial Sequence
  Description of Artificial Sequence: Synthetic oligonucleotide
  Target: ATXN1; (+) strand; PAM type: NRG; PAM sequence: AAG
caaaatccagcagtaattta

SEQ ID NO: 151711 - DNA, 20 bp, Artificial Sequence
  Description of Artificial Sequence: Synthetic oligonucleotide
  Target: ATXN1; (+) strand; PAM type: NRG; PAM sequence: AAG
cagcagtaatttaaagtatg

SEQ ID NO: 151712 - DNA, 20 bp, Artificial Sequence
  Description of Artificial Sequence: Synthetic oligonucleotide
  Target: ATXN1; (+) strand; PAM type: NRG; PAM sequence: TAG
agatatctaccactcacctg

SEQ ID NO: 151713 - DNA, 20 bp, Artificial Sequence
  Description of Artificial Sequence: Synthetic oligonucleotide
  Target: ATXN1; (+) strand; PAM type: NRG; PAM sequence: AGG
gatatctaccactcacctgt

SEQ ID NO: 151714 - DNA, 20 bp, Artificial Sequence
  Description of Artificial Sequence: Synthetic oligonucleotide
  Target: ATXN1; (+) strand; PAM type: NRG; PAM sequence: CAG
cactcacctgtaggtgtact

SEQ ID NO: 151715 - DNA, 20 bp, Artificial Sequence
  Description of Artificial Sequence: Synthetic oligonucleotide
  Target: ATXN1; (+) strand; PAM type: NRG; PAM sequence: GAG
ctcacctgtaggtgtactca

SEQ ID NO: 151716 - DNA, 20 bp, Artificial Sequence
  Description of Artificial Sequence: Synthetic oligonucleotide
  Target: ATXN1; (+) strand; PAM type: NRG; PAM sequence: AAG
cagagttcacaaaatacatt

SEQ ID NO: 151717 - DNA, 20 bp, Artificial Sequence
  Description of Artificial Sequence: Synthetic oligonucleotide
  Target: ATXN1; (+) strand; PAM type: NRG; PAM sequence: AAG
cctaatatcttacattgaca

SEQ ID NO: 151718 - DNA, 20 bp, Artificial Sequence
  Description of Artificial Sequence: Synthetic oligonucleotide
  Target: ATXN1; (+) strand; PAM type: NRG; PAM sequence: TAG
cattgacaaagaataatcat

SEQ ID NO: 151719 - DNA, 20 bp, Artificial Sequence
  Description of Artificial Sequence: Synthetic oligonucleotide
  Target: ATXN1; (+) strand; PAM type: NRG; PAM sequence: AGG
attgacaaagaataatcatt

SEQ ID NO: 151720 - DNA, 20 bp, Artificial Sequence
  Description of Artificial Sequence: Synthetic oligonucleotide
  Target: ATXN1; (+) strand; PAM type: NRG; PAM sequence: AAG
gacaaagaataatcattagg

SEQ ID NO: 151721 - DNA, 20 bp, Artificial Sequence
  Description of Artificial Sequence: Synthetic oligonucleotide
  Target: ATXN1; (+) strand; PAM type: NRG; PAM sequence: AAG
atccacttaactctttttaa

SEQ ID NO: 151722 - DNA, 20 bp, Artificial Sequence
  Description of Artificial Sequence: Synthetic oligonucleotide
  Target: ATXN1; (+) strand; PAM type: NRG; PAM sequence: AGG
tccacttaactctttttaaa

SEQ ID NO: 151723 - DNA, 20 bp, Artificial Sequence
  Description of Artificial Sequence: Synthetic oligonucleotide
  Target: ATXN1; (+) strand; PAM type: NRG; PAM sequence: CAG
taactctttttaaaaggttg

SEQ ID NO: 151724 - DNA, 20 bp, Artificial Sequence
  Description of Artificial Sequence: Synthetic oligonucleotide
  Target: ATXN1; (+) strand; PAM type: NRG; PAM sequence: GAG
tctttttaaaaggttgcagt

SEQ ID NO: 151725 - DNA, 20 bp, Artificial Sequence
  Description of Artificial Sequence: Synthetic oligonucleotide
  Target: ATXN1; (+) strand; PAM type: NRG; PAM sequence: GAG
ttaaaaggttgcagtgagct

SEQ ID NO: 151726 - DNA, 20 bp, Artificial Sequence
  Description of Artificial Sequence: Synthetic oligonucleotide
  Target: ATXN1; (+) strand; PAM type: NRG; PAM sequence: CAG
gagatcgtgccattgcactc

SEQ ID NO: 151727 - DNA, 20 bp, Artificial Sequence
  Description of Artificial Sequence: Synthetic oligonucleotide
  Target: ATXN1; (+) strand; PAM type: NRG; PAM sequence: CAG
cgtgccattgcactccagcc

SEQ ID NO: 151728 - DNA, 20 bp, Artificial Sequence
  Description of Artificial Sequence: Synthetic oligonucleotide
  Target: ATXN1; (+) strand; PAM type: NRG; PAM sequence: AGG
gtgccattgcactccagccc

SEQ ID NO: 151729 - DNA, 20 bp, Artificial Sequence
  Description of Artificial Sequence: Synthetic oligonucleotide
  Target: ATXN1; (+) strand; PAM type: NRG; PAM sequence: CAG
ttgcactccagcccaggcaa

SEQ ID NO: 151730 - DNA, 20 bp, Artificial Sequence
  Description of Artificial Sequence: Synthetic oligonucleotide
  Target: ATXN1; (+) strand; PAM type: NRG; PAM sequence: GAG
tccagcccaggcaacagtgc

SEQ ID NO: 151731 - DNA, 20 bp, Artificial Sequence
  Description of Artificial Sequence: Synthetic oligonucleotide
  Target: ATXN1; (+) strand; PAM type: NRG; PAM sequence: AAG
tgcgagactccatctcaaaa

SEQ ID NO: 151732 - DNA, 20 bp, Artificial Sequence
  Description of Artificial Sequence: Synthetic oligonucleotide
  Target: ATXN1; (+) strand; PAM type: NRG; PAM sequence: AAG
tccctcaaataatacaaaaa

SEQ ID NO: 151733 - DNA, 20 bp, Artificial Sequence
  Description of Artificial Sequence: Synthetic oligonucleotide
  Target: ATXN1; (+) strand; PAM type: NRG; PAM sequence: AAG
ataatacaaaaaaagcatca

SEQ ID NO: 151734 - DNA, 20 bp, Artificial Sequence
  Description of Artificial Sequence: Synthetic oligonucleotide
  Target: ATXN1; (+) strand; PAM type: NRG; PAM sequence: GAG
aatacaaaaaaagcatcaaa

SEQ ID NO: 151735 - DNA, 20 bp, Artificial Sequence
  Description of Artificial Sequence: Synthetic oligonucleotide
  Target: ATXN1; (+) strand; PAM type: NRG; PAM sequence: AAG
aaagcatcaaagagtaatca

SEQ ID NO: 151736 - DNA, 20 bp, Artificial Sequence
  Description of Artificial Sequence: Synthetic oligonucleotide
  Target: ATXN1; (+) strand; PAM type: NRG; PAM sequence: TGG
gattaatctgtttgaaacca

SEQ ID NO: 151737 - DNA, 20 bp, Artificial Sequence
  Description of Artificial Sequence: Synthetic oligonucleotide
  Target: ATXN1; (+) strand; PAM type: NRG; PAM sequence: GGG
attaatctgtttgaaaccat

SEQ ID NO: 151738 - DNA, 20 bp, Artificial Sequence
  Description of Artificial Sequence: Synthetic oligonucleotide
  Target: ATXN1; (+) strand; PAM type: NRG; PAM sequence: TAG
tccgcattatttttccctgc

SEQ ID NO: 151739 - DNA, 20 bp, Artificial Sequence
  Description of Artificial Sequence: Synthetic oligonucleotide
  Target: ATXN1; (+) strand; PAM type: NRG; PAM sequence: TAG
attatttttccctgctagca

SEQ ID NO: 151740 - DNA, 20 bp, Artificial Sequence
  Description of Artificial Sequence: Synthetic oligonucleotide
  Target: ATXN1; (+) strand; PAM type: NRG; PAM sequence: TAG
ctagcatagtactctgcata

SEQ ID NO: 151741 - DNA, 20 bp, Artificial Sequence
  Description of Artificial Sequence: Synthetic oligonucleotide
  Target: ATXN1; (+) strand; PAM type: NRG; PAM sequence: TAG
gcatagtactctgcatatag

SEQ ID NO: 151742 - DNA, 20 bp, Artificial Sequence
  Description of Artificial Sequence: Synthetic oligonucleotide
  Target: ATXN1; (+) strand; PAM type: NRG; PAM sequence: AGG
catagtactctgcatatagt

SEQ ID NO: 151743 - DNA, 20 bp, Artificial Sequence
  Description of Artificial Sequence: Synthetic oligonucleotide
  Target: ATXN1; (+) strand; PAM type: NRG; PAM sequence: GAG
tactctgcatatagtaggct

SEQ ID NO: 151744 - DNA, 20 bp, Artificial Sequence
  Description of Artificial Sequence: Synthetic oligonucleotide
  Target: ATXN1; (+) strand; PAM type: NRG; PAM sequence: TAG
tatagtaggctgagaaaaaa

SEQ ID NO: 151745 - DNA, 20 bp, Artificial Sequence
  Description of Artificial Sequence: Synthetic oligonucleotide
  Target: ATXN1; (+) strand; PAM type: NRG; PAM sequence: GAG
aattaaattgaatgcaaaat

SEQ ID NO: 151746 - DNA, 20 bp, Artificial Sequence
  Description of Artificial Sequence: Synthetic oligonucleotide
  Target: ATXN1; (+) strand; PAM type: NRG; PAM sequence: TAG
aattgaatgcaaaatgagat

SEQ ID NO: 151747 - DNA, 20 bp, Artificial Sequence
  Description of Artificial Sequence: Synthetic oligonucleotide
  Target: ATXN1; (+) strand; PAM type: NRG; PAM sequence: AAG
gcaaaatgagattagacaaa

SEQ ID NO: 151748 - DNA, 20 bp, Artificial Sequence
  Description of Artificial Sequence: Synthetic oligonucleotide
  Target: ATXN1; (+) strand; PAM type: NRG; PAM sequence: AAG
attagacaaaaagatgttta

SEQ ID NO: 151749 - DNA, 20 bp, Artificial Sequence
  Description of Artificial Sequence: Synthetic oligonucleotide
  Target: ATXN1; (+) strand; PAM type: NRG; PAM sequence: TAG
actcaaactgttattgatta

SEQ ID NO: 151750 - DNA, 20 bp, Artificial Sequence
  Description of Artificial Sequence: Synthetic oligonucleotide
  Target: ATXN1; (+) strand; PAM type: NRG; PAM sequence: TGG
ttgattatagctgatattca

SEQ ID NO: 151751 - DNA, 20 bp, Artificial Sequence
  Description of Artificial Sequence: Synthetic oligonucleotide
  Target: ATXN1; (+) strand; PAM type: NRG; PAM sequence: CAG
tgatattcatggctaaactc

SEQ ID NO: 151752 - DNA, 20 bp, Artificial Sequence
  Description of Artificial Sequence: Synthetic oligonucleotide
  Target: ATXN1; (+) strand; PAM type: NRG; PAM sequence: GAG
tccttaatttcacttaatgt

SEQ ID NO: 151753 - DNA, 20 bp, Artificial Sequence
  Description of Artificial Sequence: Synthetic oligonucleotide
  Target: ATXN1; (+) strand; PAM type: NRG; PAM sequence: CAG
atgtgagcatgttcaatcta

SEQ ID NO: 151754 - DNA, 20 bp, Artificial Sequence
  Description of Artificial Sequence: Synthetic oligonucleotide
  Target: ATXN1; (+) strand; PAM type: NRG; PAM sequence: CAG
tcaatctacagctttgattt

SEQ ID NO: 151755 - DNA, 20 bp, Artificial Sequence
  Description of Artificial Sequence: Synthetic oligonucleotide
  Target: ATXN1; (+) strand; PAM type: NRG; PAM sequence: AAG
agtgtttaattttattatca

SEQ ID NO: 151756 - DNA, 20 bp, Artificial Sequence
  Description of Artificial Sequence: Synthetic oligonucleotide
  Target: ATXN1; (+) strand; PAM type: NRG; PAM sequence: AAG
aattttattatcaaagtatt

SEQ ID NO: 151757 - DNA, 20 bp, Artificial Sequence
  Description of Artificial Sequence: Synthetic oligonucleotide
  Target: ATXN1; (+) strand; PAM type: NRG; PAM sequence: TGG
gtattaagaatatgcctacc

SEQ ID NO: 151758 - DNA, 20 bp, Artificial Sequence
  Description of Artificial Sequence: Synthetic oligonucleotide
  Target: ATXN1; (+) strand; PAM type: NRG; PAM sequence: AAG
taagaatatgcctacctggt

SEQ ID NO: 151759 - DNA, 20 bp, Artificial Sequence
  Description of Artificial Sequence: Synthetic oligonucleotide
  Target: ATXN1; (+) strand; PAM type: NRG; PAM sequence: TAG
atgcctacctggtaagtttt

SEQ ID NO: 151760 - DNA, 20 bp, Artificial Sequence
  Description of Artificial Sequence: Synthetic oligonucleotide
  Target: ATXN1; (+) strand; PAM type: NRG; PAM sequence: AAG
ggtaagtttttagaaacata

SEQ ID NO: 151761 - DNA, 20 bp, Artificial Sequence
  Description of Artificial Sequence: Synthetic oligonucleotide
  Target: ATXN1; (+) strand; PAM type: NRG; PAM sequence: AGG
gtaagtttttagaaacataa

SEQ ID NO: 151762 - DNA, 20 bp, Artificial Sequence
  Description of Artificial Sequence: Synthetic oligonucleotide
  Target: ATXN1; (+) strand; PAM type: NRG; PAM sequence: TGG
cataaaggaactgacaactt

SEQ ID NO: 151763 - DNA, 20 bp, Artificial Sequence
  Description of Artificial Sequence: Synthetic oligonucleotide
  Target: ATXN1; (+) strand; PAM type: NRG; PAM sequence: GGG
ataaaggaactgacaacttt

SEQ ID NO: 151764 - DNA, 20 bp, Artificial Sequence
  Description of Artificial Sequence: Synthetic oligonucleotide
  Target: ATXN1; (+) strand; PAM type: NRG; PAM sequence: AAG
gggaaatatatacgttctga

SEQ ID NO: 151765 - DNA, 20 bp, Artificial Sequence
  Description of Artificial Sequence: Synthetic oligonucleotide
  Target: ATXN1; (+) strand; PAM type: NRG; PAM sequence: AAG
cgttctgaaagaacgaaatt

SEQ ID NO: 151766 - DNA, 20 bp, Artificial Sequence
  Description of Artificial Sequence: Synthetic oligonucleotide
  Target: ATXN1; (+) strand; PAM type: NRG; PAM sequence: AGG
gttctgaaagaacgaaatta

SEQ ID NO: 151767 - DNA, 20 bp, Artificial Sequence
  Description of Artificial Sequence: Synthetic oligonucleotide
  Target: ATXN1; (+) strand; PAM type: NRG; PAM sequence: CAG
gctttgtgttctttctttaa

SEQ ID NO: 151768 - DNA, 20 bp, Artificial Sequence
  Description of Artificial Sequence: Synthetic oligonucleotide
  Target: ATXN1; (+) strand; PAM type: NRG; PAM sequence: CAG
aacagttcctaatctccctt

SEQ ID NO: 151769 - DNA, 20 bp, Artificial Sequence
  Description of Artificial Sequence: Synthetic oligonucleotide
  Target: ATXN1; (+) strand; PAM type: NRG; PAM sequence: TGG
tctcccttcagtgtatttat

SEQ ID NO: 151770 - DNA, 20 bp, Artificial Sequence
  Description of Artificial Sequence: Synthetic oligonucleotide
  Target: ATXN1; (+) strand; PAM type: NRG; PAM sequence: GGG
ctcccttcagtgtatttatt

SEQ ID NO: 151771 - DNA, 20 bp, Artificial Sequence
  Description of Artificial Sequence: Synthetic oligonucleotide
  Target: ATXN1; (+) strand; PAM type: NRG; PAM sequence: TAG
tcagtgtatttattgggcat

SEQ ID NO: 151772 - DNA, 20 bp, Artificial Sequence
  Description of Artificial Sequence: Synthetic oligonucleotide
  Target: ATXN1; (+) strand; PAM type: NRG; PAM sequence: CAG
ttagttgttatctaacacaa

SEQ ID NO: 151773 - DNA, 20 bp, Artificial Sequence
  Description of Artificial Sequence: Synthetic oligonucleotide
  Target: ATXN1; (+) strand; PAM type: NRG; PAM sequence: TAG
atctaacacaacagttctcc

SEQ ID NO: 151774 - DNA, 20 bp, Artificial Sequence
  Description of Artificial Sequence: Synthetic oligonucleotide
  Target: ATXN1; (+) strand; PAM type: NRG; PAM sequence: TAG
taacacaacagttctcctag

SEQ ID NO: 151775 - DNA, 20 bp, Artificial Sequence
  Description of Artificial Sequence: Synthetic oligonucleotide
  Target: ATXN1; (+) strand; PAM type: NRG; PAM sequence: AAG
atgaaatcaaccttaaaata

SEQ ID NO: 151776 - DNA, 20 bp, Artificial Sequence
  Description of Artificial Sequence: Synthetic oligonucleotide
  Target: ATXN1; (+) strand; PAM type: NRG; PAM sequence: GAG
gaaatcaaccttaaaataaa

SEQ ID NO: 151777 - DNA, 20 bp, Artificial Sequence
  Description of Artificial Sequence: Synthetic oligonucleotide
  Target: ATXN1; (+) strand; PAM type: NRG; PAM sequence: CAG
ccttaaaataaagagctttt

SEQ ID NO: 151778 - DNA, 20 bp, Artificial Sequence
  Description of Artificial Sequence: Synthetic oligonucleotide
  Target: ATXN1; (+) strand; PAM type: NRG; PAM sequence: AGG
cttaaaataaagagcttttc

SEQ ID NO: 151779 - DNA, 20 bp, Artificial Sequence
  Description of Artificial Sequence: Synthetic oligonucleotide
  Target: ATXN1; (+) strand; PAM type: NRG; PAM sequence: GAG
taaaataaagagcttttcag

SEQ ID NO: 151780 - DNA, 20 bp, Artificial Sequence
  Description of Artificial Sequence: Synthetic oligonucleotide
  Target: ATXN1; (+) strand; PAM type: NRG; PAM sequence: AAG
aagagcttttcaggagtaaa

SEQ ID NO: 151781 - DNA, 20 bp, Artificial Sequence
  Description of Artificial Sequence: Synthetic oligonucleotide
  Target: ATXN1; (+) strand; PAM type: NRG; PAM sequence: GAG
gagcttttcaggagtaaaaa

SEQ ID NO: 151782 - DNA, 20 bp, Artificial Sequence
  Description of Artificial Sequence: Synthetic oligonucleotide
  Target: ATXN1; (+) strand; PAM type: NRG; PAM sequence: AGG
agcttttcaggagtaaaaag

SEQ ID NO: 151783 - DNA, 20 bp, Artificial Sequence
  Description of Artificial Sequence: Synthetic oligonucleotide
  Target: ATXN1; (+) strand; PAM type: NRG; PAM sequence: AAG
gtaaaaagaggctgttacaa

SEQ ID NO: 151784 - DNA, 20 bp, Artificial Sequence
  Description of Artificial Sequence: Synthetic oligonucleotide
  Target: ATXN1; (+) strand; PAM type: NRG; PAM sequence: TAG
ctgttacaaaagaaaaatgc

SEQ ID NO: 151785 - DNA, 20 bp, Artificial Sequence
  Description of Artificial Sequence: Synthetic oligonucleotide
  Target: ATXN1; (+) strand; PAM type: NRG; PAM sequence: GAG
gttacaaaagaaaaatgcta

SEQ ID NO: 151786 - DNA, 20 bp, Artificial Sequence
  Description of Artificial Sequence: Synthetic oligonucleotide
  Target: ATXN1; (+) strand; PAM type: NRG; PAM sequence: AGG
ttacaaaagaaaaatgctag

SEQ ID NO: 151787 - DNA, 20 bp, Artificial Sequence
  Description of Artificial Sequence: Synthetic oligonucleotide
  Target: ATXN1; (+) strand; PAM type: NRG; PAM sequence: GGG
tacaaaagaaaaatgctaga

SEQ ID NO: 151788 - DNA, 20 bp, Artificial Sequence
  Description of Artificial Sequence: Synthetic oligonucleotide
  Target: ATXN1; (+) strand; PAM type: NRG; PAM sequence: GGG
acaaaagaaaaatgctagag

SEQ ID NO: 151789 - DNA, 20 bp, Artificial Sequence
  Description of Artificial Sequence: Synthetic oligonucleotide
  Target: ATXN1; (+) strand; PAM type: NRG; PAM sequence: TAG
ggaattatctttatatcaca

SEQ ID NO: 151790 - DNA, 20 bp, Artificial Sequence
  Description of Artificial Sequence: Synthetic oligonucleotide
  Target: ATXN1; (+) strand; PAM type: NRG; PAM sequence: TAG
tcacatagtaatttacatct

SEQ ID NO: 151791 - DNA, 20 bp, Artificial Sequence
  Description of Artificial Sequence: Synthetic oligonucleotide
  Target: ATXN1; (+) strand; PAM type: NRG; PAM sequence: AAG
atttacatcttagaaactta

SEQ ID NO: 151792 - DNA, 20 bp, Artificial Sequence
  Description of Artificial Sequence: Synthetic oligonucleotide
  Target: ATXN1; (+) strand; PAM type: NRG; PAM sequence: TAG
agaaacttaaagttgtatca

SEQ ID NO: 151793 - DNA, 20 bp, Artificial Sequence
  Description of Artificial Sequence: Synthetic oligonucleotide
  Target: ATXN1; (+) strand; PAM type: NRG; PAM sequence: TAG
ttgtatcatagctgtacaat

SEQ ID NO: 151794 - DNA, 20 bp, Artificial Sequence
  Description of Artificial Sequence: Synthetic oligonucleotide
  Target: ATXN1; (+) strand; PAM type: NRG; PAM sequence: GAG
caaaactgaatatattttat

SEQ ID NO: 151795 - DNA, 20 bp, Artificial Sequence
  Description of Artificial Sequence: Synthetic oligonucleotide
  Target: ATXN1; (+) strand; PAM type: NRG; PAM sequence: AAG
atgagatactgattactcac

SEQ ID NO: 151796 - DNA, 20 bp, Artificial Sequence
  Description of Artificial Sequence: Synthetic oligonucleotide
  Target: ATXN1; (+) strand; PAM type: NRG; PAM sequence: AAG
actgattactcacaagaaca

SEQ ID NO: 151797 - DNA, 20 bp, Artificial Sequence
  Description of Artificial Sequence: Synthetic oligonucleotide
  Target: ATXN1; (+) strand; PAM type: NRG; PAM sequence: AGG
ctgattactcacaagaacaa

SEQ ID NO: 151798 - DNA, 20 bp, Artificial Sequence
  Description of Artificial Sequence: Synthetic oligonucleotide
  Target: ATXN1; (+) strand; PAM type: NRG; PAM sequence: GGG
tgattactcacaagaacaaa

SEQ ID NO: 151799 - DNA, 20 bp, Artificial Sequence
  Description of Artificial Sequence: Synthetic oligonucleotide
  Target: ATXN1; (+) strand; PAM type: NRG; PAM sequence: AAG
aacaaagggaaatccaattg

SEQ ID NO: 151800 - DNA, 20 bp, Artificial Sequence
  Description of Artificial Sequence: Synthetic oligonucleotide
  Target: ATXN1; (+) strand; PAM type: NRG; PAM sequence: AGG
acaaagggaaatccaattga

SEQ ID NO: 151801 - DNA, 20 bp, Artificial Sequence
  Description of Artificial Sequence: Synthetic oligonucleotide
  Target: ATXN1; (+) strand; PAM type: NRG; PAM sequence: CAG
gattaaattcctgtcaaaac

SEQ ID NO: 151802 - DNA, 20 bp, Artificial Sequence
  Description of Artificial Sequence: Synthetic oligonucleotide
  Target: ATXN1; (+) strand; PAM type: NRG; PAM sequence: AAG
gtgtctgcacgtatatcgca

SEQ ID NO: 151803 - DNA, 20 bp, Artificial Sequence
  Description of Artificial Sequence: Synthetic oligonucleotide
  Target: ATXN1; (+) strand; PAM type: NRG; PAM sequence: CAG
tgtgaatttgatgcatattc

SEQ ID NO: 151804 - DNA, 20 bp, Artificial Sequence
  Description of Artificial Sequence: Synthetic oligonucleotide
  Target: ATXN1; (+) strand; PAM type: NRG; PAM sequence: AGG
gtgaatttgatgcatattcc

SEQ ID NO: 151805 - DNA, 20 bp, Artificial Sequence
  Description of Artificial Sequence: Synthetic oligonucleotide
  Target: ATXN1; (+) strand; PAM type: NRG; PAM sequence: CAG
ccaggtataaatcccctttc

SEQ ID NO: 151806 - DNA, 20 bp, Artificial Sequence
  Description of Artificial Sequence: Synthetic oligonucleotide
  Target: ATXN1; (+) strand; PAM type: NRG; PAM sequence: GAG
aggtataaatcccctttcca

SEQ ID NO: 151807 - DNA, 20 bp, Artificial Sequence
  Description of Artificial Sequence: Synthetic oligonucleotide
  Target: ATXN1; (+) strand; PAM type: NRG; PAM sequence: GAG
gtataaatcccctttccaga

SEQ ID NO: 151808 - DNA, 20 bp, Artificial Sequence
  Description of Artificial Sequence: Synthetic oligonucleotide
  Target: ATXN1; (+) strand; PAM type: NRG; PAM sequence: CAG
taaatcccctttccagagag

SEQ ID NO: 151809 - DNA, 20 bp, Artificial Sequence
  Description of Artificial Sequence: Synthetic oligonucleotide
  Target: ATXN1; (+) strand; PAM type: NRG; PAM sequence: TAG
tgccacacttcaaactgaaa

SEQ ID NO: 151810 - DNA, 20 bp, Artificial Sequence
  Description of Artificial Sequence: Synthetic oligonucleotide
  Target: ATXN1; (+) strand; PAM type: NRG; PAM sequence: CAG
tcaaactgaaatagattcat

SEQ ID NO: 151811 - DNA, 20 bp, Artificial Sequence
  Description of Artificial Sequence: Synthetic oligonucleotide
  Target: ATXN1; (+) strand; PAM type: NRG; PAM sequence: CGG
aaatagattcatcagcattt

SEQ ID NO: 151812 - DNA, 20 bp, Artificial Sequence
  Description of Artificial Sequence: Synthetic oligonucleotide
  Target: ATXN1; (+) strand; PAM type: NRG; PAM sequence: GGG
aatagattcatcagcatttc

SEQ ID NO: 151813 - DNA, 20 bp, Artificial Sequence
  Description of Artificial Sequence: Synthetic oligonucleotide
  Target: ATXN1; (+) strand; PAM type: NRG; PAM sequence: CAG
gcatttcgggtacatacgaa

SEQ ID NO: 151814 - DNA, 20 bp, Artificial Sequence
  Description of Artificial Sequence: Synthetic oligonucleotide
  Target: ATXN1; (+) strand; PAM type: NRG; PAM sequence: AAG
tacatacgaacagctcccca

SEQ ID NO: 151815 - DNA, 20 bp, Artificial Sequence
  Description of Artificial Sequence: Synthetic oligonucleotide
  Target: ATXN1; (+) strand; PAM type: NRG; PAM sequence: TAG
gaacagctccccaaagccat

SEQ ID NO: 151816 - DNA, 20 bp, Artificial Sequence
  Description of Artificial Sequence: Synthetic oligonucleotide
  Target: ATXN1; (+) strand; PAM type: NRG; PAM sequence: AAG
gctccccaaagccattagca

SEQ ID NO: 151817 - DNA, 20 bp, Artificial Sequence
  Description of Artificial Sequence: Synthetic oligonucleotide
  Target: ATXN1; (+) strand; PAM type: NRG; PAM sequence: AGG
ctccccaaagccattagcaa

SEQ ID NO: 151818 - DNA, 20 bp, Artificial Sequence
  Description of Artificial Sequence: Synthetic oligonucleotide
  Target: ATXN1; (+) strand; PAM type: NRG; PAM sequence: AAG
cattagcaaaggttatttgt

SEQ ID NO: 151819 - DNA, 20 bp, Artificial Sequence
  Description of Artificial Sequence: Synthetic oligonucleotide
  Target: ATXN1; (+) strand; PAM type: NRG; PAM sequence: TGG
tagcaaaggttatttgtaag

SEQ ID NO: 151820 - DNA, 20 bp, Artificial Sequence
  Description of Artificial Sequence: Synthetic oligonucleotide
  Target: ATXN1; (+) strand; PAM type: NRG; PAM sequence: AAG
ttatttgtaagtggaaaatc

SEQ ID NO: 151821 - DNA, 20 bp, Artificial Sequence
  Description of Artificial Sequence: Synthetic oligonucleotide
  Target: ATXN1; (+) strand; PAM type: NRG; PAM sequence: GAG
atttgtaagtggaaaatcaa

SEQ ID NO: 151822 - DNA, 20 bp, Artificial Sequence
  Description of Artificial Sequence: Synthetic oligonucleotide
  Target: ATXN1; (+) strand; PAM type: NRG; PAM sequence: AAG
gtggaaaatcaagagacata

SEQ ID NO: 151823 - DNA, 20 bp, Artificial Sequence
  Description of Artificial Sequence: Synthetic oligonucleotide
  Target: ATXN1; (+) strand; PAM type: NRG; PAM sequence: AAG
caagagacataaagatttca

SEQ ID NO: 151824 - DNA, 20 bp, Artificial Sequence
  Description of Artificial Sequence: Synthetic oligonucleotide
  Target: ATXN1; (+) strand; PAM type: NRG; PAM sequence: TAG
agtcaaaatgcaatgttatt

SEQ ID NO: 151825 - DNA, 20 bp, Artificial Sequence
  Description of Artificial Sequence: Synthetic oligonucleotide
  Target: ATXN1; (+) strand; PAM type: NRG; PAM sequence: CAG
caatgttatttagttttctg

SEQ ID NO: 151826 - DNA, 20 bp, Artificial Sequence
  Description of Artificial Sequence: Synthetic oligonucleotide
  Target: ATXN1; (+) strand; PAM type: NRG; PAM sequence: AAG
agttttctgcagcacataac

SEQ ID NO: 151827 - DNA, 20 bp, Artificial Sequence
  Description of Artificial Sequence: Synthetic oligonucleotide
  Target: ATXN1; (+) strand; PAM type: NRG; PAM sequence: AGG
gttttctgcagcacataaca

SEQ ID NO: 151828 - DNA, 20 bp, Artificial Sequence
  Description of Artificial Sequence: Synthetic oligonucleotide
  Target: ATXN1; (+) strand; PAM type: NRG; PAM sequence: CAG
cataacaaggcaaaaacttt

SEQ ID NO: 151829 - DNA, 20 bp, Artificial Sequence
  Description of Artificial Sequence: Synthetic oligonucleotide
  Target: ATXN1; (+) strand; PAM type: NRG; PAM sequence: CAG
acaaggcaaaaactttcagt

SEQ ID NO: 151830 - DNA, 20 bp, Artificial Sequence
  Description of Artificial Sequence: Synthetic oligonucleotide
  Target: ATXN1; (+) strand; PAM type: NRG; PAM sequence: GAG
aaggcaaaaactttcagtca

SEQ ID NO: 151831 - DNA, 20 bp, Artificial Sequence
  Description of Artificial Sequence: Synthetic oligonucleotide
  Target: ATXN1; (+) strand; PAM type: NRG; PAM sequence: GAG
ggcaaaaactttcagtcaga

SEQ ID NO: 151832 - DNA, 20 bp, Artificial Sequence
  Description of Artificial Sequence: Synthetic oligonucleotide
  Target: ATXN1; (+) strand; PAM type: NRG; PAM sequence: AAG
aaactttcagtcagagagaa

SEQ ID NO: 151833 - DNA, 20 bp, Artificial Sequence
  Description of Artificial Sequence: Synthetic oligonucleotide
  Target: ATXN1; (+) strand; PAM type: NRG; PAM sequence: AAG
tcagtcagagagaaaagcaa

SEQ ID NO: 151834 - DNA, 20 bp, Artificial Sequence
  Description of Artificial Sequence: Synthetic oligonucleotide
  Target: ATXN1; (+) strand; PAM type: NRG; PAM sequence: AAG
tcagagagaaaagcaaaagc

SEQ ID NO: 151835 - DNA, 20 bp, Artificial Sequence
  Description of Artificial Sequence: Synthetic oligonucleotide
  Target: ATXN1; (+) strand; PAM type: NRG; PAM sequence: CAG
gcaagatcattgctccttca

SEQ ID NO: 151836 - DNA, 20 bp, Artificial Sequence
  Description of Artificial Sequence: Synthetic oligonucleotide
  Target: ATXN1; (+) strand; PAM type: NRG; PAM sequence: GAG
aagatcattgctccttcaca

SEQ ID NO: 151837 - DNA, 20 bp, Artificial Sequence
  Description of Artificial Sequence: Synthetic oligonucleotide
  Target: ATXN1; (+) strand; PAM type: NRG; PAM sequence: TGG
cattgctccttcacagagac

SEQ ID NO: 151838 - DNA, 20 bp, Artificial Sequence
  Description of Artificial Sequence: Synthetic oligonucleotide
  Target: ATXN1; (+) strand; PAM type: NRG; PAM sequence: AAG
ttcacagagactggtaaata

SEQ ID NO: 151839 - DNA, 20 bp, Artificial Sequence
  Description of Artificial Sequence: Synthetic oligonucleotide
  Target: ATXN1; (+) strand; PAM type: NRG; PAM sequence: TGG
gaatgtatgcacaaaacacc

SEQ ID NO: 151840 - DNA, 20 bp, Artificial Sequence
  Description of Artificial Sequence: Synthetic oligonucleotide
  Target: ATXN1; (+) strand; PAM type: NRG; PAM sequence: CAG
ttgctttcctgtttccttgc

SEQ ID NO: 151841 - DNA, 20 bp, Artificial Sequence
  Description of Artificial Sequence: Synthetic oligonucleotide
  Target: ATXN1; (+) strand; PAM type: NRG; PAM sequence: CAG
ttttttatatgattatctaa

SEQ ID NO: 151842 - DNA, 20 bp, Artificial Sequence
  Description of Artificial Sequence: Synthetic oligonucleotide
  Target: ATXN1; (+) strand; PAM type: NRG; PAM sequence: AAG
aacagtcaaacaaaccttca

SEQ ID NO: 151843 - DNA, 20 bp, Artificial Sequence
  Description of Artificial Sequence: Synthetic oligonucleotide
  Target: ATXN1; (+) strand; PAM type: NRG; PAM sequence: TAG
tcaaagcaatgaattacgca

SEQ ID NO: 151844 - DNA, 20 bp, Artificial Sequence
  Description of Artificial Sequence: Synthetic oligonucleotide
  Target: ATXN1; (+) strand; PAM type: NRG; PAM sequence: CAG
atgaattacgcatagacaca

SEQ ID NO: 151845 - DNA, 20 bp, Artificial Sequence
  Description of Artificial Sequence: Synthetic oligonucleotide
  Target: ATXN1; (+) strand; PAM type: NRG; PAM sequence: AAG
acagacacactctcacacaa

SEQ ID NO: 151846 - DNA, 20 bp, Artificial Sequence
  Description of Artificial Sequence: Synthetic oligonucleotide
  Target: ATXN1; (+) strand; PAM type: NRG; PAM sequence: GAG
agacacactctcacacaaaa

SEQ ID NO: 151847 - DNA, 20 bp, Artificial Sequence
  Description of Artificial Sequence: Synthetic oligonucleotide
  Target: ATXN1; (+) strand; PAM type: NRG; PAM sequence: GAG
acacactctcacacaaaaga

SEQ ID NO: 151848 - DNA, 20 bp, Artificial Sequence
  Description of Artificial Sequence: Synthetic oligonucleotide
  Target: ATXN1; (+) strand; PAM type: NRG; PAM sequence: AAG
ctctcacacaaaagagagca

SEQ ID NO: 151849 - DNA, 20 bp, Artificial Sequence
  Description of Artificial Sequence: Synthetic oligonucleotide
  Target: ATXN1; (+) strand; PAM type: NRG; PAM sequence: CAG
aatattttcctaaccatgca

SEQ ID NO: 151850 - DNA, 20 bp, Artificial Sequence
  Description of Artificial Sequence: Synthetic oligonucleotide
  Target: ATXN1; (+) strand; PAM type: NRG; PAM sequence: TGG
ttttcctaaccatgcacaga

SEQ ID NO: 151851 - DNA, 20 bp, Artificial Sequence
  Description of Artificial Sequence: Synthetic oligonucleotide
  Target: ATXN1; (+) strand; PAM type: NRG; PAM sequence: AAG
tcctaaccatgcacagatgg

SEQ ID NO: 151852 - DNA, 20 bp, Artificial Sequence
  Description of Artificial Sequence: Synthetic oligonucleotide
  Target: ATXN1; (+) strand; PAM type: NRG; PAM sequence: CAG
accatgcacagatggaagta

SEQ ID NO: 151853 - DNA, 20 bp, Artificial Sequence
  Description of Artificial Sequence: Synthetic oligonucleotide
  Target: ATXN1; (+) strand; PAM type: NRG; PAM sequence: TGG
agacgtttctgccaaccgcc

SEQ ID NO: 151854 - DNA, 20 bp, Artificial Sequence
  Description of Artificial Sequence: Synthetic oligonucleotide
  Target: ATXN1; (+) strand; PAM type: NRG; PAM sequence: CAG
tttctgccaaccgcctggtt

SEQ ID NO: 151855 - DNA, 20 bp, Artificial Sequence
  Description of Artificial Sequence: Synthetic oligonucleotide
  Target: ATXN1; (+) strand; PAM type: NRG; PAM sequence: TGG
ttgctctatttttaattatt

SEQ ID NO: 151856 - DNA, 20 bp, Artificial Sequence
  Description of Artificial Sequence: Synthetic oligonucleotide
  Target: ATXN1; (+) strand; PAM type: NRG; PAM sequence: CAG
ctatttttaattatttggtt

SEQ ID NO: 151857 - DNA, 20 bp, Artificial Sequence
  Description of Artificial Sequence: Synthetic oligonucleotide
  Target: ATXN1; (+) strand; PAM type: NRG; PAM sequence: GAG
atttttaattatttggttca

SEQ ID NO: 151858 - DNA, 20 bp, Artificial Sequence
  Description of Artificial Sequence: Synthetic oligonucleotide
  Target: ATXN1; (+) strand; PAM type: NRG; PAM sequence: AGG
tttttaattatttggttcag

SEQ ID NO: 151859 - DNA, 20 bp, Artificial Sequence
  Description of Artificial Sequence: Synthetic oligonucleotide
  Target: ATXN1; (+) strand; PAM type: NRG; PAM sequence: TGG
tgattaacttctgtgttgca

SEQ ID NO: 151860 - DNA, 20 bp, Artificial Sequence
  Description of Artificial Sequence: Synthetic oligonucleotide
  Target: ATXN1; (+) strand; PAM type: NRG; PAM sequence: AAG
aacttctgtgttgcatggca

SEQ ID NO: 151861 - DNA, 20 bp, Artificial Sequence
  Description of Artificial Sequence: Synthetic oligonucleotide
  Target: ATXN1; (+) strand; PAM type: NRG; PAM sequence: AGG
acttctgtgttgcatggcaa

SEQ ID NO: 151862 - DNA, 20 bp, Artificial Sequence
  Description of Artificial Sequence: Synthetic oligonucleotide
  Target: ATXN1; (+) strand; PAM type: NRG; PAM sequence: AAG
tctgtgttgcatggcaaagg

SEQ ID NO: 151863 - DNA, 20 bp, Artificial Sequence
  Description of Artificial Sequence: Synthetic oligonucleotide
  Target: ATXN1; (+) strand; PAM type: NRG; PAM sequence: AAG
gttgcatggcaaaggaagta

SEQ ID NO: 151864 - DNA, 20 bp, Artificial Sequence
  Description of Artificial Sequence: Synthetic oligonucleotide
  Target: ATXN1; (+) strand; PAM type: NRG; PAM sequence: CAG
gaagtaaagttcctgaccca

SEQ ID NO: 151865 - DNA, 20 bp, Artificial Sequence
  Description of Artificial Sequence: Synthetic oligonucleotide
  Target: ATXN1; (+) strand; PAM type: NRG; PAM sequence: AAG
aaagttcctgacccacagca

SEQ ID NO: 151866 - DNA, 20 bp, Artificial Sequence
  Description of Artificial Sequence: Synthetic oligonucleotide
  Target: ATXN1; (+) strand; PAM type: NRG; PAM sequence: CAG
ctgacccacagcaaagaaca

SEQ ID NO: 151867 - DNA, 20 bp, Artificial Sequence
  Description of Artificial Sequence: Synthetic oligonucleotide
  Target: ATXN1; (+) strand; PAM type: NRG; PAM sequence: AAG
cccacagcaaagaacacaga

SEQ ID NO: 151868 - DNA, 20 bp, Artificial Sequence
  Description of Artificial Sequence: Synthetic oligonucleotide
  Target: ATXN1; (+) strand; PAM type: NRG; PAM sequence: AAG
acagcaaagaacacagaaag

SEQ ID NO: 151869 - DNA, 20 bp, Artificial Sequence
  Description of Artificial Sequence: Synthetic oligonucleotide
  Target: ATXN1; (+) strand; PAM type: NRG; PAM sequence: CAG
gaagcttaattatttttaaa

SEQ ID NO: 151870 - DNA, 20 bp, Artificial Sequence
  Description of Artificial Sequence: Synthetic oligonucleotide
  Target: ATXN1; (+) strand; PAM type: NRG; PAM sequence: TAG
cttaattatttttaaacagc

SEQ ID NO: 151871 - DNA, 20 bp, Artificial Sequence
  Description of Artificial Sequence: Synthetic oligonucleotide
  Target: ATXN1; (+) strand; PAM type: NRG; PAM sequence: TAG
gtaatattgtaaaccatgtg

SEQ ID NO: 151872 - DNA, 20 bp, Artificial Sequence
  Description of Artificial Sequence: Synthetic oligonucleotide
  Target: ATXN1; (+) strand; PAM type: NRG; PAM sequence: GAG
aatattgtaaaccatgtgta

SEQ ID NO: 151873 - DNA, 20 bp, Artificial Sequence
  Description of Artificial Sequence: Synthetic oligonucleotide
  Target: ATXN1; (+) strand; PAM type: NRG; PAM sequence: AAG
tagagacaactaatttgtca

SEQ ID NO: 151874 - DNA, 20 bp, Artificial Sequence
  Description of Artificial Sequence: Synthetic oligonucleotide
  Target: ATXN1; (+) strand; PAM type: NRG; PAM sequence: CAG
acaactaatttgtcaaagac

SEQ ID NO: 151875 - DNA, 20 bp, Artificial Sequence
  Description of Artificial Sequence: Synthetic oligonucleotide
  Target: ATXN1; (+) strand; PAM type: NRG; PAM sequence: CAG
agaccagttgatgactgttg

SEQ ID NO: 151876 - DNA, 20 bp, Artificial Sequence
  Description of Artificial Sequence: Synthetic oligonucleotide
  Target: ATXN1; (+) strand; PAM type: NRG; PAM sequence: AAG
ttgatgactgttgcagtttg

SEQ ID NO: 151877 - DNA, 20 bp, Artificial Sequence
  Description of Artificial Sequence: Synthetic oligonucleotide
  Target: ATXN1; (+) strand; PAM type: NRG; PAM sequence: TAG
actgttgcagtttgaagctg

SEQ ID NO: 151878 - DNA, 20 bp, Artificial Sequence
  Description of Artificial Sequence: Synthetic oligonucleotide
  Target: ATXN1; (+) strand; PAM type: NRG; PAM sequence: AGG
ctgttgcagtttgaagctgt

SEQ ID NO: 151879 - DNA, 20 bp, Artificial Sequence
  Description of Artificial Sequence: Synthetic oligonucleotide
  Target: ATXN1; (+) strand; PAM type: NRG; PAM sequence: GGG
tgttgcagtttgaagctgta

SEQ ID NO: 151880 - DNA, 20 bp, Artificial Sequence
  Description of Artificial Sequence: Synthetic oligonucleotide
  Target: ATXN1; (+) strand; PAM type: NRG; PAM sequence: AAG
ttgaagctgtagggtgtatg

SEQ ID NO: 151881 - DNA, 20 bp, Artificial Sequence
  Description of Artificial Sequence: Synthetic oligonucleotide
  Target: ATXN1; (+) strand; PAM type: NRG; PAM sequence: CAG
gctgtagggtgtatgaagaa

SEQ ID NO: 151882 - DNA, 20 bp, Artificial Sequence
  Description of Artificial Sequence: Synthetic oligonucleotide
  Target: ATXN1; (+) strand; PAM type: NRG; PAM sequence: AAG
tatgaagaacagaaaaatcc

SEQ ID NO: 151883 - DNA, 20 bp, Artificial Sequence
  Description of Artificial Sequence: Synthetic oligonucleotide
  Target: ATXN1; (+) strand; PAM type: NRG; PAM sequence: AGG
atgaagaacagaaaaatcca

SEQ ID NO: 151884 - DNA, 20 bp, Artificial Sequence
  Description of Artificial Sequence: Synthetic oligonucleotide
  Target: ATXN1; (+) strand; PAM type: NRG; PAM sequence: GGG
tgaagaacagaaaaatccaa

SEQ ID NO: 151885 - DNA, 20 bp, Artificial Sequence
  Description of Artificial Sequence: Synthetic oligonucleotide
  Target: ATXN1; (+) strand; PAM type: NRG; PAM sequence: TAG
agaaaaatccaagggaactt

SEQ ID NO: 151886 - DNA, 20 bp, Artificial Sequence
  Description of Artificial Sequence: Synthetic oligonucleotide
  Target: ATXN1; (+) strand; PAM type: NRG; PAM sequence: AAG
aaatccaagggaactttagt

SEQ ID NO: 151887 - DNA, 20 bp, Artificial Sequence
  Description of Artificial Sequence: Synthetic oligonucleotide
  Target: ATXN1; (+) strand; PAM type: NRG; PAM sequence: TAG
atgaatctcataatgacaaa

SEQ ID NO: 151888 - DNA, 20 bp, Artificial Sequence
  Description of Artificial Sequence: Synthetic oligonucleotide
  Target: ATXN1; (+) strand; PAM type: NRG; PAM sequence: GAG
acaaatagattttcatctct

SEQ ID NO: 151889 - DNA, 20 bp, Artificial Sequence
  Description of Artificial Sequence: Synthetic oligonucleotide
  Target: ATXN1; (+) strand; PAM type: NRG; PAM sequence: TGG
tcatctctgagaaataacaa

SEQ ID NO: 151890 - DNA, 20 bp, Artificial Sequence
  Description of Artificial Sequence: Synthetic oligonucleotide
  Target: ATXN1; (+) strand; PAM type: NRG; PAM sequence: GAG
atctctgagaaataacaatg

SEQ ID NO: 151891 - DNA, 20 bp, Artificial Sequence
  Description of Artificial Sequence: Synthetic oligonucleotide
  Target: ATXN1; (+) strand; PAM type: NRG; PAM sequence: AAG
ctgagaaataacaatggagc

SEQ ID NO: 151892 - DNA, 20 bp, Artificial Sequence
  Description of Artificial Sequence: Synthetic oligonucleotide
  Target: ATXN1; (+) strand; PAM type: NRG; PAM sequence: TAG
aataacaatggagcaagaaa

SEQ ID NO: 151893 - DNA, 20 bp, Artificial Sequence
  Description of Artificial Sequence: Synthetic oligonucleotide
  Target: ATXN1; (+) strand; PAM type: NRG; PAM sequence: GAG
taacaatggagcaagaaata

SEQ ID NO: 151894 - DNA, 20 bp, Artificial Sequence
  Description of Artificial Sequence: Synthetic oligonucleotide
  Target: ATXN1; (+) strand; PAM type: NRG; PAM sequence: GAG
acaatggagcaagaaataga

SEQ ID NO: 151895 - DNA, 20 bp, Artificial Sequence
  Description of Artificial Sequence: Synthetic oligonucleotide
  Target: ATXN1; (+) strand; PAM type: NRG; PAM sequence: AGG
caatggagcaagaaatagag

SEQ ID NO: 151896 - DNA, 20 bp, Artificial Sequence
  Description of Artificial Sequence: Synthetic oligonucleotide
  Target: ATXN1; (+) strand; PAM type: NRG; PAM sequence: AAG
tggagcaagaaatagagagg

SEQ ID NO: 151897 - DNA, 20 bp, Artificial Sequence
  Description of Artificial Sequence: Synthetic oligonucleotide
  Target: ATXN1; (+) strand; PAM type: NRG; PAM sequence: TAG
aatagagaggaagaaattaa

SEQ ID NO: 151898 - DNA, 20 bp, Artificial Sequence
  Description of Artificial Sequence: Synthetic oligonucleotide
  Target: ATXN1; (+) strand; PAM type: NRG; PAM sequence: AAG
gaagaaattaatagtgttgt

SEQ ID NO: 151899 - DNA, 20 bp, Artificial Sequence
  Description of Artificial Sequence: Synthetic oligonucleotide
  Target: ATXN1; (+) strand; PAM type: NRG; PAM sequence: AGG
aagaaattaatagtgttgta

SEQ ID NO: 151900 - DNA, 20 bp, Artificial Sequence
  Description of Artificial Sequence: Synthetic oligonucleotide
  Target: ATXN1; (+) strand; PAM type: NRG; PAM sequence: TAG
gttgtaaggcctaatctcat

SEQ ID NO: 151901 - DNA, 20 bp, Artificial Sequence
  Description of Artificial Sequence: Synthetic oligonucleotide
  Target: ATXN1; (+) strand; PAM type: NRG; PAM sequence: CAG
gtaaggcctaatctcattag

SEQ ID NO: 151902 - DNA, 20 bp, Artificial Sequence
  Description of Artificial Sequence: Synthetic oligonucleotide
  Target: ATXN1; (+) strand; PAM type: NRG; PAM sequence: AGG
taaggcctaatctcattagc

SEQ ID NO: 151903 - DNA, 20 bp, Artificial Sequence
  Description of Artificial Sequence: Synthetic oligonucleotide
  Target: ATXN1; (+) strand; PAM type: NRG; PAM sequence: GAG
aggcctaatctcattagcag

SEQ ID NO: 151904 - DNA, 20 bp, Artificial Sequence
  Description of Artificial Sequence: Synthetic oligonucleotide
  Target: ATXN1; (+) strand; PAM type: NRG; PAM sequence: AAG
cctaatctcattagcaggag

SEQ ID NO: 151905 - DNA, 20 bp, Artificial Sequence
  Description of Artificial Sequence: Synthetic oligonucleotide
  Target: ATXN1; (+) strand; PAM type: NRG; PAM sequence: CAG
ctcattagcaggagaagttt

SEQ ID NO: 151906 - DNA, 20 bp, Artificial Sequence
  Description of Artificial Sequence: Synthetic oligonucleotide
  Target: ATXN1; (+) strand; PAM type: NRG; PAM sequence: TAG
ggagaagtttcagttttgac

SEQ ID NO: 151907 - DNA, 20 bp, Artificial Sequence
  Description of Artificial Sequence: Synthetic oligonucleotide
  Target: ATXN1; (+) strand; PAM type: NRG; PAM sequence: AGG
gagaagtttcagttttgact

SEQ ID NO: 151908 - DNA, 20 bp, Artificial Sequence
  Description of Artificial Sequence: Synthetic oligonucleotide
  Target: ATXN1; (+) strand; PAM type: NRG; PAM sequence: GAG
gaagtttcagttttgactag

SEQ ID NO: 151909 - DNA, 20 bp, Artificial Sequence
  Description of Artificial Sequence: Synthetic oligonucleotide
  Target: ATXN1; (+) strand; PAM type: NRG; PAM sequence: CAG
gtttcagttttgactaggag

SEQ ID NO: 151910 - DNA, 20 bp, Artificial Sequence
  Description of Artificial Sequence: Synthetic oligonucleotide
  Target: ATXN1; (+) strand; PAM type: NRG; PAM sequence: TGG
ttttgactaggagcagtgaa

SEQ ID NO: 151911 - DNA, 20 bp, Artificial Sequence
  Description of Artificial Sequence: Synthetic oligonucleotide
  Target: ATXN1; (+) strand; PAM type: NRG; PAM sequence: CAG
aggagcagtgaatggaatgc

SEQ ID NO: 151912 - DNA, 20 bp, Artificial Sequence
  Description of Artificial Sequence: Synthetic oligonucleotide
  Target: ATXN1; (+) strand; PAM type: NRG; PAM sequence: CAG
agcagtgaatggaatgccag

SEQ ID NO: 151913 - DNA, 20 bp, Artificial Sequence
  Description of Artificial Sequence: Synthetic oligonucleotide
  Target: ATXN1; (+) strand; PAM type: NRG; PAM sequence: AAG
aatggaatgccagcagcctt

SEQ ID NO: 151914 - DNA, 20 bp, Artificial Sequence
  Description of Artificial Sequence: Synthetic oligonucleotide
  Target: ATXN1; (+) strand; PAM type: NRG; PAM sequence: CAG
aatgccagcagccttaagca

SEQ ID NO: 151915 - DNA, 20 bp, Artificial Sequence
  Description of Artificial Sequence: Synthetic oligonucleotide
  Target: ATXN1; (+) strand; PAM type: NRG; PAM sequence: AGG
atgccagcagccttaagcac

SEQ ID NO: 151916 - DNA, 20 bp, Artificial Sequence
  Description of Artificial Sequence: Synthetic oligonucleotide
  Target: ATXN1; (+) strand; PAM type: NRG; PAM sequence: TGG
gcagccttaagcacaggaaa

SEQ ID NO: 151917 - DNA, 20 bp, Artificial Sequence
  Description of Artificial Sequence: Synthetic oligonucleotide
  Target: ATXN1; (+) strand; PAM type: NRG; PAM sequence: CAG
ttaagcacaggaaatggact

SEQ ID NO: 151918 - DNA, 20 bp, Artificial Sequence
  Description of Artificial Sequence: Synthetic oligonucleotide
  Target: ATXN1; (+) strand; PAM type: NRG; PAM sequence: AAG
caggaaatggactcagatgc

SEQ ID NO: 151919 - DNA, 20 bp, Artificial Sequence
  Description of Artificial Sequence: Synthetic oligonucleotide
  Target: ATXN1; (+) strand; PAM type: NRG; PAM sequence: AAG
gaaatggactcagatgcaag

SEQ ID NO: 151920 - DNA, 20 bp, Artificial Sequence
  Description of Artificial Sequence: Synthetic oligonucleotide
  Target: ATXN1; (+) strand; PAM type: NRG; PAM sequence: TGG
tggactcagatgcaagaagt

SEQ ID NO: 151921 - DNA, 20 bp, Artificial Sequence
  Description of Artificial Sequence: Synthetic oligonucleotide
  Target: ATXN1; (+) strand; PAM type: NRG; PAM sequence: CAG
ctcagatgcaagaagttggt

SEQ ID NO: 151922 - DNA, 20 bp, Artificial Sequence
  Description of Artificial Sequence: Synthetic oligonucleotide
  Target: ATXN1; (+) strand; PAM type: NRG; PAM sequence: AGG
tcagatgcaagaagttggtc

SEQ ID NO: 151923 - DNA, 20 bp, Artificial Sequence
  Description of Artificial Sequence: Synthetic oligonucleotide
  Target: ATXN1; (+) strand; PAM type: NRG; PAM sequence: CAG
agaagttggtcaggaaactc

SEQ ID NO: 151924 - DNA, 20 bp, Artificial Sequence
  Description of Artificial Sequence: Synthetic oligonucleotide
  Target: ATXN1; (+) strand; PAM type: NRG; PAM sequence: CAG
gaaactccagccataatatt

SEQ ID NO: 151925 - DNA, 20 bp, Artificial Sequence
  Description of Artificial Sequence: Synthetic oligonucleotide
  Target: ATXN1; (+) strand; PAM type: NRG; PAM sequence: TAG
taatattcagaataacacac

SEQ ID NO: 151926 - DNA, 20 bp, Artificial Sequence
  Description of Artificial Sequence: Synthetic oligonucleotide
  Target: ATXN1; (+) strand; PAM type: NRG; PAM sequence: TAG
agaataacacactagaattt

SEQ ID NO: 151927 - DNA, 20 bp, Artificial Sequence
  Description of Artificial Sequence: Synthetic oligonucleotide
  Target: ATXN1; (+) strand; PAM type: NRG; PAM sequence: GAG
aacacactagaattttagct

SEQ ID NO: 151928 - DNA, 20 bp, Artificial Sequence
  Description of Artificial Sequence: Synthetic oligonucleotide
  Target: ATXN1; (+) strand; PAM type: NRG; PAM sequence: AAG
cactagaattttagctgagc

SEQ ID NO: 151929 - DNA, 20 bp, Artificial Sequence
  Description of Artificial Sequence: Synthetic oligonucleotide
  Target: ATXN1; (+) strand; PAM type: NRG; PAM sequence: CAG
agctgagcaagatgaaatcc

SEQ ID NO: 151930 - DNA, 20 bp, Artificial Sequence
  Description of Artificial Sequence: Synthetic oligonucleotide
  Target: ATXN1; (+) strand; PAM type: NRG; PAM sequence: AAG
tgagcaagatgaaatcccag

SEQ ID NO: 151931 - DNA, 20 bp, Artificial Sequence
  Description of Artificial Sequence: Synthetic oligonucleotide
  Target: ATXN1; (+) strand; PAM type: NRG; PAM sequence: GAG
agcaagatgaaatcccagaa

SEQ ID NO: 151932 - DNA, 20 bp, Artificial Sequence
  Description of Artificial Sequence: Synthetic oligonucleotide
  Target: ATXN1; (+) strand; PAM type: NRG; PAM sequence: AAG
aagatgaaatcccagaagag

SEQ ID NO: 151933 - DNA, 20 bp, Artificial Sequence
  Description of Artificial Sequence: Synthetic oligonucleotide
  Target: ATXN1; (+) strand; PAM type: NRG; PAM sequence: TAG
atgaaatcccagaagagaag

SEQ ID NO: 151934 - DNA, 20 bp, Artificial Sequence
  Description of Artificial Sequence: Synthetic oligonucleotide
  Target: ATXN1; (+) strand; PAM type: NRG; PAM sequence: AAG
aatcccagaagagaagtaga

SEQ ID NO: 151935 - DNA, 20 bp, Artificial Sequence
  Description of Artificial Sequence: Synthetic oligonucleotide
  Target: ATXN1; (+) strand; PAM type: NRG; PAM sequence: GAG
tcccagaagagaagtagaaa

SEQ ID NO: 151936 - DNA, 20 bp, Artificial Sequence
  Description of Artificial Sequence: Synthetic oligonucleotide
  Target: ATXN1; (+) strand; PAM type: NRG; PAM sequence: AAG
cagaagagaagtagaaagag

SEQ ID NO: 151937 - DNA, 20 bp, Artificial Sequence
  Description of Artificial Sequence: Synthetic oligonucleotide
  Target: ATXN1; (+) strand; PAM type: NRG; PAM sequence: TGG
agaagtagaaagagaagcga

SEQ ID NO: 151938 - DNA, 20 bp, Artificial Sequence
  Description of Artificial Sequence: Synthetic oligonucleotide
  Target: ATXN1; (+) strand; PAM type: NRG; PAM sequence: CAG
tagaaagagaagcgatggtt

SEQ ID NO: 151939 - DNA, 20 bp, Artificial Sequence
  Description of Artificial Sequence: Synthetic oligonucleotide
  Target: ATXN1; (+) strand; PAM type: NRG; PAM sequence: AAG
agaagcgatggttcagcaat

SEQ ID NO: 151940 - DNA, 20 bp, Artificial Sequence
  Description of Artificial Sequence: Synthetic oligonucleotide
  Target: ATXN1; (+) strand; PAM type: NRG; PAM sequence: CAG
gcgatggttcagcaataaga

SEQ ID NO: 151941 - DNA, 20 bp, Artificial Sequence
  Description of Artificial Sequence: Synthetic oligonucleotide
  Target: ATXN1; (+) strand; PAM type: NRG; PAM sequence: AAG
ggttcagcaataagacagaa

SEQ ID NO: 151942 - DNA, 20 bp, Artificial Sequence
  Description of Artificial Sequence: Synthetic oligonucleotide
  Target: ATXN1; (+) strand; PAM type: NRG; PAM sequence: TGG
cagcaataagacagaaaaga

SEQ ID NO: 151943 - DNA, 20 bp, Artificial Sequence
  Description of Artificial Sequence: Synthetic oligonucleotide
  Target: ATXN1; (+) strand; PAM type: NRG; PAM sequence: AAG
ataagacagaaaagatggtc

SEQ ID NO: 151944 - DNA, 20 bp, Artificial Sequence
  Description of Artificial Sequence: Synthetic oligonucleotide
  Target: ATXN1; (+) strand; PAM type: NRG; PAM sequence: AGG
taagacagaaaagatggtca

SEQ ID NO: 151945 - DNA, 20 bp, Artificial Sequence
  Description of Artificial Sequence: Synthetic oligonucleotide
  Target: ATXN1; (+) strand; PAM type: NRG; PAM sequence: CAG
gtcaaggtataaacaatgaa

SEQ ID NO: 151946 - DNA, 20 bp, Artificial Sequence
  Description of Artificial Sequence: Synthetic oligonucleotide
  Target: ATXN1; (+) strand; PAM type: NRG; PAM sequence: AGG
tcaaggtataaacaatgaac

SEQ ID NO: 151947 - DNA, 20 bp, Artificial Sequence
  Description of Artificial Sequence: Synthetic oligonucleotide
  Target: ATXN1; (+) strand; PAM type: NRG; PAM sequence: TGG
ggtataaacaatgaacaggt

SEQ ID NO: 151948 - DNA, 20 bp, Artificial Sequence
  Description of Artificial Sequence: Synthetic oligonucleotide
  Target: ATXN1; (+) strand; PAM type: NRG; PAM sequence: TGG
atgaacaggttggaactgtt

SEQ ID NO: 151949 - DNA, 20 bp, Artificial Sequence
  Description of Artificial Sequence: Synthetic oligonucleotide
  Target: ATXN1; (+) strand; PAM type: NRG; PAM sequence: AAG
tggaactgttttatattttt

SEQ ID NO: 151950 - DNA, 20 bp, Artificial Sequence
  Description of Artificial Sequence: Synthetic oligonucleotide
  Target: ATXN1; (+) strand; PAM type: NRG; PAM sequence: AAG
catttacaaaacaaaaaaaa

SEQ ID NO: 151951 - DNA, 20 bp, Artificial Sequence
  Description of Artificial Sequence: Synthetic oligonucleotide
  Target: ATXN1; (+) strand; PAM type: NRG; PAM sequence: TAG
ttacaaaacaaaaaaaaaag

SEQ ID NO: 151952 - DNA, 20 bp, Artificial Sequence
  Description of Artificial Sequence: Synthetic oligonucleotide
  Target: ATXN1; (+) strand; PAM type: NRG; PAM sequence: AAG
caaaaaaaaaagtagtttct

SEQ ID NO: 151953 - DNA, 20 bp, Artificial Sequence
  Description of Artificial Sequence: Synthetic oligonucleotide
  Target: ATXN1; (+) strand; PAM type: NRG; PAM sequence: AAG
aaaaaaagtagtttctaagt

SEQ ID NO: 151954 - DNA, 20 bp, Artificial Sequence
  Description of Artificial Sequence: Synthetic oligonucleotide
  Target: ATXN1; (+) strand; PAM type: NRG; PAM sequence: AAG
agtaagaaaacaataaaccc

SEQ ID NO: 151955 - DNA, 20 bp, Artificial Sequence
  Description of Artificial Sequence: Synthetic oligonucleotide
  Target: ATXN1; (+) strand; PAM type: NRG; PAM sequence: TAG
aagaaaacaataaacccaag

SEQ ID NO: 151956 - DNA, 20 bp, Artificial Sequence
  Description of Artificial Sequence: Synthetic oligonucleotide
  Target: ATXN1; (+) strand; PAM type: NRG; PAM sequence: TAG
aataaacccaagtagcaaat

SEQ ID NO: 151957 - DNA, 20 bp, Artificial Sequence
  Description of Artificial Sequence: Synthetic oligonucleotide
  Target: ATXN1; (+) strand; PAM type: NRG; PAM sequence: CAG
tagcaaattagttataaaca

SEQ ID NO: 151958 - DNA, 20 bp, Artificial Sequence
  Description of Artificial Sequence: Synthetic oligonucleotide
  Target: ATXN1; (+) strand; PAM type: NRG; PAM sequence: AAG
aaattagttataaacacaga

SEQ ID NO: 151959 - DNA, 20 bp, Artificial Sequence
  Description of Artificial Sequence: Synthetic oligonucleotide
  Target: ATXN1; (+) strand; PAM type: NRG; PAM sequence: TAG
aacacagaaagaaaacaaaa

SEQ ID NO: 151960 - DNA, 20 bp, Artificial Sequence
  Description of Artificial Sequence: Synthetic oligonucleotide
  Target: ATXN1; (+) strand; PAM type: NRG; PAM sequence: CGG
cagaaagaaaacaaaataga

SEQ ID NO: 151961 - DNA, 20 bp, Artificial Sequence
  Description of Artificial Sequence: Synthetic oligonucleotide
  Target: ATXN1; (+) strand; PAM type: NRG; PAM sequence: CAG
aaaacaaaatagacggcatc

SEQ ID NO: 151962 - DNA, 20 bp, Artificial Sequence
  Description of Artificial Sequence: Synthetic oligonucleotide
  Target: ATXN1; (+) strand; PAM type: NRG; PAM sequence: AAG
aaaatagacggcatccagtt

SEQ ID NO: 151963 - DNA, 20 bp, Artificial Sequence
  Description of Artificial Sequence: Synthetic oligonucleotide
  Target: ATXN1; (+) strand; PAM type: NRG; PAM sequence: AAG
catccagttaagaattttga

SEQ ID NO: 151964 - DNA, 20 bp, Artificial Sequence
  Description of Artificial Sequence: Synthetic oligonucleotide
  Target: ATXN1; (+) strand; PAM type: NRG; PAM sequence: CAG
ccagttaagaattttgaaag

SEQ ID NO: 151965 - DNA, 20 bp, Artificial Sequence
  Description of Artificial Sequence: Synthetic oligonucleotide
  Target: ATXN1; (+) strand; PAM type: NRG; PAM sequence: TAG
taagaattttgaaagcagaa

SEQ ID NO: 151966 - DNA, 20 bp, Artificial Sequence
  Description of Artificial Sequence: Synthetic oligonucleotide
  Target: ATXN1; (+) strand; PAM type: NRG; PAM sequence: AGG
aagaattttgaaagcagaat

SEQ ID NO: 151967 - DNA, 20 bp, Artificial Sequence
  Description of Artificial Sequence: Synthetic oligonucleotide
  Target: ATXN1; (+) strand; PAM type: NRG; PAM sequence: GGG
agaattttgaaagcagaata

SEQ ID NO: 151968 - DNA, 20 bp, Artificial Sequence
  Description of Artificial Sequence: Synthetic oligonucleotide
  Target: ATXN1; (+) strand; PAM type: NRG; PAM sequence: CAG
agaatagggctaaaacctaa

SEQ ID NO: 151969 - DNA, 20 bp, Artificial Sequence
  Description of Artificial Sequence: Synthetic oligonucleotide
  Target: ATXN1; (+) strand; PAM type: NRG; PAM sequence: GAG
ctaacagaactttattcctc

SEQ ID NO: 151970 - DNA, 20 bp, Artificial Sequence
  Description of Artificial Sequence: Synthetic oligonucleotide
  Target: ATXN1; (+) strand; PAM type: NRG; PAM sequence: AAG
acagaactttattcctcgag

SEQ ID NO: 151971 - DNA, 20 bp, Artificial Sequence
  Description of Artificial Sequence: Synthetic oligonucleotide
  Target: ATXN1; (+) strand; PAM type: NRG; PAM sequence: TAG
agaagctttctcttgatcaa

SEQ ID NO: 151972 - DNA, 20 bp, Artificial Sequence
  Description of Artificial Sequence: Synthetic oligonucleotide
  Target: ATXN1; (+) strand; PAM type: NRG; PAM sequence: AAG
atcaatagccctaaaatttt

SEQ ID NO: 151973 - DNA, 20 bp, Artificial Sequence
  Description of Artificial Sequence: Synthetic oligonucleotide
  Target: ATXN1; (+) strand; PAM type: NRG; PAM sequence: AAG
ttttaagacattctgtattt

SEQ ID NO: 151974 - DNA, 20 bp, Artificial Sequence
  Description of Artificial Sequence: Synthetic oligonucleotide
  Target: ATXN1; (+) strand; PAM type: NRG; PAM sequence: TGG
atttaagtccttaatgtact

SEQ ID NO: 151975 - DNA, 20 bp, Artificial Sequence
  Description of Artificial Sequence: Synthetic oligonucleotide
  Target: ATXN1; (+) strand; PAM type: NRG; PAM sequence: CAG
ttaatgtacttggaaaacct

SEQ ID NO: 151976 - DNA, 20 bp, Artificial Sequence
  Description of Artificial Sequence: Synthetic oligonucleotide
  Target: ATXN1; (+) strand; PAM type: NRG; PAM sequence: GAG
aatgtacttggaaaacctca

SEQ ID NO: 151977 - DNA, 20 bp, Artificial Sequence
  Description of Artificial Sequence: Synthetic oligonucleotide
  Target: ATXN1; (+) strand; PAM type: NRG; PAM sequence: CAG
tcagagtctactgaatcata

SEQ ID NO: 151978 - DNA, 20 bp, Artificial Sequence
  Description of Artificial Sequence: Synthetic oligonucleotide
  Target: ATXN1; (+) strand; PAM type: NRG; PAM sequence: AGG
cagagtctactgaatcatac

SEQ ID NO: 151979 - DNA, 20 bp, Artificial Sequence
  Description of Artificial Sequence: Synthetic oligonucleotide
  Target: ATXN1; (+) strand; PAM type: NRG; PAM sequence: AAG
actgaatcatacaggccacg

SEQ ID NO: 151980 - DNA, 20 bp, Artificial Sequence
  Description of Artificial Sequence: Synthetic oligonucleotide
  Target: ATXN1; (+) strand; PAM type: NRG; PAM sequence: GAG
tgaatcatacaggccacgaa

SEQ ID NO: 151981 - DNA, 20 bp, Artificial Sequence
  Description of Artificial Sequence: Synthetic oligonucleotide
  Target: ATXN1; (+) strand; PAM type: NRG; PAM sequence: CAG
cacgaagagccaaaatattt

SEQ ID NO: 151982 - DNA, 20 bp, Artificial Sequence
  Description of Artificial Sequence: Synthetic oligonucleotide
  Target: ATXN1; (+) strand; PAM type: NRG; PAM sequence: AGG
acgaagagccaaaatatttc

SEQ ID NO: 151983 - DNA, 20 bp, Artificial Sequence
  Description of Artificial Sequence: Synthetic oligonucleotide
  Target: ATXN1; (+) strand; PAM type: NRG; PAM sequence: GAG
gaagagccaaaatatttcag

SEQ ID NO: 151984 - DNA, 20 bp, Artificial Sequence
  Description of Artificial Sequence: Synthetic oligonucleotide
  Target: ATXN1; (+) strand; PAM type: NRG; PAM sequence: TAG
ccaaaatatttcaggagtaa

SEQ ID NO: 151985 - DNA, 20 bp, Artificial Sequence
  Description of Artificial Sequence: Synthetic oligonucleotide
  Target: ATXN1; (+) strand; PAM type: NRG; PAM sequence: CAG
gttgctaaaaattacatttg

SEQ ID NO: 151986 - DNA, 20 bp, Artificial Sequence
  Description of Artificial Sequence: Synthetic oligonucleotide
  Target: ATXN1; (+) strand; PAM type: NRG; PAM sequence: CAG
aattacatttgcagcgaatc

SEQ ID NO: 151987 - DNA, 20 bp, Artificial Sequence
  Description of Artificial Sequence: Synthetic oligonucleotide
  Target: ATXN1; (+) strand; PAM type: NRG; PAM sequence: AGG
attacatttgcagcgaatcc

SEQ ID NO: 151988 - DNA, 20 bp, Artificial Sequence
  Description of Artificial Sequence: Synthetic oligonucleotide
  Target: ATXN1; (+) strand; PAM type: NRG; PAM sequence: CAG
agcgaatccaggaccaatgc

SEQ ID NO: 151989 - DNA, 20 bp, Artificial Sequence
  Description of Artificial Sequence: Synthetic oligonucleotide
  Target: ATXN1; (+) strand; PAM type: NRG; PAM sequence: TGG
ggaccaatgccagaatgatc

SEQ ID NO: 151990 - DNA, 20 bp, Artificial Sequence
  Description of Artificial Sequence: Synthetic oligonucleotide
  Target: ATXN1; (+) strand; PAM type: NRG; PAM sequence: GGG
gaccaatgccagaatgatct

SEQ ID NO: 151991 - DNA, 20 bp, Artificial Sequence
  Description of Artificial Sequence: Synthetic oligonucleotide
  Target: ATXN1; (+) strand; PAM type: NRG; PAM sequence: GAG
taaacacctaatttctcctt

SEQ ID NO: 151992 - DNA, 20 bp, Artificial Sequence
  Description of Artificial Sequence: Synthetic oligonucleotide
  Target: ATXN1; (+) strand; PAM type: NRG; PAM sequence: AGG
aaacacctaatttctccttg

SEQ ID NO: 151993 - DNA, 20 bp, Artificial Sequence
  Description of Artificial Sequence: Synthetic oligonucleotide
  Target: ATXN1; (+) strand; PAM type: NRG; PAM sequence: GAG
acacctaatttctccttgag

SEQ ID NO: 151994 - DNA, 20 bp, Artificial Sequence
  Description of Artificial Sequence: Synthetic oligonucleotide
  Target: ATXN1; (+) strand; PAM type: NRG; PAM sequence: GAG
acctaatttctccttgagga

SEQ ID NO: 151995 - DNA, 20 bp, Artificial Sequence
  Description of Artificial Sequence: Synthetic oligonucleotide
  Target: ATXN1; (+) strand; PAM type: NRG; PAM sequence: TAG
taatttctccttgaggagag

SEQ ID NO: 151996 - DNA, 20 bp, Artificial Sequence
  Description of Artificial Sequence: Synthetic oligonucleotide
  Target: ATXN1; (+) strand; PAM type: NRG; PAM sequence: TGG
ctccttgaggagagtagaaa

SEQ ID NO: 151997 - DNA, 20 bp, Artificial Sequence
  Description of Artificial Sequence: Synthetic oligonucleotide
  Target: ATXN1; (+) strand; PAM type: NRG; PAM sequence: GAG
ccttgaggagagtagaaatg

SEQ ID NO: 151998 - DNA, 20 bp, Artificial Sequence
  Description of Artificial Sequence: Synthetic oligonucleotide
  Target: ATXN1; (+) strand; PAM type: NRG; PAM sequence: CAG
gtagaaatggagaataaaaa

SEQ ID NO: 151999 - DNA, 20 bp, Artificial Sequence
  Description of Artificial Sequence: Synthetic oligonucleotide
  Target: ATXN1; (+) strand; PAM type: NRG; PAM sequence: TGG
aaaaacagaacttcctttgc

SEQ ID NO: 152000 - DNA, 20 bp, Artificial Sequence
  Description of Artificial Sequence: Synthetic oligonucleotide
  Target: ATXN1; (+) strand; PAM type: NRG; PAM sequence: GGG
aaaacagaacttcctttgct

SEQ ID NO: 152001 - DNA, 20 bp, Artificial Sequence
  Description of Artificial Sequence: Synthetic oligonucleotide
  Target: ATXN1; (+) strand; PAM type: NRG; PAM sequence: GGG
aaacagaacttcctttgctg

SEQ ID NO: 152002 - DNA, 20 bp, Artificial Sequence
  Description of Artificial Sequence: Synthetic oligonucleotide
  Target: ATXN1; (+) strand; PAM type: NRG; PAM sequence: GGG
aacagaacttcctttgctgg

SEQ ID NO: 152003 - DNA, 20 bp, Artificial Sequence
  Description of Artificial Sequence: Synthetic oligonucleotide
  Target: ATXN1; (+) strand; PAM type: NRG; PAM sequence: AAG
gctgggggctctcaattctg

SEQ ID NO: 152004 - DNA, 20 bp, Artificial Sequence
  Description of Artificial Sequence: Synthetic oligonucleotide
  Target: ATXN1; (+) strand; PAM type: NRG; PAM sequence: CAG
gggctctcaattctgaagct

SEQ ID NO: 152005 - DNA, 20 bp, Artificial Sequence
  Description of Artificial Sequence: Synthetic oligonucleotide
  Target: ATXN1; (+) strand; PAM type: NRG; PAM sequence: TGG
gttccttaaaccgctaacac

SEQ ID NO: 152006 - DNA, 20 bp, Artificial Sequence
  Description of Artificial Sequence: Synthetic oligonucleotide
  Target: ATXN1; (+) strand; PAM type: NRG; PAM sequence: TAG
aaaccgctaacactggctat

SEQ ID NO: 152007 - DNA, 20 bp, Artificial Sequence
  Description of Artificial Sequence: Synthetic oligonucleotide
  Target: ATXN1; (+) strand; PAM type: NRG; PAM sequence: CAG
taacactggctattagcttt

SEQ ID NO: 152008 - DNA, 20 bp, Artificial Sequence
  Description of Artificial Sequence: Synthetic oligonucleotide
  Target: ATXN1; (+) strand; PAM type: NRG; PAM sequence: TGG
actggctattagctttcagc

SEQ ID NO: 152009 - DNA, 20 bp, Artificial Sequence
  Description of Artificial Sequence: Synthetic oligonucleotide
  Target: ATXN1; (+) strand; PAM type: NRG; PAM sequence: GGG
ctggctattagctttcagct

SEQ ID NO: 152010 - DNA, 20 bp, Artificial Sequence
  Description of Artificial Sequence: Synthetic oligonucleotide
  Target: ATXN1; (+) strand; PAM type: NRG; PAM sequence: TGG
ctattagctttcagctgggc

SEQ ID NO: 152011 - DNA, 20 bp, Artificial Sequence
  Description of Artificial Sequence: Synthetic oligonucleotide
  Target: ATXN1; (+) strand; PAM type: NRG; PAM sequence: TGG
ttcagctgggctggttgaca

SEQ ID NO: 152012 - DNA, 20 bp, Artificial Sequence
  Description of Artificial Sequence: Synthetic oligonucleotide
  Target: ATXN1; (+) strand; PAM type: NRG; PAM sequence: AAG
gctgggctggttgacatggc

SEQ ID NO: 152013 - DNA, 20 bp, Artificial Sequence
  Description of Artificial Sequence: Synthetic oligonucleotide
  Target: ATXN1; (+) strand; PAM type: NRG; PAM sequence: TAG
ggttgacatggcaagaccct

SEQ ID NO: 152014 - DNA, 20 bp, Artificial Sequence
  Description of Artificial Sequence: Synthetic oligonucleotide
  Target: ATXN1; (+) strand; PAM type: NRG; PAM sequence: AAG
tgacatggcaagacccttag

SEQ ID NO: 152015 - DNA, 20 bp, Artificial Sequence
  Description of Artificial Sequence: Synthetic oligonucleotide
  Target: ATXN1; (+) strand; PAM type: NRG; PAM sequence: AGG
gacatggcaagacccttaga

SEQ ID NO: 152016 - DNA, 20 bp, Artificial Sequence
  Description of Artificial Sequence: Synthetic oligonucleotide
  Target: ATXN1; (+) strand; PAM type: NRG; PAM sequence: GGG
acatggcaagacccttagaa

SEQ ID NO: 152017 - DNA, 20 bp, Artificial Sequence
  Description of Artificial Sequence: Synthetic oligonucleotide
  Target: ATXN1; (+) strand; PAM type: NRG; PAM sequence: TGG
gaagggcacatccatatttg

SEQ ID NO: 152018 - DNA, 20 bp, Artificial Sequence
  Description of Artificial Sequence: Synthetic oligonucleotide
  Target: ATXN1; (+) strand; PAM type: NRG; PAM sequence: GGG
aagggcacatccatatttgt

SEQ ID NO: 152019 - DNA, 20 bp, Artificial Sequence
  Description of Artificial Sequence: Synthetic oligonucleotide
  Target: ATXN1; (+) strand; PAM type: NRG; PAM sequence: TGG
tccatatttgtgggtaatta

SEQ ID NO: 152020 - DNA, 20 bp, Artificial Sequence
  Description of Artificial Sequence: Synthetic oligonucleotide
  Target: ATXN1; (+) strand; PAM type: NRG; PAM sequence: TGG
aattatggaatttcaacaat

SEQ ID NO: 152021 - DNA, 20 bp, Artificial Sequence
  Description of Artificial Sequence: Synthetic oligonucleotide
  Target: ATXN1; (+) strand; PAM type: NRG; PAM sequence: AAG
tatggaatttcaacaattgg

SEQ ID NO: 152022 - DNA, 20 bp, Artificial Sequence
  Description of Artificial Sequence: Synthetic oligonucleotide
  Target: ATXN1; (+) strand; PAM type: NRG; PAM sequence: CAG
ttcaacaattggaagcaact

SEQ ID NO: 152023 - DNA, 20 bp, Artificial Sequence
  Description of Artificial Sequence: Synthetic oligonucleotide
  Target: ATXN1; (+) strand; PAM type: NRG; PAM sequence: AGG
tcaacaattggaagcaactc

SEQ ID NO: 152024 - DNA, 20 bp, Artificial Sequence
  Description of Artificial Sequence: Synthetic oligonucleotide
  Target: ATXN1; (+) strand; PAM type: NRG; PAM sequence: GGG
caacaattggaagcaactca

SEQ ID NO: 152025 - DNA, 20 bp, Artificial Sequence
  Description of Artificial Sequence: Synthetic oligonucleotide
  Target: ATXN1; (+) strand; PAM type: NRG; PAM sequence: GAG
acaattggaagcaactcagg

SEQ ID NO: 152026 - DNA, 20 bp, Artificial Sequence
  Description of Artificial Sequence: Synthetic oligonucleotide
  Target: ATXN1; (+) strand; PAM type: NRG; PAM sequence: GAG
gcaactcagggagccatcat

SEQ ID NO: 152027 - DNA, 20 bp, Artificial Sequence
  Description of Artificial Sequence: Synthetic oligonucleotide
  Target: ATXN1; (+) strand; PAM type: NRG; PAM sequence: AGG
caactcagggagccatcatg

SEQ ID NO: 152028 - DNA, 20 bp, Artificial Sequence
  Description of Artificial Sequence: Synthetic oligonucleotide
  Target: ATXN1; (+) strand; PAM type: NRG; PAM sequence: GAG
actcagggagccatcatgag

SEQ ID NO: 152029 - DNA, 20 bp, Artificial Sequence
  Description of Artificial Sequence: Synthetic oligonucleotide
  Target: ATXN1; (+) strand; PAM type: NRG; PAM sequence: AAG
cagggagccatcatgaggag

SEQ ID NO: 152030 - DNA, 20 bp, Artificial Sequence
  Description of Artificial Sequence: Synthetic oligonucleotide
  Target: ATXN1; (+) strand; PAM type: NRG; PAM sequence: AAG
ccatcatgaggagaagaaaa

SEQ ID NO: 152031 - DNA, 20 bp, Artificial Sequence
  Description of Artificial Sequence: Synthetic oligonucleotide
  Target: ATXN1; (+) strand; PAM type: NRG; PAM sequence: AGG
catcatgaggagaagaaaaa

SEQ ID NO: 152032 - DNA, 20 bp, Artificial Sequence
  Description of Artificial Sequence: Synthetic oligonucleotide
  Target: ATXN1; (+) strand; PAM type: NRG; PAM sequence: CAG
agaaaaaaggtaatctgttt

SEQ ID NO: 152033 - DNA, 20 bp, Artificial Sequence
  Description of Artificial Sequence: Synthetic oligonucleotide
  Target: ATXN1; (+) strand; PAM type: NRG; PAM sequence: AAG
aaaaggtaatctgtttcaga

SEQ ID NO: 152034 - DNA, 20 bp, Artificial Sequence
  Description of Artificial Sequence: Synthetic oligonucleotide
  Target: ATXN1; (+) strand; PAM type: NRG; PAM sequence: AAG
gtttcagaaagtccaaaata

SEQ ID NO: 152035 - DNA, 20 bp, Artificial Sequence
  Description of Artificial Sequence: Synthetic oligonucleotide
  Target: ATXN1; (+) strand; PAM type: NRG; PAM sequence: TAG
ttcctcctctattatgcaaa

SEQ ID NO: 152036 - DNA, 20 bp, Artificial Sequence
  Description of Artificial Sequence: Synthetic oligonucleotide
  Target: ATXN1; (+) strand; PAM type: NRG; PAM sequence: AGG
tcctcctctattatgcaaat

SEQ ID NO: 152037 - DNA, 20 bp, Artificial Sequence
  Description of Artificial Sequence: Synthetic oligonucleotide
  Target: ATXN1; (+) strand; PAM type: NRG; PAM sequence: AAG
ctctattatgcaaataggtg

SEQ ID NO: 152038 - DNA, 20 bp, Artificial Sequence
  Description of Artificial Sequence: Synthetic oligonucleotide
  Target: ATXN1; (+) strand; PAM type: NRG; PAM sequence: TGG
aaataggtgaagtatgtgta

SEQ ID NO: 152039 - DNA, 20 bp, Artificial Sequence
  Description of Artificial Sequence: Synthetic oligonucleotide
  Target: ATXN1; (+) strand; PAM type: NRG; PAM sequence: GGG
aataggtgaagtatgtgtat

SEQ ID NO: 152040 - DNA, 20 bp, Artificial Sequence
  Description of Artificial Sequence: Synthetic oligonucleotide
  Target: ATXN1; (+) strand; PAM type: NRG; PAM sequence: TGG
atgtgtatgggtgtgtgtat

SEQ ID NO: 152041 - DNA, 20 bp, Artificial Sequence
  Description of Artificial Sequence: Synthetic oligonucleotide
  Target: ATXN1; (+) strand; PAM type: NRG; PAM sequence: AAG
atgggtgtgtgtattggcaa

SEQ ID NO: 152042 - DNA, 20 bp, Artificial Sequence
  Description of Artificial Sequence: Synthetic oligonucleotide
  Target: ATXN1; (+) strand; PAM type: NRG; PAM sequence: TAG
tgtgtgtattggcaaaagac

SEQ ID NO: 152043 - DNA, 20 bp, Artificial Sequence
  Description of Artificial Sequence: Synthetic oligonucleotide
  Target: ATXN1; (+) strand; PAM type: NRG; PAM sequence: CAG
agactagaattttaaaaaac

SEQ ID NO: 152044 - DNA, 20 bp, Artificial Sequence
  Description of Artificial Sequence: Synthetic oligonucleotide
  Target: ATXN1; (+) strand; PAM type: NRG; PAM sequence: AGG
gactagaattttaaaaaacc

SEQ ID NO: 152045 - DNA, 20 bp, Artificial Sequence
  Description of Artificial Sequence: Synthetic oligonucleotide
  Target: ATXN1; (+) strand; PAM type: NRG; PAM sequence: AAG
aaaaaccaggattttaaaaa

SEQ ID NO: 152046 - DNA, 20 bp, Artificial Sequence
  Description of Artificial Sequence: Synthetic oligonucleotide
  Target: ATXN1; (+) strand; PAM type: NRG; PAM sequence: TAG
atctatgactgaattattta

SEQ ID NO: 152047 - DNA, 20 bp, Artificial Sequence
  Description of Artificial Sequence: Synthetic oligonucleotide
  Target: ATXN1; (+) strand; PAM type: NRG; PAM sequence: TGG
gaattatttatagttgcaaa

SEQ ID NO: 152048 - DNA, 20 bp, Artificial Sequence
  Description of Artificial Sequence: Synthetic oligonucleotide
  Target: ATXN1; (+) strand; PAM type: NRG; PAM sequence: TAG
atggcttcataataccaacc

SEQ ID NO: 152049 - DNA, 20 bp, Artificial Sequence
  Description of Artificial Sequence: Synthetic oligonucleotide
  Target: ATXN1; (+) strand; PAM type: NRG; PAM sequence: CAG
ccaacctagtattattactg

SEQ ID NO: 152050 - DNA, 20 bp, Artificial Sequence
  Description of Artificial Sequence: Synthetic oligonucleotide
  Target: ATXN1; (+) strand; PAM type: NRG; PAM sequence: AGG
caacctagtattattactgc

SEQ ID NO: 152051 - DNA, 20 bp, Artificial Sequence
  Description of Artificial Sequence: Synthetic oligonucleotide
  Target: ATXN1; (+) strand; PAM type: NRG; PAM sequence: TGG
agtattattactgcaggcac

SEQ ID NO: 152052 - DNA, 20 bp, Artificial Sequence
  Description of Artificial Sequence: Synthetic oligonucleotide
  Target: ATXN1; (+) strand; PAM type: NRG; PAM sequence: TGG
attactgcaggcactggccc

SEQ ID NO: 152053 - DNA, 20 bp, Artificial Sequence
  Description of Artificial Sequence: Synthetic oligonucleotide
  Target: ATXN1; (+) strand; PAM type: NRG; PAM sequence: TAG
tgcaggcactggccctggct

SEQ ID NO: 152054 - DNA, 20 bp, Artificial Sequence
  Description of Artificial Sequence: Synthetic oligonucleotide
  Target: ATXN1; (+) strand; PAM type: NRG; PAM sequence: TAG
cttagaaatgttatttcatt

SEQ ID NO: 152055 - DNA, 20 bp, Artificial Sequence
  Description of Artificial Sequence: Synthetic oligonucleotide
  Target: ATXN1; (+) strand; PAM type: NRG; PAM sequence: TAG
gtttctatttgttgtaacac

SEQ ID NO: 152056 - DNA, 20 bp, Artificial Sequence
  Description of Artificial Sequence: Synthetic oligonucleotide
  Target: ATXN1; (+) strand; PAM type: NRG; PAM sequence: TGG
tgtaacactagccactgtga

SEQ ID NO: 152057 - DNA, 20 bp, Artificial Sequence
  Description of Artificial Sequence: Synthetic oligonucleotide
  Target: ATXN1; (+) strand; PAM type: NRG; PAM sequence: GGG
gtaacactagccactgtgat

SEQ ID NO: 152058 - DNA, 20 bp, Artificial Sequence
  Description of Artificial Sequence: Synthetic oligonucleotide
  Target: ATXN1; (+) strand; PAM type: NRG; PAM sequence: GGG
taacactagccactgtgatg

SEQ ID NO: 152059 - DNA, 20 bp, Artificial Sequence
  Description of Artificial Sequence: Synthetic oligonucleotide
  Target: ATXN1; (+) strand; PAM type: NRG; PAM sequence: AAG
tgtccataaaacaaccctat

SEQ ID NO: 152060 - DNA, 20 bp, Artificial Sequence
  Description of Artificial Sequence: Synthetic oligonucleotide
  Target: ATXN1; (+) strand; PAM type: NRG; PAM sequence: AAG
acatgaattcaattttcttt

SEQ ID NO: 152061 - DNA, 20 bp, Artificial Sequence
  Description of Artificial Sequence: Synthetic oligonucleotide
  Target: ATXN1; (+) strand; PAM type: NRG; PAM sequence: AAG
attcaattttctttaagtga

SEQ ID NO: 152062 - DNA, 20 bp, Artificial Sequence
  Description of Artificial Sequence: Synthetic oligonucleotide
  Target: ATXN1; (+) strand; PAM type: NRG; PAM sequence: AAG
aattttctttaagtgaaaga

SEQ ID NO: 152063 - DNA, 20 bp, Artificial Sequence
  Description of Artificial Sequence: Synthetic oligonucleotide
  Target: ATXN1; (+) strand; PAM type: NRG; PAM sequence: TGG
agtgaaagaaagcaaaaata

SEQ ID NO: 152064 - DNA, 20 bp, Artificial Sequence
  Description of Artificial Sequence: Synthetic oligonucleotide
  Target: ATXN1; (+) strand; PAM type: NRG; PAM sequence: CAG
gaaagcaaaaatatggttgt

SEQ ID NO: 152065 - DNA, 20 bp, Artificial Sequence
  Description of Artificial Sequence: Synthetic oligonucleotide
  Target: ATXN1; (+) strand; PAM type: NRG; PAM sequence: AAG
aaaaatatggttgtcagaac

SEQ ID NO: 152066 - DNA, 20 bp, Artificial Sequence
  Description of Artificial Sequence: Synthetic oligonucleotide
  Target: ATXN1; (+) strand; PAM type: NRG; PAM sequence: TGG
agaacaagaactgctttctg

SEQ ID NO: 152067 - DNA, 20 bp, Artificial Sequence
  Description of Artificial Sequence: Synthetic oligonucleotide
  Target: ATXN1; (+) strand; PAM type: NRG; PAM sequence: GGG
gaacaagaactgctttctgt

SEQ ID NO: 152068 - DNA, 20 bp, Artificial Sequence
  Description of Artificial Sequence: Synthetic oligonucleotide
  Target: ATXN1; (+) strand; PAM type: NRG; PAM sequence: TAG
ctgctttctgtgggatattc

SEQ ID NO: 152069 - DNA, 20 bp, Artificial Sequence
  Description of Artificial Sequence: Synthetic oligonucleotide
  Target: ATXN1; (+) strand; PAM type: NRG; PAM sequence: AAG
gggatattctagttaaatga

SEQ ID NO: 152070 - DNA, 20 bp, Artificial Sequence
  Description of Artificial Sequence: Synthetic oligonucleotide
  Target: ATXN1; (+) strand; PAM type: NRG; PAM sequence: CAG
tgtatccattctccaataca

SEQ ID NO: 152071 - DNA, 20 bp, Artificial Sequence
  Description of Artificial Sequence: Synthetic oligonucleotide
  Target: ATXN1; (+) strand; PAM type: NRG; PAM sequence: CAG
atccattctccaatacacag

SEQ ID NO: 152072 - DNA, 20 bp, Artificial Sequence
  Description of Artificial Sequence: Synthetic oligonucleotide
  Target: ATXN1; (+) strand; PAM type: NRG; PAM sequence: CAG
tacacagcagatttatattt

SEQ ID NO: 152073 - DNA, 20 bp, Artificial Sequence
  Description of Artificial Sequence: Synthetic oligonucleotide
  Target: ATXN1; (+) strand; PAM type: NRG; PAM sequence: AAG
acagcagatttatatttcag

SEQ ID NO: 152074 - DNA, 20 bp, Artificial Sequence
  Description of Artificial Sequence: Synthetic oligonucleotide
  Target: ATXN1; (+) strand; PAM type: NRG; PAM sequence: AGG
cagcagatttatatttcaga

SEQ ID NO: 152075 - DNA, 20 bp, Artificial Sequence
  Description of Artificial Sequence: Synthetic oligonucleotide
  Target: ATXN1; (+) strand; PAM type: NRG; PAM sequence: CAG
atatttcagaaggtttttga

SEQ ID NO: 152076 - DNA, 20 bp, Artificial Sequence
  Description of Artificial Sequence: Synthetic oligonucleotide
  Target: ATXN1; (+) strand; PAM type: NRG; PAM sequence: GAG
atttcagaaggtttttgaca

SEQ ID NO: 152077 - DNA, 20 bp, Artificial Sequence
  Description of Artificial Sequence: Synthetic oligonucleotide
  Target: ATXN1; (+) strand; PAM type: NRG; PAM sequence: TGG
ttgtcctacataacattcca

SEQ ID NO: 152078 - DNA, 20 bp, Artificial Sequence
  Description of Artificial Sequence: Synthetic oligonucleotide
  Target: ATXN1; (+) strand; PAM type: NRG; PAM sequence: GGG
tgtcctacataacattccat

SEQ ID NO: 152079 - DNA, 20 bp, Artificial Sequence
  Description of Artificial Sequence: Synthetic oligonucleotide
  Target: ATXN1; (+) strand; PAM type: NRG; PAM sequence: GAG
ccatgggctgaactcccaac

SEQ ID NO: 152080 - DNA, 20 bp, Artificial Sequence
  Description of Artificial Sequence: Synthetic oligonucleotide
  Target: ATXN1; (+) strand; PAM type: NRG; PAM sequence: AGG
catgggctgaactcccaacg

SEQ ID NO: 152081 - DNA, 20 bp, Artificial Sequence
  Description of Artificial Sequence: Synthetic oligonucleotide
  Target: ATXN1; (+) strand; PAM type: NRG; PAM sequence: GGG
atgggctgaactcccaacga

SEQ ID NO: 152082 - DNA, 20 bp, Artificial Sequence
  Description of Artificial Sequence: Synthetic oligonucleotide
  Target: ATXN1; (+) strand; PAM type: NRG; PAM sequence: GGG
tgggctgaactcccaacgag

SEQ ID NO: 152083 - DNA, 20 bp, Artificial Sequence
  Description of Artificial Sequence: Synthetic oligonucleotide
  Target: ATXN1; (+) strand; PAM type: NRG; PAM sequence: CAG
aacgaggggcatatatttgt

SEQ ID NO: 152084 - DNA, 20 bp, Artificial Sequence
  Description of Artificial Sequence: Synthetic oligonucleotide
  Target: ATXN1; (+) strand; PAM type: NRG; PAM sequence: TAG
tgtttgcacttgttctattg

SEQ ID NO: 152085 - DNA, 20 bp, Artificial Sequence
  Description of Artificial Sequence: Synthetic oligonucleotide
  Target: ATXN1; (+) strand; PAM type: NRG; PAM sequence: TGG
aaacattaatatatacattt

SEQ ID NO: 152086 - DNA, 20 bp, Artificial Sequence
  Description of Artificial Sequence: Synthetic oligonucleotide
  Target: ATXN1; (+) strand; PAM type: NRG; PAM sequence: AAG
ttttattctgtaccaccttg

SEQ ID NO: 152087 - DNA, 20 bp, Artificial Sequence
  Description of Artificial Sequence: Synthetic oligonucleotide
  Target: ATXN1; (+) strand; PAM type: NRG; PAM sequence: AAG
cacccataactttttaaaat

SEQ ID NO: 152088 - DNA, 20 bp, Artificial Sequence
  Description of Artificial Sequence: Synthetic oligonucleotide
  Target: ATXN1; (+) strand; PAM type: NRG; PAM sequence: CAG
ataagccctgctatttaaat

SEQ ID NO: 152089 - DNA, 20 bp, Artificial Sequence
  Description of Artificial Sequence: Synthetic oligonucleotide
  Target: ATXN1; (+) strand; PAM type: NRG; PAM sequence: TAG
gtatctgcttatgtaaacac

SEQ ID NO: 152090 - DNA, 20 bp, Artificial Sequence
  Description of Artificial Sequence: Synthetic oligonucleotide
  Target: ATXN1; (+) strand; PAM type: NRG; PAM sequence: CAG
ttatgtaaacactagaaatc

SEQ ID NO: 152091 - DNA, 20 bp, Artificial Sequence
  Description of Artificial Sequence: Synthetic oligonucleotide
  Target: ATXN1; (+) strand; PAM type: NRG; PAM sequence: AGG
tatgtaaacactagaaatcc

SEQ ID NO: 152092 - DNA, 20 bp, Artificial Sequence
  Description of Artificial Sequence: Synthetic oligonucleotide
  Target: ATXN1; (+) strand; PAM type: NRG; PAM sequence: GGG
atgtaaacactagaaatcca

SEQ ID NO: 152093 - DNA, 20 bp, Artificial Sequence
  Description of Artificial Sequence: Synthetic oligonucleotide
  Target: ATXN1; (+) strand; PAM type: NRG; PAM sequence: GAG
gtaaacactagaaatccagg

SEQ ID NO: 152094 - DNA, 20 bp, Artificial Sequence
  Description of Artificial Sequence: Synthetic oligonucleotide
  Target: ATXN1; (+) strand; PAM type: NRG; PAM sequence: GAG
ctacacaaaaccaatcactt

SEQ ID NO: 152095 - DNA, 20 bp, Artificial Sequence
  Description of Artificial Sequence: Synthetic oligonucleotide
  Target: ATXN1; (+) strand; PAM type: NRG; PAM sequence: AAG
ccaatcacttgagtatttaa

SEQ ID NO: 152096 - DNA, 20 bp, Artificial Sequence
  Description of Artificial Sequence: Synthetic oligonucleotide
  Target: ATXN1; (+) strand; PAM type: NRG; PAM sequence: TAG
tcacttgagtatttaaaagc

SEQ ID NO: 152097 - DNA, 20 bp, Artificial Sequence
  Description of Artificial Sequence: Synthetic oligonucleotide
  Target: ATXN1; (+) strand; PAM type: NRG; PAM sequence: TGG
gtatttaaaagctagatctg

SEQ ID NO: 152098 - DNA, 20 bp, Artificial Sequence
  Description of Artificial Sequence: Synthetic oligonucleotide
  Target: ATXN1; (+) strand; PAM type: NRG; PAM sequence: GAG
ttaaaagctagatctgtggc

SEQ ID NO: 152099 - DNA, 20 bp, Artificial Sequence
  Description of Artificial Sequence: Synthetic oligonucleotide
  Target: ATXN1; (+) strand; PAM type: NRG; PAM sequence: GAG
aaaagctagatctgtggcga

SEQ ID NO: 152100 - DNA, 20 bp, Artificial Sequence
  Description of Artificial Sequence: Synthetic oligonucleotide
  Target: ATXN1; (+) strand; PAM type: NRG; PAM sequence: CAG
gctagatctgtggcgagaga

SEQ ID NO: 152101 - DNA, 20 bp, Artificial Sequence
  Description of Artificial Sequence: Synthetic oligonucleotide
  Target: ATXN1; (+) strand; PAM type: NRG; PAM sequence: AGG
ctagatctgtggcgagagac

SEQ ID NO: 152102 - DNA, 20 bp, Artificial Sequence
  Description of Artificial Sequence: Synthetic oligonucleotide
  Target: ATXN1; (+) strand; PAM type: NRG; PAM sequence: TAG
atctgtggcgagagacaggc

SEQ ID NO: 152103 - DNA, 20 bp, Artificial Sequence
  Description of Artificial Sequence: Synthetic oligonucleotide
  Target: ATXN1; (+) strand; PAM type: NRG; PAM sequence: TAG
ggcgagagacaggctagaac

SEQ ID NO: 152104 - DNA, 20 bp, Artificial Sequence
  Description of Artificial Sequence: Synthetic oligonucleotide
  Target: ATXN1; (+) strand; PAM type: NRG; PAM sequence: AAG
aggctagaactagcacaaac

SEQ ID NO: 152105 - DNA, 20 bp, Artificial Sequence
  Description of Artificial Sequence: Synthetic oligonucleotide
  Target: ATXN1; (+) strand; PAM type: NRG; PAM sequence: AAG
tagcacaaacaagtctgtgc

SEQ ID NO: 152106 - DNA, 20 bp, Artificial Sequence
  Description of Artificial Sequence: Synthetic oligonucleotide
  Target: ATXN1; (+) strand; PAM type: NRG; PAM sequence: CAG
atcctccactgcctctactc

SEQ ID NO: 152107 - DNA, 20 bp, Artificial Sequence
  Description of Artificial Sequence: Synthetic oligonucleotide
  Target: ATXN1; (+) strand; PAM type: NRG; PAM sequence: AGG
tcctccactgcctctactcc

SEQ ID NO: 152108 - DNA, 20 bp, Artificial Sequence
  Description of Artificial Sequence: Synthetic oligonucleotide
  Target: ATXN1; (+) strand; PAM type: NRG; PAM sequence: CAG
gcctctactccaggtcatcc

SEQ ID NO: 152109 - DNA, 20 bp, Artificial Sequence
  Description of Artificial Sequence: Synthetic oligonucleotide
  Target: ATXN1; (+) strand; PAM type: NRG; PAM sequence: AGG
cctctactccaggtcatccc

SEQ ID NO: 152110 - DNA, 20 bp, Artificial Sequence
  Description of Artificial Sequence: Synthetic oligonucleotide
  Target: ATXN1; (+) strand; PAM type: NRG; PAM sequence: GAG
catcccaggactatgcctgt

SEQ ID NO: 152111 - DNA, 20 bp, Artificial Sequence
  Description of Artificial Sequence: Synthetic oligonucleotide
  Target: ATXN1; (+) strand; PAM type: NRG; PAM sequence: AAG
tatgcctgtgagctaatgcc

SEQ ID NO: 152112 - DNA, 20 bp, Artificial Sequence
  Description of Artificial Sequence: Synthetic oligonucleotide
  Target: ATXN1; (+) strand; PAM type: NRG; PAM sequence: TGG
cctgtgagctaatgccaaga

SEQ ID NO: 152113 - DNA, 20 bp, Artificial Sequence
  Description of Artificial Sequence: Synthetic oligonucleotide
  Target: ATXN1; (+) strand; PAM type: NRG; PAM sequence: TGG
atgccaagatggaaaaaaaa

SEQ ID NO: 152114 - DNA, 20 bp, Artificial Sequence
  Description of Artificial Sequence: Synthetic oligonucleotide
  Target: ATXN1; (+) strand; PAM type: NRG; PAM sequence: TGG
caagatggaaaaaaaatgga

SEQ ID NO: 152115 - DNA, 20 bp, Artificial Sequence
  Description of Artificial Sequence: Synthetic oligonucleotide
  Target: ATXN1; (+) strand; PAM type: NRG; PAM sequence: GGG
aagatggaaaaaaaatggat

SEQ ID NO: 152116 - DNA, 20 bp, Artificial Sequence
  Description of Artificial Sequence: Synthetic oligonucleotide
  Target: ATXN1; (+) strand; PAM type: NRG; PAM sequence: TAG
atggatgggtgccttttttc

SEQ ID NO: 152117 - DNA, 20 bp, Artificial Sequence
  Description of Artificial Sequence: Synthetic oligonucleotide
  Target: ATXN1; (+) strand; PAM type: NRG; PAM sequence: AAG
ttttctagtgtatttgtgta

SEQ ID NO: 152118 - DNA, 20 bp, Artificial Sequence
  Description of Artificial Sequence: Synthetic oligonucleotide
  Target: ATXN1; (+) strand; PAM type: NRG; PAM sequence: AAG
tatttgtgtaaagactcccc

SEQ ID NO: 152119 - DNA, 20 bp, Artificial Sequence
  Description of Artificial Sequence: Synthetic oligonucleotide
  Target: ATXN1; (+) strand; PAM type: NRG; PAM sequence: GAG
tttgtgtaaagactccccaa

SEQ ID NO: 152120 - DNA, 20 bp, Artificial Sequence
  Description of Artificial Sequence: Synthetic oligonucleotide
  Target: ATXN1; (+) strand; PAM type: NRG; PAM sequence: AAG
taaagactccccaagagctc

SEQ ID NO: 152121 - DNA, 20 bp, Artificial Sequence
  Description of Artificial Sequence: Synthetic oligonucleotide
  Target: ATXN1; (+) strand; PAM type: NRG; PAM sequence: GAG
aagactccccaagagctcaa

SEQ ID NO: 152122 - DNA, 20 bp, Artificial Sequence
  Description of Artificial Sequence: Synthetic oligonucleotide
  Target: ATXN1; (+) strand; PAM type: NRG; PAM sequence: AGG
agactccccaagagctcaag

SEQ ID NO: 152123 - DNA, 20 bp, Artificial Sequence
  Description of Artificial Sequence: Synthetic oligonucleotide
  Target: ATXN1; (+) strand; PAM type: NRG; PAM sequence: GGG
gactccccaagagctcaaga

SEQ ID NO: 152124 - DNA, 20 bp, Artificial Sequence
  Description of Artificial Sequence: Synthetic oligonucleotide
  Target: ATXN1; (+) strand; PAM type: NRG; PAM sequence: GAG
ctccccaagagctcaagagg

SEQ ID NO: 152125 - DNA, 20 bp, Artificial Sequence
  Description of Artificial Sequence: Synthetic oligonucleotide
  Target: ATXN1; (+) strand; PAM type: NRG; PAM sequence: AAG
tgctgctctgcaaatgacaa

SEQ ID NO: 152126 - DNA, 20 bp, Artificial Sequence
  Description of Artificial Sequence: Synthetic oligonucleotide
  Target: ATXN1; (+) strand; PAM type: NRG; PAM sequence: AGG
gctgctctgcaaatgacaaa

SEQ ID NO: 152127 - DNA, 20 bp, Artificial Sequence
  Description of Artificial Sequence: Synthetic oligonucleotide
  Target: ATXN1; (+) strand; PAM type: NRG; PAM sequence: TAG
tgcaaatgacaaaaggtgtg

SEQ ID NO: 152128 - DNA, 20 bp, Artificial Sequence
  Description of Artificial Sequence: Synthetic oligonucleotide
  Target: ATXN1; (+) strand; PAM type: NRG; PAM sequence: AAG
gacaaaaggtgtgtagctgc

SEQ ID NO: 152129 - DNA, 20 bp, Artificial Sequence
  Description of Artificial Sequence: Synthetic oligonucleotide
  Target: ATXN1; (+) strand; PAM type: NRG; PAM sequence: CAG
gtgtgtagctgcaagccaat

SEQ ID NO: 152130 - DNA, 20 bp, Artificial Sequence
  Description of Artificial Sequence: Synthetic oligonucleotide
  Target: ATXN1; (+) strand; PAM type: NRG; PAM sequence: AGG
tgtgtagctgcaagccaatc

SEQ ID NO: 152131 - DNA, 20 bp, Artificial Sequence
  Description of Artificial Sequence: Synthetic oligonucleotide
  Target: ATXN1; (+) strand; PAM type: NRG; PAM sequence: CAG
gtagctgcaagccaatcagg

SEQ ID NO: 152132 - DNA, 20 bp, Artificial Sequence
  Description of Artificial Sequence: Synthetic oligonucleotide
  Target: ATXN1; (+) strand; PAM type: NRG; PAM sequence: TGG
cagaacatttaacatcgtcc

SEQ ID NO: 152133 - DNA, 20 bp, Artificial Sequence
  Description of Artificial Sequence: Synthetic oligonucleotide
  Target: ATXN1; (+) strand; PAM type: NRG; PAM sequence: AAG
cgtcctggccattaatgact

SEQ ID NO: 152134 - DNA, 20 bp, Artificial Sequence
  Description of Artificial Sequence: Synthetic oligonucleotide
  Target: ATXN1; (+) strand; PAM type: NRG; PAM sequence: CAG
attaatgactaagcctgcgc

SEQ ID NO: 152135 - DNA, 20 bp, Artificial Sequence
  Description of Artificial Sequence: Synthetic oligonucleotide
  Target: ATXN1; (+) strand; PAM type: NRG; PAM sequence: AAG
ctaagcctgcgccagctcaa

SEQ ID NO: 152136 - DNA, 20 bp, Artificial Sequence
  Description of Artificial Sequence: Synthetic oligonucleotide
  Target: ATXN1; (+) strand; PAM type: NRG; PAM sequence: CGG
agcctgcgccagctcaaaag

SEQ ID NO: 152137 - DNA, 20 bp, Artificial Sequence
  Description of Artificial Sequence: Synthetic oligonucleotide
  Target: ATXN1; (+) strand; PAM type: NRG; PAM sequence: CGG
tgcgccagctcaaaagcggt

SEQ ID NO: 152138 - DNA, 20 bp, Artificial Sequence
  Description of Artificial Sequence: Synthetic oligonucleotide
  Target: ATXN1; (+) strand; PAM type: NRG; PAM sequence: CAG
agctcaaaagcggtcggaaa

SEQ ID NO: 152139 - DNA, 20 bp, Artificial Sequence
  Description of Artificial Sequence: Synthetic oligonucleotide
  Target: ATXN1; (+) strand; PAM type: NRG; PAM sequence: CAG
aagcggtcggaaacagacgt

SEQ ID NO: 152140 - DNA, 20 bp, Artificial Sequence
  Description of Artificial Sequence: Synthetic oligonucleotide
  Target: ATXN1; (+) strand; PAM type: NRG; PAM sequence: TGG
cggaaacagacgtcagacta

SEQ ID NO: 152141 - DNA, 20 bp, Artificial Sequence
  Description of Artificial Sequence: Synthetic oligonucleotide
  Target: ATXN1; (+) strand; PAM type: NRG; PAM sequence: GGG
ggaaacagacgtcagactat

SEQ ID NO: 152142 - DNA, 20 bp, Artificial Sequence
  Description of Artificial Sequence: Synthetic oligonucleotide
  Target: ATXN1; (+) strand; PAM type: NRG; PAM sequence: CAG
acagacgtcagactatggga

SEQ ID NO: 152143 - DNA, 20 bp, Artificial Sequence
  Description of Artificial Sequence: Synthetic oligonucleotide
  Target: ATXN1; (+) strand; PAM type: NRG; PAM sequence: CAG
acagctaaaacattgattct

SEQ ID NO: 152144 - DNA, 20 bp, Artificial Sequence
  Description of Artificial Sequence: Synthetic oligonucleotide
  Target: ATXN1; (+) strand; PAM type: NRG; PAM sequence: AGG
cagctaaaacattgattctc

SEQ ID NO: 152145 - DNA, 20 bp, Artificial Sequence
  Description of Artificial Sequence: Synthetic oligonucleotide
  Target: ATXN1; (+) strand; PAM type: NRG; PAM sequence: GGG
agctaaaacattgattctca

SEQ ID NO: 152146 - DNA, 20 bp, Artificial Sequence
  Description of Artificial Sequence: Synthetic oligonucleotide
  Target: ATXN1; (+) strand; PAM type: NRG; PAM sequence: AAG
gattctcagggatgtcgtcc

SEQ ID NO: 152147 - DNA, 20 bp, Artificial Sequence
  Description of Artificial Sequence: Synthetic oligonucleotide
  Target: ATXN1; (+) strand; PAM type: NRG; PAM sequence: GAG
ttctcagggatgtcgtccaa

SEQ ID NO: 152148 - DNA, 20 bp, Artificial Sequence
  Description of Artificial Sequence: Synthetic oligonucleotide
  Target: ATXN1; (+) strand; PAM type: NRG; PAM sequence: AGG
tctcagggatgtcgtccaag

SEQ ID NO: 152149 - DNA, 20 bp, Artificial Sequence
  Description of Artificial Sequence: Synthetic oligonucleotide
  Target: ATXN1; (+) strand; PAM type: NRG; PAM sequence: GAG
tcagggatgtcgtccaagag

SEQ ID NO: 152150 - DNA, 20 bp, Artificial Sequence
  Description of Artificial Sequence: Synthetic oligonucleotide
  Target: ATXN1; (+) strand; PAM type: NRG; PAM sequence: AGG
cagggatgtcgtccaagagg

SEQ ID NO: 152151 - DNA, 20 bp, Artificial Sequence
  Description of Artificial Sequence: Synthetic oligonucleotide
  Target: ATXN1; (+) strand; PAM type: NRG; PAM sequence: AAG
cgtccaagaggaggtctctg

SEQ ID NO: 152152 - DNA, 20 bp, Artificial Sequence
  Description of Artificial Sequence: Synthetic oligonucleotide
  Target: ATXN1; (+) strand; PAM type: NRG; PAM sequence: TGG
caagaggaggtctctgaagc

SEQ ID NO: 152153 - DNA, 20 bp, Artificial Sequence
  Description of Artificial Sequence: Synthetic oligonucleotide
  Target: ATXN1; (+) strand; PAM type: NRG; PAM sequence: GGG
aagaggaggtctctgaagct

SEQ ID NO: 152154 - DNA, 20 bp, Artificial Sequence
  Description of Artificial Sequence: Synthetic oligonucleotide
  Target: ATXN1; (+) strand; PAM type: NRG; PAM sequence: TAG
tgaagctgggtgtcatcctt

SEQ ID NO: 152155 - DNA, 20 bp, Artificial Sequence
  Description of Artificial Sequence: Synthetic oligonucleotide
  Target: ATXN1; (+) strand; PAM type: NRG; PAM sequence: AGG
gaagctgggtgtcatccttt

SEQ ID NO: 152156 - DNA, 20 bp, Artificial Sequence
  Description of Artificial Sequence: Synthetic oligonucleotide
  Target: ATXN1; (+) strand; PAM type: NRG; PAM sequence: GGG
aagctgggtgtcatccttta

SEQ ID NO: 152157 - DNA, 20 bp, Artificial Sequence
  Description of Artificial Sequence: Synthetic oligonucleotide
  Target: ATXN1; (+) strand; PAM type: NRG; PAM sequence: TGG
ctgggtgtcatcctttaggg

SEQ ID NO: 152158 - DNA, 20 bp, Artificial Sequence
  Description of Artificial Sequence: Synthetic oligonucleotide
  Target: ATXN1; (+) strand; PAM type: NRG; PAM sequence: CAG
tgtcatcctttagggtggcc

SEQ ID NO: 152159 - DNA, 20 bp, Artificial Sequence
  Description of Artificial Sequence: Synthetic oligonucleotide
  Target: ATXN1; (+) strand; PAM type: NRG; PAM sequence: TGG
tagggtggcccagaataaaa

SEQ ID NO: 152160 - DNA, 20 bp, Artificial Sequence
  Description of Artificial Sequence: Synthetic oligonucleotide
  Target: ATXN1; (+) strand; PAM type: NRG; PAM sequence: TGG
tggtgacacattatgcctcc

SEQ ID NO: 152161 - DNA, 20 bp, Artificial Sequence
  Description of Artificial Sequence: Synthetic oligonucleotide
  Target: ATXN1; (+) strand; PAM type: NRG; PAM sequence: GAG
gacacattatgcctcctggc

SEQ ID NO: 152162 - DNA, 20 bp, Artificial Sequence
  Description of Artificial Sequence: Synthetic oligonucleotide
  Target: ATXN1; (+) strand; PAM type: NRG; PAM sequence: CGG
gagttcataaacactttgaa

SEQ ID NO: 152163 - DNA, 20 bp, Artificial Sequence
  Description of Artificial Sequence: Synthetic oligonucleotide
  Target: ATXN1; (+) strand; PAM type: NRG; PAM sequence: AAG
cataaacactttgaacggca

SEQ ID NO: 152164 - DNA, 20 bp, Artificial Sequence
  Description of Artificial Sequence: Synthetic oligonucleotide
  Target: ATXN1; (+) strand; PAM type: NRG; PAM sequence: AAG
ctttgaacggcaaagacacc

SEQ ID NO: 152165 - DNA, 20 bp, Artificial Sequence
  Description of Artificial Sequence: Synthetic oligonucleotide
  Target: ATXN1; (+) strand; PAM type: NRG; PAM sequence: CGG
acggcaaagacaccaagtcc

SEQ ID NO: 152166 - DNA, 20 bp, Artificial Sequence
  Description of Artificial Sequence: Synthetic oligonucleotide
  Target: ATXN1; (+) strand; PAM type: NRG; PAM sequence: GGG
cggcaaagacaccaagtccc

SEQ ID NO: 152167 - DNA, 20 bp, Artificial Sequence
  Description of Artificial Sequence: Synthetic oligonucleotide
  Target: ATXN1; (+) strand; PAM type: NRG; PAM sequence: GGG
ggcaaagacaccaagtcccg

SEQ ID NO: 152168 - DNA, 20 bp, Artificial Sequence
  Description of Artificial Sequence: Synthetic oligonucleotide
  Target: ATXN1; (+) strand; PAM type: NRG; PAM sequence: AAG
agtcccggggacttccaacg

SEQ ID NO: 152169 - DNA, 20 bp, Artificial Sequence
  Description of Artificial Sequence: Synthetic oligonucleotide
  Target: ATXN1; (+) strand; PAM type: NRG; PAM sequence: TGG
gggacttccaacgaagatct

SEQ ID NO: 152170 - DNA, 20 bp, Artificial Sequence
  Description of Artificial Sequence: Synthetic oligonucleotide
  Target: ATXN1; (+) strand; PAM type: NRG; PAM sequence: GGG
ggacttccaacgaagatctt

SEQ ID NO: 152171 - DNA, 20 bp, Artificial Sequence
  Description of Artificial Sequence: Synthetic oligonucleotide
  Target: ATXN1; (+) strand; PAM type: NRG; PAM sequence: GGG
gacttccaacgaagatcttg

SEQ ID NO: 152172 - DNA, 20 bp, Artificial Sequence
  Description of Artificial Sequence: Synthetic oligonucleotide
  Target: ATXN1; (+) strand; PAM type: NRG; PAM sequence: AAG
tccaacgaagatcttggggc

SEQ ID NO: 152173 - DNA, 20 bp, Artificial Sequence
  Description of Artificial Sequence: Synthetic oligonucleotide
  Target: ATXN1; (+) strand; PAM type: NRG; PAM sequence: AAG
aacgaagatcttggggcaag

SEQ ID NO: 152174 - DNA, 20 bp, Artificial Sequence
  Description of Artificial Sequence: Synthetic oligonucleotide
  Target: ATXN1; (+) strand; PAM type: NRG; PAM sequence: GAG
cgaagatcttggggcaagaa

SEQ ID NO: 152175 - DNA, 20 bp, Artificial Sequence
  Description of Artificial Sequence: Synthetic oligonucleotide
  Target: ATXN1; (+) strand; PAM type: NRG; PAM sequence: CAG
gggcaagaagagatgtccac

SEQ ID NO: 152176 - DNA, 20 bp, Artificial Sequence
  Description of Artificial Sequence: Synthetic oligonucleotide
  Target: ATXN1; (+) strand; PAM type: NRG; PAM sequence: TAG
ctttctgttctgtgacctgt

SEQ ID NO: 152177 - DNA, 20 bp, Artificial Sequence
  Description of Artificial Sequence: Synthetic oligonucleotide
  Target: ATXN1; (+) strand; PAM type: NRG; PAM sequence: GAG
ttctgttctgtgacctgtta

SEQ ID NO: 152178 - DNA, 20 bp, Artificial Sequence
  Description of Artificial Sequence: Synthetic oligonucleotide
  Target: ATXN1; (+) strand; PAM type: NRG; PAM sequence: GAG
ctgttctgtgacctgttaga

SEQ ID NO: 152179 - DNA, 20 bp, Artificial Sequence
  Description of Artificial Sequence: Synthetic oligonucleotide
  Target: ATXN1; (+) strand; PAM type: NRG; PAM sequence: TAG
ctgttagagagaaacattct

SEQ ID NO: 152180 - DNA, 20 bp, Artificial Sequence
  Description of Artificial Sequence: Synthetic oligonucleotide
  Target: ATXN1; (+) strand; PAM type: NRG; PAM sequence: AAG
ttcttagctactccatcacc

SEQ ID NO: 152181 - DNA, 20 bp, Artificial Sequence
  Description of Artificial Sequence: Synthetic oligonucleotide
  Target: ATXN1; (+) strand; PAM type: NRG; PAM sequence: AAG
gctactccatcaccaagcaa

SEQ ID NO: 152182 - DNA, 20 bp, Artificial Sequence
  Description of Artificial Sequence: Synthetic oligonucleotide
  Target: ATXN1; (+) strand; PAM type: NRG; PAM sequence: CAG
caccaagcaaaagtccctgc

SEQ ID NO: 152183 - DNA, 20 bp, Artificial Sequence
  Description of Artificial Sequence: Synthetic oligonucleotide
  Target: ATXN1; (+) strand; PAM type: NRG; PAM sequence: AGG
accaagcaaaagtccctgcc

SEQ ID NO: 152184 - DNA, 20 bp, Artificial Sequence
  Description of Artificial Sequence: Synthetic oligonucleotide
  Target: ATXN1; (+) strand; PAM type: NRG; PAM sequence: TGG
ggctgtatctccttgactcc

SEQ ID NO: 152185 - DNA, 20 bp, Artificial Sequence
  Description of Artificial Sequence: Synthetic oligonucleotide
  Target: ATXN1; (+) strand; PAM type: NRG; PAM sequence: GGG
gctgtatctccttgactcct

SEQ ID NO: 152186 - DNA, 20 bp, Artificial Sequence
  Description of Artificial Sequence: Synthetic oligonucleotide
  Target: ATXN1; (+) strand; PAM type: NRG; PAM sequence: GGG
ctgtatctccttgactcctg

SEQ ID NO: 152187 - DNA, 20 bp, Artificial Sequence
  Description of Artificial Sequence: Synthetic oligonucleotide
  Target: ATXN1; (+) strand; PAM type: NRG; PAM sequence: GGG
tgtatctccttgactcctgg

SEQ ID NO: 152188 - DNA, 20 bp, Artificial Sequence
  Description of Artificial Sequence: Synthetic oligonucleotide
  Target: ATXN1; (+) strand; PAM type: NRG; PAM sequence: AAG
ctccttgactcctgggggaa

SEQ ID NO: 152189 - DNA, 20 bp, Artificial Sequence
  Description of Artificial Sequence: Synthetic oligonucleotide
  Target: ATXN1; (+) strand; PAM type: NRG; PAM sequence: AAG
ctcctgggggaaaagctgta

SEQ ID NO: 152190 - DNA, 20 bp, Artificial Sequence
  Description of Artificial Sequence: Synthetic oligonucleotide
  Target: ATXN1; (+) strand; PAM type: NRG; PAM sequence: GAG
cctgggggaaaagctgtaaa

SEQ ID NO: 152191 - DNA, 20 bp, Artificial Sequence
  Description of Artificial Sequence: Synthetic oligonucleotide
  Target: ATXN1; (+) strand; PAM type: NRG; PAM sequence: GAG
ggaaaagctgtaaagagatt

SEQ ID NO: 152192 - DNA, 20 bp, Artificial Sequence
  Description of Artificial Sequence: Synthetic oligonucleotide
  Target: ATXN1; (+) strand; PAM type: NRG; PAM sequence: AGG
gaaaagctgtaaagagattg

SEQ ID NO: 152193 - DNA, 20 bp, Artificial Sequence
  Description of Artificial Sequence: Synthetic oligonucleotide
  Target: ATXN1; (+) strand; PAM type: NRG; PAM sequence: GAG
aaagctgtaaagagattgag

SEQ ID NO: 152194 - DNA, 20 bp, Artificial Sequence
  Description of Artificial Sequence: Synthetic oligonucleotide
  Target: ATXN1; (+) strand; PAM type: NRG; PAM sequence: AGG
aagctgtaaagagattgagg

SEQ ID NO: 152195 - DNA, 20 bp, Artificial Sequence
  Description of Artificial Sequence: Synthetic oligonucleotide
  Target: ATXN1; (+) strand; PAM type: NRG; PAM sequence: GGG
agctgtaaagagattgagga

SEQ ID NO: 152196 - DNA, 20 bp, Artificial Sequence
  Description of Artificial Sequence: Synthetic oligonucleotide
  Target: ATXN1; (+) strand; PAM type: NRG; PAM sequence: AAG
agagattgaggagggcacct

SEQ ID NO: 152197 - DNA, 20 bp, Artificial Sequence
  Description of Artificial Sequence: Synthetic oligonucleotide
  Target: ATXN1; (+) strand; PAM type: NRG; PAM sequence: GAG
agattgaggagggcacctaa

SEQ ID NO: 152198 - DNA, 20 bp, Artificial Sequence
  Description of Artificial Sequence: Synthetic oligonucleotide
  Target: ATXN1; (+) strand; PAM type: NRG; PAM sequence: GAG
attgaggagggcacctaaga

SEQ ID NO: 152199 - DNA, 20 bp, Artificial Sequence
  Description of Artificial Sequence: Synthetic oligonucleotide
  Target: ATXN1; (+) strand; PAM type: NRG; PAM sequence: GAG
tgaggagggcacctaagaga

SEQ ID NO: 152200 - DNA, 20 bp, Artificial Sequence
  Description of Artificial Sequence: Synthetic oligonucleotide
  Target: ATXN1; (+) strand; PAM type: NRG; PAM sequence: TAG
gagggcacctaagagagaga

SEQ ID NO: 152201 - DNA, 20 bp, Artificial Sequence
  Description of Artificial Sequence: Synthetic oligonucleotide
  Target: ATXN1; (+) strand; PAM type: NRG; PAM sequence: TGG
gcacctaagagagagataga

SEQ ID NO: 152202 - DNA, 20 bp, Artificial Sequence
  Description of Artificial Sequence: Synthetic oligonucleotide
  Target: ATXN1; (+) strand; PAM type: NRG; PAM sequence: CAG
gatggcctttgtcttgtttg

SEQ ID NO: 152203 - DNA, 20 bp, Artificial Sequence
  Description of Artificial Sequence: Synthetic oligonucleotide
  Target: ATXN1; (+) strand; PAM type: NRG; PAM sequence: GAG
ttgtttgcagtttcactaat

SEQ ID NO: 152204 - DNA, 20 bp, Artificial Sequence
  Description of Artificial Sequence: Synthetic oligonucleotide
  Target: ATXN1; (+) strand; PAM type: NRG; PAM sequence: AGG
tgtttgcagtttcactaatg

SEQ ID NO: 152205 - DNA, 20 bp, Artificial Sequence
  Description of Artificial Sequence: Synthetic oligonucleotide
  Target: ATXN1; (+) strand; PAM type: NRG; PAM sequence: CAG
agtttcactaatgaggtttc

SEQ ID NO: 152206 - DNA, 20 bp, Artificial Sequence
  Description of Artificial Sequence: Synthetic oligonucleotide
  Target: ATXN1; (+) strand; PAM type: NRG; PAM sequence: TGG
aggtttccagatataaaatc

SEQ ID NO: 152207 - DNA, 20 bp, Artificial Sequence
  Description of Artificial Sequence: Synthetic oligonucleotide
  Target: ATXN1; (+) strand; PAM type: NRG; PAM sequence: AAG
tataaaatctggcttctgtc

SEQ ID NO: 152208 - DNA, 20 bp, Artificial Sequence
  Description of Artificial Sequence: Synthetic oligonucleotide
  Target: ATXN1; (+) strand; PAM type: NRG; PAM sequence: CAG
tgtcaagtctaaatgtgaat

SEQ ID NO: 152209 - DNA, 20 bp, Artificial Sequence
  Description of Artificial Sequence: Synthetic oligonucleotide
  Target: ATXN1; (+) strand; PAM type: NRG; PAM sequence: GAG
ctaaatgtgaatcagattct

SEQ ID NO: 152210 - DNA, 20 bp, Artificial Sequence
  Description of Artificial Sequence: Synthetic oligonucleotide
  Target: ATXN1; (+) strand; PAM type: NRG; PAM sequence: TGG
tatttctgcaactaacaata

SEQ ID NO: 152211 - DNA, 20 bp, Artificial Sequence
  Description of Artificial Sequence: Synthetic oligonucleotide
  Target: ATXN1; (+) strand; PAM type: NRG; PAM sequence: CAG
gcaactaacaatatggtcac

SEQ ID NO: 152212 - DNA, 20 bp, Artificial Sequence
  Description of Artificial Sequence: Synthetic oligonucleotide
  Target: ATXN1; (+) strand; PAM type: NRG; PAM sequence: AAG
accagcaaactacttctgca

SEQ ID NO: 152213 - DNA, 20 bp, Artificial Sequence
  Description of Artificial Sequence: Synthetic oligonucleotide
  Target: ATXN1; (+) strand; PAM type: NRG; PAM sequence: AAG
gcaaactacttctgcaaaga

SEQ ID NO: 152214 - DNA, 20 bp, Artificial Sequence
  Description of Artificial Sequence: Synthetic oligonucleotide
  Target: ATXN1; (+) strand; PAM type: NRG; PAM sequence: AAG
ctacttctgcaaagaaagaa

SEQ ID NO: 152215 - DNA, 20 bp, Artificial Sequence
  Description of Artificial Sequence: Synthetic oligonucleotide
  Target: ATXN1; (+) strand; PAM type: NRG; PAM sequence: AGG
tacttctgcaaagaaagaaa

SEQ ID NO: 152216 - DNA, 20 bp, Artificial Sequence
  Description of Artificial Sequence: Synthetic oligonucleotide
  Target: ATXN1; (+) strand; PAM type: NRG; PAM sequence: TAG
agaaagaaaaggcttcataa

SEQ ID NO: 152217 - DNA, 20 bp, Artificial Sequence
  Description of Artificial Sequence: Synthetic oligonucleotide
  Target: ATXN1; (+) strand; PAM type: NRG; PAM sequence: TGG
ttcataatagttattgcttc

SEQ ID NO: 152218 - DNA, 20 bp, Artificial Sequence
  Description of Artificial Sequence: Synthetic oligonucleotide
  Target: ATXN1; (+) strand; PAM type: NRG; PAM sequence: AAG
tagttattgcttctggcacc

SEQ ID NO: 152219 - DNA, 20 bp, Artificial Sequence
  Description of Artificial Sequence: Synthetic oligonucleotide
  Target: ATXN1; (+) strand; PAM type: NRG; PAM sequence: GAG
gttattgcttctggcaccaa

SEQ ID NO: 152220 - DNA, 20 bp, Artificial Sequence
  Description of Artificial Sequence: Synthetic oligonucleotide
  Target: ATXN1; (+) strand; PAM type: NRG; PAM sequence: TGG
ttgcttctggcaccaagaga

SEQ ID NO: 152221 - DNA, 20 bp, Artificial Sequence
  Description of Artificial Sequence: Synthetic oligonucleotide
  Target: ATXN1; (+) strand; PAM type: NRG; PAM sequence: CAG
ttctggcaccaagagatgga

SEQ ID NO: 152222 - DNA, 20 bp, Artificial Sequence
  Description of Artificial Sequence: Synthetic oligonucleotide
  Target: ATXN1; (+) strand; PAM type: NRG; PAM sequence: AAG
tggacagtgtattttactaa

SEQ ID NO: 152223 - DNA, 20 bp, Artificial Sequence
  Description of Artificial Sequence: Synthetic oligonucleotide
  Target: ATXN1; (+) strand; PAM type: NRG; PAM sequence: TAG
agtgtattttactaaaagat

SEQ ID NO: 152224 - DNA, 20 bp, Artificial Sequence
  Description of Artificial Sequence: Synthetic oligonucleotide
  Target: ATXN1; (+) strand; PAM type: NRG; PAM sequence: TAG
tttactaaaagattagccac

SEQ ID NO: 152225 - DNA, 20 bp, Artificial Sequence
  Description of Artificial Sequence: Synthetic oligonucleotide
  Target: ATXN1; (+) strand; PAM type: NRG; PAM sequence: CAG
ttagccactagatgttgtaa

SEQ ID NO: 152226 - DNA, 20 bp, Artificial Sequence
  Description of Artificial Sequence: Synthetic oligonucleotide
  Target: ATXN1; (+) strand; PAM type: NRG; PAM sequence: TAG
gccactagatgttgtaacag

SEQ ID NO: 152227 - DNA, 20 bp, Artificial Sequence
  Description of Artificial Sequence: Synthetic oligonucleotide
  Target: ATXN1; (+) strand; PAM type: NRG; PAM sequence: TGG
aacagtagatacttaattat

SEQ ID NO: 152228 - DNA, 20 bp, Artificial Sequence
  Description of Artificial Sequence: Synthetic oligonucleotide
  Target: ATXN1; (+) strand; PAM type: NRG; PAM sequence: GGG
acagtagatacttaattatt

SEQ ID NO: 152229 - DNA, 20 bp, Artificial Sequence
  Description of Artificial Sequence: Synthetic oligonucleotide
  Target: ATXN1; (+) strand; PAM type: NRG; PAM sequence: GGG
cagtagatacttaattattg

SEQ ID NO: 152230 - DNA, 20 bp, Artificial Sequence
  Description of Artificial Sequence: Synthetic oligonucleotide
  Target: ATXN1; (+) strand; PAM type: NRG; PAM sequence: AAG
tagatacttaattattgggg

SEQ ID NO: 152231 - DNA, 20 bp, Artificial Sequence
  Description of Artificial Sequence: Synthetic oligonucleotide
  Target: ATXN1; (+) strand; PAM type: NRG; PAM sequence: TGG
attattggggaagtaactca

SEQ ID NO: 152232 - DNA, 20 bp, Artificial Sequence
  Description of Artificial Sequence: Synthetic oligonucleotide
  Target: ATXN1; (+) strand; PAM type: NRG; PAM sequence: CAG
gaagtaactcatggtttttg

SEQ ID NO: 152233 - DNA, 20 bp, Artificial Sequence
  Description of Artificial Sequence: Synthetic oligonucleotide
  Target: ATXN1; (+) strand; PAM type: NRG; PAM sequence: CAG
tttttgcagatacaaatgtc

SEQ ID NO: 152234 - DNA, 20 bp, Artificial Sequence
  Description of Artificial Sequence: Synthetic oligonucleotide
  Target: ATXN1; (+) strand; PAM type: NRG; PAM sequence: CAG
cagatacaaatgtccagcac

SEQ ID NO: 152235 - DNA, 20 bp, Artificial Sequence
  Description of Artificial Sequence: Synthetic oligonucleotide
  Target: ATXN1; (+) strand; PAM type: NRG; PAM sequence: TAG
agcaccagctccttcttgcc

SEQ ID NO: 152236 - DNA, 20 bp, Artificial Sequence
  Description of Artificial Sequence: Synthetic oligonucleotide
  Target: ATXN1; (+) strand; PAM type: NRG; PAM sequence: CAG
accagctccttcttgcctag

SEQ ID NO: 152237 - DNA, 20 bp, Artificial Sequence
  Description of Artificial Sequence: Synthetic oligonucleotide
  Target: ATXN1; (+) strand; PAM type: NRG; PAM sequence: AAG
ccttcttgcctagcagaata

SEQ ID NO: 152238 - DNA, 20 bp, Artificial Sequence
  Description of Artificial Sequence: Synthetic oligonucleotide
  Target: ATXN1; (+) strand; PAM type: NRG; PAM sequence: CAG
agcagaataaagctgattca

SEQ ID NO: 152239 - DNA, 20 bp, Artificial Sequence
  Description of Artificial Sequence: Synthetic oligonucleotide
  Target: ATXN1; (+) strand; PAM type: NRG; PAM sequence: AGG
gcagaataaagctgattcac

SEQ ID NO: 152240 - DNA, 20 bp, Artificial Sequence
  Description of Artificial Sequence: Synthetic oligonucleotide
  Target: ATXN1; (+) strand; PAM type: NRG; PAM sequence: TGG
gaataaagctgattcacagg

SEQ ID NO: 152241 - DNA, 20 bp, Artificial Sequence
  Description of Artificial Sequence: Synthetic oligonucleotide
  Target: ATXN1; (+) strand; PAM type: NRG; PAM sequence: TGG
aaagctgattcacaggtggc

SEQ ID NO: 152242 - DNA, 20 bp, Artificial Sequence
  Description of Artificial Sequence: Synthetic oligonucleotide
  Target: ATXN1; (+) strand; PAM type: NRG; PAM sequence: AAG
gctgattcacaggtggctgg

SEQ ID NO: 152243 - DNA, 20 bp, Artificial Sequence
  Description of Artificial Sequence: Synthetic oligonucleotide
  Target: ATXN1; (+) strand; PAM type: NRG; PAM sequence: GAG
tgattcacaggtggctggaa

SEQ ID NO: 152244 - DNA, 20 bp, Artificial Sequence
  Description of Artificial Sequence: Synthetic oligonucleotide
  Target: ATXN1; (+) strand; PAM type: NRG; PAM sequence: TAG
ctaatctcttctgtaacatc

SEQ ID NO: 152245 - DNA, 20 bp, Artificial Sequence
  Description of Artificial Sequence: Synthetic oligonucleotide
  Target: ATXN1; (+) strand; PAM type: NRG; PAM sequence: TAG
atctcttctgtaacatctag

SEQ ID NO: 152246 - DNA, 20 bp, Artificial Sequence
  Description of Artificial Sequence: Synthetic oligonucleotide
  Target: ATXN1; (+) strand; PAM type: NRG; PAM sequence: AAG
cttctgtaacatctagtaga

SEQ ID NO: 152247 - DNA, 20 bp, Artificial Sequence
  Description of Artificial Sequence: Synthetic oligonucleotide
  Target: ATXN1; (+) strand; PAM type: NRG; PAM sequence: CAG
tgtaacatctagtagaaaga

SEQ ID NO: 152248 - DNA, 20 bp, Artificial Sequence
  Description of Artificial Sequence: Synthetic oligonucleotide
  Target: ATXN1; (+) strand; PAM type: NRG; PAM sequence: CAG
aacatctagtagaaagacag

SEQ ID NO: 152249 - DNA, 20 bp, Artificial Sequence
  Description of Artificial Sequence: Synthetic oligonucleotide
  Target: ATXN1; (+) strand; PAM type: NRG; PAM sequence: CAG
aaagacagcagatacctaca

SEQ ID NO: 152250 - DNA, 20 bp, Artificial Sequence
  Description of Artificial Sequence: Synthetic oligonucleotide
  Target: ATXN1; (+) strand; PAM type: NRG; PAM sequence: GAG
agacagcagatacctacaca

SEQ ID NO: 152251 - DNA, 20 bp, Artificial Sequence
  Description of Artificial Sequence: Synthetic oligonucleotide
  Target: ATXN1; (+) strand; PAM type: NRG; PAM sequence: AAG
tgtacaatcttcccatccac

SEQ ID NO: 152252 - DNA, 20 bp, Artificial Sequence
  Description of Artificial Sequence: Synthetic oligonucleotide
  Target: ATXN1; (+) strand; PAM type: NRG; PAM sequence: AGG
gtacaatcttcccatccaca

SEQ ID NO: 152253 - DNA, 20 bp, Artificial Sequence
  Description of Artificial Sequence: Synthetic oligonucleotide
  Target: ATXN1; (+) strand; PAM type: NRG; PAM sequence: CAG
tcccatccacaaggacttct

SEQ ID NO: 152254 - DNA, 20 bp, Artificial Sequence
  Description of Artificial Sequence: Synthetic oligonucleotide
  Target: ATXN1; (+) strand; PAM type: NRG; PAM sequence: GAG
ccatccacaaggacttctca

SEQ ID NO: 152255 - DNA, 20 bp, Artificial Sequence
  Description of Artificial Sequence: Synthetic oligonucleotide
  Target: ATXN1; (+) strand; PAM type: NRG; PAM sequence: CAG
tccacaaggacttctcagag

SEQ ID NO: 152256 - DNA, 20 bp, Artificial Sequence
  Description of Artificial Sequence: Synthetic oligonucleotide
  Target: ATXN1; (+) strand; PAM type: NRG; PAM sequence: AAG
agcagatgacattaaatttc

SEQ ID NO: 152257 - DNA, 20 bp, Artificial Sequence
  Description of Artificial Sequence: Synthetic oligonucleotide
  Target: ATXN1; (+) strand; PAM type: NRG; PAM sequence: GAG
aatttcaagattccatatat

SEQ ID NO: 152258 - DNA, 20 bp, Artificial Sequence
  Description of Artificial Sequence: Synthetic oligonucleotide
  Target: ATXN1; (+) strand; PAM type: NRG; PAM sequence: TGG
tgttttcaaccttgctgtca

SEQ ID NO: 152259 - DNA, 20 bp, Artificial Sequence
  Description of Artificial Sequence: Synthetic oligonucleotide
  Target: ATXN1; (+) strand; PAM type: NRG; PAM sequence: GGG
gttttcaaccttgctgtcat

SEQ ID NO: 152260 - DNA, 20 bp, Artificial Sequence
  Description of Artificial Sequence: Synthetic oligonucleotide
  Target: ATXN1; (+) strand; PAM type: NRG; PAM sequence: AAG
ttgctgtcatgggtgcatta

SEQ ID NO: 152261 - DNA, 20 bp, Artificial Sequence
  Description of Artificial Sequence: Synthetic oligonucleotide
  Target: ATXN1; (+) strand; PAM type: NRG; PAM sequence: AGG
tgctgtcatgggtgcattaa

SEQ ID NO: 152262 - DNA, 20 bp, Artificial Sequence
  Description of Artificial Sequence: Synthetic oligonucleotide
  Target: ATXN1; (+) strand; PAM type: NRG; PAM sequence: AAG
taaaggaaatacacctcaaa

SEQ ID NO: 152263 - DNA, 20 bp, Artificial Sequence
  Description of Artificial Sequence: Synthetic oligonucleotide
  Target: ATXN1; (+) strand; PAM type: NRG; PAM sequence: AAG
cctcaaaaagctcaacttta

SEQ ID NO: 152264 - DNA, 20 bp, Artificial Sequence
  Description of Artificial Sequence: Synthetic oligonucleotide
  Target: ATXN1; (+) strand; PAM type: NRG; PAM sequence: AGG
ctcaaaaagctcaactttaa

SEQ ID NO: 152265 - DNA, 20 bp, Artificial Sequence
  Description of Artificial Sequence: Synthetic oligonucleotide
  Target: ATXN1; (+) strand; PAM type: NRG; PAM sequence: CAG
aaagctcaactttaaaggtg

SEQ ID NO: 152266 - DNA, 20 bp, Artificial Sequence
  Description of Artificial Sequence: Synthetic oligonucleotide
  Target: ATXN1; (+) strand; PAM type: NRG; PAM sequence: TGG
gctcaactttaaaggtgcag

SEQ ID NO: 152267 - DNA, 20 bp, Artificial Sequence
  Description of Artificial Sequence: Synthetic oligonucleotide
  Target: ATXN1; (+) strand; PAM type: NRG; PAM sequence: AAG
tcattctctgtttatccatc

SEQ ID NO: 152268 - DNA, 20 bp, Artificial Sequence
  Description of Artificial Sequence: Synthetic oligonucleotide
  Target: ATXN1; (+) strand; PAM type: NRG; PAM sequence: TAG
ctctgtttatccatcaagtt

SEQ ID NO: 152269 - DNA, 20 bp, Artificial Sequence
  Description of Artificial Sequence: Synthetic oligonucleotide
  Target: ATXN1; (+) strand; PAM type: NRG; PAM sequence: AGG
tctgtttatccatcaagttt

SEQ ID NO: 152270 - DNA, 20 bp, Artificial Sequence
  Description of Artificial Sequence: Synthetic oligonucleotide
  Target: ATXN1; (+) strand; PAM type: NRG; PAM sequence: CGG
tatccatcaagtttaggctc

SEQ ID NO: 152271 - DNA, 20 bp, Artificial Sequence
  Description of Artificial Sequence: Synthetic oligonucleotide
  Target: ATXN1; (+) strand; PAM type: NRG; PAM sequence: TAG
atttatttatttattttttt

SEQ ID NO: 152272 - DNA, 20 bp, Artificial Sequence
  Description of Artificial Sequence: Synthetic oligonucleotide
  Target: ATXN1; (+) strand; PAM type: NRG; PAM sequence: GAG
ttatttatttatttttttta

SEQ ID NO: 152273 - DNA, 20 bp, Artificial Sequence
  Description of Artificial Sequence: Synthetic oligonucleotide
  Target: ATXN1; (+) strand; PAM type: NRG; PAM sequence: CAG
ttatttattttttttagaga

SEQ ID NO: 152274 - DNA, 20 bp, Artificial Sequence
  Description of Artificial Sequence: Synthetic oligonucleotide
  Target: ATXN1; (+) strand; PAM type: NRG; PAM sequence: AGG
tatttattttttttagagac

SEQ ID NO: 152275 - DNA, 20 bp, Artificial Sequence
  Description of Artificial Sequence: Synthetic oligonucleotide
  Target: ATXN1; (+) strand; PAM type: NRG; PAM sequence: GGG
atttattttttttagagaca

SEQ ID NO: 152276 - DNA, 20 bp, Artificial Sequence
  Description of Artificial Sequence: Synthetic oligonucleotide
  Target: ATXN1; (+) strand; PAM type: NRG; PAM sequence: TGG
agagacagggtctcactctg

SEQ ID NO: 152277 - DNA, 20 bp, Artificial Sequence
  Description of Artificial Sequence: Synthetic oligonucleotide
  Target: ATXN1; (+) strand; PAM type: NRG; PAM sequence: CAG
cagggtctcactctgtggcc

SEQ ID NO: 152278 - DNA, 20 bp, Artificial Sequence
  Description of Artificial Sequence: Synthetic oligonucleotide
  Target: ATXN1; (+) strand; PAM type: NRG; PAM sequence: AGG
agggtctcactctgtggccc

SEQ ID NO: 152279 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtggcccaggc

SEQ ID NO: 152280 - DNA, 20 bp, Artificial Sequence
  Description of Artificial Sequence: Synthetic oligonucleotide
  Target: ATXN1; (+) strand; PAM type: NRG; PAM sequence: TAG
ccaggctggtcttgaactcc

SEQ ID NO: 152281 - DNA, 20 bp, Artificial Sequence
  Description of Artificial Sequence: Synthetic oligonucleotide
  Target: ATXN1; (+) strand; PAM type: NRG; PAM sequence: CAG
tggtcttgaactcctagcct

SEQ ID NO: 152282 - DNA, 20 bp, Artificial Sequence
  Description of Artificial Sequence: Synthetic oligonucleotide
  Target: ATXN1; (+) strand; PAM type: NRG; PAM sequence: AGG
ggtcttgaactcctagcctc

SEQ ID NO: 152283 - DNA, 20 bp, Artificial Sequence
  Description of Artificial Sequence: Synthetic oligonucleotide
  Target: ATXN1; (+) strand; PAM type: NRG; PAM sequence: TGG
ctcaggcgatcccaccgcct

SEQ ID NO: 152284 - DNA, 20 bp, Artificial Sequence
  Description of Artificial Sequence: Synthetic oligonucleotide
  Target: ATXN1; (+) strand; PAM type: NRG; PAM sequence: AAG
cccaccgccttggcctccca

SEQ ID NO: 152285 - DNA, 20 bp, Artificial Sequence
  Description of Artificial Sequence: Synthetic oligonucleotide
  Target: ATXN1; (+) strand; PAM type: NRG; PAM sequence: TGG
gccttggcctcccaaagcac

SEQ ID NO: 152286 - DNA, 20 bp, Artificial Sequence
  Description of Artificial Sequence: Synthetic oligonucleotide
  Target: ATXN1; (+) strand; PAM type: NRG; PAM sequence: GGG
ccttggcctcccaaagcact

SEQ ID NO: 152287 - DNA, 20 bp, Artificial Sequence
  Description of Artificial Sequence: Synthetic oligonucleotide
  Target: ATXN1; (+) strand; PAM type: NRG; PAM sequence: GAG
ctcccaaagcactgggattc

SEQ ID NO: 152288 - DNA, 20 bp, Artificial Sequence
  Description of Artificial Sequence: Synthetic oligonucleotide
  Target: ATXN1; (+) strand; PAM type: NRG; PAM sequence: AGG
tcccaaagcactgggattcg

SEQ ID NO: 152289 - DNA, 20 bp, Artificial Sequence
  Description of Artificial Sequence: Synthetic oligonucleotide
  Target: ATXN1; (+) strand; PAM type: NRG; PAM sequence: GAG
agcactgggattcgaggcat

SEQ ID NO: 152290 - DNA, 20 bp, Artificial Sequence
  Description of Artificial Sequence: Synthetic oligonucleotide
  Target: ATXN1; (+) strand; PAM type: NRG; PAM sequence: CAG
gaggcatgagccaccatgcc

SEQ ID NO: 152291 - DNA, 20 bp, Artificial Sequence
  Description of Artificial Sequence: Synthetic oligonucleotide
  Target: ATXN1; (+) strand; PAM type: NRG; PAM sequence: AAG
taacatctaaatttataatg

SEQ ID NO: 152292 - DNA, 20 bp, Artificial Sequence
  Description of Artificial Sequence: Synthetic oligonucleotide
  Target: ATXN1; (+) strand; PAM type: NRG; PAM sequence: AAG
ttataatgaagcactgtttc

SEQ ID NO: 152293 - DNA, 20 bp, Artificial Sequence
  Description of Artificial Sequence: Synthetic oligonucleotide
  Target: ATXN1; (+) strand; PAM type: NRG; PAM sequence: AGG
tataatgaagcactgtttca

SEQ ID NO: 152294 - DNA, 20 bp, Artificial Sequence
  Description of Artificial Sequence: Synthetic oligonucleotide
  Target: ATXN1; (+) strand; PAM type: NRG; PAM sequence: GGG
ataatgaagcactgtttcaa

SEQ ID NO: 152295 - DNA, 20 bp, Artificial Sequence
  Description of Artificial Sequence: Synthetic oligonucleotide
  Target: ATXN1; (+) strand; PAM type: NRG; PAM sequence: GGG
taatgaagcactgtttcaag

SEQ ID NO: 152296 - DNA, 20 bp, Artificial Sequence
  Description of Artificial Sequence: Synthetic oligonucleotide
  Target: ATXN1; (+) strand; PAM type: NRG; PAM sequence: TGG
gcactgtttcaaggggtaac

SEQ ID NO: 152297 - DNA, 20 bp, Artificial Sequence
  Description of Artificial Sequence: Synthetic oligonucleotide
  Target: ATXN1; (+) strand; PAM type: NRG; PAM sequence: GGG
cactgtttcaaggggtaact

SEQ ID NO: 152298 - DNA, 20 bp, Artificial Sequence
  Description of Artificial Sequence: Synthetic oligonucleotide
  Target: ATXN1; (+) strand; PAM type: NRG; PAM sequence: AAG
actgggaattgcacataccc

SEQ ID NO: 152299 - DNA, 20 bp, Artificial Sequence
  Description of Artificial Sequence: Synthetic oligonucleotide
  Target: ATXN1; (+) strand; PAM type: NRG; PAM sequence: AGG
ctgggaattgcacataccca

SEQ ID NO: 152300 - DNA, 20 bp, Artificial Sequence
  Description of Artificial Sequence: Synthetic oligonucleotide
  Target: ATXN1; (+) strand; PAM type: NRG; PAM sequence: GGG
tgggaattgcacatacccaa

SEQ ID NO: 152301 - DNA, 20 bp, Artificial Sequence
  Description of Artificial Sequence: Synthetic oligonucleotide
  Target: ATXN1; (+) strand; PAM type: NRG; PAM sequence: TGG
attgcacatacccaagggat

SEQ ID NO: 152302 - DNA, 20 bp, Artificial Sequence
  Description of Artificial Sequence: Synthetic oligonucleotide
  Target: ATXN1; (+) strand; PAM type: NRG; PAM sequence: CAG
cttgcatttcttcaccattc

SEQ ID NO: 152303 - DNA, 20 bp, Artificial Sequence
  Description of Artificial Sequence: Synthetic oligonucleotide
  Target: ATXN1; (+) strand; PAM type: NRG; PAM sequence: TAG
gctccatctcaatattgttc

SEQ ID NO: 152304 - DNA, 20 bp, Artificial Sequence
  Description of Artificial Sequence: Synthetic oligonucleotide
  Target: ATXN1; (+) strand; PAM type: NRG; PAM sequence: AGG
ctccatctcaatattgttct

SEQ ID NO: 152305 - DNA, 20 bp, Artificial Sequence
  Description of Artificial Sequence: Synthetic oligonucleotide
  Target: ATXN1; (+) strand; PAM type: NRG; PAM sequence: GGG
tccatctcaatattgttcta

SEQ ID NO: 152306 - DNA, 20 bp, Artificial Sequence
  Description of Artificial Sequence: Synthetic oligonucleotide
  Target: ATXN1; (+) strand; PAM type: NRG; PAM sequence: GGG
ccatctcaatattgttctag

SEQ ID NO: 152307 - DNA, 20 bp, Artificial Sequence
  Description of Artificial Sequence: Synthetic oligonucleotide
  Target: ATXN1; (+) strand; PAM type: NRG; PAM sequence: GGG
catctcaatattgttctagg

SEQ ID NO: 152308 - DNA, 20 bp, Artificial Sequence
  Description of Artificial Sequence: Synthetic oligonucleotide
  Target: ATXN1; (+) strand; PAM type: NRG; PAM sequence: CAG
attgttctagggggctaact

SEQ ID NO: 152309 - DNA, 20 bp, Artificial Sequence
  Description of Artificial Sequence: Synthetic oligonucleotide
  Target: ATXN1; (+) strand; PAM type: NRG; PAM sequence: AAG
tctagggggctaactcagtt

SEQ ID NO: 152310 - DNA, 20 bp, Artificial Sequence
  Description of Artificial Sequence: Synthetic oligonucleotide
  Target: ATXN1; (+) strand; PAM type: NRG; PAM sequence: AAG
ggggctaactcagttaagca

SEQ ID NO: 152311 - DNA, 20 bp, Artificial Sequence
  Description of Artificial Sequence: Synthetic oligonucleotide
  Target: ATXN1; (+) strand; PAM type: NRG; PAM sequence: CGG
gtcttttcatcctacaactt

SEQ ID NO: 152312 - DNA, 20 bp, Artificial Sequence
  Description of Artificial Sequence: Synthetic oligonucleotide
  Target: ATXN1; (+) strand; PAM type: NRG; PAM sequence: TGG
tcggaaacgcaaataatttc

SEQ ID NO: 152313 - DNA, 20 bp, Artificial Sequence
  Description of Artificial Sequence: Synthetic oligonucleotide
  Target: ATXN1; (+) strand; PAM type: NRG; PAM sequence: GGG
cggaaacgcaaataatttct

SEQ ID NO: 152314 - DNA, 20 bp, Artificial Sequence
  Description of Artificial Sequence: Synthetic oligonucleotide
  Target: ATXN1; (+) strand; PAM type: NRG; PAM sequence: GGG
ggaaacgcaaataatttctg

SEQ ID NO: 152315 - DNA, 20 bp, Artificial Sequence
  Description of Artificial Sequence: Synthetic oligonucleotide
  Target: ATXN1; (+) strand; PAM type: NRG; PAM sequence: TGG
aaataatttctggggtatct

SEQ ID NO: 152316 - DNA, 20 bp, Artificial Sequence
  Description of Artificial Sequence: Synthetic oligonucleotide
  Target: ATXN1; (+) strand; PAM type: NRG; PAM sequence: AAG
ctggggtatcttggctgtac

SEQ ID NO: 152317 - DNA, 20 bp, Artificial Sequence
  Description of Artificial Sequence: Synthetic oligonucleotide
  Target: ATXN1; (+) strand; PAM type: NRG; PAM sequence: AGG
tggggtatcttggctgtaca

SEQ ID NO: 152318 - DNA, 20 bp, Artificial Sequence
  Description of Artificial Sequence: Synthetic oligonucleotide
  Target: ATXN1; (+) strand; PAM type: NRG; PAM sequence: GAG
gggtatcttggctgtacaag

SEQ ID NO: 152319 - DNA, 20 bp, Artificial Sequence
  Description of Artificial Sequence: Synthetic oligonucleotide
  Target: ATXN1; (+) strand; PAM type: NRG; PAM sequence: TGG
atcttggctgtacaaggaga

SEQ ID NO: 152320 - DNA, 20 bp, Artificial Sequence
  Description of Artificial Sequence: Synthetic oligonucleotide
  Target: ATXN1; (+) strand; PAM type: NRG; PAM sequence: GAG
cttggctgtacaaggagatg

SEQ ID NO: 152321 - DNA, 20 bp, Artificial Sequence
  Description of Artificial Sequence: Synthetic oligonucleotide
  Target: ATXN1; (+) strand; PAM type: NRG; PAM sequence: AAG
ggctgtacaaggagatggag

SEQ ID NO: 152322 - DNA, 20 bp, Artificial Sequence
  Description of Artificial Sequence: Synthetic oligonucleotide
  Target: ATXN1; (+) strand; PAM type: NRG; PAM sequence: GAG
ctgtacaaggagatggagaa

SEQ ID NO: 152323 - DNA, 20 bp, Artificial Sequence
  Description of Artificial Sequence: Synthetic oligonucleotide
  Target: ATXN1; (+) strand; PAM type: NRG; PAM sequence: GAG
gtacaaggagatggagaaga

SEQ ID NO: 152324 - DNA, 20 bp, Artificial Sequence
  Description of Artificial Sequence: Synthetic oligonucleotide
  Target: ATXN1; (+) strand; PAM type: NRG; PAM sequence: AAG
ggagaagagagctgaactac

SEQ ID NO: 152325 - DNA, 20 bp, Artificial Sequence
  Description of Artificial Sequence: Synthetic oligonucleotide
  Target: ATXN1; (+) strand; PAM type: NRG; PAM sequence: CAG
aagagagctgaactacaagt

SEQ ID NO: 152326 - DNA, 20 bp, Artificial Sequence
  Description of Artificial Sequence: Synthetic oligonucleotide
  Target: ATXN1; (+) strand; PAM type: NRG; PAM sequence: CAG
tgaactacaagtcagaaaat

SEQ ID NO: 152327 - DNA, 20 bp, Artificial Sequence
  Description of Artificial Sequence: Synthetic oligonucleotide
  Target: ATXN1; (+) strand; PAM type: NRG; PAM sequence: AGG
gaactacaagtcagaaaatc

SEQ ID NO: 152328 - DNA, 20 bp, Artificial Sequence
  Description of Artificial Sequence: Synthetic oligonucleotide
  Target: ATXN1; (+) strand; PAM type: NRG; PAM sequence: CAG
aagtcagaaaatcaggttta

SEQ ID NO: 152329 - DNA, 20 bp, Artificial Sequence
  Description of Artificial Sequence: Synthetic oligonucleotide
  Target: ATXN1; (+) strand; PAM type: NRG; PAM sequence: CAG
agaaaatcaggtttacagca

SEQ ID NO: 152330 - DNA, 20 bp, Artificial Sequence
  Description of Artificial Sequence: Synthetic oligonucleotide
  Target: ATXN1; (+) strand; PAM type: NRG; PAM sequence: AGG
gaaaatcaggtttacagcac

SEQ ID NO: 152331 - DNA, 20 bp, Artificial Sequence
  Description of Artificial Sequence: Synthetic oligonucleotide
  Target: ATXN1; (+) strand; PAM type: NRG; PAM sequence: TGG
ctacatgtatttctaaccac

SEQ ID NO: 152332 - DNA, 20 bp, Artificial Sequence
  Description of Artificial Sequence: Synthetic oligonucleotide
  Target: ATXN1; (+) strand; PAM type: NRG; PAM sequence: TAG
tatttctaaccactggaatc

SEQ ID NO: 152333 - DNA, 20 bp, Artificial Sequence
  Description of Artificial Sequence: Synthetic oligonucleotide
  Target: ATXN1; (+) strand; PAM type: NRG; PAM sequence: CAG
accactggaatctagtaaat

SEQ ID NO: 152334 - DNA, 20 bp, Artificial Sequence
  Description of Artificial Sequence: Synthetic oligonucleotide
  Target: ATXN1; (+) strand; PAM type: NRG; PAM sequence: TAG
tagtaaatcagtcaacctcg

SEQ ID NO: 152335 - DNA, 20 bp, Artificial Sequence
  Description of Artificial Sequence: Synthetic oligonucleotide
  Target: ATXN1; (+) strand; PAM type: NRG; PAM sequence: AGG
agtaaatcagtcaacctcgt

SEQ ID NO: 152336 - DNA, 20 bp, Artificial Sequence
  Description of Artificial Sequence: Synthetic oligonucleotide
  Target: ATXN1; (+) strand; PAM type: NRG; PAM sequence: TAG
gtaggttctgttttctcccc

SEQ ID NO: 152337 - DNA, 20 bp, Artificial Sequence
  Description of Artificial Sequence: Synthetic oligonucleotide
  Target: ATXN1; (+) strand; PAM type: NRG; PAM sequence: GAG
tgttttctcccctagaaaat

SEQ ID NO: 152338 - DNA, 20 bp, Artificial Sequence
  Description of Artificial Sequence: Synthetic oligonucleotide
  Target: ATXN1; (+) strand; PAM type: NRG; PAM sequence: AGG
gttttctcccctagaaaatg

SEQ ID NO: 152339 - DNA, 20 bp, Artificial Sequence
  Description of Artificial Sequence: Synthetic oligonucleotide
  Target: ATXN1; (+) strand; PAM type: NRG; PAM sequence: GGG
ttttctcccctagaaaatga

SEQ ID NO: 152340 - DNA, 20 bp, Artificial Sequence
  Description of Artificial Sequence: Synthetic oligonucleotide
  Target: ATXN1; (+) strand; PAM type: NRG; PAM sequence: AAG
atgagggtacttttctactc

SEQ ID NO: 152341 - DNA, 20 bp, Artificial Sequence
  Description of Artificial Sequence: Synthetic oligonucleotide
  Target: ATXN1; (+) strand; PAM type: NRG; PAM sequence: CAG
agggtacttttctactcaag

SEQ ID NO: 152342 - DNA, 20 bp, Artificial Sequence
  Description of Artificial Sequence: Synthetic oligonucleotide
  Target: ATXN1; (+) strand; PAM type: NRG; PAM sequence: AAG
tccactgaaacaatttatct

SEQ ID NO: 152343 - DNA, 20 bp, Artificial Sequence
  Description of Artificial Sequence: Synthetic oligonucleotide
  Target: ATXN1; (+) strand; PAM type: NRG; PAM sequence: AGG
ccactgaaacaatttatcta

SEQ ID NO: 152344 - DNA, 20 bp, Artificial Sequence
  Description of Artificial Sequence: Synthetic oligonucleotide
  Target: ATXN1; (+) strand; PAM type: NRG; PAM sequence: CAG
attctgtgatgtgctattat

SEQ ID NO: 152345 - DNA, 20 bp, Artificial Sequence
  Description of Artificial Sequence: Synthetic oligonucleotide
  Target: ATXN1; (+) strand; PAM type: NRG; PAM sequence: GAG
gtgatgtgctattatcagct

SEQ ID NO: 152346 - DNA, 20 bp, Artificial Sequence
  Description of Artificial Sequence: Synthetic oligonucleotide
  Target: ATXN1; (+) strand; PAM type: NRG; PAM sequence: AGG
tgatgtgctattatcagctg

SEQ ID NO: 152347 - DNA, 20 bp, Artificial Sequence
  Description of Artificial Sequence: Synthetic oligonucleotide
  Target: ATXN1; (+) strand; PAM type: NRG; PAM sequence: CAG
tgtgctattatcagctgagg

SEQ ID NO: 152348 - DNA, 20 bp, Artificial Sequence
  Description of Artificial Sequence: Synthetic oligonucleotide
  Target: ATXN1; (+) strand; PAM type: NRG; PAM sequence: TGG
gacacattaaccactgcaca

SEQ ID NO: 152349 - DNA, 20 bp, Artificial Sequence
  Description of Artificial Sequence: Synthetic oligonucleotide
  Target: ATXN1; (+) strand; PAM type: NRG; PAM sequence: TGG
attaaccactgcacatggtc

SEQ ID NO: 152350 - DNA, 20 bp, Artificial Sequence
  Description of Artificial Sequence: Synthetic oligonucleotide
  Target: ATXN1; (+) strand; PAM type: NRG; PAM sequence: TGG
gcacatggtctggataactg

SEQ ID NO: 152351 - DNA, 20 bp, Artificial Sequence
  Description of Artificial Sequence: Synthetic oligonucleotide
  Target: ATXN1; (+) strand; PAM type: NRG; PAM sequence: AAG
tctggataactgtggtttta

SEQ ID NO: 152352 - DNA, 20 bp, Artificial Sequence
  Description of Artificial Sequence: Synthetic oligonucleotide
  Target: ATXN1; (+) strand; PAM type: NRG; PAM sequence: AGG
ctggataactgtggttttaa

SEQ ID NO: 152353 - DNA, 20 bp, Artificial Sequence
  Description of Artificial Sequence: Synthetic oligonucleotide
  Target: ATXN1; (+) strand; PAM type: NRG; PAM sequence: TAG
aactgtggttttaaaggctg

SEQ ID NO: 152354 - DNA, 20 bp, Artificial Sequence
  Description of Artificial Sequence: Synthetic oligonucleotide
  Target: ATXN1; (+) strand; PAM type: NRG; PAM sequence: CAG
aaaggctgtagttactaaat

SEQ ID NO: 152355 - DNA, 20 bp, Artificial Sequence
  Description of Artificial Sequence: Synthetic oligonucleotide
  Target: ATXN1; (+) strand; PAM type: NRG; PAM sequence: GAG
aggctgtagttactaaatca

SEQ ID NO: 152356 - DNA, 20 bp, Artificial Sequence
  Description of Artificial Sequence: Synthetic oligonucleotide
  Target: ATXN1; (+) strand; PAM type: NRG; PAM sequence: AGG
ggctgtagttactaaatcag

SEQ ID NO: 152357 - DNA, 20 bp, Artificial Sequence
  Description of Artificial Sequence: Synthetic oligonucleotide
  Target: ATXN1; (+) strand; PAM type: NRG; PAM sequence: CAG
tagttactaaatcagaggct

SEQ ID NO: 152358 - DNA, 20 bp, Artificial Sequence
  Description of Artificial Sequence: Synthetic oligonucleotide
  Target: ATXN1; (+) strand; PAM type: NRG; PAM sequence: CAG
taaatcagaggctcagactg

SEQ ID NO: 152359 - DNA, 20 bp, Artificial Sequence
  Description of Artificial Sequence: Synthetic oligonucleotide
  Target: ATXN1; (+) strand; PAM type: NRG; PAM sequence: AAG
tcagactgcagaataccatc

SEQ ID NO: 152360 - DNA, 20 bp, Artificial Sequence
  Description of Artificial Sequence: Synthetic oligonucleotide
  Target: ATXN1; (+) strand; PAM type: NRG; PAM sequence: GAG
agactgcagaataccatcaa

SEQ ID NO: 152361 - DNA, 20 bp, Artificial Sequence
  Description of Artificial Sequence: Synthetic oligonucleotide
  Target: ATXN1; (+) strand; PAM type: NRG; PAM sequence: AAG
tgcagaataccatcaagaga

SEQ ID NO: 152362 - DNA, 20 bp, Artificial Sequence
  Description of Artificial Sequence: Synthetic oligonucleotide
  Target: ATXN1; (+) strand; PAM type: NRG; PAM sequence: AGG
gcagaataccatcaagagaa

SEQ ID NO: 152363 - DNA, 20 bp, Artificial Sequence
  Description of Artificial Sequence: Synthetic oligonucleotide
  Target: ATXN1; (+) strand; PAM type: NRG; PAM sequence: GGG
cagaataccatcaagagaaa

SEQ ID NO: 152364 - DNA, 20 bp, Artificial Sequence
  Description of Artificial Sequence: Synthetic oligonucleotide
  Target: ATXN1; (+) strand; PAM type: NRG; PAM sequence: TAG
agagaaagggtacttttgac

SEQ ID NO: 152365 - DNA, 20 bp, Artificial Sequence
  Description of Artificial Sequence: Synthetic oligonucleotide
  Target: ATXN1; (+) strand; PAM type: NRG; PAM sequence: AAG
gtacttttgactagtcctac

SEQ ID NO: 152366 - DNA, 20 bp, Artificial Sequence
  Description of Artificial Sequence: Synthetic oligonucleotide
  Target: ATXN1; (+) strand; PAM type: NRG; PAM sequence: GAG
acttttgactagtcctacaa

SEQ ID NO: 152367 - DNA, 20 bp, Artificial Sequence
  Description of Artificial Sequence: Synthetic oligonucleotide
  Target: ATXN1; (+) strand; PAM type: NRG; PAM sequence: CAG
gactagtcctacaagagaaa

SEQ ID NO: 152368 - DNA, 20 bp, Artificial Sequence
  Description of Artificial Sequence: Synthetic oligonucleotide
  Target: ATXN1; (+) strand; PAM type: NRG; PAM sequence: AGG
actagtcctacaagagaaac

SEQ ID NO: 152369 - DNA, 20 bp, Artificial Sequence
  Description of Artificial Sequence: Synthetic oligonucleotide
  Target: ATXN1; (+) strand; PAM type: NRG; PAM sequence: CAG
tacaagagaaacaggaaaca

SEQ ID NO: 152370 - DNA, 20 bp, Artificial Sequence
  Description of Artificial Sequence: Synthetic oligonucleotide
  Target: ATXN1; (+) strand; PAM type: NRG; PAM sequence: AGG
acaagagaaacaggaaacac

SEQ ID NO: 152371 - DNA, 20 bp, Artificial Sequence
  Description of Artificial Sequence: Synthetic oligonucleotide
  Target: ATXN1; (+) strand; PAM type: NRG; PAM sequence: CAG
gaaacacaggactttcctcc

SEQ ID NO: 152372 - DNA, 20 bp, Artificial Sequence
  Description of Artificial Sequence: Synthetic oligonucleotide
  Target: ATXN1; (+) strand; PAM type: NRG; PAM sequence: AAG
tcctcccagtatactctttg

SEQ ID NO: 152373 - DNA, 20 bp, Artificial Sequence
  Description of Artificial Sequence: Synthetic oligonucleotide
  Target: ATXN1; (+) strand; PAM type: NRG; PAM sequence: TGG
agtatactctttgaagaccc

SEQ ID NO: 152374 - DNA, 20 bp, Artificial Sequence
  Description of Artificial Sequence: Synthetic oligonucleotide
  Target: ATXN1; (+) strand; PAM type: NRG; PAM sequence: GAG
agaccctggacatttaaaat

SEQ ID NO: 152375 - DNA, 20 bp, Artificial Sequence
  Description of Artificial Sequence: Synthetic oligonucleotide
  Target: ATXN1; (+) strand; PAM type: NRG; PAM sequence: AAG
cctggacatttaaaatgaga

SEQ ID NO: 152376 - DNA, 20 bp, Artificial Sequence
  Description of Artificial Sequence: Synthetic oligonucleotide
  Target: ATXN1; (+) strand; PAM type: NRG; PAM sequence: AAG
atttaaaatgagaaagtttt

SEQ ID NO: 152377 - DNA, 20 bp, Artificial Sequence
  Description of Artificial Sequence: Synthetic oligonucleotide
  Target: ATXN1; (+) strand; PAM type: NRG; PAM sequence: AAG
ttttaagaacacttttttta

SEQ ID NO: 152378 - DNA, 20 bp, Artificial Sequence
  Description of Artificial Sequence: Synthetic oligonucleotide
  Target: ATXN1; (+) strand; PAM type: NRG; PAM sequence: AGG
tttaagaacactttttttaa

SEQ ID NO: 152379 - DNA, 20 bp, Artificial Sequence
  Description of Artificial Sequence: Synthetic oligonucleotide
  Target: ATXN1; (+) strand; PAM type: NRG; PAM sequence: AAG
aagaacactttttttaaagg

SEQ ID NO: 152380 - DNA, 20 bp, Artificial Sequence
  Description of Artificial Sequence: Synthetic oligonucleotide
  Target: ATXN1; (+) strand; PAM type: NRG; PAM sequence: GAG
taaaggaagtctcatttctt

SEQ ID NO: 152381 - DNA, 20 bp, Artificial Sequence
  Description of Artificial Sequence: Synthetic oligonucleotide
  Target: ATXN1; (+) strand; PAM type: NRG; PAM sequence: CAG
agtctcatttcttgagactt

SEQ ID NO: 152382 - DNA, 20 bp, Artificial Sequence
  Description of Artificial Sequence: Synthetic oligonucleotide
  Target: ATXN1; (+) strand; PAM type: NRG; PAM sequence: AGG
gtctcatttcttgagacttc

SEQ ID NO: 152383 - DNA, 20 bp, Artificial Sequence
  Description of Artificial Sequence: Synthetic oligonucleotide
  Target: ATXN1; (+) strand; PAM type: NRG; PAM sequence: GGG
tctcatttcttgagacttca

SEQ ID NO: 152384 - DNA, 20 bp, Artificial Sequence
  Description of Artificial Sequence: Synthetic oligonucleotide
  Target: ATXN1; (+) strand; PAM type: NRG; PAM sequence: AAG
tcttgagacttcagggcaaa

SEQ ID NO: 152385 - DNA, 20 bp, Artificial Sequence
  Description of Artificial Sequence: Synthetic oligonucleotide
  Target: ATXN1; (+) strand; PAM type: NRG; PAM sequence: AAG
tcagggcaaaaagttaaatt

SEQ ID NO: 152386 - DNA, 20 bp, Artificial Sequence
  Description of Artificial Sequence: Synthetic oligonucleotide
  Target: ATXN1; (+) strand; PAM type: NRG; PAM sequence: CAG
gttaaattaagtgcaccctt

SEQ ID NO: 152387 - DNA, 20 bp, Artificial Sequence
  Description of Artificial Sequence: Synthetic oligonucleotide
  Target: ATXN1; (+) strand; PAM type: NRG; PAM sequence: GAG
taaattaagtgcacccttca

SEQ ID NO: 152388 - DNA, 20 bp, Artificial Sequence
  Description of Artificial Sequence: Synthetic oligonucleotide
  Target: ATXN1; (+) strand; PAM type: NRG; PAM sequence: CAG
ttaagtgcacccttcagaga

SEQ ID NO: 152389 - DNA, 20 bp, Artificial Sequence
  Description of Artificial Sequence: Synthetic oligonucleotide
  Target: ATXN1; (+) strand; PAM type: NRG; PAM sequence: CAG
agacagaaactttgcgattt

SEQ ID NO: 152390 - DNA, 20 bp, Artificial Sequence
  Description of Artificial Sequence: Synthetic oligonucleotide
  Target: ATXN1; (+) strand; PAM type: NRG; PAM sequence: AGG
gacagaaactttgcgatttc

SEQ ID NO: 152391 - DNA, 20 bp, Artificial Sequence
  Description of Artificial Sequence: Synthetic oligonucleotide
  Target: ATXN1; (+) strand; PAM type: NRG; PAM sequence: CAG
gtcaccgaatgttctctgta

SEQ ID NO: 152392 - DNA, 20 bp, Artificial Sequence
  Description of Artificial Sequence: Synthetic oligonucleotide
  Target: ATXN1; (+) strand; PAM type: NRG; PAM sequence: CAG
accgaatgttctctgtacag

SEQ ID NO: 152393 - DNA, 20 bp, Artificial Sequence
  Description of Artificial Sequence: Synthetic oligonucleotide
  Target: ATXN1; (+) strand; PAM type: NRG; PAM sequence: AGG
ccgaatgttctctgtacagc

SEQ ID NO: 152394 - DNA, 20 bp, Artificial Sequence
  Description of Artificial Sequence: Synthetic oligonucleotide
  Target: ATXN1; (+) strand; PAM type: NRG; PAM sequence: CAG
atgttctctgtacagcagga

SEQ ID NO: 152395 - DNA, 20 bp, Artificial Sequence
  Description of Artificial Sequence: Synthetic oligonucleotide
  Target: ATXN1; (+) strand; PAM type: NRG; PAM sequence: CAG
ctgtacagcaggacagccaa

SEQ ID NO: 152396 - DNA, 20 bp, Artificial Sequence
  Description of Artificial Sequence: Synthetic oligonucleotide
  Target: ATXN1; (+) strand; PAM type: NRG; PAM sequence: TGG
ggacagccaacagctgtgtt

SEQ ID NO: 152397 - DNA, 20 bp, Artificial Sequence
  Description of Artificial Sequence: Synthetic oligonucleotide
  Target: ATXN1; (+) strand; PAM type: NRG; PAM sequence: CAG
atattaaaaaaccctccctc

SEQ ID NO: 152398 - DNA, 20 bp, Artificial Sequence
  Description of Artificial Sequence: Synthetic oligonucleotide
  Target: ATXN1; (+) strand; PAM type: NRG; PAM sequence: AGG
tattaaaaaaccctccctcc

SEQ ID NO: 152399 - DNA, 20 bp, Artificial Sequence
  Description of Artificial Sequence: Synthetic oligonucleotide
  Target: ATXN1; (+) strand; PAM type: NRG; PAM sequence: AAG
aaccctccctccaggactta

SEQ ID NO: 152400 - DNA, 20 bp, Artificial Sequence
  Description of Artificial Sequence: Synthetic oligonucleotide
  Target: ATXN1; (+) strand; PAM type: NRG; PAM sequence: TGG
agatgatatgaactgtgtca

SEQ ID NO: 152401 - DNA, 20 bp, Artificial Sequence
  Description of Artificial Sequence: Synthetic oligonucleotide
  Target: ATXN1; (+) strand; PAM type: NRG; PAM sequence: GAG
atgatatgaactgtgtcatg

SEQ ID NO: 152402 - DNA, 20 bp, Artificial Sequence
  Description of Artificial Sequence: Synthetic oligonucleotide
  Target: ATXN1; (+) strand; PAM type: NRG; PAM sequence: TAG
atgaactgtgtcatggagtt

SEQ ID NO: 152403 - DNA, 20 bp, Artificial Sequence
  Description of Artificial Sequence: Synthetic oligonucleotide
  Target: ATXN1; (+) strand; PAM type: NRG; PAM sequence: GAG
tgtgtcatggagtttagtct

SEQ ID NO: 152404 - DNA, 20 bp, Artificial Sequence
  Description of Artificial Sequence: Synthetic oligonucleotide
  Target: ATXN1; (+) strand; PAM type: NRG; PAM sequence: AGG
gtgtcatggagtttagtctg

SEQ ID NO: 152405 - DNA, 20 bp, Artificial Sequence
  Description of Artificial Sequence: Synthetic oligonucleotide
  Target: ATXN1; (+) strand; PAM type: NRG; PAM sequence: AAG
tcatggagtttagtctgagg

SEQ ID NO: 152406 - DNA, 20 bp, Artificial Sequence
  Description of Artificial Sequence: Synthetic oligonucleotide
  Target: ATXN1; (+) strand; PAM type: NRG; PAM sequence: AGG
catggagtttagtctgagga

SEQ ID NO: 152407 - DNA, 20 bp, Artificial Sequence
  Description of Artificial Sequence: Synthetic oligonucleotide
  Target: ATXN1; (+) strand; PAM type: NRG; PAM sequence: TGG
gaggaaggctcatatactac

SEQ ID NO: 152408 - DNA, 20 bp, Artificial Sequence
  Description of Artificial Sequence: Synthetic oligonucleotide
  Target: ATXN1; (+) strand; PAM type: NRG; PAM sequence: GAG
aaggctcatatactactggt

SEQ ID NO: 152409 - DNA, 20 bp, Artificial Sequence
  Description of Artificial Sequence: Synthetic oligonucleotide
  Target: ATXN1; (+) strand; PAM type: NRG; PAM sequence: AAG
actggtgagacccacatttc

SEQ ID NO: 152410 - DNA, 20 bp, Artificial Sequence
  Description of Artificial Sequence: Synthetic oligonucleotide
  Target: ATXN1; (+) strand; PAM type: NRG; PAM sequence: AGG
ctggtgagacccacatttca

SEQ ID NO: 152411 - DNA, 20 bp, Artificial Sequence
  Description of Artificial Sequence: Synthetic oligonucleotide
  Target: ATXN1; (+) strand; PAM type: NRG; PAM sequence: CAG
ccacatttcaaggtcctact

SEQ ID NO: 152412 - DNA, 20 bp, Artificial Sequence
  Description of Artificial Sequence: Synthetic oligonucleotide
  Target: ATXN1; (+) strand; PAM type: NRG; PAM sequence: AAG
atttcaaggtcctactcaga

SEQ ID NO: 152413 - DNA, 20 bp, Artificial Sequence
  Description of Artificial Sequence: Synthetic oligonucleotide
  Target: ATXN1; (+) strand; PAM type: NRG; PAM sequence: TAG
actcacattctgctaatcac

SEQ ID NO: 152414 - DNA, 20 bp, Artificial Sequence
  Description of Artificial Sequence: Synthetic oligonucleotide
  Target: ATXN1; (+) strand; PAM type: NRG; PAM sequence: AGG
ctcacattctgctaatcact

SEQ ID NO: 152415 - DNA, 20 bp, Artificial Sequence
  Description of Artificial Sequence: Synthetic oligonucleotide
  Target: ATXN1; (+) strand; PAM type: NRG; PAM sequence: CAG
aatcactaggatgactgaaa

SEQ ID NO: 152416 - DNA, 20 bp, Artificial Sequence
  Description of Artificial Sequence: Synthetic oligonucleotide
  Target: ATXN1; (+) strand; PAM type: NRG; PAM sequence: CAG
ggatgactgaaacagctttg

SEQ ID NO: 152417 - DNA, 20 bp, Artificial Sequence
  Description of Artificial Sequence: Synthetic oligonucleotide
  Target: ATXN1; (+) strand; PAM type: NRG; PAM sequence: TGG
gaaacagctttgcagctcgc

SEQ ID NO: 152418 - DNA, 20 bp, Artificial Sequence
  Description of Artificial Sequence: Synthetic oligonucleotide
  Target: ATXN1; (+) strand; PAM type: NRG; PAM sequence: GGG
aaacagctttgcagctcgct

SEQ ID NO: 152419 - DNA, 20 bp, Artificial Sequence
  Description of Artificial Sequence: Synthetic oligonucleotide
  Target: ATXN1; (+) strand; PAM type: NRG; PAM sequence: GAG
acagctttgcagctcgctgg

SEQ ID NO: 152420 - DNA, 20 bp, Artificial Sequence
  Description of Artificial Sequence: Synthetic oligonucleotide
  Target: ATXN1; (+) strand; PAM type: NRG; PAM sequence: AGG
cagctttgcagctcgctggg

SEQ ID NO: 152421 - DNA, 20 bp, Artificial Sequence
  Description of Artificial Sequence: Synthetic oligonucleotide
  Target: ATXN1; (+) strand; PAM type: NRG; PAM sequence: AAG
gctcgctgggaggaaaatta

SEQ ID NO: 152422 - DNA, 20 bp, Artificial Sequence
  Description of Artificial Sequence: Synthetic oligonucleotide
  Target: ATXN1; (+) strand; PAM type: NRG; PAM sequence: AAG
gctgggaggaaaattaaaga

SEQ ID NO: 152423 - DNA, 20 bp, Artificial Sequence
  Description of Artificial Sequence: Synthetic oligonucleotide
  Target: ATXN1; (+) strand; PAM type: NRG; PAM sequence: TAG
gggaggaaaattaaagaaag

SEQ ID NO: 152424 - DNA, 20 bp, Artificial Sequence
  Description of Artificial Sequence: Synthetic oligonucleotide
  Target: ATXN1; (+) strand; PAM type: NRG; PAM sequence: CAG
tccttttatatctgtttaca

SEQ ID NO: 152425 - DNA, 20 bp, Artificial Sequence
  Description of Artificial Sequence: Synthetic oligonucleotide
  Target: ATXN1; (+) strand; PAM type: NRG; PAM sequence: TAG
gtttacacagattgttaaaa

SEQ ID NO: 152426 - DNA, 20 bp, Artificial Sequence
  Description of Artificial Sequence: Synthetic oligonucleotide
  Target: ATXN1; (+) strand; PAM type: NRG; PAM sequence: CGG
cacagattgttaaaatagta

SEQ ID NO: 152427 - DNA, 20 bp, Artificial Sequence
  Description of Artificial Sequence: Synthetic oligonucleotide
  Target: ATXN1; (+) strand; PAM type: NRG; PAM sequence: TGG
ttaaaatagtacggttcatt

SEQ ID NO: 152428 - DNA, 20 bp, Artificial Sequence
  Description of Artificial Sequence: Synthetic oligonucleotide
  Target: ATXN1; (+) strand; PAM type: NRG; PAM sequence: GAG
cggttcatttggacgatgtt

SEQ ID NO: 152429 - DNA, 20 bp, Artificial Sequence
  Description of Artificial Sequence: Synthetic oligonucleotide
  Target: ATXN1; (+) strand; PAM type: NRG; PAM sequence: TGG
tcatttggacgatgttgaga

SEQ ID NO: 152430 - DNA, 20 bp, Artificial Sequence
  Description of Artificial Sequence: Synthetic oligonucleotide
  Target: ATXN1; (+) strand; PAM type: NRG; PAM sequence: AAG
aatataacttgttccttctg

SEQ ID NO: 152431 - DNA, 20 bp, Artificial Sequence
  Description of Artificial Sequence: Synthetic oligonucleotide
  Target: ATXN1; (+) strand; PAM type: NRG; PAM sequence: GAG
tataacttgttccttctgaa

SEQ ID NO: 152432 - DNA, 20 bp, Artificial Sequence
  Description of Artificial Sequence: Synthetic oligonucleotide
  Target: ATXN1; (+) strand; PAM type: NRG; PAM sequence: TAG
aacttgttccttctgaagag

SEQ ID NO: 152433 - DNA, 20 bp, Artificial Sequence
  Description of Artificial Sequence: Synthetic oligonucleotide
  Target: ATXN1; (+) strand; PAM type: NRG; PAM sequence: GAG
cttgttccttctgaagagta

SEQ ID NO: 152434 - DNA, 20 bp, Artificial Sequence
  Description of Artificial Sequence: Synthetic oligonucleotide
  Target: ATXN1; (+) strand; PAM type: NRG; PAM sequence: AAG
ttccttctgaagagtagaga

SEQ ID NO: 152435 - DNA, 20 bp, Artificial Sequence
  Description of Artificial Sequence: Synthetic oligonucleotide
  Target: ATXN1; (+) strand; PAM type: NRG; PAM sequence: AGG
tccttctgaagagtagagaa

SEQ ID NO: 152436 - DNA, 20 bp, Artificial Sequence
  Description of Artificial Sequence: Synthetic oligonucleotide
  Target: ATXN1; (+) strand; PAM type: NRG; PAM sequence: AAG
tgaagagtagagaaaggttc

SEQ ID NO: 152437 - DNA, 20 bp, Artificial Sequence
  Description of Artificial Sequence: Synthetic oligonucleotide
  Target: ATXN1; (+) strand; PAM type: NRG; PAM sequence: AGG
gaagagtagagaaaggttca

SEQ ID NO: 152438 - DNA, 20 bp, Artificial Sequence
  Description of Artificial Sequence: Synthetic oligonucleotide
  Target: ATXN1; (+) strand; PAM type: NRG; PAM sequence: GGG
aagagtagagaaaggttcaa

SEQ ID NO: 152439 - DNA, 20 bp, Artificial Sequence
  Description of Artificial Sequence: Synthetic oligonucleotide
  Target: ATXN1; (+) strand; PAM type: NRG; PAM sequence: GGG
agagtagagaaaggttcaag

SEQ ID NO: 152440 - DNA, 20 bp, Artificial Sequence
  Description of Artificial Sequence: Synthetic oligonucleotide
  Target: ATXN1; (+) strand; PAM type: NRG; PAM sequence: CAG
gagaaaggttcaaggggtta

SEQ ID NO: 152441 - DNA, 20 bp, Artificial Sequence
  Description of Artificial Sequence: Synthetic oligonucleotide
  Target: ATXN1; (+) strand; PAM type: NRG; PAM sequence: GAG
gaaaggttcaaggggttaca

SEQ ID NO: 152442 - DNA, 20 bp, Artificial Sequence
  Description of Artificial Sequence: Synthetic oligonucleotide
  Target: ATXN1; (+) strand; PAM type: NRG; PAM sequence: AGG
aaaggttcaaggggttacag

SEQ ID NO: 152443 - DNA, 20 bp, Artificial Sequence
  Description of Artificial Sequence: Synthetic oligonucleotide
  Target: ATXN1; (+) strand; PAM type: NRG; PAM sequence: CAG
aggggttacagaggcttaaa

SEQ ID NO: 152444 - DNA, 20 bp, Artificial Sequence
  Description of Artificial Sequence: Synthetic oligonucleotide
  Target: ATXN1; (+) strand; PAM type: NRG; PAM sequence: CAG
ttacagaggcttaaacagaa

SEQ ID NO: 152445 - DNA, 20 bp, Artificial Sequence
  Description of Artificial Sequence: Synthetic oligonucleotide
  Target: ATXN1; (+) strand; PAM type: NRG; PAM sequence: AGG
tacagaggcttaaacagaac

SEQ ID NO: 152446 - DNA, 20 bp, Artificial Sequence
  Description of Artificial Sequence: Synthetic oligonucleotide
  Target: ATXN1; (+) strand; PAM type: NRG; PAM sequence: AAG
gaggcttaaacagaacagga

SEQ ID NO: 152447 - DNA, 20 bp, Artificial Sequence
  Description of Artificial Sequence: Synthetic oligonucleotide
  Target: ATXN1; (+) strand; PAM type: NRG; PAM sequence: TGG
caaaataaaacaccgaaatt

SEQ ID NO: 152448 - DNA, 20 bp, Artificial Sequence
  Description of Artificial Sequence: Synthetic oligonucleotide
  Target: ATXN1; (+) strand; PAM type: NRG; PAM sequence: GGG
aaaataaaacaccgaaattt

SEQ ID NO: 152449 - DNA, 20 bp, Artificial Sequence
  Description of Artificial Sequence: Synthetic oligonucleotide
  Target: ATXN1; (+) strand; PAM type: NRG; PAM sequence: TAG
aaaacaccgaaatttgggct

SEQ ID NO: 152450 - DNA, 20 bp, Artificial Sequence
  Description of Artificial Sequence: Synthetic oligonucleotide
  Target: ATXN1; (+) strand; PAM type: NRG; PAM sequence: TAG
catatttccttcaaactcaa

SEQ ID NO: 152451 - DNA, 20 bp, Artificial Sequence
  Description of Artificial Sequence: Synthetic oligonucleotide
  Target: ATXN1; (+) strand; PAM type: NRG; PAM sequence: AAG
tttccttcaaactcaataga

SEQ ID NO: 152452 - DNA, 20 bp, Artificial Sequence
  Description of Artificial Sequence: Synthetic oligonucleotide
  Target: ATXN1; (+) strand; PAM type: NRG; PAM sequence: AAG
ttcaaactcaatagaaagca

SEQ ID NO: 152453 - DNA, 20 bp, Artificial Sequence
  Description of Artificial Sequence: Synthetic oligonucleotide
  Target: ATXN1; (+) strand; PAM type: NRG; PAM sequence: TGG
caatagaaagcaaagttgta

SEQ ID NO: 152454 - DNA, 20 bp, Artificial Sequence
  Description of Artificial Sequence: Synthetic oligonucleotide
  Target: ATXN1; (+) strand; PAM type: NRG; PAM sequence: AAG
agaaagcaaagttgtatgga

SEQ ID NO: 152455 - DNA, 20 bp, Artificial Sequence
  Description of Artificial Sequence: Synthetic oligonucleotide
  Target: ATXN1; (+) strand; PAM type: NRG; PAM sequence: GAG
aaagcaaagttgtatggaaa

SEQ ID NO: 152456 - DNA, 20 bp, Artificial Sequence
  Description of Artificial Sequence: Synthetic oligonucleotide
  Target: ATXN1; (+) strand; PAM type: NRG; PAM sequence: TGG
gatttttaaataaataacca

SEQ ID NO: 152457 - DNA, 20 bp, Artificial Sequence
  Description of Artificial Sequence: Synthetic oligonucleotide
  Target: ATXN1; (+) strand; PAM type: NRG; PAM sequence: TGG
acaataataaacttgtctta

SEQ ID NO: 152458 - DNA, 20 bp, Artificial Sequence
  Description of Artificial Sequence: Synthetic oligonucleotide
  Target: ATXN1; (+) strand; PAM type: NRG; PAM sequence: GGG
caataataaacttgtcttat

SEQ ID NO: 152459 - DNA, 20 bp, Artificial Sequence
  Description of Artificial Sequence: Synthetic oligonucleotide
  Target: ATXN1; (+) strand; PAM type: NRG; PAM sequence: AAG
gggtctatgaccacttacaa

SEQ ID NO: 152460 - DNA, 20 bp, Artificial Sequence
  Description of Artificial Sequence: Synthetic oligonucleotide
  Target: ATXN1; (+) strand; PAM type: NRG; PAM sequence: AAG
caaaactgctatcttttgaa

SEQ ID NO: 152461 - DNA, 20 bp, Artificial Sequence
  Description of Artificial Sequence: Synthetic oligonucleotide
  Target: ATXN1; (+) strand; PAM type: NRG; PAM sequence: CAG
tgctatcttttgaaaagtat

SEQ ID NO: 152462 - DNA, 20 bp, Artificial Sequence
  Description of Artificial Sequence: Synthetic oligonucleotide
  Target: ATXN1; (+) strand; PAM type: NRG; PAM sequence: CAG
tcttttgaaaagtatcagat

SEQ ID NO: 152463 - DNA, 20 bp, Artificial Sequence
  Description of Artificial Sequence: Synthetic oligonucleotide
  Target: ATXN1; (+) strand; PAM type: NRG; PAM sequence: CAG
aaaagtatcagatcagacac

SEQ ID NO: 152464 - DNA, 20 bp, Artificial Sequence
  Description of Artificial Sequence: Synthetic oligonucleotide
  Target: ATXN1; (+) strand; PAM type: NRG; PAM sequence: AAG
gtatcagatcagacaccaga

SEQ ID NO: 152465 - DNA, 20 bp, Artificial Sequence
  Description of Artificial Sequence: Synthetic oligonucleotide
  Target: ATXN1; (+) strand; PAM type: NRG; PAM sequence: AGG
tatcagatcagacaccagaa

SEQ ID NO: 152466 - DNA, 20 bp, Artificial Sequence
  Description of Artificial Sequence: Synthetic oligonucleotide
  Target: ATXN1; (+) strand; PAM type: NRG; PAM sequence: CAG
cagatcagacaccagaaagg

SEQ ID NO: 152467 - DNA, 20 bp, Artificial Sequence
  Description of Artificial Sequence: Synthetic oligonucleotide
  Target: ATXN1; (+) strand; PAM type: NRG; PAM sequence: CAG
atcagacaccagaaaggcag

SEQ ID NO: 152468 - DNA, 20 bp, Artificial Sequence
  Description of Artificial Sequence: Synthetic oligonucleotide
  Target: ATXN1; (+) strand; PAM type: NRG; PAM sequence: TGG
gacaccagaaaggcagcagc

SEQ ID NO: 152469 - DNA, 20 bp, Artificial Sequence
  Description of Artificial Sequence: Synthetic oligonucleotide
  Target: ATXN1; (+) strand; PAM type: NRG; PAM sequence: GGG
acaccagaaaggcagcagct

SEQ ID NO: 152470 - DNA, 20 bp, Artificial Sequence
  Description of Artificial Sequence: Synthetic oligonucleotide
  Target: ATXN1; (+) strand; PAM type: NRG; PAM sequence: GGG
caccagaaaggcagcagctg

SEQ ID NO: 152471 - DNA, 20 bp, Artificial Sequence
  Description of Artificial Sequence: Synthetic oligonucleotide
  Target: ATXN1; (+) strand; PAM type: NRG; PAM sequence: TAG
cacattctttcccacttcct

SEQ ID NO: 152472 - DNA, 20 bp, Artificial Sequence
  Description of Artificial Sequence: Synthetic oligonucleotide
  Target: ATXN1; (+) strand; PAM type: NRG; PAM sequence: AAG
ctttcccacttccttagatg

SEQ ID NO: 152473 - DNA, 20 bp, Artificial Sequence
  Description of Artificial Sequence: Synthetic oligonucleotide
  Target: ATXN1; (+) strand; PAM type: NRG; PAM sequence: AGG
tttcccacttccttagatga

SEQ ID NO: 152474 - DNA, 20 bp, Artificial Sequence
  Description of Artificial Sequence: Synthetic oligonucleotide
  Target: ATXN1; (+) strand; PAM type: NRG; PAM sequence: AAG
tgaaggctgtctcccaataa

SEQ ID NO: 152475 - DNA, 20 bp, Artificial Sequence
  Description of Artificial Sequence: Synthetic oligonucleotide
  Target: ATXN1; (+) strand; PAM type: NRG; PAM sequence: TGG
tcccaataaaagccacaact

SEQ ID NO: 152476 - DNA, 20 bp, Artificial Sequence
  Description of Artificial Sequence: Synthetic oligonucleotide
  Target: ATXN1; (+) strand; PAM type: NRG; PAM sequence: GGG
cccaataaaagccacaactt

SEQ ID NO: 152477 - DNA, 20 bp, Artificial Sequence
  Description of Artificial Sequence: Synthetic oligonucleotide
  Target: ATXN1; (+) strand; PAM type: NRG; PAM sequence: GGG
ccaataaaagccacaacttg

SEQ ID NO: 152478 - DNA, 20 bp, Artificial Sequence
  Description of Artificial Sequence: Synthetic oligonucleotide
  Target: ATXN1; (+) strand; PAM type: NRG; PAM sequence: TAG
cttggggtcatacttctctc

SEQ ID NO: 152479 - DNA, 20 bp, Artificial Sequence
  Description of Artificial Sequence: Synthetic oligonucleotide
  Target: ATXN1; (+) strand; PAM type: NRG; PAM sequence: TGG
ggtcatacttctctctagtc

SEQ ID NO: 152480 - DNA, 20 bp, Artificial Sequence
  Description of Artificial Sequence: Synthetic oligonucleotide
  Target: ATXN1; (+) strand; PAM type: NRG; PAM sequence: GGG
gtcatacttctctctagtct

SEQ ID NO: 152481 - DNA, 20 bp, Artificial Sequence
  Description of Artificial Sequence: Synthetic oligonucleotide
  Target: ATXN1; (+) strand; PAM type: NRG; PAM sequence: CAG
cttctctctagtctgggttg

SEQ ID NO: 152482 - DNA, 20 bp, Artificial Sequence
  Description of Artificial Sequence: Synthetic oligonucleotide
  Target: ATXN1; (+) strand; PAM type: NRG; PAM sequence: CAG
tagtctgggttgcagtgacc

SEQ ID NO: 152483 - DNA, 20 bp, Artificial Sequence
  Description of Artificial Sequence: Synthetic oligonucleotide
  Target: ATXN1; (+) strand; PAM type: NRG; PAM sequence: AGG
agtctgggttgcagtgaccc

SEQ ID NO: 152484 - DNA, 20 bp, Artificial Sequence
  Description of Artificial Sequence: Synthetic oligonucleotide
  Target: ATXN1; (+) strand; PAM type: NRG; PAM sequence: CAG
ctgggttgcagtgacccagg

SEQ ID NO: 152485 - DNA, 20 bp, Artificial Sequence
  Description of Artificial Sequence: Synthetic oligonucleotide
  Target: ATXN1; (+) strand; PAM type: NRG; PAM sequence: CAG
tgcagtgacccaggcagctc

SEQ ID NO: 152486 - DNA, 20 bp, Artificial Sequence
  Description of Artificial Sequence: Synthetic oligonucleotide
  Target: ATXN1; (+) strand; PAM type: NRG; PAM sequence: GAG
cagtgacccaggcagctcca

SEQ ID NO: 152487 - DNA, 20 bp, Artificial Sequence
  Description of Artificial Sequence: Synthetic oligonucleotide
  Target: ATXN1; (+) strand; PAM type: NRG; PAM sequence: AGG
agtgacccaggcagctccag

SEQ ID NO: 152488 - DNA, 20 bp, Artificial Sequence
  Description of Artificial Sequence: Synthetic oligonucleotide
  Target: ATXN1; (+) strand; PAM type: NRG; PAM sequence: TGG
aggcagctccagaggtgaac

SEQ ID NO: 152489 - DNA, 20 bp, Artificial Sequence
  Description of Artificial Sequence: Synthetic oligonucleotide
  Target: ATXN1; (+) strand; PAM type: NRG; PAM sequence: CAG
ctccagaggtgaactggaca

SEQ ID NO: 152490 - DNA, 20 bp, Artificial Sequence
  Description of Artificial Sequence: Synthetic oligonucleotide
  Target: ATXN1; (+) strand; PAM type: NRG; PAM sequence: GAG
ccagaggtgaactggacaca

SEQ ID NO: 152491 - DNA, 20 bp, Artificial Sequence
  Description of Artificial Sequence: Synthetic oligonucleotide
  Target: ATXN1; (+) strand; PAM type: NRG; PAM sequence: TGG
ggtgaactggacacagagcc

SEQ ID NO: 152492 - DNA, 20 bp, Artificial Sequence
  Description of Artificial Sequence: Synthetic oligonucleotide
  Target: ATXN1; (+) strand; PAM type: NRG; PAM sequence: AAG
actggacacagagcctggaa

SEQ ID NO: 152493 - DNA, 20 bp, Artificial Sequence
  Description of Artificial Sequence: Synthetic oligonucleotide
  Target: ATXN1; (+) strand; PAM type: NRG; PAM sequence: AGG
ctggacacagagcctggaaa

SEQ ID NO: 152494 - DNA, 20 bp, Artificial Sequence
  Description of Artificial Sequence: Synthetic oligonucleotide
  Target: ATXN1; (+) strand; PAM type: NRG; PAM sequence: GGG
tggacacagagcctggaaaa

SEQ ID NO: 152495 - DNA, 20 bp, Artificial Sequence
  Description of Artificial Sequence: Synthetic oligonucleotide
  Target: ATXN1; (+) strand; PAM type: NRG; PAM sequence: GGG
ggacacagagcctggaaaag

SEQ ID NO: 152496 - DNA, 20 bp, Artificial Sequence
  Description of Artificial Sequence: Synthetic oligonucleotide
  Target: ATXN1; (+) strand; PAM type: NRG; PAM sequence: AAG
cacagagcctggaaaagggg

SEQ ID NO: 152497 - DNA, 20 bp, Artificial Sequence
  Description of Artificial Sequence: Synthetic oligonucleotide
  Target: ATXN1; (+) strand; PAM type: NRG; PAM sequence: CAG
taatcaaaacaaaattcatc

SEQ ID NO: 152498 - DNA, 20 bp, Artificial Sequence
  Description of Artificial Sequence: Synthetic oligonucleotide
  Target: ATXN1; (+) strand; PAM type: NRG; PAM sequence: GAG
atcaaaacaaaattcatcca

SEQ ID NO: 152499 - DNA, 20 bp, Artificial Sequence
  Description of Artificial Sequence: Synthetic oligonucleotide
  Target: ATXN1; (+) strand; PAM type: NRG; PAM sequence: TGG
gagtcatttctgcctcccct

SEQ ID NO: 152500 - DNA, 20 bp, Artificial Sequence
  Description of Artificial Sequence: Synthetic oligonucleotide
  Target: ATXN1; (+) strand; PAM type: NRG; PAM sequence: CAG
tgcctccccttggaacctgc

SEQ ID NO: 152501 - DNA, 20 bp, Artificial Sequence
  Description of Artificial Sequence: Synthetic oligonucleotide
  Target: ATXN1; (+) strand; PAM type: NRG; PAM sequence: AGG
gcctccccttggaacctgcc

SEQ ID NO: 152502 - DNA, 20 bp, Artificial Sequence
  Description of Artificial Sequence: Synthetic oligonucleotide
  Target: ATXN1; (+) strand; PAM type: NRG; PAM sequence: GGG
cctccccttggaacctgcca

SEQ ID NO: 152503 - DNA, 20 bp, Artificial Sequence
  Description of Artificial Sequence: Synthetic oligonucleotide
  Target: ATXN1; (+) strand; PAM type: NRG; PAM sequence: CAG
ccccttggaacctgccaggg

SEQ ID NO: 152504 - DNA, 20 bp, Artificial Sequence
  Description of Artificial Sequence: Synthetic oligonucleotide
  Target: ATXN1; (+) strand; PAM type: NRG; PAM sequence: AGG
cccttggaacctgccagggc

SEQ ID NO: 152505 - DNA, 20 bp, Artificial Sequence
  Description of Artificial Sequence: Synthetic oligonucleotide
  Target: ATXN1; (+) strand; PAM type: NRG; PAM sequence: GGG
ccttggaacctgccagggca

SEQ ID NO: 152506 - DNA, 20 bp, Artificial Sequence
  Description of Artificial Sequence: Synthetic oligonucleotide
  Target: ATXN1; (+) strand; PAM type: NRG; PAM sequence: AAG
ggaacctgccagggcagggc

SEQ ID NO: 152507 - DNA, 20 bp, Artificial Sequence
  Description of Artificial Sequence: Synthetic oligonucleotide
  Target: ATXN1; (+) strand; PAM type: NRG; PAM sequence: AGG
gaacctgccagggcagggca

SEQ ID NO: 152508 - DNA, 20 bp, Artificial Sequence
  Description of Artificial Sequence: Synthetic oligonucleotide
  Target: ATXN1; (+) strand; PAM type: NRG; PAM sequence: AAG
ccagggcagggcaaggttaa

SEQ ID NO: 152509 - DNA, 20 bp, Artificial Sequence
  Description of Artificial Sequence: Synthetic oligonucleotide
  Target: ATXN1; (+) strand; PAM type: NRG; PAM sequence: AGG
cagggcagggcaaggttaaa

SEQ ID NO: 152510 - DNA, 20 bp, Artificial Sequence
  Description of Artificial Sequence: Synthetic oligonucleotide
  Target: ATXN1; (+) strand; PAM type: NRG; PAM sequence: GGG
agggcagggcaaggttaaaa

SEQ ID NO: 152511 - DNA, 20 bp, Artificial Sequence
  Description of Artificial Sequence: Synthetic oligonucleotide
  Target: ATXN1; (+) strand; PAM type: NRG; PAM sequence: TAG
gggcaaggttaaaagggcct

SEQ ID NO: 152512 - DNA, 20 bp, Artificial Sequence
  Description of Artificial Sequence: Synthetic oligonucleotide
  Target: ATXN1; (+) strand; PAM type: NRG; PAM sequence: AGG
ggcaaggttaaaagggcctt

SEQ ID NO: 152513 - DNA, 20 bp, Artificial Sequence
  Description of Artificial Sequence: Synthetic oligonucleotide
  Target: ATXN1; (+) strand; PAM type: NRG; PAM sequence: GGG
gcaaggttaaaagggcctta

SEQ ID NO: 152514 - DNA, 20 bp, Artificial Sequence
  Description of Artificial Sequence: Synthetic oligonucleotide
  Target: ATXN1; (+) strand; PAM type: NRG; PAM sequence: TGG
ggccttagggtactctcctc

SEQ ID NO: 152515 - DNA, 20 bp, Artificial Sequence
  Description of Artificial Sequence: Synthetic oligonucleotide
  Target: ATXN1; (+) strand; PAM type: NRG; PAM sequence: GGG
gccttagggtactctcctct

SEQ ID NO: 152516 - DNA, 20 bp, Artificial Sequence
  Description of Artificial Sequence: Synthetic oligonucleotide
  Target: ATXN1; (+) strand; PAM type: NRG; PAM sequence: GGG
ccttagggtactctcctctg

SEQ ID NO: 152517 - DNA, 20 bp, Artificial Sequence
  Description of Artificial Sequence: Synthetic oligonucleotide
  Target: ATXN1; (+) strand; PAM type: NRG; PAM sequence: GGG
cttagggtactctcctctgg

SEQ ID NO: 152518 - DNA, 20 bp, Artificial Sequence
  Description of Artificial Sequence: Synthetic oligonucleotide
  Target: ATXN1; (+) strand; PAM type: NRG; PAM sequence: CAG
actctcctctgggggtgctg

SEQ ID NO: 152519 - DNA, 20 bp, Artificial Sequence
  Description of Artificial Sequence: Synthetic oligonucleotide
  Target: ATXN1; (+) strand; PAM type: NRG; PAM sequence: CGG
ctcctctgggggtgctgcag

SEQ ID NO: 152520 - DNA, 20 bp, Artificial Sequence
  Description of Artificial Sequence: Synthetic oligonucleotide
  Target: ATXN1; (+) strand; PAM type: NRG; PAM sequence: AAG
tgggggtgctgcagcggtca

SEQ ID NO: 152521 - DNA, 20 bp, Artificial Sequence
  Description of Artificial Sequence: Synthetic oligonucleotide
  Target: ATXN1; (+) strand; PAM type: NRG; PAM sequence: AGG
gggggtgctgcagcggtcaa

SEQ ID NO: 152522 - DNA, 20 bp, Artificial Sequence
  Description of Artificial Sequence: Synthetic oligonucleotide
  Target: ATXN1; (+) strand; PAM type: NRG; PAM sequence: CAG
gctgcagcggtcaaaggacc

SEQ ID NO: 152523 - DNA, 20 bp, Artificial Sequence
  Description of Artificial Sequence: Synthetic oligonucleotide
  Target: ATXN1; (+) strand; PAM type: NRG; PAM sequence: AGG
ctgcagcggtcaaaggaccc

SEQ ID NO: 152524 - DNA, 20 bp, Artificial Sequence
  Description of Artificial Sequence: Synthetic oligonucleotide
  Target: ATXN1; (+) strand; PAM type: NRG; PAM sequence: GGG
tgcagcggtcaaaggaccca

SEQ ID NO: 152525 - DNA, 20 bp, Artificial Sequence
  Description of Artificial Sequence: Synthetic oligonucleotide
  Target: ATXN1; (+) strand; PAM type: NRG; PAM sequence: CAG
ggtcaaaggacccagggctt

SEQ ID NO: 152526 - DNA, 20 bp, Artificial Sequence
  Description of Artificial Sequence: Synthetic oligonucleotide
  Target: ATXN1; (+) strand; PAM type: NRG; PAM sequence: TGG
cccagggcttcagtttccaa

SEQ ID NO: 152527 - DNA, 20 bp, Artificial Sequence
  Description of Artificial Sequence: Synthetic oligonucleotide
  Target: ATXN1; (+) strand; PAM type: NRG; PAM sequence: GGG
ccagggcttcagtttccaat

SEQ ID NO: 152528 - DNA, 20 bp, Artificial Sequence
  Description of Artificial Sequence: Synthetic oligonucleotide
  Target: ATXN1; (+) strand; PAM type: NRG; PAM sequence: GAG
agggcttcagtttccaatgg

SEQ ID NO: 152529 - DNA, 20 bp, Artificial Sequence
  Description of Artificial Sequence: Synthetic oligonucleotide
  Target: ATXN1; (+) strand; PAM type: NRG; PAM sequence: AGG
gggcttcagtttccaatggg

SEQ ID NO: 152530 - DNA, 20 bp, Artificial Sequence
  Description of Artificial Sequence: Synthetic oligonucleotide
  Target: ATXN1; (+) strand; PAM type: NRG; PAM sequence: CAG
ggaggcatttccatacctgt

SEQ ID NO: 152531 - DNA, 20 bp, Artificial Sequence
  Description of Artificial Sequence: Synthetic oligonucleotide
  Target: ATXN1; (+) strand; PAM type: NRG; PAM sequence: CAG
tacctgtcagaatctcttaa

SEQ ID NO: 152532 - DNA, 20 bp, Artificial Sequence
  Description of Artificial Sequence: Synthetic oligonucleotide
  Target: ATXN1; (+) strand; PAM type: NRG; PAM sequence: AGG
acctgtcagaatctcttaac

SEQ ID NO: 152533 - DNA, 20 bp, Artificial Sequence
  Description of Artificial Sequence: Synthetic oligonucleotide
  Target: ATXN1; (+) strand; PAM type: NRG; PAM sequence: TGG
tcttaacaggttctgacata

SEQ ID NO: 152534 - DNA, 20 bp, Artificial Sequence
  Description of Artificial Sequence: Synthetic oligonucleotide
  Target: ATXN1; (+) strand; PAM type: NRG; PAM sequence: TGG
ctgacatatggtccaacata

SEQ ID NO: 152535 - DNA, 20 bp, Artificial Sequence
  Description of Artificial Sequence: Synthetic oligonucleotide
  Target: ATXN1; (+) strand; PAM type: NRG; PAM sequence: TGG
acaaatgcactccctccacc

SEQ ID NO: 152536 - DNA, 20 bp, Artificial Sequence
  Description of Artificial Sequence: Synthetic oligonucleotide
  Target: ATXN1; (+) strand; PAM type: NRG; PAM sequence: GAG
aaatgcactccctccacctg

SEQ ID NO: 152537 - DNA, 20 bp, Artificial Sequence
  Description of Artificial Sequence: Synthetic oligonucleotide
  Target: ATXN1; (+) strand; PAM type: NRG; PAM sequence: AAG
tgcactccctccacctggag

SEQ ID NO: 152538 - DNA, 20 bp, Artificial Sequence
  Description of Artificial Sequence: Synthetic oligonucleotide
  Target: ATXN1; (+) strand; PAM type: NRG; PAM sequence: AGG
gcactccctccacctggaga

SEQ ID NO: 152539 - DNA, 20 bp, Artificial Sequence
  Description of Artificial Sequence: Synthetic oligonucleotide
  Target: ATXN1; (+) strand; PAM type: NRG; PAM sequence: CAG
gcgtcctcacctaccaccaa

SEQ ID NO: 152540 - DNA, 20 bp, Artificial Sequence
  Description of Artificial Sequence: Synthetic oligonucleotide
  Target: ATXN1; (+) strand; PAM type: NRG; PAM sequence: GAG
accaccaacagtgcaacttc

SEQ ID NO: 152541 - DNA, 20 bp, Artificial Sequence
  Description of Artificial Sequence: Synthetic oligonucleotide
  Target: ATXN1; (+) strand; PAM type: NRG; PAM sequence: AAG
aacagtgcaacttcgagatg

SEQ ID NO: 152542 - DNA, 20 bp, Artificial Sequence
  Description of Artificial Sequence: Synthetic oligonucleotide
  Target: ATXN1; (+) strand; PAM type: NRG; PAM sequence: CAG
agatgaagtcatttacaacc

SEQ ID NO: 152543 - DNA, 20 bp, Artificial Sequence
  Description of Artificial Sequence: Synthetic oligonucleotide
  Target: ATXN1; (+) strand; PAM type: NRG; PAM sequence: GAG
atgaagtcatttacaaccca

SEQ ID NO: 152544 - DNA, 20 bp, Artificial Sequence
  Description of Artificial Sequence: Synthetic oligonucleotide
  Target: ATXN1; (+) strand; PAM type: NRG; PAM sequence: AGG
tgaagtcatttacaacccag

SEQ ID NO: 152545 - DNA, 20 bp, Artificial Sequence
  Description of Artificial Sequence: Synthetic oligonucleotide
  Target: ATXN1; (+) strand; PAM type: NRG; PAM sequence: GAG
aagtcatttacaacccagag

SEQ ID NO: 152546 - DNA, 20 bp, Artificial Sequence
  Description of Artificial Sequence: Synthetic oligonucleotide
  Target: ATXN1; (+) strand; PAM type: NRG; PAM sequence: TGG
catttacaacccagaggaga

SEQ ID NO: 152547 - DNA, 20 bp, Artificial Sequence
  Description of Artificial Sequence: Synthetic oligonucleotide
  Target: ATXN1; (+) strand; PAM type: NRG; PAM sequence: TGG
tacaacccagaggagatgga

SEQ ID NO: 152548 - DNA, 20 bp, Artificial Sequence
  Description of Artificial Sequence: Synthetic oligonucleotide
  Target: ATXN1; (+) strand; PAM type: NRG; PAM sequence: CGG
agaggagatggatggtcacc

SEQ ID NO: 152549 - DNA, 20 bp, Artificial Sequence
  Description of Artificial Sequence: Synthetic oligonucleotide
  Target: ATXN1; (+) strand; PAM type: NRG; PAM sequence: CGG
gagatggatggtcacccggc

SEQ ID NO: 152550 - DNA, 20 bp, Artificial Sequence
  Description of Artificial Sequence: Synthetic oligonucleotide
  Target: ATXN1; (+) strand; PAM type: NRG; PAM sequence: AAG
cacccggccggccaactcaa

SEQ ID NO: 152551 - DNA, 20 bp, Artificial Sequence
  Description of Artificial Sequence: Synthetic oligonucleotide
  Target: ATXN1; (+) strand; PAM type: NRG; PAM sequence: AGG
acccggccggccaactcaaa

SEQ ID NO: 152552 - DNA, 20 bp, Artificial Sequence
  Description of Artificial Sequence: Synthetic oligonucleotide
  Target: ATXN1; (+) strand; PAM type: NRG; PAM sequence: GGG
cccggccggccaactcaaaa

SEQ ID NO: 152553 - DNA, 20 bp, Artificial Sequence
  Description of Artificial Sequence: Synthetic oligonucleotide
  Target: ATXN1; (+) strand; PAM type: NRG; PAM sequence: CAG
ccggccaactcaaaagggca

SEQ ID NO: 152554 - DNA, 20 bp, Artificial Sequence
  Description of Artificial Sequence: Synthetic oligonucleotide
  Target: ATXN1; (+) strand; PAM type: NRG; PAM sequence: AAG
caactcaaaagggcacagat

SEQ ID NO: 152555 - DNA, 20 bp, Artificial Sequence
  Description of Artificial Sequence: Synthetic oligonucleotide
  Target: ATXN1; (+) strand; PAM type: NRG; PAM sequence: TAG
caaaagggcacagataagat

SEQ ID NO: 152556 - DNA, 20 bp, Artificial Sequence
  Description of Artificial Sequence: Synthetic oligonucleotide
  Target: ATXN1; (+) strand; PAM type: NRG; PAM sequence: TGG
agggcacagataagattaga

SEQ ID NO: 152557 - DNA, 20 bp, Artificial Sequence
  Description of Artificial Sequence: Synthetic oligonucleotide
  Target: ATXN1; (+) strand; PAM type: NRG; PAM sequence: CGG
agatggacctcctaccccac

SEQ ID NO: 152558 - DNA, 20 bp, Artificial Sequence
  Description of Artificial Sequence: Synthetic oligonucleotide
  Target: ATXN1; (+) strand; PAM type: NRG; PAM sequence: GAG
ccaccggtttcatacttgac

SEQ ID NO: 152559 - DNA, 20 bp, Artificial Sequence
  Description of Artificial Sequence: Synthetic oligonucleotide
  Target: ATXN1; (+) strand; PAM type: NRG; PAM sequence: CAG
ccggtttcatacttgacgag

SEQ ID NO: 152560 - DNA, 20 bp, Artificial Sequence
  Description of Artificial Sequence: Synthetic oligonucleotide
  Target: ATXN1; (+) strand; PAM type: NRG; PAM sequence: AGG
cggtttcatacttgacgagc

SEQ ID NO: 152561 - DNA, 20 bp, Artificial Sequence
  Description of Artificial Sequence: Synthetic oligonucleotide
  Target: ATXN1; (+) strand; PAM type: NRG; PAM sequence: GGG
ggtttcatacttgacgagca

SEQ ID NO: 152562 - DNA, 20 bp, Artificial Sequence
  Description of Artificial Sequence: Synthetic oligonucleotide
  Target: ATXN1; (+) strand; PAM type: NRG; PAM sequence: CAG
tacttgacgagcagggtttg

SEQ ID NO: 152563 - DNA, 20 bp, Artificial Sequence
  Description of Artificial Sequence: Synthetic oligonucleotide
  Target: ATXN1; (+) strand; PAM type: NRG; PAM sequence: AAG
ttgacgagcagggtttgcag

SEQ ID NO: 152564 - DNA, 20 bp, Artificial Sequence
  Description of Artificial Sequence: Synthetic oligonucleotide
  Target: ATXN1; (+) strand; PAM type: NRG; PAM sequence: AAG
acgagcagggtttgcagaag

SEQ ID NO: 152565 - DNA, 20 bp, Artificial Sequence
  Description of Artificial Sequence: Synthetic oligonucleotide
  Target: ATXN1; (+) strand; PAM type: NRG; PAM sequence: AGG
cgagcagggtttgcagaaga

SEQ ID NO: 152566 - DNA, 20 bp, Artificial Sequence
  Description of Artificial Sequence: Synthetic oligonucleotide
  Target: ATXN1; (+) strand; PAM type: NRG; PAM sequence: TGG
gtttgcagaagaaggtttca

SEQ ID NO: 152567 - DNA, 20 bp, Artificial Sequence
  Description of Artificial Sequence: Synthetic oligonucleotide
  Target: ATXN1; (+) strand; PAM type: NRG; PAM sequence: AAG
catggtcaccctaccccttt

SEQ ID NO: 152568 - DNA, 20 bp, Artificial Sequence
  Description of Artificial Sequence: Synthetic oligonucleotide
  Target: ATXN1; (+) strand; PAM type: NRG; PAM sequence: CAG
ggtcaccctacccctttaag

SEQ ID NO: 152569 - DNA, 20 bp, Artificial Sequence
  Description of Artificial Sequence: Synthetic oligonucleotide
  Target: ATXN1; (+) strand; PAM type: NRG; PAM sequence: TGG
aagcagttctcctttccatg

SEQ ID NO: 152570 - DNA, 20 bp, Artificial Sequence
  Description of Artificial Sequence: Synthetic oligonucleotide
  Target: ATXN1; (+) strand; PAM type: NRG; PAM sequence: TAG
tctaaccaaccaacctcact

SEQ ID NO: 152571 - DNA, 20 bp, Artificial Sequence
  Description of Artificial Sequence: Synthetic oligonucleotide
  Target: ATXN1; (+) strand; PAM type: NRG; PAM sequence: CAG
accaacctcacttagaactt

SEQ ID NO: 152572 - DNA, 20 bp, Artificial Sequence
  Description of Artificial Sequence: Synthetic oligonucleotide
  Target: ATXN1; (+) strand; PAM type: NRG; PAM sequence: CAG
acttcagaactactctcttc

SEQ ID NO: 152573 - DNA, 20 bp, Artificial Sequence
  Description of Artificial Sequence: Synthetic oligonucleotide
  Target: ATXN1; (+) strand; PAM type: NRG; PAM sequence: AAG
aactactctcttccagataa

SEQ ID NO: 152574 - DNA, 20 bp, Artificial Sequence
  Description of Artificial Sequence: Synthetic oligonucleotide
  Target: ATXN1; (+) strand; PAM type: NRG; PAM sequence: TGG
tccagataaaagtatctcct

SEQ ID NO: 152575 - DNA, 20 bp, Artificial Sequence
  Description of Artificial Sequence: Synthetic oligonucleotide
  Target: ATXN1; (+) strand; PAM type: NRG; PAM sequence: GGG
ccagataaaagtatctcctt

SEQ ID NO: 152576 - DNA, 20 bp, Artificial Sequence
  Description of Artificial Sequence: Synthetic oligonucleotide
  Target: ATXN1; (+) strand; PAM type: NRG; PAM sequence: TAG
ccttgggataactatctcac

SEQ ID NO: 152577 - DNA, 20 bp, Artificial Sequence
  Description of Artificial Sequence: Synthetic oligonucleotide
  Target: ATXN1; (+) strand; PAM type: NRG; PAM sequence: GAG
ctcactagaaactttcacct

SEQ ID NO: 152578 - DNA, 20 bp, Artificial Sequence
  Description of Artificial Sequence: Synthetic oligonucleotide
  Target: ATXN1; (+) strand; PAM type: NRG; PAM sequence: CAG
agaaactttcacctgagttg

SEQ ID NO: 152579 - DNA, 20 bp, Artificial Sequence
  Description of Artificial Sequence: Synthetic oligonucleotide
  Target: ATXN1; (+) strand; PAM type: NRG; PAM sequence: GAG
aaactttcacctgagttgca

SEQ ID NO: 152580 - DNA, 20 bp, Artificial Sequence
  Description of Artificial Sequence: Synthetic oligonucleotide
  Target: ATXN1; (+) strand; PAM type: NRG; PAM sequence: GAG
gagttgcagagtatgaccac

SEQ ID NO: 152581 - DNA, 20 bp, Artificial Sequence
  Description of Artificial Sequence: Synthetic oligonucleotide
  Target: ATXN1; (+) strand; PAM type: NRG; PAM sequence: GAG
gttgcagagtatgaccacga

SEQ ID NO: 152582 - DNA, 20 bp, Artificial Sequence
  Description of Artificial Sequence: Synthetic oligonucleotide
  Target: ATXN1; (+) strand; PAM type: NRG; PAM sequence: AAG
tatgaccacgagagcactta

SEQ ID NO: 152583 - DNA, 20 bp, Artificial Sequence
  Description of Artificial Sequence: Synthetic oligonucleotide
  Target: ATXN1; (+) strand; PAM type: NRG; PAM sequence: AGG
atgaccacgagagcacttaa

SEQ ID NO: 152584 - DNA, 20 bp, Artificial Sequence
  Description of Artificial Sequence: Synthetic oligonucleotide
  Target: ATXN1; (+) strand; PAM type: NRG; PAM sequence: GAG
gaccacgagagcacttaaag

SEQ ID NO: 152585 - DNA, 20 bp, Artificial Sequence
  Description of Artificial Sequence: Synthetic oligonucleotide
  Target: ATXN1; (+) strand; PAM type: NRG; PAM sequence: AAG
cacttaaaggagactgatca

SEQ ID NO: 152586 - DNA, 20 bp, Artificial Sequence
  Description of Artificial Sequence: Synthetic oligonucleotide
  Target: ATXN1; (+) strand; PAM type: NRG; PAM sequence: CAG
taaaggagactgatcaaagt

SEQ ID NO: 152587 - DNA, 20 bp, Artificial Sequence
  Description of Artificial Sequence: Synthetic oligonucleotide
  Target: ATXN1; (+) strand; PAM type: NRG; PAM sequence: CAG
gactgatcaaagtcagaaaa

SEQ ID NO: 152588 - DNA, 20 bp, Artificial Sequence
  Description of Artificial Sequence: Synthetic oligonucleotide
  Target: ATXN1; (+) strand; PAM type: NRG; PAM sequence: AAG
aaagtcagaaaacagatgtt

SEQ ID NO: 152589 - DNA, 20 bp, Artificial Sequence
  Description of Artificial Sequence: Synthetic oligonucleotide
  Target: ATXN1; (+) strand; PAM type: NRG; PAM sequence: TAG
catttattcattcgatgcaa

SEQ ID NO: 152590 - DNA, 20 bp, Artificial Sequence
  Description of Artificial Sequence: Synthetic oligonucleotide
  Target: ATXN1; (+) strand; PAM type: NRG; PAM sequence: CAG
atcttcatataatcgaaatt

SEQ ID NO: 152591 - DNA, 20 bp, Artificial Sequence
  Description of Artificial Sequence: Synthetic oligonucleotide
  Target: ATXN1; (+) strand; PAM type: NRG; PAM sequence: TAG
ttcatataatcgaaattcag

SEQ ID NO: 152592 - DNA, 20 bp, Artificial Sequence
  Description of Artificial Sequence: Synthetic oligonucleotide
  Target: ATXN1; (+) strand; PAM type: NRG; PAM sequence: AGG
tcatataatcgaaattcagt

SEQ ID NO: 152593 - DNA, 20 bp, Artificial Sequence
  Description of Artificial Sequence: Synthetic oligonucleotide
  Target: ATXN1; (+) strand; PAM type: NRG; PAM sequence: GAG
tcagtaggaattttttcaat

SEQ ID NO: 152594 - DNA, 20 bp, Artificial Sequence
  Description of Artificial Sequence: Synthetic oligonucleotide
  Target: ATXN1; (+) strand; PAM type: NRG; PAM sequence: AGG
cagtaggaattttttcaatg

SEQ ID NO: 152595 - DNA, 20 bp, Artificial Sequence
  Description of Artificial Sequence: Synthetic oligonucleotide
  Target: ATXN1; (+) strand; PAM type: NRG; PAM sequence: GAG
gtaggaattttttcaatgag

SEQ ID NO: 152596 - DNA, 20 bp, Artificial Sequence
  Description of Artificial Sequence: Synthetic oligonucleotide
  Target: ATXN1; (+) strand; PAM type: NRG; PAM sequence: AGG
taggaattttttcaatgagg

SEQ ID NO: 152597 - DNA, 20 bp, Artificial Sequence
  Description of Artificial Sequence: Synthetic oligonucleotide
  Target: ATXN1; (+) strand; PAM type: NRG; PAM sequence: AAG
gaattttttcaatgaggagg

SEQ ID NO: 152598 - DNA, 20 bp, Artificial Sequence
  Description of Artificial Sequence: Synthetic oligonucleotide
  Target: ATXN1; (+) strand; PAM type: NRG; PAM sequence: CAG
tttttcaatgaggaggaaga

SEQ ID NO: 152599 - DNA, 20 bp, Artificial Sequence
  Description of Artificial Sequence: Synthetic oligonucleotide
  Target: ATXN1; (+) strand; PAM type: NRG; PAM sequence: TAG
aatgaggaggaagacagtct

SEQ ID NO: 152600 - DNA, 20 bp, Artificial Sequence
  Description of Artificial Sequence: Synthetic oligonucleotide
  Target: ATXN1; (+) strand; PAM type: NRG; PAM sequence: AAG
tcttagacgttcaaaaacaa

SEQ ID NO: 152601 - DNA, 20 bp, Artificial Sequence
  Description of Artificial Sequence: Synthetic oligonucleotide
  Target: ATXN1; (+) strand; PAM type: NRG; PAM sequence: TAG
gtattgaatttcaataataa

SEQ ID NO: 152602 - DNA, 20 bp, Artificial Sequence
  Description of Artificial Sequence: Synthetic oligonucleotide
  Target: ATXN1; (+) strand; PAM type: NRG; PAM sequence: TGG
aataataatagtgttttgtg

SEQ ID NO: 152603 - DNA, 20 bp, Artificial Sequence
  Description of Artificial Sequence: Synthetic oligonucleotide
  Target: ATXN1; (+) strand; PAM type: NRG; PAM sequence: AAG
atagtgttttgtgtggttat

SEQ ID NO: 152604 - DNA, 20 bp, Artificial Sequence
  Description of Artificial Sequence: Synthetic oligonucleotide
  Target: ATXN1; (+) strand; PAM type: NRG; PAM sequence: CAG
gttttgtgtggttataagtg

SEQ ID NO: 152605 - DNA, 20 bp, Artificial Sequence
  Description of Artificial Sequence: Synthetic oligonucleotide
  Target: ATXN1; (+) strand; PAM type: NRG; PAM sequence: GAG
tataaaacttaaatatgatt

SEQ ID NO: 152606 - DNA, 20 bp, Artificial Sequence
  Description of Artificial Sequence: Synthetic oligonucleotide
  Target: ATXN1; (+) strand; PAM type: NRG; PAM sequence: CAG
taaatatgattgagcgaatt

SEQ ID NO: 152607 - DNA, 20 bp, Artificial Sequence
  Description of Artificial Sequence: Synthetic oligonucleotide
  Target: ATXN1; (+) strand; PAM type: NRG; PAM sequence: CAG
attcagcactctattacgta

SEQ ID NO: 152608 - DNA, 20 bp, Artificial Sequence
  Description of Artificial Sequence: Synthetic oligonucleotide
  Target: ATXN1; (+) strand; PAM type: NRG; PAM sequence: CAG
attacgtacagctttctttc

SEQ ID NO: 152609 - DNA, 20 bp, Artificial Sequence
  Description of Artificial Sequence: Synthetic oligonucleotide
  Target: ATXN1; (+) strand; PAM type: NRG; PAM sequence: TGG
ctttccagaaaattcatcat

SEQ ID NO: 152610 - DNA, 20 bp, Artificial Sequence
  Description of Artificial Sequence: Synthetic oligonucleotide
  Target: ATXN1; (+) strand; PAM type: NRG; PAM sequence: TAG
attggacctttctttctcct

SEQ ID NO: 152611 - DNA, 20 bp, Artificial Sequence
  Description of Artificial Sequence: Synthetic oligonucleotide
  Target: ATXN1; (+) strand; PAM type: NRG; PAM sequence: CAG
acctttctttctccttagca

SEQ ID NO: 152612 - DNA, 20 bp, Artificial Sequence
  Description of Artificial Sequence: Synthetic oligonucleotide
  Target: ATXN1; (+) strand; PAM type: NRG; PAM sequence: AGG
cctttctttctccttagcac

SEQ ID NO: 152613 - DNA, 20 bp, Artificial Sequence
  Description of Artificial Sequence: Synthetic oligonucleotide
  Target: ATXN1; (+) strand; PAM type: NRG; PAM sequence: TGG
ccttttcactcactgtgtga

SEQ ID NO: 152614 - DNA, 20 bp, Artificial Sequence
  Description of Artificial Sequence: Synthetic oligonucleotide
  Target: ATXN1; (+) strand; PAM type: NRG; PAM sequence: AAG
cactcactgtgtgatggaca

SEQ ID NO: 152615 - DNA, 20 bp, Artificial Sequence
  Description of Artificial Sequence: Synthetic oligonucleotide
  Target: ATXN1; (+) strand; PAM type: NRG; PAM sequence: AAG
tgtgtgatggacaaagcaca

SEQ ID NO: 152616 - DNA, 20 bp, Artificial Sequence
  Description of Artificial Sequence: Synthetic oligonucleotide
  Target: ATXN1; (+) strand; PAM type: NRG; PAM sequence: CAG
tgatggacaaagcacaaagc

SEQ ID NO: 152617 - DNA, 20 bp, Artificial Sequence
  Description of Artificial Sequence: Synthetic oligonucleotide
  Target: ATXN1; (+) strand; PAM type: NRG; PAM sequence: TGG
tggacaaagcacaaagccag

SEQ ID NO: 152618 - DNA, 20 bp, Artificial Sequence
  Description of Artificial Sequence: Synthetic oligonucleotide
  Target: ATXN1; (+) strand; PAM type: NRG; PAM sequence: CAG
cacaaagccagtggaacaaa

SEQ ID NO: 152619 - DNA, 20 bp, Artificial Sequence
  Description of Artificial Sequence: Synthetic oligonucleotide
  Target: ATXN1; (+) strand; PAM type: NRG; PAM sequence: AGG
acaaagccagtggaacaaac

SEQ ID NO: 152620 - DNA, 20 bp, Artificial Sequence
  Description of Artificial Sequence: Synthetic oligonucleotide
  Target: ATXN1; (+) strand; PAM type: NRG; PAM sequence: TAG
agtggaacaaacaggtgcca

SEQ ID NO: 152621 - DNA, 20 bp, Artificial Sequence
  Description of Artificial Sequence: Synthetic oligonucleotide
  Target: ATXN1; (+) strand; PAM type: NRG; PAM sequence: TGG
catagctttttccaccactg

SEQ ID NO: 152622 - DNA, 20 bp, Artificial Sequence
  Description of Artificial Sequence: Synthetic oligonucleotide
  Target: ATXN1; (+) strand; PAM type: NRG; PAM sequence: CAG
ttttccaccactgtggttca

SEQ ID NO: 152623 - DNA, 20 bp, Artificial Sequence
  Description of Artificial Sequence: Synthetic oligonucleotide
  Target: ATXN1; (+) strand; PAM type: NRG; PAM sequence: AGG
tttccaccactgtggttcac

SEQ ID NO: 152624 - DNA, 20 bp, Artificial Sequence
  Description of Artificial Sequence: Synthetic oligonucleotide
  Target: ATXN1; (+) strand; PAM type: NRG; PAM sequence: TGG
tggttcacaggaccccatgc

SEQ ID NO: 152625 - DNA, 20 bp, Artificial Sequence
  Description of Artificial Sequence: Synthetic oligonucleotide
  Target: ATXN1; (+) strand; PAM type: NRG; PAM sequence: CAG
caccacaattatatacatca

SEQ ID NO: 152626 - DNA, 20 bp, Artificial Sequence
  Description of Artificial Sequence: Synthetic oligonucleotide
  Target: ATXN1; (+) strand; PAM type: NRG; PAM sequence: TAG
tacatcacagtccatattaa

SEQ ID NO: 152627 - DNA, 20 bp, Artificial Sequence
  Description of Artificial Sequence: Synthetic oligonucleotide
  Target: ATXN1; (+) strand; PAM type: NRG; PAM sequence: TGG
tcacagtccatattaataga

SEQ ID NO: 152628 - DNA, 20 bp, Artificial Sequence
  Description of Artificial Sequence: Synthetic oligonucleotide
  Target: ATXN1; (+) strand; PAM type: NRG; PAM sequence: AAG
tcacatccaatttgtaacat

SEQ ID NO: 152629 - DNA, 20 bp, Artificial Sequence
  Description of Artificial Sequence: Synthetic oligonucleotide
  Target: ATXN1; (+) strand; PAM type: NRG; PAM sequence: CAG
aatttgtaacataagcatca

SEQ ID NO: 152630 - DNA, 20 bp, Artificial Sequence
  Description of Artificial Sequence: Synthetic oligonucleotide
  Target: ATXN1; (+) strand; PAM type: NRG; PAM sequence: AGG
atttgtaacataagcatcac

SEQ ID NO: 152631 - DNA, 20 bp, Artificial Sequence
  Description of Artificial Sequence: Synthetic oligonucleotide
  Target: ATXN1; (+) strand; PAM type: NRG; PAM sequence: GGG
tttgtaacataagcatcaca

SEQ ID NO: 152632 - DNA, 20 bp, Artificial Sequence
  Description of Artificial Sequence: Synthetic oligonucleotide
  Target: ATXN1; (+) strand; PAM type: NRG; PAM sequence: GGG
ttgtaacataagcatcacag

SEQ ID NO: 152633 - DNA, 20 bp, Artificial Sequence
  Description of Artificial Sequence: Synthetic oligonucleotide
  Target: ATXN1; (+) strand; PAM type: NRG; PAM sequence: GGG
tgtaacataagcatcacagg

SEQ ID NO: 152634 - DNA, 20 bp, Artificial Sequence
  Description of Artificial Sequence: Synthetic oligonucleotide
  Target: ATXN1; (+) strand; PAM type: NRG; PAM sequence: TAG
cgtatgtattgcccattcac

SEQ ID NO: 152635 - DNA, 20 bp, Artificial Sequence
  Description of Artificial Sequence: Synthetic oligonucleotide
  Target: ATXN1; (+) strand; PAM type: NRG; PAM sequence: TGG
attcactagatgccacatac

SEQ ID NO: 152636 - DNA, 20 bp, Artificial Sequence
  Description of Artificial Sequence: Synthetic oligonucleotide
  Target: ATXN1; (+) strand; PAM type: NRG; PAM sequence: AAG
actagatgccacatactgga

SEQ ID NO: 152637 - DNA, 20 bp, Artificial Sequence
  Description of Artificial Sequence: Synthetic oligonucleotide
  Target: ATXN1; (+) strand; PAM type: NRG; PAM sequence: GAG
tagatgccacatactggaaa

SEQ ID NO: 152638 - DNA, 20 bp, Artificial Sequence
  Description of Artificial Sequence: Synthetic oligonucleotide
  Target: ATXN1; (+) strand; PAM type: NRG; PAM sequence: AGG
agatgccacatactggaaag

SEQ ID NO: 152639 - DNA, 20 bp, Artificial Sequence
  Description of Artificial Sequence: Synthetic oligonucleotide
  Target: ATXN1; (+) strand; PAM type: NRG; PAM sequence: GGG
gatgccacatactggaaaga

SEQ ID NO: 152640 - DNA, 20 bp, Artificial Sequence
  Description of Artificial Sequence: Synthetic oligonucleotide
  Target: ATXN1; (+) strand; PAM type: NRG; PAM sequence: CAG
gccacatactggaaagaggg

SEQ ID NO: 152641 - DNA, 20 bp, Artificial Sequence
  Description of Artificial Sequence: Synthetic oligonucleotide
  Target: ATXN1; (+) strand; PAM type: NRG; PAM sequence: TGG
agggcagtccctcctatcgc

SEQ ID NO: 152642 - DNA, 20 bp, Artificial Sequence
  Description of Artificial Sequence: Synthetic oligonucleotide
  Target: ATXN1; (+) strand; PAM type: NRG; PAM sequence: GGG
gggcagtccctcctatcgct

SEQ ID NO: 152643 - DNA, 20 bp, Artificial Sequence
  Description of Artificial Sequence: Synthetic oligonucleotide
  Target: ATXN1; (+) strand; PAM type: NRG; PAM sequence: CAG
agtccctcctatcgctgggc

SEQ ID NO: 152644 - DNA, 20 bp, Artificial Sequence
  Description of Artificial Sequence: Synthetic oligonucleotide
  Target: ATXN1; (+) strand; PAM type: NRG; PAM sequence: AGG
gtccctcctatcgctgggcc

SEQ ID NO: 152645 - DNA, 20 bp, Artificial Sequence
  Description of Artificial Sequence: Synthetic oligonucleotide
  Target: ATXN1; (+) strand; PAM type: NRG; PAM sequence: AAG
ctcctatcgctgggccagga

SEQ ID NO: 152646 - DNA, 20 bp, Artificial Sequence
  Description of Artificial Sequence: Synthetic oligonucleotide
  Target: ATXN1; (+) strand; PAM type: NRG; PAM sequence: AGG
tcctatcgctgggccaggaa

SEQ ID NO: 152647 - DNA, 20 bp, Artificial Sequence
  Description of Artificial Sequence: Synthetic oligonucleotide
  Target: ATXN1; (+) strand; PAM type: NRG; PAM sequence: GGG
cctatcgctgggccaggaaa

SEQ ID NO: 152648 - DNA, 20 bp, Artificial Sequence
  Description of Artificial Sequence: Synthetic oligonucleotide
  Target: ATXN1; (+) strand; PAM type: NRG; PAM sequence: GGG
ctatcgctgggccaggaaag

SEQ ID NO: 152649 - DNA, 20 bp, Artificial Sequence
  Description of Artificial Sequence: Synthetic oligonucleotide
  Target: ATXN1; (+) strand; PAM type: NRG; PAM sequence: AAG
gggccaggaaaggggttgtg

SEQ ID NO: 152650 - DNA, 20 bp, Artificial Sequence
  Description of Artificial Sequence: Synthetic oligonucleotide
  Target: ATXN1; (+) strand; PAM type: NRG; PAM sequence: AAG
ggggttgtgaagtattatac

SEQ ID NO: 152651 - DNA, 20 bp, Artificial Sequence
  Description of Artificial Sequence: Synthetic oligonucleotide
  Target: ATXN1; (+) strand; PAM type: NRG; PAM sequence: AGG
gggttgtgaagtattataca

SEQ ID NO: 152652 - DNA, 20 bp, Artificial Sequence
  Description of Artificial Sequence: Synthetic oligonucleotide
  Target: ATXN1; (+) strand; PAM type: NRG; PAM sequence: GGG
ggttgtgaagtattatacaa

SEQ ID NO: 152653 - DNA, 20 bp, Artificial Sequence
  Description of Artificial Sequence: Synthetic oligonucleotide
  Target: ATXN1; (+) strand; PAM type: NRG; PAM sequence: GGG
gttgtgaagtattatacaag

SEQ ID NO: 152654 - DNA, 20 bp, Artificial Sequence
  Description of Artificial Sequence: Synthetic oligonucleotide
  Target: ATXN1; (+) strand; PAM type: NRG; PAM sequence: AAG
gtgaagtattatacaagggg

SEQ ID NO: 152655 - DNA, 20 bp, Artificial Sequence
  Description of Artificial Sequence: Synthetic oligonucleotide
  Target: ATXN1; (+) strand; PAM type: NRG; PAM sequence: TGG
gtattatacaaggggaagaa

SEQ ID NO: 152656 - DNA, 20 bp, Artificial Sequence
  Description of Artificial Sequence: Synthetic oligonucleotide
  Target: ATXN1; (+) strand; PAM type: NRG; PAM sequence: GGG
tattatacaaggggaagaat

SEQ ID NO: 152657 - DNA, 20 bp, Artificial Sequence
  Description of Artificial Sequence: Synthetic oligonucleotide
  Target: ATXN1; (+) strand; PAM type: NRG; PAM sequence: GGG
attatacaaggggaagaatg

SEQ ID NO: 152658 - DNA, 20 bp, Artificial Sequence
  Description of Artificial Sequence: Synthetic oligonucleotide
  Target: ATXN1; (+) strand; PAM type: NRG; PAM sequence: TGG
aggggaagaatggggtgcta

SEQ ID NO: 152659 - DNA, 20 bp, Artificial Sequence
  Description of Artificial Sequence: Synthetic oligonucleotide
  Target: ATXN1; (+) strand; PAM type: NRG; PAM sequence: GGG
ggggaagaatggggtgctat

SEQ ID NO: 152660 - DNA, 20 bp, Artificial Sequence
  Description of Artificial Sequence: Synthetic oligonucleotide
  Target: ATXN1; (+) strand; PAM type: NRG; PAM sequence: CAG
aatggggtgctatgggaacc

SEQ ID NO: 152661 - DNA, 20 bp, Artificial Sequence
  Description of Artificial Sequence: Synthetic oligonucleotide
  Target: ATXN1; (+) strand; PAM type: NRG; PAM sequence: AAG
ggtgctatgggaacccagaa

SEQ ID NO: 152662 - DNA, 20 bp, Artificial Sequence
  Description of Artificial Sequence: Synthetic oligonucleotide
  Target: ATXN1; (+) strand; PAM type: NRG; PAM sequence: AGG
gtgctatgggaacccagaaa

SEQ ID NO: 152663 - DNA, 20 bp, Artificial Sequence
  Description of Artificial Sequence: Synthetic oligonucleotide
  Target: ATXN1; (+) strand; PAM type: NRG; PAM sequence: TAG
ctatgggaacccagaaaagg

SEQ ID NO: 152664 - DNA, 20 bp, Artificial Sequence
  Description of Artificial Sequence: Synthetic oligonucleotide
  Target: ATXN1; (+) strand; PAM type: NRG; PAM sequence: TAG
agaaaaggtagcaaataaca

SEQ ID NO: 152665 - DNA, 20 bp, Artificial Sequence
  Description of Artificial Sequence: Synthetic oligonucleotide
  Target: ATXN1; (+) strand; PAM type: NRG; PAM sequence: TAG
gtagcaaataacatagtccc

SEQ ID NO: 152666 - DNA, 20 bp, Artificial Sequence
  Description of Artificial Sequence: Synthetic oligonucleotide
  Target: ATXN1; (+) strand; PAM type: NRG; PAM sequence: AAG
aataacatagtccctagtcc

SEQ ID NO: 152667 - DNA, 20 bp, Artificial Sequence
  Description of Artificial Sequence: Synthetic oligonucleotide
  Target: ATXN1; (+) strand; PAM type: NRG; PAM sequence: AGG
ataacatagtccctagtcca

SEQ ID NO: 152668 - DNA, 20 bp, Artificial Sequence
  Description of Artificial Sequence: Synthetic oligonucleotide
  Target: ATXN1; (+) strand; PAM type: NRG; PAM sequence: GGG
taacatagtccctagtccaa

SEQ ID NO: 152669 - DNA, 20 bp, Artificial Sequence
  Description of Artificial Sequence: Synthetic oligonucleotide
  Target: ATXN1; (+) strand; PAM type: NRG; PAM sequence: GAG
ccctagtccaagggcttcgt

SEQ ID NO: 152670 - DNA, 20 bp, Artificial Sequence
  Description of Artificial Sequence: Synthetic oligonucleotide
  Target: ATXN1; (+) strand; PAM type: NRG; PAM sequence: AGG
cctagtccaagggcttcgtg

SEQ ID NO: 152671 - DNA, 20 bp, Artificial Sequence
  Description of Artificial Sequence: Synthetic oligonucleotide
  Target: ATXN1; (+) strand; PAM type: NRG; PAM sequence: AAG
agtccaagggcttcgtgagg

SEQ ID NO: 152672 - DNA, 20 bp, Artificial Sequence
  Description of Artificial Sequence: Synthetic oligonucleotide
  Target: ATXN1; (+) strand; PAM type: NRG; PAM sequence: GAG
tccaagggcttcgtgaggaa

SEQ ID NO: 152673 - DNA, 20 bp, Artificial Sequence
  Description of Artificial Sequence: Synthetic oligonucleotide
  Target: ATXN1; (+) strand; PAM type: NRG; PAM sequence: AAG
cttcgtgaggaagagactct

SEQ ID NO: 152674 - DNA, 20 bp, Artificial Sequence
  Description of Artificial Sequence: Synthetic oligonucleotide
  Target: ATXN1; (+) strand; PAM type: NRG; PAM sequence: GAG
tgaggaagagactctaagct

SEQ ID NO: 152675 - DNA, 20 bp, Artificial Sequence
  Description of Artificial Sequence: Synthetic oligonucleotide
  Target: ATXN1; (+) strand; PAM type: NRG; PAM sequence: AAG
agactctaagctgagatttc

SEQ ID NO: 152676 - DNA, 20 bp, Artificial Sequence
  Description of Artificial Sequence: Synthetic oligonucleotide
  Target: ATXN1; (+) strand; PAM type: NRG; PAM sequence: GAG
taagctgagatttcaagaat

SEQ ID NO: 152677 - DNA, 20 bp, Artificial Sequence
  Description of Artificial Sequence: Synthetic oligonucleotide
  Target: ATXN1; (+) strand; PAM type: NRG; PAM sequence: AGG
aagctgagatttcaagaatg

SEQ ID NO: 152678 - DNA, 20 bp, Artificial Sequence
  Description of Artificial Sequence: Synthetic oligonucleotide
  Target: ATXN1; (+) strand; PAM type: NRG; PAM sequence: GGG
agctgagatttcaagaatga

SEQ ID NO: 152679 - DNA, 20 bp, Artificial Sequence
  Description of Artificial Sequence: Synthetic oligonucleotide
  Target: ATXN1; (+) strand; PAM type: NRG; PAM sequence: AAG
gagatttcaagaatgaggga

SEQ ID NO: 152680 - DNA, 20 bp, Artificial Sequence
  Description of Artificial Sequence: Synthetic oligonucleotide
  Target: ATXN1; (+) strand; PAM type: NRG; PAM sequence: AGG
agatttcaagaatgagggaa

SEQ ID NO: 152681 - DNA, 20 bp, Artificial Sequence
  Description of Artificial Sequence: Synthetic oligonucleotide
  Target: ATXN1; (+) strand; PAM type: NRG; PAM sequence: TAG
tttcaagaatgagggaaagg

SEQ ID NO: 152682 - DNA, 20 bp, Artificial Sequence
  Description of Artificial Sequence: Synthetic oligonucleotide
  Target: ATXN1; (+) strand; PAM type: NRG; PAM sequence: CAG
aagaatgagggaaaggtagc

SEQ ID NO: 152683 - DNA, 20 bp, Artificial Sequence
  Description of Artificial Sequence: Synthetic oligonucleotide
  Target: ATXN1; (+) strand; PAM type: NRG; PAM sequence: CAG
atgagggaaaggtagccaga

SEQ ID NO: 152684 - DNA, 20 bp, Artificial Sequence
  Description of Artificial Sequence: Synthetic oligonucleotide
  Target: ATXN1; (+) strand; PAM type: NRG; PAM sequence: CAG
ggaaaggtagccagacagtg

SEQ ID NO: 152685 - DNA, 20 bp, Artificial Sequence
  Description of Artificial Sequence: Synthetic oligonucleotide
  Target: ATXN1; (+) strand; PAM type: NRG; PAM sequence: GAG
aaaggtagccagacagtgca

SEQ ID NO: 152686 - DNA, 20 bp, Artificial Sequence
  Description of Artificial Sequence: Synthetic oligonucleotide
  Target: ATXN1; (+) strand; PAM type: NRG; PAM sequence: GAG
aggtagccagacagtgcaga

SEQ ID NO: 152687 - DNA, 20 bp, Artificial Sequence
  Description of Artificial Sequence: Synthetic oligonucleotide
  Target: ATXN1; (+) strand; PAM type: NRG; PAM sequence: GAG
gtagccagacagtgcagaga

SEQ ID NO: 152688 - DNA, 20 bp, Artificial Sequence
  Description of Artificial Sequence: Synthetic oligonucleotide
  Target: ATXN1; (+) strand; PAM type: NRG; PAM sequence: AGG
tagccagacagtgcagagag

SEQ ID NO: 152689 - DNA, 20 bp, Artificial Sequence
  Description of Artificial Sequence: Synthetic oligonucleotide
  Target: ATXN1; (+) strand; PAM type: NRG; PAM sequence: GAG
gccagacagtgcagagagag

SEQ ID NO: 152690 - DNA, 20 bp, Artificial Sequence
  Description of Artificial Sequence: Synthetic oligonucleotide
  Target: ATXN1; (+) strand; PAM type: NRG; PAM sequence: TGG
gacagtgcagagagaggagc

SEQ ID NO: 152691 - DNA, 20 bp, Artificial Sequence
  Description of Artificial Sequence: Synthetic oligonucleotide
  Target: ATXN1; (+) strand; PAM type: NRG; PAM sequence: GGG
acagtgcagagagaggagct

SEQ ID NO: 152692 - DNA, 20 bp, Artificial Sequence
  Description of Artificial Sequence: Synthetic oligonucleotide
  Target: ATXN1; (+) strand; PAM type: NRG; PAM sequence: AAG
agagagaggagctgggttct

SEQ ID NO: 152693 - DNA, 20 bp, Artificial Sequence
  Description of Artificial Sequence: Synthetic oligonucleotide
  Target: ATXN1; (+) strand; PAM type: NRG; PAM sequence: AGG
gagagaggagctgggttcta

SEQ ID NO: 152694 - DNA, 20 bp, Artificial Sequence
  Description of Artificial Sequence: Synthetic oligonucleotide
  Target: ATXN1; (+) strand; PAM type: NRG; PAM sequence: GAG
gagaggagctgggttctaag

SEQ ID NO: 152695 - DNA, 20 bp, Artificial Sequence
  Description of Artificial Sequence: Synthetic oligonucleotide
  Target: ATXN1; (+) strand; PAM type: NRG; PAM sequence: AGG
agaggagctgggttctaagg

SEQ ID NO: 152696 - DNA, 20 bp, Artificial Sequence
  Description of Artificial Sequence: Synthetic oligonucleotide
  Target: ATXN1; (+) strand; PAM type: NRG; PAM sequence: AAG
ggagctgggttctaaggagg

SEQ ID NO: 152697 - DNA, 20 bp, Artificial Sequence
  Description of Artificial Sequence: Synthetic oligonucleotide
  Target: ATXN1; (+) strand; PAM type: NRG; PAM sequence: AAG
gaggaagaacaacatgtcta

SEQ ID NO: 152698 - DNA, 20 bp, Artificial Sequence
  Description of Artificial Sequence: Synthetic oligonucleotide
  Target: ATXN1; (+) strand; PAM type: NRG; PAM sequence: AGG
aggaagaacaacatgtctaa

SEQ ID NO: 152699 - DNA, 20 bp, Artificial Sequence
  Description of Artificial Sequence: Synthetic oligonucleotide
  Target: ATXN1; (+) strand; PAM type: NRG; PAM sequence: TGG
agaacaacatgtctaaaggc

SEQ ID NO: 152700 - DNA, 20 bp, Artificial Sequence
  Description of Artificial Sequence: Synthetic oligonucleotide
  Target: ATXN1; (+) strand; PAM type: NRG; PAM sequence: GAG
aacaacatgtctaaaggctg

SEQ ID NO: 152701 - DNA, 20 bp, Artificial Sequence
  Description of Artificial Sequence: Synthetic oligonucleotide
  Target: ATXN1; (+) strand; PAM type: NRG; PAM sequence: CAG
ctaaaggctggagcaaaaaa

SEQ ID NO: 152702 - DNA, 20 bp, Artificial Sequence
  Description of Artificial Sequence: Synthetic oligonucleotide
  Target: ATXN1; (+) strand; PAM type: NRG; PAM sequence: GAG
aaaggctggagcaaaaaaca

SEQ ID NO: 152703 - DNA, 20 bp, Artificial Sequence
  Description of Artificial Sequence: Synthetic oligonucleotide
  Target: ATXN1; (+) strand; PAM type: NRG; PAM sequence: TGG
ctggagcaaaaaacagagta

SEQ ID NO: 152704 - DNA, 20 bp, Artificial Sequence
  Description of Artificial Sequence: Synthetic oligonucleotide
  Target: ATXN1; (+) strand; PAM type: NRG; PAM sequence: AAG
aaaacagagtatggcacttg

SEQ ID NO: 152705 - DNA, 20 bp, Artificial Sequence
  Description of Artificial Sequence: Synthetic oligonucleotide
  Target: ATXN1; (+) strand; PAM type: NRG; PAM sequence: AGG
aaacagagtatggcacttga

SEQ ID NO: 152706 - DNA, 20 bp, Artificial Sequence
  Description of Artificial Sequence: Synthetic oligonucleotide
  Target: ATXN1; (+) strand; PAM type: NRG; PAM sequence: GAG
acagagtatggcacttgaag

SEQ ID NO: 152707 - DNA, 20 bp, Artificial Sequence
  Description of Artificial Sequence: Synthetic oligonucleotide
  Target: ATXN1; (+) strand; PAM type: NRG; PAM sequence: AGG
cagagtatggcacttgaagg

SEQ ID NO: 152708 - DNA, 20 bp, Artificial Sequence
  Description of Artificial Sequence: Synthetic oligonucleotide
  Target: ATXN1; (+) strand; PAM type: NRG; PAM sequence: AAG
agtatggcacttgaaggagg

SEQ ID NO: 152709 - DNA, 20 bp, Artificial Sequence
  Description of Artificial Sequence: Synthetic oligonucleotide
  Target: ATXN1; (+) strand; PAM type: NRG; PAM sequence: TGG
acttgaaggaggaagtgcga

SEQ ID NO: 152710 - DNA, 20 bp, Artificial Sequence
  Description of Artificial Sequence: Synthetic oligonucleotide
  Target: ATXN1; (+) strand; PAM type: NRG; PAM sequence: GGG
cttgaaggaggaagtgcgat

SEQ ID NO: 152711 - DNA, 20 bp, Artificial Sequence
  Description of Artificial Sequence: Synthetic oligonucleotide
  Target: ATXN1; (+) strand; PAM type: NRG; PAM sequence: TGG
gaagtgcgatgggaccgacg

SEQ ID NO: 152712 - DNA, 20 bp, Artificial Sequence
  Description of Artificial Sequence: Synthetic oligonucleotide
  Target: ATXN1; (+) strand; PAM type: NRG; PAM sequence: GGG
aagtgcgatgggaccgacgt

SEQ ID NO: 152713 - DNA, 20 bp, Artificial Sequence
  Description of Artificial Sequence: Synthetic oligonucleotide
  Target: ATXN1; (+) strand; PAM type: NRG; PAM sequence: CAG
ggaccgacgtgggacgaata

SEQ ID NO: 152714 - DNA, 20 bp, Artificial Sequence
  Description of Artificial Sequence: Synthetic oligonucleotide
  Target: ATXN1; (+) strand; PAM type: NRG; PAM sequence: AGG
gaccgacgtgggacgaatac

SEQ ID NO: 152715 - DNA, 20 bp, Artificial Sequence
  Description of Artificial Sequence: Synthetic oligonucleotide
  Target: ATXN1; (+) strand; PAM type: NRG; PAM sequence: GGG
accgacgtgggacgaataca

SEQ ID NO: 152716 - DNA, 20 bp, Artificial Sequence
  Description of Artificial Sequence: Synthetic oligonucleotide
  Target: ATXN1; (+) strand; PAM type: NRG; PAM sequence: GAG
acgaatacagggcaacatgt

SEQ ID NO: 152717 - DNA, 20 bp, Artificial Sequence
  Description of Artificial Sequence: Synthetic oligonucleotide
  Target: ATXN1; (+) strand; PAM type: NRG; PAM sequence: GAG
cagggcaacatgtgagtgat

SEQ ID NO: 152718 - DNA, 20 bp, Artificial Sequence
  Description of Artificial Sequence: Synthetic oligonucleotide
  Target: ATXN1; (+) strand; PAM type: NRG; PAM sequence: AGG
agggcaacatgtgagtgatg

SEQ ID NO: 152719 - DNA, 20 bp, Artificial Sequence
  Description of Artificial Sequence: Synthetic oligonucleotide
  Target: ATXN1; (+) strand; PAM type: NRG; PAM sequence: TGG
caacatgtgagtgatgaggc

SEQ ID NO: 152720 - DNA, 20 bp, Artificial Sequence
  Description of Artificial Sequence: Synthetic oligonucleotide
  Target: ATXN1; (+) strand; PAM type: NRG; PAM sequence: GAG
acatgtgagtgatgaggctg

SEQ ID NO: 152721 - DNA, 20 bp, Artificial Sequence
  Description of Artificial Sequence: Synthetic oligonucleotide
  Target: ATXN1; (+) strand; PAM type: NRG; PAM sequence: GAG
atgtgagtgatgaggctgga

SEQ ID NO: 152722 - DNA, 20 bp, Artificial Sequence
  Description of Artificial Sequence: Synthetic oligonucleotide
  Target: ATXN1; (+) strand; PAM type: NRG; PAM sequence: AAG
agtgatgaggctggagagat

SEQ ID NO: 152723 - DNA, 20 bp, Artificial Sequence
  Description of Artificial Sequence: Synthetic oligonucleotide
  Target: ATXN1; (+) strand; PAM type: NRG; PAM sequence: AGG
gtgatgaggctggagagata

SEQ ID NO: 152724 - DNA, 20 bp, Artificial Sequence
  Description of Artificial Sequence: Synthetic oligonucleotide
  Target: ATXN1; (+) strand; PAM type: NRG; PAM sequence: AAG
atgaggctggagagataagg

SEQ ID NO: 152725 - DNA, 20 bp, Artificial Sequence
  Description of Artificial Sequence: Synthetic oligonucleotide
  Target: ATXN1; (+) strand; PAM type: NRG; PAM sequence: AGG
tgaggctggagagataagga

SEQ ID NO: 152726 - DNA, 20 bp, Artificial Sequence
  Description of Artificial Sequence: Synthetic oligonucleotide
  Target: ATXN1; (+) strand; PAM type: NRG; PAM sequence: TGG
aggaaggtcctcaaaaccta

SEQ ID NO: 152727 - DNA, 20 bp, Artificial Sequence
  Description of Artificial Sequence: Synthetic oligonucleotide
  Target: ATXN1; (+) strand; PAM type: NRG; PAM sequence: GAG
gaaggtcctcaaaacctatg

SEQ ID NO: 152728 - DNA, 20 bp, Artificial Sequence
  Description of Artificial Sequence: Synthetic oligonucleotide
  Target: ATXN1; (+) strand; PAM type: NRG; PAM sequence: CAG
gtcctcaaaacctatggagc

SEQ ID NO: 152729 - DNA, 20 bp, Artificial Sequence
  Description of Artificial Sequence: Synthetic oligonucleotide
  Target: ATXN1; (+) strand; PAM type: NRG; PAM sequence: AGG
tcctcaaaacctatggagcc

SEQ ID NO: 152730 - DNA, 20 bp, Artificial Sequence
  Description of Artificial Sequence: Synthetic oligonucleotide
  Target: ATXN1; (+) strand; PAM type: NRG; PAM sequence: AAG
aaaacctatggagccaggct

SEQ ID NO: 152731 - DNA, 20 bp, Artificial Sequence
  Description of Artificial Sequence: Synthetic oligonucleotide
  Target: ATXN1; (+) strand; PAM type: NRG; PAM sequence: AGG
aaacctatggagccaggcta

SEQ ID NO: 152732 - DNA, 20 bp, Artificial Sequence
  Description of Artificial Sequence: Synthetic oligonucleotide
  Target: ATXN1; (+) strand; PAM type: NRG; PAM sequence: TAG
tggagccaggctaaggattc

SEQ ID NO: 152733 - DNA, 20 bp, Artificial Sequence
  Description of Artificial Sequence: Synthetic oligonucleotide
  Target: ATXN1; (+) strand; PAM type: NRG; PAM sequence: GAG
aggattctagactttatcct

SEQ ID NO: 152734 - DNA, 20 bp, Artificial Sequence
  Description of Artificial Sequence: Synthetic oligonucleotide
  Target: ATXN1; (+) strand; PAM type: NRG; PAM sequence: AGG
ggattctagactttatcctg

SEQ ID NO: 152735 - DNA, 20 bp, Artificial Sequence
  Description of Artificial Sequence: Synthetic oligonucleotide
  Target: ATXN1; (+) strand; PAM type: NRG; PAM sequence: GAG
gactttatcctgaggaccat

SEQ ID NO: 152736 - DNA, 20 bp, Artificial Sequence
  Description of Artificial Sequence: Synthetic oligonucleotide
  Target: ATXN1; (+) strand; PAM type: NRG; PAM sequence: CAG
tcctgaggaccatgagaacc

SEQ ID NO: 152737 - DNA, 20 bp, Artificial Sequence
  Description of Artificial Sequence: Synthetic oligonucleotide
  Target: ATXN1; (+) strand; PAM type: NRG; PAM sequence: AGG
cctgaggaccatgagaaccc

SEQ ID NO: 152738 - DNA, 20 bp, Artificial Sequence
  Description of Artificial Sequence: Synthetic oligonucleotide
  Target: ATXN1; (+) strand; PAM type: NRG; PAM sequence: GGG
ctgaggaccatgagaaccca

SEQ ID NO: 152739 - DNA, 20 bp, Artificial Sequence
  Description of Artificial Sequence: Synthetic oligonucleotide
  Target: ATXN1; (+) strand; PAM type: NRG; PAM sequence: GAG
gaggaccatgagaacccagg

SEQ ID NO: 152740 - DNA, 20 bp, Artificial Sequence
  Description of Artificial Sequence: Synthetic oligonucleotide
  Target: ATXN1; (+) strand; PAM type: NRG; PAM sequence: AGG
aggaccatgagaacccaggg

SEQ ID NO: 152741 - DNA, 20 bp, Artificial Sequence
  Description of Artificial Sequence: Synthetic oligonucleotide
  Target: ATXN1; (+) strand; PAM type: NRG; PAM sequence: GGG
ggaccatgagaacccaggga

SEQ ID NO: 152742 - DNA, 20 bp, Artificial Sequence
  Description of Artificial Sequence: Synthetic oligonucleotide
  Target: ATXN1; (+) strand; PAM type: NRG; PAM sequence: GAG
accatgagaacccagggagg

SEQ ID NO: 152743 - DNA, 20 bp, Artificial Sequence
  Description of Artificial Sequence: Synthetic oligonucleotide
  Target: ATXN1; (+) strand; PAM type: NRG; PAM sequence: AAG
gagaacccagggagggagtt

SEQ ID NO: 152744 - DNA, 20 bp, Artificial Sequence
  Description of Artificial Sequence: Synthetic oligonucleotide
  Target: ATXN1; (+) strand; PAM type: NRG; PAM sequence: CAG
agggagggagttaagaaaaa

SEQ ID NO: 152745 - DNA, 20 bp, Artificial Sequence
  Description of Artificial Sequence: Synthetic oligonucleotide
  Target: ATXN1; (+) strand; PAM type: NRG; PAM sequence: GAG
ggagggagttaagaaaaaca

SEQ ID NO: 152746 - DNA, 20 bp, Artificial Sequence
  Description of Artificial Sequence: Synthetic oligonucleotide
  Target: ATXN1; (+) strand; PAM type: NRG; PAM sequence: CAG
gttaagaaaaacagagatgt

SEQ ID NO: 152747 - DNA, 20 bp, Artificial Sequence
  Description of Artificial Sequence: Synthetic oligonucleotide
  Target: ATXN1; (+) strand; PAM type: NRG; PAM sequence: CAG
aagaaaaacagagatgtcag

SEQ ID NO: 152748 - DNA, 20 bp, Artificial Sequence
  Description of Artificial Sequence: Synthetic oligonucleotide
  Target: ATXN1; (+) strand; PAM type: NRG; PAM sequence: TGG
atactaacaaatgttcattt

SEQ ID NO: 152749 - DNA, 20 bp, Artificial Sequence
  Description of Artificial Sequence: Synthetic oligonucleotide
  Target: ATXN1; (+) strand; PAM type: NRG; PAM sequence: AAG
aaatgttcattttggcttca

SEQ ID NO: 152750 - DNA, 20 bp, Artificial Sequence
  Description of Artificial Sequence: Synthetic oligonucleotide
  Target: ATXN1; (+) strand; PAM type: NRG; PAM sequence: GAG
atgttcattttggcttcaaa

SEQ ID NO: 152751 - DNA, 20 bp, Artificial Sequence
  Description of Artificial Sequence: Synthetic oligonucleotide
  Target: ATXN1; (+) strand; PAM type: NRG; PAM sequence: AGG
tgttcattttggcttcaaag

SEQ ID NO: 152752 - DNA, 20 bp, Artificial Sequence
  Description of Artificial Sequence: Synthetic oligonucleotide
  Target: ATXN1; (+) strand; PAM type: NRG; PAM sequence: TGG
ttcaaagaggaaaaacatgt

SEQ ID NO: 152753 - DNA, 20 bp, Artificial Sequence
  Description of Artificial Sequence: Synthetic oligonucleotide
  Target: ATXN1; (+) strand; PAM type: NRG; PAM sequence: CAG
agaggaaaaacatgttggac

SEQ ID NO: 152754 - DNA, 20 bp, Artificial Sequence
  Description of Artificial Sequence: Synthetic oligonucleotide
  Target: ATXN1; (+) strand; PAM type: NRG; PAM sequence: TAG
gaccagaacaacaatacatc

SEQ ID NO: 152755 - DNA, 20 bp, Artificial Sequence
  Description of Artificial Sequence: Synthetic oligonucleotide
  Target: ATXN1; (+) strand; PAM type: NRG; PAM sequence: CAG
agaacaacaatacatctaga

SEQ ID NO: 152756 - DNA, 20 bp, Artificial Sequence
  Description of Artificial Sequence: Synthetic oligonucleotide
  Target: ATXN1; (+) strand; PAM type: NRG; PAM sequence: AGG
gaacaacaatacatctagac

SEQ ID NO: 152757 - DNA, 20 bp, Artificial Sequence
  Description of Artificial Sequence: Synthetic oligonucleotide
  Target: ATXN1; (+) strand; PAM type: NRG; PAM sequence: TAG
atacatctagacaggccatt

SEQ ID NO: 152758 - DNA, 20 bp, Artificial Sequence
  Description of Artificial Sequence: Synthetic oligonucleotide
  Target: ATXN1; (+) strand; PAM type: NRG; PAM sequence: AGG
tacatctagacaggccattt

SEQ ID NO: 152759 - DNA, 20 bp, Artificial Sequence
  Description of Artificial Sequence: Synthetic oligonucleotide
  Target: ATXN1; (+) strand; PAM type: NRG; PAM sequence: GAG
catctagacaggccatttag

SEQ ID NO: 152760 - DNA, 20 bp, Artificial Sequence
  Description of Artificial Sequence: Synthetic oligonucleotide
  Target: ATXN1; (+) strand; PAM type: NRG; PAM sequence: AGG
atctagacaggccatttagg

SEQ ID NO: 152761 - DNA, 20 bp, Artificial Sequence
  Description of Artificial Sequence: Synthetic oligonucleotide
  Target: ATXN1; (+) strand; PAM type: NRG; PAM sequence: CAG
tatcatatgccaaaccaccc

SEQ ID NO: 152762 - DNA, 20 bp, Artificial Sequence
  Description of Artificial Sequence: Synthetic oligonucleotide
  Target: ATXN1; (+) strand; PAM type: NRG; PAM sequence: CAG
tatgccaaaccaccccagct

SEQ ID NO: 152763 - DNA, 20 bp, Artificial Sequence
  Description of Artificial Sequence: Synthetic oligonucleotide
  Target: ATXN1; (+) strand; PAM type: NRG; PAM sequence: CAG
gccaaaccaccccagctcag

SEQ ID NO: 152764 - DNA, 20 bp, Artificial Sequence
  Description of Artificial Sequence: Synthetic oligonucleotide
  Target: ATXN1; (+) strand; PAM type: NRG; PAM sequence: GAG
caaaccaccccagctcagca

SEQ ID NO: 152765 - DNA, 20 bp, Artificial Sequence
  Description of Artificial Sequence: Synthetic oligonucleotide
  Target: ATXN1; (+) strand; PAM type: NRG; PAM sequence: CAG
cccagctcagcagagccact

SEQ ID NO: 152766 - DNA, 20 bp, Artificial Sequence
  Description of Artificial Sequence: Synthetic oligonucleotide
  Target: ATXN1; (+) strand; PAM type: NRG; PAM sequence: GAG
tcagctaaaactcacacttt

SEQ ID NO: 152767 - DNA, 20 bp, Artificial Sequence
  Description of Artificial Sequence: Synthetic oligonucleotide
  Target: ATXN1; (+) strand; PAM type: NRG; PAM sequence: CAG
taaaactcacactttgagac

SEQ ID NO: 152768 - DNA, 20 bp, Artificial Sequence
  Description of Artificial Sequence: Synthetic oligonucleotide
  Target: ATXN1; (+) strand; PAM type: NRG; PAM sequence: TAG
tcctcaaaaaattcaatccc

SEQ ID NO: 152769 - DNA, 20 bp, Artificial Sequence
  Description of Artificial Sequence: Synthetic oligonucleotide
  Target: ATXN1; (+) strand; PAM type: NRG; PAM sequence: AGG
cctcaaaaaattcaatccct

SEQ ID NO: 152770 - DNA, 20 bp, Artificial Sequence
  Description of Artificial Sequence: Synthetic oligonucleotide
  Target: ATXN1; (+) strand; PAM type: NRG; PAM sequence: AAG
caaaaaattcaatccctagg

SEQ ID NO: 152771 - DNA, 20 bp, Artificial Sequence
  Description of Artificial Sequence: Synthetic oligonucleotide
  Target: ATXN1; (+) strand; PAM type: NRG; PAM sequence: TGG
agttgttcccaaccttccac

SEQ ID NO: 152772 - DNA, 20 bp, Artificial Sequence
  Description of Artificial Sequence: Synthetic oligonucleotide
  Target: ATXN1; (+) strand; PAM type: NRG; PAM sequence: AAG
tgttcccaaccttccactgg

SEQ ID NO: 152773 - DNA, 20 bp, Artificial Sequence
  Description of Artificial Sequence: Synthetic oligonucleotide
  Target: ATXN1; (+) strand; PAM type: NRG; PAM sequence: GAG
ttcccaaccttccactggaa

SEQ ID NO: 152774 - DNA, 20 bp, Artificial Sequence
  Description of Artificial Sequence: Synthetic oligonucleotide
  Target: ATXN1; (+) strand; PAM type: NRG; PAM sequence: CGG
tccactggaagagctatccc

SEQ ID NO: 152775 - DNA, 20 bp, Artificial Sequence
  Description of Artificial Sequence: Synthetic oligonucleotide
  Target: ATXN1; (+) strand; PAM type: NRG; PAM sequence: GAG
cactggaagagctatccccg

SEQ ID NO: 152776 - DNA, 20 bp, Artificial Sequence
  Description of Artificial Sequence: Synthetic oligonucleotide
  Target: ATXN1; (+) strand; PAM type: NRG; PAM sequence: AAG
tggaagagctatccccggag

SEQ ID NO: 152777 - DNA, 20 bp, Artificial Sequence
  Description of Artificial Sequence: Synthetic oligonucleotide
  Target: ATXN1; (+) strand; PAM type: NRG; PAM sequence: GAG
gaagagctatccccggagaa

SEQ ID NO: 152778 - DNA, 20 bp, Artificial Sequence
  Description of Artificial Sequence: Synthetic oligonucleotide
  Target: ATXN1; (+) strand; PAM type: NRG; PAM sequence: CAG
tccccggagaagagctacaa

SEQ ID NO: 152779 - DNA, 20 bp, Artificial Sequence
  Description of Artificial Sequence: Synthetic oligonucleotide
  Target: ATXN1; (+) strand; PAM type: NRG; PAM sequence: AGG
ccccggagaagagctacaac

SEQ ID NO: 152780 - DNA, 20 bp, Artificial Sequence
  Description of Artificial Sequence: Synthetic oligonucleotide
  Target: ATXN1; (+) strand; PAM type: NRG; PAM sequence: AAG
ggagaagagctacaacagga

SEQ ID NO: 152781 - DNA, 20 bp, Artificial Sequence
  Description of Artificial Sequence: Synthetic oligonucleotide
  Target: ATXN1; (+) strand; PAM type: NRG; PAM sequence: AGG
gagaagagctacaacaggaa

SEQ ID NO: 152782 - DNA, 20 bp, Artificial Sequence
  Description of Artificial Sequence: Synthetic oligonucleotide
  Target: ATXN1; (+) strand; PAM type: NRG; PAM sequence: CAG
agctacaacaggaaaggaat

SEQ ID NO: 152783 - DNA, 20 bp, Artificial Sequence
  Description of Artificial Sequence: Synthetic oligonucleotide
  Target: ATXN1; (+) strand; PAM type: NRG; PAM sequence: AGG
gctacaacaggaaaggaatc

SEQ ID NO: 152784 - DNA, 20 bp, Artificial Sequence
  Description of Artificial Sequence: Synthetic oligonucleotide
  Target: ATXN1; (+) strand; PAM type: NRG; PAM sequence: GGG
ctacaacaggaaaggaatca

SEQ ID NO: 152785 - DNA, 20 bp, Artificial Sequence
  Description of Artificial Sequence: Synthetic oligonucleotide
  Target: ATXN1; (+) strand; PAM type: NRG; PAM sequence: TAG
caacaggaaaggaatcaggg

SEQ ID NO: 152786 - DNA, 20 bp, Artificial Sequence
  Description of Artificial Sequence: Synthetic oligonucleotide
  Target: ATXN1; (+) strand; PAM type: NRG; PAM sequence: TGG
agggtagcatcgtgcctctc

SEQ ID NO: 152787 - DNA, 20 bp, Artificial Sequence
  Description of Artificial Sequence: Synthetic oligonucleotide
  Target: ATXN1; (+) strand; PAM type: NRG; PAM sequence: TGG
gtgcctctctggttcctaca

SEQ ID NO: 152788 - DNA, 20 bp, Artificial Sequence
  Description of Artificial Sequence: Synthetic oligonucleotide
  Target: ATXN1; (+) strand; PAM type: NRG; PAM sequence: CAG
gttcctacatggatgaaaac

SEQ ID NO: 152789 - DNA, 20 bp, Artificial Sequence
  Description of Artificial Sequence: Synthetic oligonucleotide
  Target: ATXN1; (+) strand; PAM type: NRG; PAM sequence: AAG
catggatgaaaaccagcgcc

SEQ ID NO: 152790 - DNA, 20 bp, Artificial Sequence
  Description of Artificial Sequence: Synthetic oligonucleotide
  Target: ATXN1; (+) strand; PAM type: NRG; PAM sequence: AGG
atggatgaaaaccagcgcca

SEQ ID NO: 152791 - DNA, 20 bp, Artificial Sequence
  Description of Artificial Sequence: Synthetic oligonucleotide
  Target: ATXN1; (+) strand; PAM type: NRG; PAM sequence: GAG
ggatgaaaaccagcgccaag

SEQ ID NO: 152792 - DNA, 20 bp, Artificial Sequence
  Description of Artificial Sequence: Synthetic oligonucleotide
  Target: ATXN1; (+) strand; PAM type: NRG; PAM sequence: TAG
gcgccaaggagcccattcct

SEQ ID NO: 152793 - DNA, 20 bp, Artificial Sequence
  Description of Artificial Sequence: Synthetic oligonucleotide
  Target: ATXN1; (+) strand; PAM type: NRG; PAM sequence: CAG
ccaaggagcccattccttag

SEQ ID NO: 152794 - DNA, 20 bp, Artificial Sequence
  Description of Artificial Sequence: Synthetic oligonucleotide
  Target: ATXN1; (+) strand; PAM type: NRG; PAM sequence: AGG
caaggagcccattccttagc

SEQ ID NO: 152795 - DNA, 20 bp, Artificial Sequence
  Description of Artificial Sequence: Synthetic oligonucleotide
  Target: ATXN1; (+) strand; PAM type: NRG; PAM sequence: GGG
aaggagcccattccttagca

SEQ ID NO: 152796 - DNA, 20 bp, Artificial Sequence
  Description of Artificial Sequence: Synthetic oligonucleotide
  Target: ATXN1; (+) strand; PAM type: NRG; PAM sequence: CAG
gagcccattccttagcaggg

SEQ ID NO: 152797 - DNA, 20 bp, Artificial Sequence
  Description of Artificial Sequence: Synthetic oligonucleotide
  Target: ATXN1; (+) strand; PAM type: NRG; PAM sequence: TAG
tagcagggcagcctgctacg

SEQ ID NO: 152798 - DNA, 20 bp, Artificial Sequence
  Description of Artificial Sequence: Synthetic oligonucleotide
  Target: ATXN1; (+) strand; PAM type: NRG; PAM sequence: CAG
cagggcagcctgctacgtag

SEQ ID NO: 152799 - DNA, 20 bp, Artificial Sequence
  Description of Artificial Sequence: Synthetic oligonucleotide
  Target: ATXN1; (+) strand; PAM type: NRG; PAM sequence: AAG
ctgctacgtagcagaaatgt

SEQ ID NO: 152800 - DNA, 20 bp, Artificial Sequence
  Description of Artificial Sequence: Synthetic oligonucleotide
  Target: ATXN1; (+) strand; PAM type: NRG; PAM sequence: CAG
tacgtagcagaaatgtaaga

SEQ ID NO: 152801 - DNA, 20 bp, Artificial Sequence
  Description of Artificial Sequence: Synthetic oligonucleotide
  Target: ATXN1; (+) strand; PAM type: NRG; PAM sequence: AAG
gtagcagaaatgtaagacag

SEQ ID NO: 152802 - DNA, 20 bp, Artificial Sequence
  Description of Artificial Sequence: Synthetic oligonucleotide
  Target: ATXN1; (+) strand; PAM type: NRG; PAM sequence: AAG
aatgtaagacagaagttgta

SEQ ID NO: 152803 - DNA, 20 bp, Artificial Sequence
  Description of Artificial Sequence: Synthetic oligonucleotide
  Target: ATXN1; (+) strand; PAM type: NRG; PAM sequence: CAG
agttgtaaagaccccgaccc

SEQ ID NO: 152804 - DNA, 20 bp, Artificial Sequence
  Description of Artificial Sequence: Synthetic oligonucleotide
  Target: ATXN1; (+) strand; PAM type: NRG; PAM sequence: GAG
ttgtaaagaccccgacccca

SEQ ID NO: 152805 - DNA, 20 bp, Artificial Sequence
  Description of Artificial Sequence: Synthetic oligonucleotide
  Target: ATXN1; (+) strand; PAM type: NRG; PAM sequence: TGG
agaccccgaccccagagact

SEQ ID NO: 152806 - DNA, 20 bp, Artificial Sequence
  Description of Artificial Sequence: Synthetic oligonucleotide
  Target: ATXN1; (+) strand; PAM type: NRG; PAM sequence: TGG
gaccccagagacttggataa

SEQ ID NO: 152807 - DNA, 20 bp, Artificial Sequence
  Description of Artificial Sequence: Synthetic oligonucleotide
  Target: ATXN1; (+) strand; PAM type: NRG; PAM sequence: TAG
ccagagacttggataatggt

SEQ ID NO: 152808 - DNA, 20 bp, Artificial Sequence
  Description of Artificial Sequence: Synthetic oligonucleotide
  Target: ATXN1; (+) strand; PAM type: NRG; PAM sequence: TGG
cttggataatggttagactt

SEQ ID NO: 152809 - DNA, 20 bp, Artificial Sequence
  Description of Artificial Sequence: Synthetic oligonucleotide
  Target: ATXN1; (+) strand; PAM type: NRG; PAM sequence: CAG
gataatggttagactttggc

SEQ ID NO: 152810 - DNA, 20 bp, Artificial Sequence
  Description of Artificial Sequence: Synthetic oligonucleotide
  Target: ATXN1; (+) strand; PAM type: NRG; PAM sequence: AGG
ataatggttagactttggcc

SEQ ID NO: 152811 - DNA, 20 bp, Artificial Sequence
  Description of Artificial Sequence: Synthetic oligonucleotide
  Target: ATXN1; (+) strand; PAM type: NRG; PAM sequence: GAG
gttagactttggccaggcct

SEQ ID NO: 152812 - DNA, 20 bp, Artificial Sequence
  Description of Artificial Sequence: Synthetic oligonucleotide
  Target: ATXN1; (+) strand; PAM type: NRG; PAM sequence: TAG
agattcctgactgatctctc

SEQ ID NO: 152813 - DNA, 20 bp, Artificial Sequence
  Description of Artificial Sequence: Synthetic oligonucleotide
  Target: ATXN1; (+) strand; PAM type: NRG; PAM sequence: AGG
gattcctgactgatctctct

SEQ ID NO: 152814 - DNA, 20 bp, Artificial Sequence
  Description of Artificial Sequence: Synthetic oligonucleotide
  Target: ATXN1; (+) strand; PAM type: NRG; PAM sequence: TAG
tgactgatctctctaggccc

SEQ ID NO: 152815 - DNA, 20 bp, Artificial Sequence
  Description of Artificial Sequence: Synthetic oligonucleotide
  Target: ATXN1; (+) strand; PAM type: NRG; PAM sequence: CAG
tgatctctctaggccctagt

SEQ ID NO: 152816 - DNA, 20 bp, Artificial Sequence
  Description of Artificial Sequence: Synthetic oligonucleotide
  Target: ATXN1; (+) strand; PAM type: NRG; PAM sequence: AGG
gatctctctaggccctagtc

SEQ ID NO: 152817 - DNA, 20 bp, Artificial Sequence
  Description of Artificial Sequence: Synthetic oligonucleotide
  Target: ATXN1; (+) strand; PAM type: NRG; PAM sequence: GGG
atctctctaggccctagtca

SEQ ID NO: 152818 - DNA, 20 bp, Artificial Sequence
  Description of Artificial Sequence: Synthetic oligonucleotide
  Target: ATXN1; (+) strand; PAM type: NRG; PAM sequence: GAG
ctctctaggccctagtcagg

SEQ ID NO: 152819 - DNA, 20 bp, Artificial Sequence
  Description of Artificial Sequence: Synthetic oligonucleotide
  Target: ATXN1; (+) strand; PAM type: NRG; PAM sequence: AGG
tctctaggccctagtcaggg

SEQ ID NO: 152820 - DNA, 20 bp, Artificial Sequence
  Description of Artificial Sequence: Synthetic oligonucleotide
  Target: ATXN1; (+) strand; PAM type: NRG; PAM sequence: CAG
gccctagtcagggaggctgc

SEQ ID NO: 152821 - DNA, 20 bp, Artificial Sequence
  Description of Artificial Sequence: Synthetic oligonucleotide
  Target: ATXN1; (+) strand; PAM type: NRG; PAM sequence: CAG
atgtttctacccactgctcc

SEQ ID NO: 152822 - DNA, 20 bp, Artificial Sequence
  Description of Artificial Sequence: Synthetic oligonucleotide
  Target: ATXN1; (+) strand; PAM type: NRG; PAM sequence: AGG
tgtttctacccactgctccc

SEQ ID NO: 152823 - DNA, 20 bp, Artificial Sequence
  Description of Artificial Sequence: Synthetic oligonucleotide
  Target: ATXN1; (+) strand; PAM type: NRG; PAM sequence: CAG
tctacccactgctcccagga

SEQ ID NO: 152824 - DNA, 20 bp, Artificial Sequence
  Description of Artificial Sequence: Synthetic oligonucleotide
  Target: ATXN1; (+) strand; PAM type: NRG; PAM sequence: AGG
ctacccactgctcccaggac

SEQ ID NO: 152825 - DNA, 20 bp, Artificial Sequence
  Description of Artificial Sequence: Synthetic oligonucleotide
  Target: ATXN1; (+) strand; PAM type: NRG; PAM sequence: GGG
tacccactgctcccaggaca

SEQ ID NO: 152826 - DNA, 20 bp, Artificial Sequence
  Description of Artificial Sequence: Synthetic oligonucleotide
  Target: ATXN1; (+) strand; PAM type: NRG; PAM sequence: GAG
ctcccaggacagggctccct

SEQ ID NO: 152827 - DNA, 20 bp, Artificial Sequence
  Description of Artificial Sequence: Synthetic oligonucleotide
  Target: ATXN1; (+) strand; PAM type: NRG; PAM sequence: CAG
agggctccctgagaaacaca

SEQ ID NO: 152828 - DNA, 20 bp, Artificial Sequence
  Description of Artificial Sequence: Synthetic oligonucleotide
  Target: ATXN1; (+) strand; PAM type: NRG; PAM sequence: AGG
gggctccctgagaaacacac

SEQ ID NO: 152829 - DNA, 20 bp, Artificial Sequence
  Description of Artificial Sequence: Synthetic oligonucleotide
  Target: ATXN1; (+) strand; PAM type: NRG; PAM sequence: CAG
tccctgagaaacacacaggt

SEQ ID NO: 152830 - DNA, 20 bp, Artificial Sequence
  Description of Artificial Sequence: Synthetic oligonucleotide
  Target: ATXN1; (+) strand; PAM type: NRG; PAM sequence: CGG
agaaacacacaggtcagcaa

SEQ ID NO: 152831 - DNA, 20 bp, Artificial Sequence
  Description of Artificial Sequence: Synthetic oligonucleotide
  Target: ATXN1; (+) strand; PAM type: NRG; PAM sequence: GAG
aaacacacaggtcagcaacg

SEQ ID NO: 152832 - DNA, 20 bp, Artificial Sequence
  Description of Artificial Sequence: Synthetic oligonucleotide
  Target: ATXN1; (+) strand; PAM type: NRG; PAM sequence: AGG
aacacacaggtcagcaacgg

SEQ ID NO: 152833 - DNA, 20 bp, Artificial Sequence
  Description of Artificial Sequence: Synthetic oligonucleotide
  Target: ATXN1; (+) strand; PAM type: NRG; PAM sequence: GGG
acacacaggtcagcaacgga

SEQ ID NO: 152834 - DNA, 20 bp, Artificial Sequence
  Description of Artificial Sequence: Synthetic oligonucleotide
  Target: ATXN1; (+) strand; PAM type: NRG; PAM sequence: GAG
caggtcagcaacggagggtt

SEQ ID NO: 152835 - DNA, 20 bp, Artificial Sequence
  Description of Artificial Sequence: Synthetic oligonucleotide
  Target: ATXN1; (+) strand; PAM type: NRG; PAM sequence: TGG
agcaacggagggttgagaac

SEQ ID NO: 152836 - DNA, 20 bp, Artificial Sequence
  Description of Artificial Sequence: Synthetic oligonucleotide
  Target: ATXN1; (+) strand; PAM type: NRG; PAM sequence: GGG
gcaacggagggttgagaact

SEQ ID NO: 152837 - DNA, 20 bp, Artificial Sequence
  Description of Artificial Sequence: Synthetic oligonucleotide
  Target: ATXN1; (+) strand; PAM type: NRG; PAM sequence: CAG
acggagggttgagaactggg

SEQ ID NO: 152838 - DNA, 20 bp, Artificial Sequence
  Description of Artificial Sequence: Synthetic oligonucleotide
  Target: ATXN1; (+) strand; PAM type: NRG; PAM sequence: GAG
ggagggttgagaactgggca

SEQ ID NO: 152839 - DNA, 20 bp, Artificial Sequence
  Description of Artificial Sequence: Synthetic oligonucleotide
  Target: ATXN1; (+) strand; PAM type: NRG; PAM sequence: GAG
agggttgagaactgggcaga

SEQ ID NO: 152840 - DNA, 20 bp, Artificial Sequence
  Description of Artificial Sequence: Synthetic oligonucleotide
  Target: ATXN1; (+) strand; PAM type: NRG; PAM sequence: AGG
gggttgagaactgggcagag

SEQ ID NO: 152841 - DNA, 20 bp, Artificial Sequence
  Description of Artificial Sequence: Synthetic oligonucleotide
  Target: ATXN1; (+) strand; PAM type: NRG; PAM sequence: CAG
actgggcagagaggatgcca

SEQ ID NO: 152842 - DNA, 20 bp, Artificial Sequence
  Description of Artificial Sequence: Synthetic oligonucleotide
  Target: ATXN1; (+) strand; PAM type: NRG; PAM sequence: CAG
ggcagagaggatgccacagc

SEQ ID NO: 152843 - DNA, 20 bp, Artificial Sequence
  Description of Artificial Sequence: Synthetic oligonucleotide
  Target: ATXN1; (+) strand; PAM type: NRG; PAM sequence: AGG
gcagagaggatgccacagcc

SEQ ID NO: 152844 - DNA, 20 bp, Artificial Sequence
  Description of Artificial Sequence: Synthetic oligonucleotide
  Target: ATXN1; (+) strand; PAM type: NRG; PAM sequence: CGG
ggatgccacagccaggaaac

SEQ ID NO: 152845 - DNA, 20 bp, Artificial Sequence
  Description of Artificial Sequence: Synthetic oligonucleotide
  Target: ATXN1; (+) strand; PAM type: NRG; PAM sequence: CAG
ccacagccaggaaaccggca

SEQ ID NO: 152846 - DNA, 20 bp, Artificial Sequence
  Description of Artificial Sequence: Synthetic oligonucleotide
  Target: ATXN1; (+) strand; PAM type: NRG; PAM sequence: AGG
cacagccaggaaaccggcac

SEQ ID NO: 152847 - DNA, 20 bp, Artificial Sequence
  Description of Artificial Sequence: Synthetic oligonucleotide
  Target: ATXN1; (+) strand; PAM type: NRG; PAM sequence: GGG
acagccaggaaaccggcaca

SEQ ID NO: 152848 - DNA, 20 bp, Artificial Sequence
  Description of Artificial Sequence: Synthetic oligonucleotide
  Target: ATXN1; (+) strand; PAM type: NRG; PAM sequence: TGG
gccaggaaaccggcacaggg

SEQ ID NO: 152849 - DNA, 20 bp, Artificial Sequence
  Description of Artificial Sequence: Synthetic oligonucleotide
  Target: ATXN1; (+) strand; PAM type: NRG; PAM sequence: GGG
ccaggaaaccggcacagggt

SEQ ID NO: 152850 - DNA, 20 bp, Artificial Sequence
  Description of Artificial Sequence: Synthetic oligonucleotide
  Target: ATXN1; (+) strand; PAM type: NRG; PAM sequence: GAG
gaaaccggcacagggtgggt

SEQ ID NO: 152851 - DNA, 20 bp, Artificial Sequence
  Description of Artificial Sequence: Synthetic oligonucleotide
  Target: ATXN1; (+) strand; PAM type: NRG; PAM sequence: AAG
gcacagggtgggtgagaatc

SEQ ID NO: 152852 - DNA, 20 bp, Artificial Sequence
  Description of Artificial Sequence: Synthetic oligonucleotide
  Target: ATXN1; (+) strand; PAM type: NRG; PAM sequence: AGG
cacagggtgggtgagaatca

SEQ ID NO: 152853 - DNA, 20 bp, Artificial Sequence
  Description of Artificial Sequence: Synthetic oligonucleotide
  Target: ATXN1; (+) strand; PAM type: NRG; PAM sequence: GAG
cagggtgggtgagaatcaag

SEQ ID NO: 152854 - DNA, 20 bp, Artificial Sequence
  Description of Artificial Sequence: Synthetic oligonucleotide
  Target: ATXN1; (+) strand; PAM type: NRG; PAM sequence: GAG
gtgggtgagaatcaaggagt

SEQ ID NO: 152855 - DNA, 20 bp, Artificial Sequence
  Description of Artificial Sequence: Synthetic oligonucleotide
  Target: ATXN1; (+) strand; PAM type: NRG; PAM sequence: AGG
tgggtgagaatcaaggagtg

SEQ ID NO: 152856 - DNA, 20 bp, Artificial Sequence
  Description of Artificial Sequence: Synthetic oligonucleotide
  Target: ATXN1; (+) strand; PAM type: NRG; PAM sequence: GGG
gggtgagaatcaaggagtga

SEQ ID NO: 152857 - DNA, 20 bp, Artificial Sequence
  Description of Artificial Sequence: Synthetic oligonucleotide
  Target: ATXN1; (+) strand; PAM type: NRG; PAM sequence: GGG
ggtgagaatcaaggagtgag

SEQ ID NO: 152858 - DNA, 20 bp, Artificial Sequence
  Description of Artificial Sequence: Synthetic oligonucleotide
  Target: ATXN1; (+) strand; PAM type: NRG; PAM sequence: CAG
gagaatcaaggagtgagggg

SEQ ID NO: 152859 - DNA, 20 bp, Artificial Sequence
  Description of Artificial Sequence: Synthetic oligonucleotide
  Target: ATXN1; (+) strand; PAM type: NRG; PAM sequence: AGG
agaatcaaggagtgaggggc

SEQ ID NO: 152860 - DNA, 20 bp, Artificial Sequence
  Description of Artificial Sequence: Synthetic oligonucleotide
  Target: ATXN1; (+) strand; PAM type: NRG; PAM sequence: TGG
atcaaggagtgaggggcagg

SEQ ID NO: 152861 - DNA, 20 bp, Artificial Sequence
  Description of Artificial Sequence: Synthetic oligonucleotide
  Target: ATXN1; (+) strand; PAM type: NRG; PAM sequence: GGG
tcaaggagtgaggggcaggt

SEQ ID NO: 152862 - DNA, 20 bp, Artificial Sequence
  Description of Artificial Sequence: Synthetic oligonucleotide
  Target: ATXN1; (+) strand; PAM type: NRG; PAM sequence: GAG
aaggagtgaggggcaggtgg

SEQ ID NO: 152863 - DNA, 20 bp, Artificial Sequence
  Description of Artificial Sequence: Synthetic oligonucleotide
  Target: ATXN1; (+) strand; PAM type: NRG; PAM sequence: AAG
gagtgaggggcaggtgggag

SEQ ID NO: 152864 - DNA, 20 bp, Artificial Sequence
  Description of Artificial Sequence: Synthetic oligonucleotide
  Target: ATXN1; (+) strand; PAM type: NRG; PAM sequence: AGG
agtgaggggcaggtgggaga

SEQ ID NO: 152865 - DNA, 20 bp, Artificial Sequence
  Description of Artificial Sequence: Synthetic oligonucleotide
  Target: ATXN1; (+) strand; PAM type: NRG; PAM sequence: GGG
gtgaggggcaggtgggagaa

SEQ ID NO: 152866 - DNA, 20 bp, Artificial Sequence
  Description of Artificial Sequence: Synthetic oligonucleotide
  Target: ATXN1; (+) strand; PAM type: NRG; PAM sequence: GGG
tgaggggcaggtgggagaag

SEQ ID NO: 152867 - DNA, 20 bp, Artificial Sequence
  Description of Artificial Sequence: Synthetic oligonucleotide
  Target: ATXN1; (+) strand; PAM type: NRG; PAM sequence: AAG
gggcaggtgggagaagggga

SEQ ID NO: 152868 - DNA, 20 bp, Artificial Sequence
  Description of Artificial Sequence: Synthetic oligonucleotide
  Target: ATXN1; (+) strand; PAM type: NRG; PAM sequence: AGG
ggcaggtgggagaaggggaa

SEQ ID NO: 152869 - DNA, 20 bp, Artificial Sequence
  Description of Artificial Sequence: Synthetic oligonucleotide
  Target: ATXN1; (+) strand; PAM type: NRG; PAM sequence: GGG
gcaggtgggagaaggggaaa

SEQ ID NO: 152870 - DNA, 20 bp, Artificial Sequence
  Description of Artificial Sequence: Synthetic oligonucleotide
  Target: ATXN1; (+) strand; PAM type: NRG; PAM sequence: GGG
caggtgggagaaggggaaag

SEQ ID NO: 152871 - DNA, 20 bp, Artificial Sequence
  Description of Artificial Sequence: Synthetic oligonucleotide
  Target: ATXN1; (+) strand; PAM type: NRG; PAM sequence: TGG
gagaaggggaaaggggccct

SEQ ID NO: 152872 - DNA, 20 bp, Artificial Sequence
  Description of Artificial Sequence: Synthetic oligonucleotide
  Target: ATXN1; (+) strand; PAM type: NRG; PAM sequence: TAG
gggaaaggggcccttggaaa

SEQ ID NO: 152873 - DNA, 20 bp, Artificial Sequence
  Description of Artificial Sequence: Synthetic oligonucleotide
  Target: ATXN1; (+) strand; PAM type: NRG; PAM sequence: AAG
aaggggcccttggaaataga

SEQ ID NO: 152874 - DNA, 20 bp, Artificial Sequence
  Description of Artificial Sequence: Synthetic oligonucleotide
  Target: ATXN1; (+) strand; PAM type: NRG; PAM sequence: TGG
gcccttggaaatagaaagac

SEQ ID NO: 152875 - DNA, 20 bp, Artificial Sequence
  Description of Artificial Sequence: Synthetic oligonucleotide
  Target: ATXN1; (+) strand; PAM type: NRG; PAM sequence: GGG
cccttggaaatagaaagact

SEQ ID NO: 152876 - DNA, 20 bp, Artificial Sequence
  Description of Artificial Sequence: Synthetic oligonucleotide
  Target: ATXN1; (+) strand; PAM type: NRG; PAM sequence: CAG
tagaaagactgggacttcaa

SEQ ID NO: 152877 - DNA, 20 bp, Artificial Sequence
  Description of Artificial Sequence: Synthetic oligonucleotide
  Target: ATXN1; (+) strand; PAM type: NRG; PAM sequence: AGG
agaaagactgggacttcaac

SEQ ID NO: 152878 - DNA, 20 bp, Artificial Sequence
  Description of Artificial Sequence: Synthetic oligonucleotide
  Target: ATXN1; (+) strand; PAM type: NRG; PAM sequence: CAG
actgggacttcaacaggaaa

SEQ ID NO: 152879 - DNA, 20 bp, Artificial Sequence
  Description of Artificial Sequence: Synthetic oligonucleotide
  Target: ATXN1; (+) strand; PAM type: NRG; PAM sequence: AAG
ttcaacaggaaacagttccc

SEQ ID NO: 152880 - DNA, 20 bp, Artificial Sequence
  Description of Artificial Sequence: Synthetic oligonucleotide
  Target: ATXN1; (+) strand; PAM type: NRG; PAM sequence: AGG
tcaacaggaaacagttccca

SEQ ID NO: 152881 - DNA, 20 bp, Artificial Sequence
  Description of Artificial Sequence: Synthetic oligonucleotide
  Target: ATXN1; (+) strand; PAM type: NRG; PAM sequence: GGG
caacaggaaacagttcccaa

SEQ ID NO: 152882 - DNA, 20 bp, Artificial Sequence
  Description of Artificial Sequence: Synthetic oligonucleotide
  Target: ATXN1; (+) strand; PAM type: NRG; PAM sequence: GGG
aacaggaaacagttcccaag

SEQ ID NO: 152883 - DNA, 20 bp, Artificial Sequence
  Description of Artificial Sequence: Synthetic oligonucleotide
  Target: ATXN1; (+) strand; PAM type: NRG; PAM sequence: AAG
gaaacagttcccaaggggaa

SEQ ID NO: 152884 - DNA, 20 bp, Artificial Sequence
  Description of Artificial Sequence: Synthetic oligonucleotide
  Target: ATXN1; (+) strand; PAM type: NRG; PAM sequence: GAG
cagttcccaaggggaaaagt

SEQ ID NO: 152885 - DNA, 20 bp, Artificial Sequence
  Description of Artificial Sequence: Synthetic oligonucleotide
  Target: ATXN1; (+) strand; PAM type: NRG; PAM sequence: CAG
ttcccaaggggaaaagtgag

SEQ ID NO: 152886 - DNA, 20 bp, Artificial Sequence
  Description of Artificial Sequence: Synthetic oligonucleotide
  Target: ATXN1; (+) strand; PAM type: NRG; PAM sequence: AAG
ccaaggggaaaagtgagcag

SEQ ID NO: 152887 - DNA, 20 bp, Artificial Sequence
  Description of Artificial Sequence: Synthetic oligonucleotide
  Target: ATXN1; (+) strand; PAM type: NRG; PAM sequence: AAG
ggggaaaagtgagcagaaga

SEQ ID NO: 152888 - DNA, 20 bp, Artificial Sequence
  Description of Artificial Sequence: Synthetic oligonucleotide
  Target: ATXN1; (+) strand; PAM type: NRG; PAM sequence: AAG
aaaagtgagcagaagaaaga

SEQ ID NO: 152889 - DNA, 20 bp, Artificial Sequence
  Description of Artificial Sequence: Synthetic oligonucleotide
  Target: ATXN1; (+) strand; PAM type: NRG; PAM sequence: GAG
aagtgagcagaagaaagaaa

SEQ ID NO: 152890 - DNA, 20 bp, Artificial Sequence
  Description of Artificial Sequence: Synthetic oligonucleotide
  Target: ATXN1; (+) strand; PAM type: NRG; PAM sequence: CAG
aagaaagaaagagctattcc

SEQ ID NO: 152891 - DNA, 20 bp, Artificial Sequence
  Description of Artificial Sequence: Synthetic oligonucleotide
  Target: ATXN1; (+) strand; PAM type: NRG; PAM sequence: AAG
agaaagagctattcccagca

SEQ ID NO: 152892 - DNA, 20 bp, Artificial Sequence
  Description of Artificial Sequence: Synthetic oligonucleotide
  Target: ATXN1; (+) strand; PAM type: NRG; PAM sequence: CAG
ctattcccagcaaagccatc

SEQ ID NO: 152893 - DNA, 20 bp, Artificial Sequence
  Description of Artificial Sequence: Synthetic oligonucleotide
  Target: ATXN1; (+) strand; PAM type: NRG; PAM sequence: TGG
ttcccagcaaagccatccag

SEQ ID NO: 152894 - DNA, 20 bp, Artificial Sequence
  Description of Artificial Sequence: Synthetic oligonucleotide
  Target: ATXN1; (+) strand; PAM type: NRG; PAM sequence: CAG
ccatccagtggaccactcgc

SEQ ID NO: 152895 - DNA, 20 bp, Artificial Sequence
  Description of Artificial Sequence: Synthetic oligonucleotide
  Target: ATXN1; (+) strand; PAM type: NRG; PAM sequence: TGG
cagtggaccactcgccagcc

SEQ ID NO: 152896 - DNA, 20 bp, Artificial Sequence
  Description of Artificial Sequence: Synthetic oligonucleotide
  Target: ATXN1; (+) strand; PAM type: NRG; PAM sequence: CAG
gaccactcgccagcctggtg

SEQ ID NO: 152897 - DNA, 20 bp, Artificial Sequence
  Description of Artificial Sequence: Synthetic oligonucleotide
  Target: ATXN1; (+) strand; PAM type: NRG; PAM sequence: GAG
gccagcctggtgcagaattt

SEQ ID NO: 152898 - DNA, 20 bp, Artificial Sequence
  Description of Artificial Sequence: Synthetic oligonucleotide
  Target: ATXN1; (+) strand; PAM type: NRG; PAM sequence: CGG
ctggtgcagaatttgagctg

SEQ ID NO: 152899 - DNA, 20 bp, Artificial Sequence
  Description of Artificial Sequence: Synthetic oligonucleotide
  Target: ATXN1; (+) strand; PAM type: NRG; PAM sequence: CAG
gtaatctcatttattcctgc

SEQ ID NO: 152900 - DNA, 20 bp, Artificial Sequence
  Description of Artificial Sequence: Synthetic oligonucleotide
  Target: ATXN1; (+) strand; PAM type: NRG; PAM sequence: AGG
taatctcatttattcctgcc

SEQ ID NO: 152901 - DNA, 20 bp, Artificial Sequence
  Description of Artificial Sequence: Synthetic oligonucleotide
  Target: ATXN1; (+) strand; PAM type: NRG; PAM sequence: TGG
ctcatttattcctgccaggt

SEQ ID NO: 152902 - DNA, 20 bp, Artificial Sequence
  Description of Artificial Sequence: Synthetic oligonucleotide
  Target: ATXN1; (+) strand; PAM type: NRG; PAM sequence: TGG
tattcctgccaggttggccc

SEQ ID NO: 152903 - DNA, 20 bp, Artificial Sequence
  Description of Artificial Sequence: Synthetic oligonucleotide
  Target: ATXN1; (+) strand; PAM type: NRG; PAM sequence: GGG
attcctgccaggttggccct

SEQ ID NO: 152904 - DNA, 20 bp, Artificial Sequence
  Description of Artificial Sequence: Synthetic oligonucleotide
  Target: ATXN1; (+) strand; PAM type: NRG; PAM sequence: AAG
gccaggttggccctgggtac

SEQ ID NO: 152905 - DNA, 20 bp, Artificial Sequence
  Description of Artificial Sequence: Synthetic oligonucleotide
  Target: ATXN1; (+) strand; PAM type: NRG; PAM sequence: TAG
aggttggccctgggtacaag

SEQ ID NO: 152906 - DNA, 20 bp, Artificial Sequence
  Description of Artificial Sequence: Synthetic oligonucleotide
  Target: ATXN1; (+) strand; PAM type: NRG; PAM sequence: AAG
ttggccctgggtacaagtag

SEQ ID NO: 152907 - DNA, 20 bp, Artificial Sequence
  Description of Artificial Sequence: Synthetic oligonucleotide
  Target: ATXN1; (+) strand; PAM type: NRG; PAM sequence: AAG
cctgggtacaagtagaagaa

SEQ ID NO: 152908 - DNA, 20 bp, Artificial Sequence
  Description of Artificial Sequence: Synthetic oligonucleotide
  Target: ATXN1; (+) strand; PAM type: NRG; PAM sequence: GAG
tgggtacaagtagaagaaaa

SEQ ID NO: 152909 - DNA, 20 bp, Artificial Sequence
  Description of Artificial Sequence: Synthetic oligonucleotide
  Target: ATXN1; (+) strand; PAM type: NRG; PAM sequence: GAG
ggtacaagtagaagaaaaga

SEQ ID NO: 152910 - DNA, 20 bp, Artificial Sequence
  Description of Artificial Sequence: Synthetic oligonucleotide
  Target: ATXN1; (+) strand; PAM type: NRG; PAM sequence: AGG
gtacaagtagaagaaaagag

SEQ ID NO: 152911 - DNA, 20 bp, Artificial Sequence
  Description of Artificial Sequence: Synthetic oligonucleotide
  Target: ATXN1; (+) strand; PAM type: NRG; PAM sequence: AAG
ttgaaccgttgtacaacaaa

SEQ ID NO: 152912 - DNA, 20 bp, Artificial Sequence
  Description of Artificial Sequence: Synthetic oligonucleotide
  Target: ATXN1; (+) strand; PAM type: NRG; PAM sequence: AAG
aagcatcatcactgaaatga

SEQ ID NO: 152913 - DNA, 20 bp, Artificial Sequence
  Description of Artificial Sequence: Synthetic oligonucleotide
  Target: ATXN1; (+) strand; PAM type: NRG; PAM sequence: AGG
agcatcatcactgaaatgaa

SEQ ID NO: 152914 - DNA, 20 bp, Artificial Sequence
  Description of Artificial Sequence: Synthetic oligonucleotide
  Target: ATXN1; (+) strand; PAM type: NRG; PAM sequence: TGG
tcactgaaatgaaaggacac

SEQ ID NO: 152915 - DNA, 20 bp, Artificial Sequence
  Description of Artificial Sequence: Synthetic oligonucleotide
  Target: ATXN1; (+) strand; PAM type: NRG; PAM sequence: TAG
gaaatgaaaggacactggac

SEQ ID NO: 152916 - DNA, 20 bp, Artificial Sequence
  Description of Artificial Sequence: Synthetic oligonucleotide
  Target: ATXN1; (+) strand; PAM type: NRG; PAM sequence: AGG
aaatgaaaggacactggact

SEQ ID NO: 152917 - DNA, 20 bp, Artificial Sequence
  Description of Artificial Sequence: Synthetic oligonucleotide
  Target: ATXN1; (+) strand; PAM type: NRG; PAM sequence: GGG
aatgaaaggacactggacta

SEQ ID NO: 152918 - DNA, 20 bp, Artificial Sequence
  Description of Artificial Sequence: Synthetic oligonucleotide
  Target: ATXN1; (+) strand; PAM type: NRG; PAM sequence: AAG
gaaaggacactggactaggg

SEQ ID NO: 152919 - DNA, 20 bp, Artificial Sequence
  Description of Artificial Sequence: Synthetic oligonucleotide
  Target: ATXN1; (+) strand; PAM type: NRG; PAM sequence: TAG
aggacactggactagggaag

SEQ ID NO: 152920 - DNA, 20 bp, Artificial Sequence
  Description of Artificial Sequence: Synthetic oligonucleotide
  Target: ATXN1; (+) strand; PAM type: NRG; PAM sequence: TAG
ctggactagggaagtagctg

SEQ ID NO: 152921 - DNA, 20 bp, Artificial Sequence
  Description of Artificial Sequence: Synthetic oligonucleotide
  Target: ATXN1; (+) strand; PAM type: NRG; PAM sequence: TAG
agggaagtagctgtagcaaa

SEQ ID NO: 152922 - DNA, 20 bp, Artificial Sequence
  Description of Artificial Sequence: Synthetic oligonucleotide
  Target: ATXN1; (+) strand; PAM type: NRG; PAM sequence: AGG
gggaagtagctgtagcaaat

SEQ ID NO: 152923 - DNA, 20 bp, Artificial Sequence
  Description of Artificial Sequence: Synthetic oligonucleotide
  Target: ATXN1; (+) strand; PAM type: NRG; PAM sequence: TGG
agcaaataggactttttaaa

SEQ ID NO: 152924 - DNA, 20 bp, Artificial Sequence
  Description of Artificial Sequence: Synthetic oligonucleotide
  Target: ATXN1; (+) strand; PAM type: NRG; PAM sequence: TAG
tttttaaatggattaatatc

SEQ ID NO: 152925 - DNA, 20 bp, Artificial Sequence
  Description of Artificial Sequence: Synthetic oligonucleotide
  Target: ATXN1; (+) strand; PAM type: NRG; PAM sequence: AAG
attaatatctagaacatata

SEQ ID NO: 152926 - DNA, 20 bp, Artificial Sequence
  Description of Artificial Sequence: Synthetic oligonucleotide
  Target: ATXN1; (+) strand; PAM type: NRG; PAM sequence: GAG
taatatctagaacatataaa

SEQ ID NO: 152927 - DNA, 20 bp, Artificial Sequence
  Description of Artificial Sequence: Synthetic oligonucleotide
  Target: ATXN1; (+) strand; PAM type: NRG; PAM sequence: TAG
atataaagagctcatataca

SEQ ID NO: 152928 - DNA, 20 bp, Artificial Sequence
  Description of Artificial Sequence: Synthetic oligonucleotide
  Target: ATXN1; (+) strand; PAM type: NRG; PAM sequence: TAG
aagagctcatatacatagat

SEQ ID NO: 152929 - DNA, 20 bp, Artificial Sequence
  Description of Artificial Sequence: Synthetic oligonucleotide
  Target: ATXN1; (+) strand; PAM type: NRG; PAM sequence: AAG
tacatagattagaaaacatc

SEQ ID NO: 152930 - DNA, 20 bp, Artificial Sequence
  Description of Artificial Sequence: Synthetic oligonucleotide
  Target: ATXN1; (+) strand; PAM type: NRG; PAM sequence: AAG
ttccatttgctaattgtaaa

SEQ ID NO: 152931 - DNA, 20 bp, Artificial Sequence
  Description of Artificial Sequence: Synthetic oligonucleotide
  Target: ATXN1; (+) strand; PAM type: NRG; PAM sequence: TAG
ctaattgtaaaaagaacaat

SEQ ID NO: 152932 - DNA, 20 bp, Artificial Sequence
  Description of Artificial Sequence: Synthetic oligonucleotide
  Target: ATXN1; (+) strand; PAM type: NRG; PAM sequence: CAG
gaacaattagtaaataaaca

SEQ ID NO: 152933 - DNA, 20 bp, Artificial Sequence
  Description of Artificial Sequence: Synthetic oligonucleotide
  Target: ATXN1; (+) strand; PAM type: NRG; PAM sequence: TGG
aattagtaaataaacacaga

SEQ ID NO: 152934 - DNA, 20 bp, Artificial Sequence
  Description of Artificial Sequence: Synthetic oligonucleotide
  Target: ATXN1; (+) strand; PAM type: NRG; PAM sequence: GAG
gatggaaatgttccatctct

SEQ ID NO: 152935 - DNA, 20 bp, Artificial Sequence
  Description of Artificial Sequence: Synthetic oligonucleotide
  Target: ATXN1; (+) strand; PAM type: NRG; PAM sequence: GAG
tggaaatgttccatctctga

SEQ ID NO: 152936 - DNA, 20 bp, Artificial Sequence
  Description of Artificial Sequence: Synthetic oligonucleotide
  Target: ATXN1; (+) strand; PAM type: NRG; PAM sequence: AGG
ggaaatgttccatctctgag

SEQ ID NO: 152937 - DNA, 20 bp, Artificial Sequence
  Description of Artificial Sequence: Synthetic oligonucleotide
  Target: ATXN1; (+) strand; PAM type: NRG; PAM sequence: GGG
gaaatgttccatctctgaga

SEQ ID NO: 152938 - DNA, 20 bp, Artificial Sequence
  Description of Artificial Sequence: Synthetic oligonucleotide
  Target: ATXN1; (+) strand; PAM type: NRG; PAM sequence: AAG
tccatctctgagagggatca

SEQ ID NO: 152939 - DNA, 20 bp, Artificial Sequence
  Description of Artificial Sequence: Synthetic oligonucleotide
  Target: ATXN1; (+) strand; PAM type: NRG; PAM sequence: AGG
ccatctctgagagggatcaa

SEQ ID NO: 152940 - DNA, 20 bp, Artificial Sequence
  Description of Artificial Sequence: Synthetic oligonucleotide
  Target: ATXN1; (+) strand; PAM type: NRG; PAM sequence: AAG
gaatgaaaactttaaaacca

SEQ ID NO: 152941 - DNA, 20 bp, Artificial Sequence
  Description of Artificial Sequence: Synthetic oligonucleotide
  Target: ATXN1; (+) strand; PAM type: NRG; PAM sequence: GAG
atgaaaactttaaaaccaaa

SEQ ID NO: 152942 - DNA, 20 bp, Artificial Sequence
  Description of Artificial Sequence: Synthetic oligonucleotide
  Target: ATXN1; (+) strand; PAM type: NRG; PAM sequence: TAG
aaccaaagagcctattaaat

SEQ ID NO: 152943 - DNA, 20 bp, Artificial Sequence
  Description of Artificial Sequence: Synthetic oligonucleotide
  Target: ATXN1; (+) strand; PAM type: NRG; PAM sequence: TAG
ctattaaattagccaaaaaa

SEQ ID NO: 152944 - DNA, 20 bp, Artificial Sequence
  Description of Artificial Sequence: Synthetic oligonucleotide
  Target: ATXN1; (+) strand; PAM type: NRG; PAM sequence: AAG
taaattagccaaaaaatagt

SEQ ID NO: 152945 - DNA, 20 bp, Artificial Sequence
  Description of Artificial Sequence: Synthetic oligonucleotide
  Target: ATXN1; (+) strand; PAM type: NRG; PAM sequence: AAG
tagtaagtcccacaattatt

SEQ ID NO: 152946 - DNA, 20 bp, Artificial Sequence
  Description of Artificial Sequence: Synthetic oligonucleotide
  Target: ATXN1; (+) strand; PAM type: NRG; PAM sequence: AAG
tcccacaattattaagattg

SEQ ID NO: 152947 - DNA, 20 bp, Artificial Sequence
  Description of Artificial Sequence: Synthetic oligonucleotide
  Target: ATXN1; (+) strand; PAM type: NRG; PAM sequence: TAG
acaattattaagattgaagc

SEQ ID NO: 152948 - DNA, 20 bp, Artificial Sequence
  Description of Artificial Sequence: Synthetic oligonucleotide
  Target: ATXN1; (+) strand; PAM type: NRG; PAM sequence: GAG
aattattaagattgaagcta

SEQ ID NO: 152949 - DNA, 20 bp, Artificial Sequence
  Description of Artificial Sequence: Synthetic oligonucleotide
  Target: ATXN1; (+) strand; PAM type: NRG; PAM sequence: TAG
tagagacattcttatatcat

SEQ ID NO: 152950 - DNA, 20 bp, Artificial Sequence
  Description of Artificial Sequence: Synthetic oligonucleotide
  Target: ATXN1; (+) strand; PAM type: NRG; PAM sequence: TGG
tcattagtaacaatgtaaat

SEQ ID NO: 152951 - DNA, 20 bp, Artificial Sequence
  Description of Artificial Sequence: Synthetic oligonucleotide
  Target: ATXN1; (+) strand; PAM type: NRG; PAM sequence: CAG
agtaacaatgtaaattggta

SEQ ID NO: 152952 - DNA, 20 bp, Artificial Sequence
  Description of Artificial Sequence: Synthetic oligonucleotide
  Target: ATXN1; (+) strand; PAM type: NRG; PAM sequence: TAG
tgtaaattggtacagccttt

SEQ ID NO: 152953 - DNA, 20 bp, Artificial Sequence
  Description of Artificial Sequence: Synthetic oligonucleotide
  Target: ATXN1; (+) strand; PAM type: NRG; PAM sequence: AAG
aattggtacagccttttaga

SEQ ID NO: 152954 - DNA, 20 bp, Artificial Sequence
  Description of Artificial Sequence: Synthetic oligonucleotide
  Target: ATXN1; (+) strand; PAM type: NRG; PAM sequence: CAG
cagccttttagaaagcaatt

SEQ ID NO: 152955 - DNA, 20 bp, Artificial Sequence
  Description of Artificial Sequence: Synthetic oligonucleotide
  Target: ATXN1; (+) strand; PAM type: NRG; PAM sequence: GAG
gccttttagaaagcaattca

SEQ ID NO: 152956 - DNA, 20 bp, Artificial Sequence
  Description of Artificial Sequence: Synthetic oligonucleotide
  Target: ATXN1; (+) strand; PAM type: NRG; PAM sequence: AAG
tttagaaagcaattcagagc

SEQ ID NO: 152957 - DNA, 20 bp, Artificial Sequence
  Description of Artificial Sequence: Synthetic oligonucleotide
  Target: ATXN1; (+) strand; PAM type: NRG; PAM sequence: TAG
agagcaagctccctctaact

SEQ ID NO: 152958 - DNA, 20 bp, Artificial Sequence
  Description of Artificial Sequence: Synthetic oligonucleotide
  Target: ATXN1; (+) strand; PAM type: NRG; PAM sequence: GAG
gctccctctaacttagtatt

SEQ ID NO: 152959 - DNA, 20 bp, Artificial Sequence
  Description of Artificial Sequence: Synthetic oligonucleotide
  Target: ATXN1; (+) strand; PAM type: NRG; PAM sequence: GAG
agtattgagccttctgatgt

SEQ ID NO: 152960 - DNA, 20 bp, Artificial Sequence
  Description of Artificial Sequence: Synthetic oligonucleotide
  Target: ATXN1; (+) strand; PAM type: NRG; PAM sequence: CGG
ttctgatgtgagtgtgtcct

SEQ ID NO: 152961 - DNA, 20 bp, Artificial Sequence
  Description of Artificial Sequence: Synthetic oligonucleotide
  Target: ATXN1; (+) strand; PAM type: NRG; PAM sequence: AAG
tcggtaaatacttgtgtgca

SEQ ID NO: 152962 - DNA, 20 bp, Artificial Sequence
  Description of Artificial Sequence: Synthetic oligonucleotide
  Target: ATXN1; (+) strand; PAM type: NRG; PAM sequence: CGG
gtgtgcaaagacattcgctg

SEQ ID NO: 152963 - DNA, 20 bp, Artificial Sequence
  Description of Artificial Sequence: Synthetic oligonucleotide
  Target: ATXN1; (+) strand; PAM type: NRG; PAM sequence: CAG
cattcgctgcggctttacaa

SEQ ID NO: 152964 - DNA, 20 bp, Artificial Sequence
  Description of Artificial Sequence: Synthetic oligonucleotide
  Target: ATXN1; (+) strand; PAM type: NRG; PAM sequence: TAG
gctttacaacagtaaacaat

SEQ ID NO: 152965 - DNA, 20 bp, Artificial Sequence
  Description of Artificial Sequence: Synthetic oligonucleotide
  Target: ATXN1; (+) strand; PAM type: NRG; PAM sequence: TAG
actcgaatgtccaaaaatga

SEQ ID NO: 152966 - DNA, 20 bp, Artificial Sequence
  Description of Artificial Sequence: Synthetic oligonucleotide
  Target: ATXN1; (+) strand; PAM type: NRG; PAM sequence: AGG
ctcgaatgtccaaaaatgat

SEQ ID NO: 152967 - DNA, 20 bp, Artificial Sequence
  Description of Artificial Sequence: Synthetic oligonucleotide
  Target: ATXN1; (+) strand; PAM type: NRG; PAM sequence: AAG
tgataggaaacttaaaaatt

SEQ ID NO: 152968 - DNA, 20 bp, Artificial Sequence
  Description of Artificial Sequence: Synthetic oligonucleotide
  Target: ATXN1; (+) strand; PAM type: NRG; PAM sequence: TAG
attaagataaaacaacctga

SEQ ID NO: 152969 - DNA, 20 bp, Artificial Sequence
  Description of Artificial Sequence: Synthetic oligonucleotide
  Target: ATXN1; (+) strand; PAM type: NRG; PAM sequence: GAG
gttatgtgatccttgcaaat

SEQ ID NO: 152970 - DNA, 20 bp, Artificial Sequence
  Description of Artificial Sequence: Synthetic oligonucleotide
  Target: ATXN1; (+) strand; PAM type: NRG; PAM sequence: TAG
ccttgcaaatgagaactgta

SEQ ID NO: 152971 - DNA, 20 bp, Artificial Sequence
  Description of Artificial Sequence: Synthetic oligonucleotide
  Target: ATXN1; (+) strand; PAM type: NRG; PAM sequence: AAG
aaatgagaactgtatagctg

SEQ ID NO: 152972 - DNA, 20 bp, Artificial Sequence
  Description of Artificial Sequence: Synthetic oligonucleotide
  Target: ATXN1; (+) strand; PAM type: NRG; PAM sequence: AAG
actgtatagctgaagttact

SEQ ID NO: 152973 - DNA, 20 bp, Artificial Sequence
  Description of Artificial Sequence: Synthetic oligonucleotide
  Target: ATXN1; (+) strand; PAM type: NRG; PAM sequence: TGG
ctaagaatgtttatgctaaa

SEQ ID NO: 152974 - DNA, 20 bp, Artificial Sequence
  Description of Artificial Sequence: Synthetic oligonucleotide
  Target: ATXN1; (+) strand; PAM type: NRG; PAM sequence: GGG
taagaatgtttatgctaaat

SEQ ID NO: 152975 - DNA, 20 bp, Artificial Sequence
  Description of Artificial Sequence: Synthetic oligonucleotide
  Target: ATXN1; (+) strand; PAM type: NRG; PAM sequence: AAG
ggaaacacaaaactgaaaaa

SEQ ID NO: 152976 - DNA, 20 bp, Artificial Sequence
  Description of Artificial Sequence: Synthetic oligonucleotide
  Target: ATXN1; (+) strand; PAM type: NRG; PAM sequence: AAG
caaaactgaaaaaaagatat

SEQ ID NO: 152977 - DNA, 20 bp, Artificial Sequence
  Description of Artificial Sequence: Synthetic oligonucleotide
  Target: ATXN1; (+) strand; PAM type: NRG; PAM sequence: AAG
aagatataagttacatcatc

SEQ ID NO: 152978 - DNA, 20 bp, Artificial Sequence
  Description of Artificial Sequence: Synthetic oligonucleotide
  Target: ATXN1; (+) strand; PAM type: NRG; PAM sequence: TGG
ataaaaatgaacttgattta

SEQ ID NO: 152979 - DNA, 20 bp, Artificial Sequence
  Description of Artificial Sequence: Synthetic oligonucleotide
  Target: ATXN1; (+) strand; PAM type: NRG; PAM sequence: TGG
aatgaacttgatttatggac

SEQ ID NO: 152980 - DNA, 20 bp, Artificial Sequence
  Description of Artificial Sequence: Synthetic oligonucleotide
  Target: ATXN1; (+) strand; PAM type: NRG; PAM sequence: TGG
acttgatttatggactggaa

SEQ ID NO: 152981 - DNA, 20 bp, Artificial Sequence
  Description of Artificial Sequence: Synthetic oligonucleotide
  Target: ATXN1; (+) strand; PAM type: NRG; PAM sequence: TGG
tgatttatggactggaatgg

SEQ ID NO: 152982 - DNA, 20 bp, Artificial Sequence
  Description of Artificial Sequence: Synthetic oligonucleotide
  Target: ATXN1; (+) strand; PAM type: NRG; PAM sequence: AAG
ggactggaatggtggaatca

SEQ ID NO: 152983 - DNA, 20 bp, Artificial Sequence
  Description of Artificial Sequence: Synthetic oligonucleotide
  Target: ATXN1; (+) strand; PAM type: NRG; PAM sequence: AGG
gactggaatggtggaatcaa

SEQ ID NO: 152984 - DNA, 20 bp, Artificial Sequence
  Description of Artificial Sequence: Synthetic oligonucleotide
  Target: ATXN1; (+) strand; PAM type: NRG; PAM sequence: GGG
actggaatggtggaatcaaa

SEQ ID NO: 152985 - DNA, 20 bp, Artificial Sequence
  Description of Artificial Sequence: Synthetic oligonucleotide
  Target: ATXN1; (+) strand; PAM type: NRG; PAM sequence: TGG
aagggaacttttgcttttat

SEQ ID NO: 152986 - DNA, 20 bp, Artificial Sequence
  Description of Artificial Sequence: Synthetic oligonucleotide
  Target: ATXN1; (+) strand; PAM type: NRG; PAM sequence: AAG
tggctttcctttattattgt

SEQ ID NO: 152987 - DNA, 20 bp, Artificial Sequence
  Description of Artificial Sequence: Synthetic oligonucleotide
  Target: ATXN1; (+) strand; PAM type: NRG; PAM sequence: AGG
ggctttcctttattattgta

SEQ ID NO: 152988 - DNA, 20 bp, Artificial Sequence
  Description of Artificial Sequence: Synthetic oligonucleotide
  Target: ATXN1; (+) strand; PAM type: NRG; PAM sequence: TGG
tcctttattattgtaaggtt

SEQ ID NO: 152989 - DNA, 20 bp, Artificial Sequence
  Description of Artificial Sequence: Synthetic oligonucleotide
  Target: ATXN1; (+) strand; PAM type: NRG; PAM sequence: GGG
cctttattattgtaaggttt

SEQ ID NO: 152990 - DNA, 20 bp, Artificial Sequence
  Description of Artificial Sequence: Synthetic oligonucleotide
  Target: ATXN1; (+) strand; PAM type: NRG; PAM sequence: TGG
gcaatacatgtttaaaaaca

SEQ ID NO: 152991 - DNA, 20 bp, Artificial Sequence
  Description of Artificial Sequence: Synthetic oligonucleotide
  Target: ATXN1; (+) strand; PAM type: NRG; PAM sequence: CAG
taaaaacatggtatttttat

SEQ ID NO: 152992 - DNA, 20 bp, Artificial Sequence
  Description of Artificial Sequence: Synthetic oligonucleotide
  Target: ATXN1; (+) strand; PAM type: NRG; PAM sequence: TAG
gtatttttatcagtcatgtg

SEQ ID NO: 152993 - DNA, 20 bp, Artificial Sequence
  Description of Artificial Sequence: Synthetic oligonucleotide
  Target: ATXN1; (+) strand; PAM type: NRG; PAM sequence: TAG
gtagtaaacactcttttctg

SEQ ID NO: 152994 - DNA, 20 bp, Artificial Sequence
  Description of Artificial Sequence: Synthetic oligonucleotide
  Target: ATXN1; (+) strand; PAM type: NRG; PAM sequence: GAG
agtaaacactcttttctgta

SEQ ID NO: 152995 - DNA, 20 bp, Artificial Sequence
  Description of Artificial Sequence: Synthetic oligonucleotide
  Target: ATXN1; (+) strand; PAM type: NRG; PAM sequence: CAG
aaacactcttttctgtagag

SEQ ID NO: 152996 - DNA, 20 bp, Artificial Sequence
  Description of Artificial Sequence: Synthetic oligonucleotide
  Target: ATXN1; (+) strand; PAM type: NRG; PAM sequence: GAG
acactcttttctgtagagca

SEQ ID NO: 152997 - DNA, 20 bp, Artificial Sequence
  Description of Artificial Sequence: Synthetic oligonucleotide
  Target: ATXN1; (+) strand; PAM type: NRG; PAM sequence: CGG
ctgtagagcagagctacctg

SEQ ID NO: 152998 - DNA, 20 bp, Artificial Sequence
  Description of Artificial Sequence: Synthetic oligonucleotide
  Target: ATXN1; (+) strand; PAM type: NRG; PAM sequence: CAG
cctgcggaaaacgtcactgc

SEQ ID NO: 152999 - DNA, 20 bp, Artificial Sequence
  Description of Artificial Sequence: Synthetic oligonucleotide
  Target: ATXN1; (+) strand; PAM type: NRG; PAM sequence: AGG
ctgcggaaaacgtcactgcc

SEQ ID NO: 153000 - DNA, 20 bp, Artificial Sequence
  Description of Artificial Sequence: Synthetic oligonucleotide
  Target: ATXN1; (+) strand; PAM type: NRG; PAM sequence: TAG
ggaaaacgtcactgccaggt

SEQ ID NO: 153001 - DNA, 20 bp, Artificial Sequence
  Description of Artificial Sequence: Synthetic oligonucleotide
  Target: ATXN1; (+) strand; PAM type: NRG; PAM sequence: TGG
aaacgtcactgccaggttag

SEQ ID NO: 153002 - DNA, 20 bp, Artificial Sequence
  Description of Artificial Sequence: Synthetic oligonucleotide
  Target: ATXN1; (+) strand; PAM type: NRG; PAM sequence: GAG
acgtcactgccaggttagtg

SEQ ID NO: 153003 - DNA, 20 bp, Artificial Sequence
  Description of Artificial Sequence: Synthetic oligonucleotide
  Target: ATXN1; (+) strand; PAM type: NRG; PAM sequence: AGG
cgtcactgccaggttagtgg

SEQ ID NO: 153004 - DNA, 20 bp, Artificial Sequence
  Description of Artificial Sequence: Synthetic oligonucleotide
  Target: ATXN1; (+) strand; PAM type: NRG; PAM sequence: GGG
gtcactgccaggttagtgga

SEQ ID NO: 153005 - DNA, 20 bp, Artificial Sequence
  Description of Artificial Sequence: Synthetic oligonucleotide
  Target: ATXN1; (+) strand; PAM type: NRG; PAM sequence: TAG
ccaggttagtggagggtgct

SEQ ID NO: 153006 - DNA, 20 bp, Artificial Sequence
  Description of Artificial Sequence: Synthetic oligonucleotide
  Target: ATXN1; (+) strand; PAM type: NRG; PAM sequence: AAG
gagggtgcttagtccttccc

SEQ ID NO: 153007 - DNA, 20 bp, Artificial Sequence
  Description of Artificial Sequence: Synthetic oligonucleotide
  Target: ATXN1; (+) strand; PAM type: NRG; PAM sequence: GAG
gggtgcttagtccttcccaa

SEQ ID NO: 153008 - DNA, 20 bp, Artificial Sequence
  Description of Artificial Sequence: Synthetic oligonucleotide
  Target: ATXN1; (+) strand; PAM type: NRG; PAM sequence: CAG
tccttcccaagagctacctg

SEQ ID NO: 153009 - DNA, 20 bp, Artificial Sequence
  Description of Artificial Sequence: Synthetic oligonucleotide
  Target: ATXN1; (+) strand; PAM type: NRG; PAM sequence: CAG
cctgcagaaaacgtcactga

SEQ ID NO: 153010 - DNA, 20 bp, Artificial Sequence
  Description of Artificial Sequence: Synthetic oligonucleotide
  Target: ATXN1; (+) strand; PAM type: NRG; PAM sequence: AGG
ctgcagaaaacgtcactgac

SEQ ID NO: 153011 - DNA, 20 bp, Artificial Sequence
  Description of Artificial Sequence: Synthetic oligonucleotide
  Target: ATXN1; (+) strand; PAM type: NRG; PAM sequence: TAG
agaaaacgtcactgacaggt

SEQ ID NO: 153012 - DNA, 20 bp, Artificial Sequence
  Description of Artificial Sequence: Synthetic oligonucleotide
  Target: ATXN1; (+) strand; PAM type: NRG; PAM sequence: TGG
aaacgtcactgacaggttag

SEQ ID NO: 153013 - DNA, 20 bp, Artificial Sequence
  Description of Artificial Sequence: Synthetic oligonucleotide
  Target: ATXN1; (+) strand; PAM type: NRG; PAM sequence: GAG
acgtcactgacaggttagtg

SEQ ID NO: 153014 - DNA, 20 bp, Artificial Sequence
  Description of Artificial Sequence: Synthetic oligonucleotide
  Target: ATXN1; (+) strand; PAM type: NRG; PAM sequence: AGG
cgtcactgacaggttagtgg

SEQ ID NO: 153015 - DNA, 20 bp, Artificial Sequence
  Description of Artificial Sequence: Synthetic oligonucleotide
  Target: ATXN1; (+) strand; PAM type: NRG; PAM sequence: GGG
gtcactgacaggttagtgga

SEQ ID NO: 153016 - DNA, 20 bp, Artificial Sequence
  Description of Artificial Sequence: Synthetic oligonucleotide
  Target: ATXN1; (+) strand; PAM type: NRG; PAM sequence: TAG
acaggttagtggagggtgct

SEQ ID NO: 153017 - DNA, 20 bp, Artificial Sequence
  Description of Artificial Sequence: Synthetic oligonucleotide
  Target: ATXN1; (+) strand; PAM type: NRG; PAM sequence: AAG
ttagtccttcccaaatttca

SEQ ID NO: 153018 - DNA, 20 bp, Artificial Sequence
  Description of Artificial Sequence: Synthetic oligonucleotide
  Target: ATXN1; (+) strand; PAM type: NRG; PAM sequence: AGG
tagtccttcccaaatttcaa

SEQ ID NO: 153019 - DNA, 20 bp, Artificial Sequence
  Description of Artificial Sequence: Synthetic oligonucleotide
  Target: ATXN1; (+) strand; PAM type: NRG; PAM sequence: GAG
caaatttcaaaggtcctttt

SEQ ID NO: 153020 - DNA, 20 bp, Artificial Sequence
  Description of Artificial Sequence: Synthetic oligonucleotide
  Target: ATXN1; (+) strand; PAM type: NRG; PAM sequence: TGG
caaactctgcctactaaaac

SEQ ID NO: 153021 - DNA, 20 bp, Artificial Sequence
  Description of Artificial Sequence: Synthetic oligonucleotide
  Target: ATXN1; (+) strand; PAM type: NRG; PAM sequence: GAG
ctactaaaactggctgctct

SEQ ID NO: 153022 - DNA, 20 bp, Artificial Sequence
  Description of Artificial Sequence: Synthetic oligonucleotide
  Target: ATXN1; (+) strand; PAM type: NRG; PAM sequence: AAG
ctaaaactggctgctctgag

SEQ ID NO: 153023 - DNA, 20 bp, Artificial Sequence
  Description of Artificial Sequence: Synthetic oligonucleotide
  Target: ATXN1; (+) strand; PAM type: NRG; PAM sequence: CAG
ccctgactatacctcaaatg

SEQ ID NO: 153024 - DNA, 20 bp, Artificial Sequence
  Description of Artificial Sequence: Synthetic oligonucleotide
  Target: ATXN1; (+) strand; PAM type: NRG; PAM sequence: CAG
ttgttcttgctttttttatt

SEQ ID NO: 153025 - DNA, 20 bp, Artificial Sequence
  Description of Artificial Sequence: Synthetic oligonucleotide
  Target: ATXN1; (+) strand; PAM type: NRG; PAM sequence: TAG
gtgtgtgtgtctgtttttat

SEQ ID NO: 153026 - DNA, 20 bp, Artificial Sequence
  Description of Artificial Sequence: Synthetic oligonucleotide
  Target: ATXN1; (+) strand; PAM type: NRG; PAM sequence: GAG
gtctgtttttattagttatt

SEQ ID NO: 153027 - DNA, 20 bp, Artificial Sequence
  Description of Artificial Sequence: Synthetic oligonucleotide
  Target: ATXN1; (+) strand; PAM type: NRG; PAM sequence: AAG
agttattgagatactaccat

SEQ ID NO: 153028 - DNA, 20 bp, Artificial Sequence
  Description of Artificial Sequence: Synthetic oligonucleotide
  Target: ATXN1; (+) strand; PAM type: NRG; PAM sequence: TAG
atactaccataagcaacatc

SEQ ID NO: 153029 - DNA, 20 bp, Artificial Sequence
  Description of Artificial Sequence: Synthetic oligonucleotide
  Target: ATXN1; (+) strand; PAM type: NRG; PAM sequence: GAG
actaccataagcaacatcta

SEQ ID NO: 153030 - DNA, 20 bp, Artificial Sequence
  Description of Artificial Sequence: Synthetic oligonucleotide
  Target: ATXN1; (+) strand; PAM type: NRG; PAM sequence: GAG
taccataagcaacatctaga

SEQ ID NO: 153031 - DNA, 20 bp, Artificial Sequence
  Description of Artificial Sequence: Synthetic oligonucleotide
  Target: ATXN1; (+) strand; PAM type: NRG; PAM sequence: GAG
ataagcaacatctagagagt

SEQ ID NO: 153032 - DNA, 20 bp, Artificial Sequence
  Description of Artificial Sequence: Synthetic oligonucleotide
  Target: ATXN1; (+) strand; PAM type: NRG; PAM sequence: CAG
gagtgcacatttaatctttc

SEQ ID NO: 153033 - DNA, 20 bp, Artificial Sequence
  Description of Artificial Sequence: Synthetic oligonucleotide
  Target: ATXN1; (+) strand; PAM type: NRG; PAM sequence: GAG
aatctttccagtgattctgt

SEQ ID NO: 153034 - DNA, 20 bp, Artificial Sequence
  Description of Artificial Sequence: Synthetic oligonucleotide
  Target: ATXN1; (+) strand; PAM type: NRG; PAM sequence: TAG
tttccagtgattctgtgagt

SEQ ID NO: 153035 - DNA, 20 bp, Artificial Sequence
  Description of Artificial Sequence: Synthetic oligonucleotide
  Target: ATXN1; (+) strand; PAM type: NRG; PAM sequence: AGG
ttccagtgattctgtgagtt

SEQ ID NO: 153036 - DNA, 20 bp, Artificial Sequence
  Description of Artificial Sequence: Synthetic oligonucleotide
  Target: ATXN1; (+) strand; PAM type: NRG; PAM sequence: CAG
atattatcatccccattcaa

SEQ ID NO: 153037 - DNA, 20 bp, Artificial Sequence
  Description of Artificial Sequence: Synthetic oligonucleotide
  Target: ATXN1; (+) strand; PAM type: NRG; PAM sequence: GAG
atcatccccattcaacagat

SEQ ID NO: 153038 - DNA, 20 bp, Artificial Sequence
  Description of Artificial Sequence: Synthetic oligonucleotide
  Target: ATXN1; (+) strand; PAM type: NRG; PAM sequence: AGG
tcatccccattcaacagatg

SEQ ID NO: 153039 - DNA, 20 bp, Artificial Sequence
  Description of Artificial Sequence: Synthetic oligonucleotide
  Target: ATXN1; (+) strand; PAM type: NRG; PAM sequence: GAG
attcaacagatgaggaaatt

SEQ ID NO: 153040 - DNA, 20 bp, Artificial Sequence
  Description of Artificial Sequence: Synthetic oligonucleotide
  Target: ATXN1; (+) strand; PAM type: NRG; PAM sequence: AGG
ttcaacagatgaggaaattg

SEQ ID NO: 153041 - DNA, 20 bp, Artificial Sequence
  Description of Artificial Sequence: Synthetic oligonucleotide
  Target: ATXN1; (+) strand; PAM type: NRG; PAM sequence: CAG
gatgaggaaattgaggatca

SEQ ID NO: 153042 - DNA, 20 bp, Artificial Sequence
  Description of Artificial Sequence: Synthetic oligonucleotide
  Target: ATXN1; (+) strand; PAM type: NRG; PAM sequence: AAG
aaattgaggatcacagattt

SEQ ID NO: 153043 - DNA, 20 bp, Artificial Sequence
  Description of Artificial Sequence: Synthetic oligonucleotide
  Target: ATXN1; (+) strand; PAM type: NRG; PAM sequence: AGG
aattgaggatcacagattta

SEQ ID NO: 153044 - DNA, 20 bp, Artificial Sequence
  Description of Artificial Sequence: Synthetic oligonucleotide
  Target: ATXN1; (+) strand; PAM type: NRG; PAM sequence: TGG
cagatttaaggaatgtgacc

SEQ ID NO: 153045 - DNA, 20 bp, Artificial Sequence
  Description of Artificial Sequence: Synthetic oligonucleotide
  Target: ATXN1; (+) strand; PAM type: NRG; PAM sequence: AAG
ggaatgtgacctggaccaca

SEQ ID NO: 153046 - DNA, 20 bp, Artificial Sequence
  Description of Artificial Sequence: Synthetic oligonucleotide
  Target: ATXN1; (+) strand; PAM type: NRG; PAM sequence: CAG
tgtgacctggaccacaaagc

SEQ ID NO: 153047 - DNA, 20 bp, Artificial Sequence
  Description of Artificial Sequence: Synthetic oligonucleotide
  Target: ATXN1; (+) strand; PAM type: NRG; PAM sequence: AGG
gtgacctggaccacaaagcc

SEQ ID NO: 153048 - DNA, 20 bp, Artificial Sequence
  Description of Artificial Sequence: Synthetic oligonucleotide
  Target: ATXN1; (+) strand; PAM type: NRG; PAM sequence: GAG
gacctggaccacaaagccag

SEQ ID NO: 153049 - DNA, 20 bp, Artificial Sequence
  Description of Artificial Sequence: Synthetic oligonucleotide
  Target: ATXN1; (+) strand; PAM type: NRG; PAM sequence: CAG
tggaccacaaagccaggagc

SEQ ID NO: 153050 - DNA, 20 bp, Artificial Sequence
  Description of Artificial Sequence: Synthetic oligonucleotide
  Target: ATXN1; (+) strand; PAM type: NRG; PAM sequence: GAG
gaccacaaagccaggagcca

SEQ ID NO: 153051 - DNA, 20 bp, Artificial Sequence
  Description of Artificial Sequence: Synthetic oligonucleotide
  Target: ATXN1; (+) strand; PAM type: NRG; PAM sequence: CAG
acaaagccaggagccagagc

SEQ ID NO: 153052 - DNA, 20 bp, Artificial Sequence
  Description of Artificial Sequence: Synthetic oligonucleotide
  Target: ATXN1; (+) strand; PAM type: NRG; PAM sequence: AAG
aagccaggagccagagccag

SEQ ID NO: 153053 - DNA, 20 bp, Artificial Sequence
  Description of Artificial Sequence: Synthetic oligonucleotide
  Target: ATXN1; (+) strand; PAM type: NRG; PAM sequence: AGG
agccaggagccagagccaga

SEQ ID NO: 153054 - DNA, 20 bp, Artificial Sequence
  Description of Artificial Sequence: Synthetic oligonucleotide
  Target: ATXN1; (+) strand; PAM type: NRG; PAM sequence: AAG
agccagagccagaaggattc

SEQ ID NO: 153055 - DNA, 20 bp, Artificial Sequence
  Description of Artificial Sequence: Synthetic oligonucleotide
  Target: ATXN1; (+) strand; PAM type: NRG; PAM sequence: AAG
cctcaatctccctgacttta

SEQ ID NO: 153056 - DNA, 20 bp, Artificial Sequence
  Description of Artificial Sequence: Synthetic oligonucleotide
  Target: ATXN1; (+) strand; PAM type: NRG; PAM sequence: TAG
gtcaccttttctatttgcac

SEQ ID NO: 153057 - DNA, 20 bp, Artificial Sequence
  Description of Artificial Sequence: Synthetic oligonucleotide
  Target: ATXN1; (+) strand; PAM type: NRG; PAM sequence: AAG
ctatttgcactagctgccta

SEQ ID NO: 153058 - DNA, 20 bp, Artificial Sequence
  Description of Artificial Sequence: Synthetic oligonucleotide
  Target: ATXN1; (+) strand; PAM type: NRG; PAM sequence: AAG
attaataattgcaatgaatc

SEQ ID NO: 153059 - DNA, 20 bp, Artificial Sequence
  Description of Artificial Sequence: Synthetic oligonucleotide
  Target: ATXN1; (+) strand; PAM type: NRG; PAM sequence: GAG
taataattgcaatgaatcaa

SEQ ID NO: 153060 - DNA, 20 bp, Artificial Sequence
  Description of Artificial Sequence: Synthetic oligonucleotide
  Target: ATXN1; (+) strand; PAM type: NRG; PAM sequence: AGG
aataattgcaatgaatcaag

SEQ ID NO: 153061 - DNA, 20 bp, Artificial Sequence
  Description of Artificial Sequence: Synthetic oligonucleotide
  Target: ATXN1; (+) strand; PAM type: NRG; PAM sequence: AAG
ctgcttatgaattaaccaaa

SEQ ID NO: 153062 - DNA, 20 bp, Artificial Sequence
  Description of Artificial Sequence: Synthetic oligonucleotide
  Target: ATXN1; (+) strand; PAM type: NRG; PAM sequence: AAG
tatgaattaaccaaaaagac

SEQ ID NO: 153063 - DNA, 20 bp, Artificial Sequence
  Description of Artificial Sequence: Synthetic oligonucleotide
  Target: ATXN1; (+) strand; PAM type: NRG; PAM sequence: AGG
atgaattaaccaaaaagaca

SEQ ID NO: 153064 - DNA, 20 bp, Artificial Sequence
  Description of Artificial Sequence: Synthetic oligonucleotide
  Target: ATXN1; (+) strand; PAM type: NRG; PAM sequence: TGG
gcaatgctgcacacactaat

SEQ ID NO: 153065 - DNA, 20 bp, Artificial Sequence
  Description of Artificial Sequence: Synthetic oligonucleotide
  Target: ATXN1; (+) strand; PAM type: NRG; PAM sequence: GGG
caatgctgcacacactaatt

SEQ ID NO: 153066 - DNA, 20 bp, Artificial Sequence
  Description of Artificial Sequence: Synthetic oligonucleotide
  Target: ATXN1; (+) strand; PAM type: NRG; PAM sequence: AAG
gctgcacacactaattggga

SEQ ID NO: 153067 - DNA, 20 bp, Artificial Sequence
  Description of Artificial Sequence: Synthetic oligonucleotide
  Target: ATXN1; (+) strand; PAM type: NRG; PAM sequence: CAG
actaattgggaaagttgacg

SEQ ID NO: 153068 - DNA, 20 bp, Artificial Sequence
  Description of Artificial Sequence: Synthetic oligonucleotide
  Target: ATXN1; (+) strand; PAM type: NRG; PAM sequence: AAG
aattgggaaagttgacgcag

SEQ ID NO: 153069 - DNA, 20 bp, Artificial Sequence
  Description of Artificial Sequence: Synthetic oligonucleotide
  Target: ATXN1; (+) strand; PAM type: NRG; PAM sequence: GAG
ttgggaaagttgacgcagaa

SEQ ID NO: 153070 - DNA, 20 bp, Artificial Sequence
  Description of Artificial Sequence: Synthetic oligonucleotide
  Target: ATXN1; (+) strand; PAM type: NRG; PAM sequence: AAG
aaagttgacgcagaagagaa

SEQ ID NO: 153071 - DNA, 20 bp, Artificial Sequence
  Description of Artificial Sequence: Synthetic oligonucleotide
  Target: ATXN1; (+) strand; PAM type: NRG; PAM sequence: AGG
aagttgacgcagaagagaaa

SEQ ID NO: 153072 - DNA, 20 bp, Artificial Sequence
  Description of Artificial Sequence: Synthetic oligonucleotide
  Target: ATXN1; (+) strand; PAM type: NRG; PAM sequence: TAG
agaagagaaaaggaattacc

SEQ ID NO: 153073 - DNA, 20 bp, Artificial Sequence
  Description of Artificial Sequence: Synthetic oligonucleotide
  Target: ATXN1; (+) strand; PAM type: NRG; PAM sequence: GAG
aagagaaaaggaattaccta

SEQ ID NO: 153074 - DNA, 20 bp, Artificial Sequence
  Description of Artificial Sequence: Synthetic oligonucleotide
  Target: ATXN1; (+) strand; PAM type: NRG; PAM sequence: CAG
gagactaaaacctgcacctg

SEQ ID NO: 153075 - DNA, 20 bp, Artificial Sequence
  Description of Artificial Sequence: Synthetic oligonucleotide
  Target: ATXN1; (+) strand; PAM type: NRG; PAM sequence: AGG
agactaaaacctgcacctgc

SEQ ID NO: 153076 - DNA, 20 bp, Artificial Sequence
  Description of Artificial Sequence: Synthetic oligonucleotide
  Target: ATXN1; (+) strand; PAM type: NRG; PAM sequence: AAG
gatttctacttgcaaattaa

SEQ ID NO: 153077 - DNA, 20 bp, Artificial Sequence
  Description of Artificial Sequence: Synthetic oligonucleotide
  Target: ATXN1; (+) strand; PAM type: NRG; PAM sequence: CAG
ttctacttgcaaattaaaag

SEQ ID NO: 153078 - DNA, 20 bp, Artificial Sequence
  Description of Artificial Sequence: Synthetic oligonucleotide
  Target: ATXN1; (+) strand; PAM type: NRG; PAM sequence: TGG
tgcaaattaaaagcagaata

SEQ ID NO: 153079 - DNA, 20 bp, Artificial Sequence
  Description of Artificial Sequence: Synthetic oligonucleotide
  Target: ATXN1; (+) strand; PAM type: NRG; PAM sequence: TAG
tggcccttgatattactgct

SEQ ID NO: 153080 - DNA, 20 bp, Artificial Sequence
  Description of Artificial Sequence: Synthetic oligonucleotide
  Target: ATXN1; (+) strand; PAM type: NRG; PAM sequence: AAG
cttgatattactgcttagaa

SEQ ID NO: 153081 - DNA, 20 bp, Artificial Sequence
  Description of Artificial Sequence: Synthetic oligonucleotide
  Target: ATXN1; (+) strand; PAM type: NRG; PAM sequence: CAG
gatattactgcttagaaaag

SEQ ID NO: 153082 - DNA, 20 bp, Artificial Sequence
  Description of Artificial Sequence: Synthetic oligonucleotide
  Target: ATXN1; (+) strand; PAM type: NRG; PAM sequence: GAG
tattactgcttagaaaagca

SEQ ID NO: 153083 - DNA, 20 bp, Artificial Sequence
  Description of Artificial Sequence: Synthetic oligonucleotide
  Target: ATXN1; (+) strand; PAM type: NRG; PAM sequence: CAG
gcaaaaaataatcccacaat

SEQ ID NO: 153084 - DNA, 20 bp, Artificial Sequence
  Description of Artificial Sequence: Synthetic oligonucleotide
  Target: ATXN1; (+) strand; PAM type: NRG; PAM sequence: AAG
ataatcccacaatcagctga

SEQ ID NO: 153085 - DNA, 20 bp, Artificial Sequence
  Description of Artificial Sequence: Synthetic oligonucleotide
  Target: ATXN1; (+) strand; PAM type: NRG; PAM sequence: CAG
atcagctgaaagattctttc

SEQ ID NO: 153086 - DNA, 20 bp, Artificial Sequence
  Description of Artificial Sequence: Synthetic oligonucleotide
  Target: ATXN1; (+) strand; PAM type: NRG; PAM sequence: CAG
gttatactgcattccacctc

SEQ ID NO: 153087 - DNA, 20 bp, Artificial Sequence
  Description of Artificial Sequence: Synthetic oligonucleotide
  Target: ATXN1; (+) strand; PAM type: NRG; PAM sequence: TGG
ctgcattccacctccagaaa

SEQ ID NO: 153088 - DNA, 20 bp, Artificial Sequence
  Description of Artificial Sequence: Synthetic oligonucleotide
  Target: ATXN1; (+) strand; PAM type: NRG; PAM sequence: TGG
ctccagaaatggatgttgtt

SEQ ID NO: 153089 - DNA, 20 bp, Artificial Sequence
  Description of Artificial Sequence: Synthetic oligonucleotide
  Target: ATXN1; (+) strand; PAM type: NRG; PAM sequence: GGG
tccagaaatggatgttgttt

SEQ ID NO: 153090 - DNA, 20 bp, Artificial Sequence
  Description of Artificial Sequence: Synthetic oligonucleotide
  Target: ATXN1; (+) strand; PAM type: NRG; PAM sequence: TGG
aatggatgttgtttgggaca

SEQ ID NO: 153091 - DNA, 20 bp, Artificial Sequence
  Description of Artificial Sequence: Synthetic oligonucleotide
  Target: ATXN1; (+) strand; PAM type: NRG; PAM sequence: TAG
ggatgttgtttgggacatgg

SEQ ID NO: 153092 - DNA, 20 bp, Artificial Sequence
  Description of Artificial Sequence: Synthetic oligonucleotide
  Target: ATXN1; (+) strand; PAM type: NRG; PAM sequence: AAG
gttgtttgggacatggtagc

SEQ ID NO: 153093 - DNA, 20 bp, Artificial Sequence
  Description of Artificial Sequence: Synthetic oligonucleotide
  Target: ATXN1; (+) strand; PAM type: NRG; PAM sequence: CAG
ttgggacatggtagcaagaa

SEQ ID NO: 153094 - DNA, 20 bp, Artificial Sequence
  Description of Artificial Sequence: Synthetic oligonucleotide
  Target: ATXN1; (+) strand; PAM type: NRG; PAM sequence: AAG
atggtagcaagaacagtaaa

SEQ ID NO: 153095 - DNA, 20 bp, Artificial Sequence
  Description of Artificial Sequence: Synthetic oligonucleotide
  Target: ATXN1; (+) strand; PAM type: NRG; PAM sequence: AGG
tggtagcaagaacagtaaaa

SEQ ID NO: 153096 - DNA, 20 bp, Artificial Sequence
  Description of Artificial Sequence: Synthetic oligonucleotide
  Target: ATXN1; (+) strand; PAM type: NRG; PAM sequence: GAG
gtagcaagaacagtaaaaag

SEQ ID NO: 153097 - DNA, 20 bp, Artificial Sequence
  Description of Artificial Sequence: Synthetic oligonucleotide
  Target: ATXN1; (+) strand; PAM type: NRG; PAM sequence: CGG
gcaagaacagtaaaaaggag

SEQ ID NO: 153098 - DNA, 20 bp, Artificial Sequence
  Description of Artificial Sequence: Synthetic oligonucleotide
  Target: ATXN1; (+) strand; PAM type: NRG; PAM sequence: GAG
aagaacagtaaaaaggagcg

SEQ ID NO: 153099 - DNA, 20 bp, Artificial Sequence
  Description of Artificial Sequence: Synthetic oligonucleotide
  Target: ATXN1; (+) strand; PAM type: NRG; PAM sequence: AGG
agaacagtaaaaaggagcgg

SEQ ID NO: 153100 - DNA, 20 bp, Artificial Sequence
  Description of Artificial Sequence: Synthetic oligonucleotide
  Target: ATXN1; (+) strand; PAM type: NRG; PAM sequence: AAG
acagtaaaaaggagcggagg

SEQ ID NO: 153101 - DNA, 20 bp, Artificial Sequence
  Description of Artificial Sequence: Synthetic oligonucleotide
  Target: ATXN1; (+) strand; PAM type: NRG; PAM sequence: CAG
aaaggagcggaggaagtatt

SEQ ID NO: 153102 - DNA, 20 bp, Artificial Sequence
  Description of Artificial Sequence: Synthetic oligonucleotide
  Target: ATXN1; (+) strand; PAM type: NRG; PAM sequence: AGG
aaggagcggaggaagtattc

SEQ ID NO: 153103 - DNA, 20 bp, Artificial Sequence
  Description of Artificial Sequence: Synthetic oligonucleotide
  Target: ATXN1; (+) strand; PAM type: NRG; PAM sequence: TAG
attcaggtatgaaactaata

SEQ ID NO: 153104 - DNA, 20 bp, Artificial Sequence
  Description of Artificial Sequence: Synthetic oligonucleotide
  Target: ATXN1; (+) strand; PAM type: NRG; PAM sequence: TGG
aggtatgaaactaatataga

SEQ ID NO: 153105 - DNA, 20 bp, Artificial Sequence
  Description of Artificial Sequence: Synthetic oligonucleotide
  Target: ATXN1; (+) strand; PAM type: NRG; PAM sequence: GGG
ggtatgaaactaatatagat

SEQ ID NO: 153106 - DNA, 20 bp, Artificial Sequence
  Description of Artificial Sequence: Synthetic oligonucleotide
  Target: ATXN1; (+) strand; PAM type: NRG; PAM sequence: GGG
gtatgaaactaatatagatg

SEQ ID NO: 153107 - DNA, 20 bp, Artificial Sequence
  Description of Artificial Sequence: Synthetic oligonucleotide
  Target: ATXN1; (+) strand; PAM type: NRG; PAM sequence: TAG
gatggggtgataaatgaatt

SEQ ID NO: 153108 - DNA, 20 bp, Artificial Sequence
  Description of Artificial Sequence: Synthetic oligonucleotide
  Target: ATXN1; (+) strand; PAM type: NRG; PAM sequence: AGG
atggggtgataaatgaattt

SEQ ID NO: 153109 - DNA, 20 bp, Artificial Sequence
  Description of Artificial Sequence: Synthetic oligonucleotide
  Target: ATXN1; (+) strand; PAM type: NRG; PAM sequence: TAG
tataaataatgacataataa

SEQ ID NO: 153110 - DNA, 20 bp, Artificial Sequence
  Description of Artificial Sequence: Synthetic oligonucleotide
  Target: ATXN1; (+) strand; PAM type: NRG; PAM sequence: AAG
attaaatacaaaatctaaca

SEQ ID NO: 153111 - DNA, 20 bp, Artificial Sequence
  Description of Artificial Sequence: Synthetic oligonucleotide
  Target: ATXN1; (+) strand; PAM type: NRG; PAM sequence: CAG
aatctaacaaagtcaaacaa

SEQ ID NO: 153112 - DNA, 20 bp, Artificial Sequence
  Description of Artificial Sequence: Synthetic oligonucleotide
  Target: ATXN1; (+) strand; PAM type: NRG; PAM sequence: CAG
caacagcaaatgatgtttga

SEQ ID NO: 153113 - DNA, 20 bp, Artificial Sequence
  Description of Artificial Sequence: Synthetic oligonucleotide
  Target: ATXN1; (+) strand; PAM type: NRG; PAM sequence: AAG
cagcaaatgatgtttgacag

SEQ ID NO: 153114 - DNA, 20 bp, Artificial Sequence
  Description of Artificial Sequence: Synthetic oligonucleotide
  Target: ATXN1; (+) strand; PAM type: NRG; PAM sequence: AAG
aatgatgtttgacagaagca

SEQ ID NO: 153115 - DNA, 20 bp, Artificial Sequence
  Description of Artificial Sequence: Synthetic oligonucleotide
  Target: ATXN1; (+) strand; PAM type: NRG; PAM sequence: AGG
atgatgtttgacagaagcaa

SEQ ID NO: 153116 - DNA, 20 bp, Artificial Sequence
  Description of Artificial Sequence: Synthetic oligonucleotide
  Target: ATXN1; (+) strand; PAM type: NRG; PAM sequence: TGG
tttgacagaagcaaaggtct

SEQ ID NO: 153117 - DNA, 20 bp, Artificial Sequence
  Description of Artificial Sequence: Synthetic oligonucleotide
  Target: ATXN1; (+) strand; PAM type: NRG; PAM sequence: GGG
ttgacagaagcaaaggtctt

SEQ ID NO: 153118 - DNA, 20 bp, Artificial Sequence
  Description of Artificial Sequence: Synthetic oligonucleotide
  Target: ATXN1; (+) strand; PAM type: NRG; PAM sequence: GGG
tgacagaagcaaaggtcttg

SEQ ID NO: 153119 - DNA, 20 bp, Artificial Sequence
  Description of Artificial Sequence: Synthetic oligonucleotide
  Target: ATXN1; (+) strand; PAM type: NRG; PAM sequence: GGG
gacagaagcaaaggtcttgg

SEQ ID NO: 153120 - DNA, 20 bp, Artificial Sequence
  Description of Artificial Sequence: Synthetic oligonucleotide
  Target: ATXN1; (+) strand; PAM type: NRG; PAM sequence: GAG
cagaagcaaaggtcttgggg

SEQ ID NO: 153121 - DNA, 20 bp, Artificial Sequence
  Description of Artificial Sequence: Synthetic oligonucleotide
  Target: ATXN1; (+) strand; PAM type: NRG; PAM sequence: CGG
agcaaaggtcttgggggagc

SEQ ID NO: 153122 - DNA, 20 bp, Artificial Sequence
  Description of Artificial Sequence: Synthetic oligonucleotide
  Target: ATXN1; (+) strand; PAM type: NRG; PAM sequence: GGG
gcaaaggtcttgggggagcc

SEQ ID NO: 153123 - DNA, 20 bp, Artificial Sequence
  Description of Artificial Sequence: Synthetic oligonucleotide
  Target: ATXN1; (+) strand; PAM type: NRG; PAM sequence: GAG
aaaggtcttgggggagccgg

SEQ ID NO: 153124 - DNA, 20 bp, Artificial Sequence
  Description of Artificial Sequence: Synthetic oligonucleotide
  Target: ATXN1; (+) strand; PAM type: NRG; PAM sequence: AAG
gtcttgggggagccgggagc

SEQ ID NO: 153125 - DNA, 20 bp, Artificial Sequence
  Description of Artificial Sequence: Synthetic oligonucleotide
  Target: ATXN1; (+) strand; PAM type: NRG; PAM sequence: TGG
attacaataaaatctattca

SEQ ID NO: 153126 - DNA, 20 bp, Artificial Sequence
  Description of Artificial Sequence: Synthetic oligonucleotide
  Target: ATXN1; (+) strand; PAM type: NRG; PAM sequence: CAG
ttcatggaactgtacaatgt

SEQ ID NO: 153127 - DNA, 20 bp, Artificial Sequence
  Description of Artificial Sequence: Synthetic oligonucleotide
  Target: ATXN1; (+) strand; PAM type: NRG; PAM sequence: GAG
catggaactgtacaatgtca

SEQ ID NO: 153128 - DNA, 20 bp, Artificial Sequence
  Description of Artificial Sequence: Synthetic oligonucleotide
  Target: ATXN1; (+) strand; PAM type: NRG; PAM sequence: TAG
gaactgtacaatgtcagaga

SEQ ID NO: 153129 - DNA, 20 bp, Artificial Sequence
  Description of Artificial Sequence: Synthetic oligonucleotide
  Target: ATXN1; (+) strand; PAM type: NRG; PAM sequence: AAG
ctgtacaatgtcagagatag

SEQ ID NO: 153130 - DNA, 20 bp, Artificial Sequence
  Description of Artificial Sequence: Synthetic oligonucleotide
  Target: ATXN1; (+) strand; PAM type: NRG; PAM sequence: GAG
gtacaatgtcagagatagaa

SEQ ID NO: 153131 - DNA, 20 bp, Artificial Sequence
  Description of Artificial Sequence: Synthetic oligonucleotide
  Target: ATXN1; (+) strand; PAM type: NRG; PAM sequence: GAG
gtcagagatagaagagtccc

SEQ ID NO: 153132 - DNA, 20 bp, Artificial Sequence
  Description of Artificial Sequence: Synthetic oligonucleotide
  Target: ATXN1; (+) strand; PAM type: NRG; PAM sequence: GAG
cagagatagaagagtcccga

SEQ ID NO: 153133 - DNA, 20 bp, Artificial Sequence
  Description of Artificial Sequence: Synthetic oligonucleotide
  Target: ATXN1; (+) strand; PAM type: NRG; PAM sequence: TGG
ctttcaacctccttgtgttt

SEQ ID NO: 153134 - DNA, 20 bp, Artificial Sequence
  Description of Artificial Sequence: Synthetic oligonucleotide
  Target: ATXN1; (+) strand; PAM type: NRG; PAM sequence: GAG
ttcaacctccttgtgttttg

SEQ ID NO: 153135 - DNA, 20 bp, Artificial Sequence
  Description of Artificial Sequence: Synthetic oligonucleotide
  Target: ATXN1; (+) strand; PAM type: NRG; PAM sequence: CAG
acctccttgtgttttggaga

SEQ ID NO: 153136 - DNA, 20 bp, Artificial Sequence
  Description of Artificial Sequence: Synthetic oligonucleotide
  Target: ATXN1; (+) strand; PAM type: NRG; PAM sequence: AGG
cctccttgtgttttggagac

SEQ ID NO: 153137 - DNA, 20 bp, Artificial Sequence
  Description of Artificial Sequence: Synthetic oligonucleotide
  Target: ATXN1; (+) strand; PAM type: NRG; PAM sequence: GAG
gttttggagacaggaaaact

SEQ ID NO: 153138 - DNA, 20 bp, Artificial Sequence
  Description of Artificial Sequence: Synthetic oligonucleotide
  Target: ATXN1; (+) strand; PAM type: NRG; PAM sequence: CAG
gagacaggaaaactgagacc

SEQ ID NO: 153139 - DNA, 20 bp, Artificial Sequence
  Description of Artificial Sequence: Synthetic oligonucleotide
  Target: ATXN1; (+) strand; PAM type: NRG; PAM sequence: AAG
caggaaaactgagacccagc

SEQ ID NO: 153140 - DNA, 20 bp, Artificial Sequence
  Description of Artificial Sequence: Synthetic oligonucleotide
  Target: ATXN1; (+) strand; PAM type: NRG; PAM sequence: AGG
aggaaaactgagacccagca

SEQ ID NO: 153141 - DNA, 20 bp, Artificial Sequence
  Description of Artificial Sequence: Synthetic oligonucleotide
  Target: ATXN1; (+) strand; PAM type: NRG; PAM sequence: CAG
aactgagacccagcaaggta

SEQ ID NO: 153142 - DNA, 20 bp, Artificial Sequence
  Description of Artificial Sequence: Synthetic oligonucleotide
  Target: ATXN1; (+) strand; PAM type: NRG; PAM sequence: GAG
gagacccagcaaggtacagt

SEQ ID NO: 153143 - DNA, 20 bp, Artificial Sequence
  Description of Artificial Sequence: Synthetic oligonucleotide
  Target: ATXN1; (+) strand; PAM type: NRG; PAM sequence: TAG
acccagcaaggtacagtgag

SEQ ID NO: 153144 - DNA, 20 bp, Artificial Sequence
  Description of Artificial Sequence: Synthetic oligonucleotide
  Target: ATXN1; (+) strand; PAM type: NRG; PAM sequence: AAG
caaggtacagtgagtagcac

SEQ ID NO: 153145 - DNA, 20 bp, Artificial Sequence
  Description of Artificial Sequence: Synthetic oligonucleotide
  Target: ATXN1; (+) strand; PAM type: NRG; PAM sequence: CAG
tagcacaagtcatcctgttg

SEQ ID NO: 153146 - DNA, 20 bp, Artificial Sequence
  Description of Artificial Sequence: Synthetic oligonucleotide
  Target: ATXN1; (+) strand; PAM type: NRG; PAM sequence: AGG
agcacaagtcatcctgttgc

SEQ ID NO: 153147 - DNA, 20 bp, Artificial Sequence
  Description of Artificial Sequence: Synthetic oligonucleotide
  Target: ATXN1; (+) strand; PAM type: NRG; PAM sequence: GGG
gcacaagtcatcctgttgca

SEQ ID NO: 153148 - DNA, 20 bp, Artificial Sequence
  Description of Artificial Sequence: Synthetic oligonucleotide
  Target: ATXN1; (+) strand; PAM type: NRG; PAM sequence: CAG
caagtcatcctgttgcaggg

SEQ ID NO: 153149 - DNA, 20 bp, Artificial Sequence
  Description of Artificial Sequence: Synthetic oligonucleotide
  Target: ATXN1; (+) strand; PAM type: NRG; PAM sequence: AGG
aagtcatcctgttgcagggc

SEQ ID NO: 153150 - DNA, 20 bp, Artificial Sequence
  Description of Artificial Sequence: Synthetic oligonucleotide
  Target: ATXN1; (+) strand; PAM type: NRG; PAM sequence: CAG
tcctgttgcagggcaggcaa

SEQ ID NO: 153151 - DNA, 20 bp, Artificial Sequence
  Description of Artificial Sequence: Synthetic oligonucleotide
  Target: ATXN1; (+) strand; PAM type: NRG; PAM sequence: GAG
cagggcaggcaacagaaact

SEQ ID NO: 153152 - DNA, 20 bp, Artificial Sequence
  Description of Artificial Sequence: Synthetic oligonucleotide
  Target: ATXN1; (+) strand; PAM type: NRG; PAM sequence: CAG
aaactgagcctccaaactac

SEQ ID NO: 153153 - DNA, 20 bp, Artificial Sequence
  Description of Artificial Sequence: Synthetic oligonucleotide
  Target: ATXN1; (+) strand; PAM type: NRG; PAM sequence: CAG
cctccaaactaccagtccaa

SEQ ID NO: 153154 - DNA, 20 bp, Artificial Sequence
  Description of Artificial Sequence: Synthetic oligonucleotide
  Target: ATXN1; (+) strand; PAM type: NRG; PAM sequence: TAG
agcacaccatactcactctg

SEQ ID NO: 153155 - DNA, 20 bp, Artificial Sequence
  Description of Artificial Sequence: Synthetic oligonucleotide
  Target: ATXN1; (+) strand; PAM type: NRG; PAM sequence: AGG
gcacaccatactcactctgt

SEQ ID NO: 153156 - DNA, 20 bp, Artificial Sequence
  Description of Artificial Sequence: Synthetic oligonucleotide
  Target: ATXN1; (+) strand; PAM type: NRG; PAM sequence: GGG
cacaccatactcactctgta

SEQ ID NO: 153157 - DNA, 20 bp, Artificial Sequence
  Description of Artificial Sequence: Synthetic oligonucleotide
  Target: ATXN1; (+) strand; PAM type: NRG; PAM sequence: TGG
atactcactctgtagggtcc

SEQ ID NO: 153158 - DNA, 20 bp, Artificial Sequence
  Description of Artificial Sequence: Synthetic oligonucleotide
  Target: ATXN1; (+) strand; PAM type: NRG; PAM sequence: AAG
ctcactctgtagggtcctgg

SEQ ID NO: 153159 - DNA, 20 bp, Artificial Sequence
  Description of Artificial Sequence: Synthetic oligonucleotide
  Target: ATXN1; (+) strand; PAM type: NRG; PAM sequence: AAG
atttgaaaccatattttcaa

SEQ ID NO: 153160 - DNA, 20 bp, Artificial Sequence
  Description of Artificial Sequence: Synthetic oligonucleotide
  Target: ATXN1; (+) strand; PAM type: NRG; PAM sequence: CAG
tttaataattttctaatgca

SEQ ID NO: 153161 - DNA, 20 bp, Artificial Sequence
  Description of Artificial Sequence: Synthetic oligonucleotide
  Target: ATXN1; (+) strand; PAM type: NRG; PAM sequence: AGG
ttaataattttctaatgcac

SEQ ID NO: 153162 - DNA, 20 bp, Artificial Sequence
  Description of Artificial Sequence: Synthetic oligonucleotide
  Target: ATXN1; (+) strand; PAM type: NRG; PAM sequence: GGG
taataattttctaatgcaca

SEQ ID NO: 153163 - DNA, 20 bp, Artificial Sequence
  Description of Artificial Sequence: Synthetic oligonucleotide
  Target: ATXN1; (+) strand; PAM type: NRG; PAM sequence: GGG
aataattttctaatgcacag

SEQ ID NO: 153164 - DNA, 20 bp, Artificial Sequence
  Description of Artificial Sequence: Synthetic oligonucleotide
  Target: ATXN1; (+) strand; PAM type: NRG; PAM sequence: AAG
gcacaggggcacattttaaa

SEQ ID NO: 153165 - DNA, 20 bp, Artificial Sequence
  Description of Artificial Sequence: Synthetic oligonucleotide
  Target: ATXN1; (+) strand; PAM type: NRG; PAM sequence: AAG
caggggcacattttaaaaag

SEQ ID NO: 153166 - DNA, 20 bp, Artificial Sequence
  Description of Artificial Sequence: Synthetic oligonucleotide
  Target: ATXN1; (+) strand; PAM type: NRG; PAM sequence: TGG
gcacattttaaaaagaagcc

SEQ ID NO: 153167 - DNA, 20 bp, Artificial Sequence
  Description of Artificial Sequence: Synthetic oligonucleotide
  Target: ATXN1; (+) strand; PAM type: NRG; PAM sequence: TGG
agcctggttttgatttcttt

SEQ ID NO: 153168 - DNA, 20 bp, Artificial Sequence
  Description of Artificial Sequence: Synthetic oligonucleotide
  Target: ATXN1; (+) strand; PAM type: NRG; PAM sequence: CGG
ttggaaaactgcacgctgct

SEQ ID NO: 153169 - DNA, 20 bp, Artificial Sequence
  Description of Artificial Sequence: Synthetic oligonucleotide
  Target: ATXN1; (+) strand; PAM type: NRG; PAM sequence: TGG
acgctgctcggtgtttaatc

SEQ ID NO: 153170 - DNA, 20 bp, Artificial Sequence
  Description of Artificial Sequence: Synthetic oligonucleotide
  Target: ATXN1; (+) strand; PAM type: NRG; PAM sequence: GAG
tcggtgtttaatctggtatt

SEQ ID NO: 153171 - DNA, 20 bp, Artificial Sequence
  Description of Artificial Sequence: Synthetic oligonucleotide
  Target: ATXN1; (+) strand; PAM type: NRG; PAM sequence: CAG
ggtattgagtgaaatattaa

SEQ ID NO: 153172 - DNA, 20 bp, Artificial Sequence
  Description of Artificial Sequence: Synthetic oligonucleotide
  Target: ATXN1; (+) strand; PAM type: NRG; PAM sequence: AGG
gtattgagtgaaatattaac

SEQ ID NO: 153173 - DNA, 20 bp, Artificial Sequence
  Description of Artificial Sequence: Synthetic oligonucleotide
  Target: ATXN1; (+) strand; PAM type: NRG; PAM sequence: TGG
aatattaacaggccatataa

SEQ ID NO: 153174 - DNA, 20 bp, Artificial Sequence
  Description of Artificial Sequence: Synthetic oligonucleotide
  Target: ATXN1; (+) strand; PAM type: NRG; PAM sequence: CAG
taatggtttcactgttcctt

SEQ ID NO: 153175 - DNA, 20 bp, Artificial Sequence
  Description of Artificial Sequence: Synthetic oligonucleotide
  Target: ATXN1; (+) strand; PAM type: NRG; PAM sequence: AAG
gtttcactgttccttcagta

SEQ ID NO: 153176 - DNA, 20 bp, Artificial Sequence
  Description of Artificial Sequence: Synthetic oligonucleotide
  Target: ATXN1; (+) strand; PAM type: NRG; PAM sequence: CAG
gttccttcagtaaagctaaa

SEQ ID NO: 153177 - DNA, 20 bp, Artificial Sequence
  Description of Artificial Sequence: Synthetic oligonucleotide
  Target: ATXN1; (+) strand; PAM type: NRG; PAM sequence: CAG
aactcgaaaaacatatcccc

SEQ ID NO: 153178 - DNA, 20 bp, Artificial Sequence
  Description of Artificial Sequence: Synthetic oligonucleotide
  Target: ATXN1; (+) strand; PAM type: NRG; PAM sequence: AGG
actcgaaaaacatatccccc

SEQ ID NO: 153179 - DNA, 20 bp, Artificial Sequence
  Description of Artificial Sequence: Synthetic oligonucleotide
  Target: ATXN1; (+) strand; PAM type: NRG; PAM sequence: CAG
aaacatatcccccaggccta

SEQ ID NO: 153180 - DNA, 20 bp, Artificial Sequence
  Description of Artificial Sequence: Synthetic oligonucleotide
  Target: ATXN1; (+) strand; PAM type: NRG; PAM sequence: TGG
catatcccccaggcctacag

SEQ ID NO: 153181 - DNA, 20 bp, Artificial Sequence
  Description of Artificial Sequence: Synthetic oligonucleotide
  Target: ATXN1; (+) strand; PAM type: NRG; PAM sequence: GAG
tatcccccaggcctacagtg

SEQ ID NO: 153182 - DNA, 20 bp, Artificial Sequence
  Description of Artificial Sequence: Synthetic oligonucleotide
  Target: ATXN1; (+) strand; PAM type: NRG; PAM sequence: TGG
caggcctacagtggagtttc

SEQ ID NO: 153183 - DNA, 20 bp, Artificial Sequence
  Description of Artificial Sequence: Synthetic oligonucleotide
  Target: ATXN1; (+) strand; PAM type: NRG; PAM sequence: GAG
ggcctacagtggagtttctg

SEQ ID NO: 153184 - DNA, 20 bp, Artificial Sequence
  Description of Artificial Sequence: Synthetic oligonucleotide
  Target: ATXN1; (+) strand; PAM type: NRG; PAM sequence: AAG
aactccacgctctgctcaac

SEQ ID NO: 153185 - DNA, 20 bp, Artificial Sequence
  Description of Artificial Sequence: Synthetic oligonucleotide
  Target: ATXN1; (+) strand; PAM type: NRG; PAM sequence: AAG
tcaacaagcccatcgctgtt

SEQ ID NO: 153186 - DNA, 20 bp, Artificial Sequence
  Description of Artificial Sequence: Synthetic oligonucleotide
  Target: ATXN1; (+) strand; PAM type: NRG; PAM sequence: CAG
atcgctgttaagtaactcat

SEQ ID NO: 153187 - DNA, 20 bp, Artificial Sequence
  Description of Artificial Sequence: Synthetic oligonucleotide
  Target: ATXN1; (+) strand; PAM type: NRG; PAM sequence: AAG
aagtaactcatcagaaaata

SEQ ID NO: 153188 - DNA, 20 bp, Artificial Sequence
  Description of Artificial Sequence: Synthetic oligonucleotide
  Target: ATXN1; (+) strand; PAM type: NRG; PAM sequence: GAG
gtaactcatcagaaaataaa

SEQ ID NO: 153189 - DNA, 20 bp, Artificial Sequence
  Description of Artificial Sequence: Synthetic oligonucleotide
  Target: ATXN1; (+) strand; PAM type: NRG; PAM sequence: AGG
taactcatcagaaaataaag

SEQ ID NO: 153190 - DNA, 20 bp, Artificial Sequence
  Description of Artificial Sequence: Synthetic oligonucleotide
  Target: ATXN1; (+) strand; PAM type: NRG; PAM sequence: GGG
aactcatcagaaaataaaga

SEQ ID NO: 153191 - DNA, 20 bp, Artificial Sequence
  Description of Artificial Sequence: Synthetic oligonucleotide
  Target: ATXN1; (+) strand; PAM type: NRG; PAM sequence: AAG
aaataaagagggaattacca

SEQ ID NO: 153192 - DNA, 20 bp, Artificial Sequence
  Description of Artificial Sequence: Synthetic oligonucleotide
  Target: ATXN1; (+) strand; PAM type: NRG; PAM sequence: AGG
aataaagagggaattaccaa

SEQ ID NO: 153193 - DNA, 20 bp, Artificial Sequence
  Description of Artificial Sequence: Synthetic oligonucleotide
  Target: ATXN1; (+) strand; PAM type: NRG; PAM sequence: GGG
ataaagagggaattaccaaa

SEQ ID NO: 153194 - DNA, 20 bp, Artificial Sequence
  Description of Artificial Sequence: Synthetic oligonucleotide
  Target: ATXN1; (+) strand; PAM type: NRG; PAM sequence: GGG
taaagagggaattaccaaag

SEQ ID NO: 153195 - DNA, 20 bp, Artificial Sequence
  Description of Artificial Sequence: Synthetic oligonucleotide
  Target: ATXN1; (+) strand; PAM type: NRG; PAM sequence: AAG
attaccaaaggggaattgcc

SEQ ID NO: 153196 - DNA, 20 bp, Artificial Sequence
  Description of Artificial Sequence: Synthetic oligonucleotide
  Target: ATXN1; (+) strand; PAM type: NRG; PAM sequence: TAG
aaggggaattgccaagcaat

SEQ ID NO: 153197 - DNA, 20 bp, Artificial Sequence
  Description of Artificial Sequence: Synthetic oligonucleotide
  Target: ATXN1; (+) strand; PAM type: NRG; PAM sequence: AAG
gccaagcaattagttctctg

SEQ ID NO: 153198 - DNA, 20 bp, Artificial Sequence
  Description of Artificial Sequence: Synthetic oligonucleotide
  Target: ATXN1; (+) strand; PAM type: NRG; PAM sequence: CAG
aagcaattagttctctgaag

SEQ ID NO: 153199 - DNA, 20 bp, Artificial Sequence
  Description of Artificial Sequence: Synthetic oligonucleotide
  Target: ATXN1; (+) strand; PAM type: NRG; PAM sequence: CAG
cagacgacatacaactgtta

SEQ ID NO: 153200 - DNA, 20 bp, Artificial Sequence
  Description of Artificial Sequence: Synthetic oligonucleotide
  Target: ATXN1; (+) strand; PAM type: NRG; PAM sequence: AGG
agacgacatacaactgttac

SEQ ID NO: 153201 - DNA, 20 bp, Artificial Sequence
  Description of Artificial Sequence: Synthetic oligonucleotide
  Target: ATXN1; (+) strand; PAM type: NRG; PAM sequence: GGG
gacgacatacaactgttaca

SEQ ID NO: 153202 - DNA, 20 bp, Artificial Sequence
  Description of Artificial Sequence: Synthetic oligonucleotide
  Target: ATXN1; (+) strand; PAM type: NRG; PAM sequence: GAG
cgacatacaactgttacagg

SEQ ID NO: 153203 - DNA, 20 bp, Artificial Sequence
  Description of Artificial Sequence: Synthetic oligonucleotide
  Target: ATXN1; (+) strand; PAM type: NRG; PAM sequence: AGG
gacatacaactgttacaggg

SEQ ID NO: 153204 - DNA, 20 bp, Artificial Sequence
  Description of Artificial Sequence: Synthetic oligonucleotide
  Target: ATXN1; (+) strand; PAM type: NRG; PAM sequence: GAG
catacaactgttacagggag

SEQ ID NO: 153205 - DNA, 20 bp, Artificial Sequence
  Description of Artificial Sequence: Synthetic oligonucleotide
  Target: ATXN1; (+) strand; PAM type: NRG; PAM sequence: CGG
tgttacagggaggagcttcc

SEQ ID NO: 153206 - DNA, 20 bp, Artificial Sequence
  Description of Artificial Sequence: Synthetic oligonucleotide
  Target: ATXN1; (+) strand; PAM type: NRG; PAM sequence: TAG
acagggaggagcttcccggt

SEQ ID NO: 153207 - DNA, 20 bp, Artificial Sequence
  Description of Artificial Sequence: Synthetic oligonucleotide
  Target: ATXN1; (+) strand; PAM type: NRG; PAM sequence: CAG
cttcccggttagtcatatgt

SEQ ID NO: 153208 - DNA, 20 bp, Artificial Sequence
  Description of Artificial Sequence: Synthetic oligonucleotide
  Target: ATXN1; (+) strand; PAM type: NRG; PAM sequence: GAG
tcccggttagtcatatgtca

SEQ ID NO: 153209 - DNA, 20 bp, Artificial Sequence
  Description of Artificial Sequence: Synthetic oligonucleotide
  Target: ATXN1; (+) strand; PAM type: NRG; PAM sequence: CAG
ggttagtcatatgtcagagt

SEQ ID NO: 153210 - DNA, 20 bp, Artificial Sequence
  Description of Artificial Sequence: Synthetic oligonucleotide
  Target: ATXN1; (+) strand; PAM type: NRG; PAM sequence: GAG
ttagtcatatgtcagagtca

SEQ ID NO: 153211 - DNA, 20 bp, Artificial Sequence
  Description of Artificial Sequence: Synthetic oligonucleotide
  Target: ATXN1; (+) strand; PAM type: NRG; PAM sequence: CAG
aaatgcatcacatatgatta

SEQ ID NO: 153212 - DNA, 20 bp, Artificial Sequence
  Description of Artificial Sequence: Synthetic oligonucleotide
  Target: ATXN1; (+) strand; PAM type: NRG; PAM sequence: TAG
atatgattacagctgtgatg

SEQ ID NO: 153213 - DNA, 20 bp, Artificial Sequence
  Description of Artificial Sequence: Synthetic oligonucleotide
  Target: ATXN1; (+) strand; PAM type: NRG; PAM sequence: AGG
tatgattacagctgtgatgt

SEQ ID NO: 153214 - DNA, 20 bp, Artificial Sequence
  Description of Artificial Sequence: Synthetic oligonucleotide
  Target: ATXN1; (+) strand; PAM type: NRG; PAM sequence: AAG
tacagctgtgatgtaggctg

SEQ ID NO: 153215 - DNA, 20 bp, Artificial Sequence
  Description of Artificial Sequence: Synthetic oligonucleotide
  Target: ATXN1; (+) strand; PAM type: NRG; PAM sequence: CAG
gtgatgtaggctgaagctgc

SEQ ID NO: 153216 - DNA, 20 bp, Artificial Sequence
  Description of Artificial Sequence: Synthetic oligonucleotide
  Target: ATXN1; (+) strand; PAM type: NRG; PAM sequence: AGG
tgatgtaggctgaagctgcc

SEQ ID NO: 153217 - DNA, 20 bp, Artificial Sequence
  Description of Artificial Sequence: Synthetic oligonucleotide
  Target: ATXN1; (+) strand; PAM type: NRG; PAM sequence: TAG
gtaggctgaagctgccaggc

SEQ ID NO: 153218 - DNA, 20 bp, Artificial Sequence
  Description of Artificial Sequence: Synthetic oligonucleotide
  Target: ATXN1; (+) strand; PAM type: NRG; PAM sequence: AGG
taggctgaagctgccaggct

SEQ ID NO: 153219 - DNA, 20 bp, Artificial Sequence
  Description of Artificial Sequence: Synthetic oligonucleotide
  Target: ATXN1; (+) strand; PAM type: NRG; PAM sequence: GGG
aggctgaagctgccaggcta

SEQ ID NO: 153220 - DNA, 20 bp, Artificial Sequence
  Description of Artificial Sequence: Synthetic oligonucleotide
  Target: ATXN1; (+) strand; PAM type: NRG; PAM sequence: TAG
ctgccaggctagggcacgaa

SEQ ID NO: 153221 - DNA, 20 bp, Artificial Sequence
  Description of Artificial Sequence: Synthetic oligonucleotide
  Target: ATXN1; (+) strand; PAM type: NRG; PAM sequence: TGG
catcctcttctcgatttccg

SEQ ID NO: 153222 - DNA, 20 bp, Artificial Sequence
  Description of Artificial Sequence: Synthetic oligonucleotide
  Target: ATXN1; (+) strand; PAM type: NRG; PAM sequence: GGG
atcctcttctcgatttccgt

SEQ ID NO: 153223 - DNA, 20 bp, Artificial Sequence
  Description of Artificial Sequence: Synthetic oligonucleotide
  Target: ATXN1; (+) strand; PAM type: NRG; PAM sequence: AAG
cgatttccgtgggtctgtaa

SEQ ID NO: 153224 - DNA, 20 bp, Artificial Sequence
  Description of Artificial Sequence: Synthetic oligonucleotide
  Target: ATXN1; (+) strand; PAM type: NRG; PAM sequence: AAG
ttccgtgggtctgtaaaagc

SEQ ID NO: 153225 - DNA, 20 bp, Artificial Sequence
  Description of Artificial Sequence: Synthetic oligonucleotide
  Target: ATXN1; (+) strand; PAM type: NRG; PAM sequence: GAG
ccgtgggtctgtaaaagcaa

SEQ ID NO: 153226 - DNA, 20 bp, Artificial Sequence
  Description of Artificial Sequence: Synthetic oligonucleotide
  Target: ATXN1; (+) strand; PAM type: NRG; PAM sequence: AAG
aagcaagagatgttgccttg

SEQ ID NO: 153227 - DNA, 20 bp, Artificial Sequence
  Description of Artificial Sequence: Synthetic oligonucleotide
  Target: ATXN1; (+) strand; PAM type: NRG; PAM sequence: AAG
accaaaaaaaaaaaaaacaa

SEQ ID NO: 153228 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaaaacaaaagtcct

SEQ ID NO: 153229 - DNA, 20 bp, Artificial Sequence
  Description of Artificial Sequence: Synthetic oligonucleotide
  Target: ATXN1; (+) strand; PAM type: NRG; PAM sequence: CAG
gtcctcagtaatttttcact

SEQ ID NO: 153230 - DNA, 20 bp, Artificial Sequence
  Description of Artificial Sequence: Synthetic oligonucleotide
  Target: ATXN1; (+) strand; PAM type: NRG; PAM sequence: AAG
agtaatttttcactcagtgt

SEQ ID NO: 153231 - DNA, 20 bp, Artificial Sequence
  Description of Artificial Sequence: Synthetic oligonucleotide
  Target: ATXN1; (+) strand; PAM type: NRG; PAM sequence: AAG
atttttcactcagtgtaaga

SEQ ID NO: 153232 - DNA, 20 bp, Artificial Sequence
  Description of Artificial Sequence: Synthetic oligonucleotide
  Target: ATXN1; (+) strand; PAM type: NRG; PAM sequence: TGG
tcagtgtaagaaagacaatc

SEQ ID NO: 153233 - DNA, 20 bp, Artificial Sequence
  Description of Artificial Sequence: Synthetic oligonucleotide
  Target: ATXN1; (+) strand; PAM type: NRG; PAM sequence: AAG
aagacaatctggccttccct

SEQ ID NO: 153234 - DNA, 20 bp, Artificial Sequence
  Description of Artificial Sequence: Synthetic oligonucleotide
  Target: ATXN1; (+) strand; PAM type: NRG; PAM sequence: CAG
caatctggccttccctaagc

SEQ ID NO: 153235 - DNA, 20 bp, Artificial Sequence
  Description of Artificial Sequence: Synthetic oligonucleotide
  Target: ATXN1; (+) strand; PAM type: NRG; PAM sequence: AAG
tggccttccctaagccagct

SEQ ID NO: 153236 - DNA, 20 bp, Artificial Sequence
  Description of Artificial Sequence: Synthetic oligonucleotide
  Target: ATXN1; (+) strand; PAM type: NRG; PAM sequence: GAG
gccttccctaagccagctaa

SEQ ID NO: 153237 - DNA, 20 bp, Artificial Sequence
  Description of Artificial Sequence: Synthetic oligonucleotide
  Target: ATXN1; (+) strand; PAM type: NRG; PAM sequence: AAG
tccctaagccagctaagaga

SEQ ID NO: 153238 - DNA, 20 bp, Artificial Sequence
  Description of Artificial Sequence: Synthetic oligonucleotide
  Target: ATXN1; (+) strand; PAM type: NRG; PAM sequence: GAG
tctatcatcttgacatgaat

SEQ ID NO: 153239 - DNA, 20 bp, Artificial Sequence
  Description of Artificial Sequence: Synthetic oligonucleotide
  Target: ATXN1; (+) strand; PAM type: NRG; PAM sequence: CAG
catcttgacatgaatgagct

SEQ ID NO: 153240 - DNA, 20 bp, Artificial Sequence
  Description of Artificial Sequence: Synthetic oligonucleotide
  Target: ATXN1; (+) strand; PAM type: NRG; PAM sequence: TAG
ctcagattcattcactgttc

SEQ ID NO: 153241 - DNA, 20 bp, Artificial Sequence
  Description of Artificial Sequence: Synthetic oligonucleotide
  Target: ATXN1; (+) strand; PAM type: NRG; PAM sequence: AAG
attcattcactgttctagtg

SEQ ID NO: 153242 - DNA, 20 bp, Artificial Sequence
  Description of Artificial Sequence: Synthetic oligonucleotide
  Target: ATXN1; (+) strand; PAM type: NRG; PAM sequence: AGG
ttcattcactgttctagtga

SEQ ID NO: 153243 - DNA, 20 bp, Artificial Sequence
  Description of Artificial Sequence: Synthetic oligonucleotide
  Target: ATXN1; (+) strand; PAM type: NRG; PAM sequence: GAG
cattcactgttctagtgaag

SEQ ID NO: 153244 - DNA, 20 bp, Artificial Sequence
  Description of Artificial Sequence: Synthetic oligonucleotide
  Target: ATXN1; (+) strand; PAM type: NRG; PAM sequence: GAG
ttcactgttctagtgaagga

SEQ ID NO: 153245 - DNA, 20 bp, Artificial Sequence
  Description of Artificial Sequence: Synthetic oligonucleotide
  Target: ATXN1; (+) strand; PAM type: NRG; PAM sequence: GAG
tctagtgaaggagagaaaat

SEQ ID NO: 153246 - DNA, 20 bp, Artificial Sequence
  Description of Artificial Sequence: Synthetic oligonucleotide
  Target: ATXN1; (+) strand; PAM type: NRG; PAM sequence: TGG
tgaaggagagaaaatgagac

SEQ ID NO: 153247 - DNA, 20 bp, Artificial Sequence
  Description of Artificial Sequence: Synthetic oligonucleotide
  Target: ATXN1; (+) strand; PAM type: NRG; PAM sequence: GGG
gaaggagagaaaatgagact

SEQ ID NO: 153248 - DNA, 20 bp, Artificial Sequence
  Description of Artificial Sequence: Synthetic oligonucleotide
  Target: ATXN1; (+) strand; PAM type: NRG; PAM sequence: GAG
gagagaaaatgagactgggc

SEQ ID NO: 153249 - DNA, 20 bp, Artificial Sequence
  Description of Artificial Sequence: Synthetic oligonucleotide
  Target: ATXN1; (+) strand; PAM type: NRG; PAM sequence: AGG
agagaaaatgagactgggcg

SEQ ID NO: 153250 - DNA, 20 bp, Artificial Sequence
  Description of Artificial Sequence: Synthetic oligonucleotide
  Target: ATXN1; (+) strand; PAM type: NRG; PAM sequence: CAG
gaaaatgagactgggcgagg

SEQ ID NO: 153251 - DNA, 20 bp, Artificial Sequence
  Description of Artificial Sequence: Synthetic oligonucleotide
  Target: ATXN1; (+) strand; PAM type: NRG; PAM sequence: AGG
aaaatgagactgggcgaggc

SEQ ID NO: 153252 - DNA, 20 bp, Artificial Sequence
  Description of Artificial Sequence: Synthetic oligonucleotide
  Target: ATXN1; (+) strand; PAM type: NRG; PAM sequence: GGG
aaatgagactgggcgaggca

SEQ ID NO: 153253 - DNA, 20 bp, Artificial Sequence
  Description of Artificial Sequence: Synthetic oligonucleotide
  Target: ATXN1; (+) strand; PAM type: NRG; PAM sequence: GGG
aatgagactgggcgaggcag

SEQ ID NO: 153254 - DNA, 20 bp, Artificial Sequence
  Description of Artificial Sequence: Synthetic oligonucleotide
  Target: ATXN1; (+) strand; PAM type: NRG; PAM sequence: CAG
gagactgggcgaggcagggg

SEQ ID NO: 153255 - DNA, 20 bp, Artificial Sequence
  Description of Artificial Sequence: Synthetic oligonucleotide
  Target: ATXN1; (+) strand; PAM type: NRG; PAM sequence: GAG
gactgggcgaggcaggggca

SEQ ID NO: 153256 - DNA, 20 bp, Artificial Sequence
  Description of Artificial Sequence: Synthetic oligonucleotide
  Target: ATXN1; (+) strand; PAM type: NRG; PAM sequence: AGG
actgggcgaggcaggggcag

SEQ ID NO: 153257 - DNA, 20 bp, Artificial Sequence
  Description of Artificial Sequence: Synthetic oligonucleotide
  Target: ATXN1; (+) strand; PAM type: NRG; PAM sequence: GGG
ctgggcgaggcaggggcaga

SEQ ID NO: 153258 - DNA, 20 bp, Artificial Sequence
  Description of Artificial Sequence: Synthetic oligonucleotide
  Target: ATXN1; (+) strand; PAM type: NRG; PAM sequence: GGG
tgggcgaggcaggggcagag

SEQ ID NO: 153259 - DNA, 20 bp, Artificial Sequence
  Description of Artificial Sequence: Synthetic oligonucleotide
  Target: ATXN1; (+) strand; PAM type: NRG; PAM sequence: GAG
ggcaggggcagaggggatgt

SEQ ID NO: 153260 - DNA, 20 bp, Artificial Sequence
  Description of Artificial Sequence: Synthetic oligonucleotide
  Target: ATXN1; (+) strand; PAM type: NRG; PAM sequence: AAG
gcagaggggatgtgagttct

SEQ ID NO: 153261 - DNA, 20 bp, Artificial Sequence
  Description of Artificial Sequence: Synthetic oligonucleotide
  Target: ATXN1; (+) strand; PAM type: NRG; PAM sequence: TGG
gtgagttctaagcttcctta

SEQ ID NO: 153262 - DNA, 20 bp, Artificial Sequence
  Description of Artificial Sequence: Synthetic oligonucleotide
  Target: ATXN1; (+) strand; PAM type: NRG; PAM sequence: AAG
ccttatggccaccctgacta

SEQ ID NO: 153263 - DNA, 20 bp, Artificial Sequence
  Description of Artificial Sequence: Synthetic oligonucleotide
  Target: ATXN1; (+) strand; PAM type: NRG; PAM sequence: TAG
tttgctgcacgttttattct

SEQ ID NO: 153264 - DNA, 20 bp, Artificial Sequence
  Description of Artificial Sequence: Synthetic oligonucleotide
  Target: ATXN1; (+) strand; PAM type: NRG; PAM sequence: GAG
tgctgcacgttttattctta

SEQ ID NO: 153265 - DNA, 20 bp, Artificial Sequence
  Description of Artificial Sequence: Synthetic oligonucleotide
  Target: ATXN1; (+) strand; PAM type: NRG; PAM sequence: CAG
ttattcttagagcttgcgtt

SEQ ID NO: 153266 - DNA, 20 bp, Artificial Sequence
  Description of Artificial Sequence: Synthetic oligonucleotide
  Target: ATXN1; (+) strand; PAM type: NRG; PAM sequence: TGG
cacaccaccacctatcacac

SEQ ID NO: 153267 - DNA, 20 bp, Artificial Sequence
  Description of Artificial Sequence: Synthetic oligonucleotide
  Target: ATXN1; (+) strand; PAM type: NRG; PAM sequence: GAG
caccaccacctatcacactg

SEQ ID NO: 153268 - DNA, 20 bp, Artificial Sequence
  Description of Artificial Sequence: Synthetic oligonucleotide
  Target: ATXN1; (+) strand; PAM type: NRG; PAM sequence: GAG
ccaccacctatcacactgga

SEQ ID NO: 153269 - DNA, 20 bp, Artificial Sequence
  Description of Artificial Sequence: Synthetic oligonucleotide
  Target: ATXN1; (+) strand; PAM type: NRG; PAM sequence: TAG
tatcacactggagagacaaa

SEQ ID NO: 153270 - DNA, 20 bp, Artificial Sequence
  Description of Artificial Sequence: Synthetic oligonucleotide
  Target: ATXN1; (+) strand; PAM type: NRG; PAM sequence: AAG
tcatatctgccaaatcttgc

SEQ ID NO: 153271 - DNA, 20 bp, Artificial Sequence
  Description of Artificial Sequence: Synthetic oligonucleotide
  Target: ATXN1; (+) strand; PAM type: NRG; PAM sequence: GAG
tctgccaaatcttgcaagct

SEQ ID NO: 153272 - DNA, 20 bp, Artificial Sequence
  Description of Artificial Sequence: Synthetic oligonucleotide
  Target: ATXN1; (+) strand; PAM type: NRG; PAM sequence: CAG
ttgcaagctgagcaatgacc

SEQ ID NO: 153273 - DNA, 20 bp, Artificial Sequence
  Description of Artificial Sequence: Synthetic oligonucleotide
  Target: ATXN1; (+) strand; PAM type: NRG; PAM sequence: AAG
agctgagcaatgacccagtg

SEQ ID NO: 153274 - DNA, 20 bp, Artificial Sequence
  Description of Artificial Sequence: Synthetic oligonucleotide
  Target: ATXN1; (+) strand; PAM type: NRG; PAM sequence: AAG
tgacccagtgaagttctttt

SEQ ID NO: 153275 - DNA, 20 bp, Artificial Sequence
  Description of Artificial Sequence: Synthetic oligonucleotide
  Target: ATXN1; (+) strand; PAM type: NRG; PAM sequence: GAG
acccagtgaagttcttttaa

SEQ ID NO: 153276 - DNA, 20 bp, Artificial Sequence
  Description of Artificial Sequence: Synthetic oligonucleotide
  Target: ATXN1; (+) strand; PAM type: NRG; PAM sequence: AAG
gaagttcttttaagagtcaa

SEQ ID NO: 153277 - DNA, 20 bp, Artificial Sequence
  Description of Artificial Sequence: Synthetic oligonucleotide
  Target: ATXN1; (+) strand; PAM type: NRG; PAM sequence: GAG
caaaagttcatcatctcgct

SEQ ID NO: 153278 - DNA, 20 bp, Artificial Sequence
  Description of Artificial Sequence: Synthetic oligonucleotide
  Target: ATXN1; (+) strand; PAM type: NRG; PAM sequence: TGG
tcttgatgctgaataacatt

SEQ ID NO: 153279 - DNA, 20 bp, Artificial Sequence
  Description of Artificial Sequence: Synthetic oligonucleotide
  Target: ATXN1; (+) strand; PAM type: NRG; PAM sequence: AAG
ataacatttggatccaactt

SEQ ID NO: 153280 - DNA, 20 bp, Artificial Sequence
  Description of Artificial Sequence: Synthetic oligonucleotide
  Target: ATXN1; (+) strand; PAM type: NRG; PAM sequence: CGG
cttaagccaatcccctgaaa

SEQ ID NO: 153281 - DNA, 20 bp, Artificial Sequence
  Description of Artificial Sequence: Synthetic oligonucleotide
  Target: ATXN1; (+) strand; PAM type: NRG; PAM sequence: AAG
gccaatcccctgaaacggat

SEQ ID NO: 153282 - DNA, 20 bp, Artificial Sequence
  Description of Artificial Sequence: Synthetic oligonucleotide
  Target: ATXN1; (+) strand; PAM type: NRG; PAM sequence: AAG
cttcaattaataattattga

SEQ ID NO: 153283 - DNA, 20 bp, Artificial Sequence
  Description of Artificial Sequence: Synthetic oligonucleotide
  Target: ATXN1; (+) strand; PAM type: NRG; PAM sequence: TAG
taataattattgaaagtgca

SEQ ID NO: 153284 - DNA, 20 bp, Artificial Sequence
  Description of Artificial Sequence: Synthetic oligonucleotide
  Target: ATXN1; (+) strand; PAM type: NRG; PAM sequence: AGG
aataattattgaaagtgcat

SEQ ID NO: 153285 - DNA, 20 bp, Artificial Sequence
  Description of Artificial Sequence: Synthetic oligonucleotide
  Target: ATXN1; (+) strand; PAM type: NRG; PAM sequence: AAG
tgaaagtgcataggaatctc

SEQ ID NO: 153286 - DNA, 20 bp, Artificial Sequence
  Description of Artificial Sequence: Synthetic oligonucleotide
  Target: ATXN1; (+) strand; PAM type: NRG; PAM sequence: AGG
gaaagtgcataggaatctca

SEQ ID NO: 153287 - DNA, 20 bp, Artificial Sequence
  Description of Artificial Sequence: Synthetic oligonucleotide
  Target: ATXN1; (+) strand; PAM type: NRG; PAM sequence: GAG
aagtgcataggaatctcaag

SEQ ID NO: 153288 - DNA, 20 bp, Artificial Sequence
  Description of Artificial Sequence: Synthetic oligonucleotide
  Target: ATXN1; (+) strand; PAM type: NRG; PAM sequence: GAG
taggaatctcaaggagatat

SEQ ID NO: 153289 - DNA, 20 bp, Artificial Sequence
  Description of Artificial Sequence: Synthetic oligonucleotide
  Target: ATXN1; (+) strand; PAM type: NRG; PAM sequence: AAG
aatctcaaggagatatgagt

SEQ ID NO: 153290 - DNA, 20 bp, Artificial Sequence
  Description of Artificial Sequence: Synthetic oligonucleotide
  Target: ATXN1; (+) strand; PAM type: NRG; PAM sequence: GAG
tctcaaggagatatgagtaa

SEQ ID NO: 153291 - DNA, 20 bp, Artificial Sequence
  Description of Artificial Sequence: Synthetic oligonucleotide
  Target: ATXN1; (+) strand; PAM type: NRG; PAM sequence: AAG
ggagatatgagtaagagtga

SEQ ID NO: 153292 - DNA, 20 bp, Artificial Sequence
  Description of Artificial Sequence: Synthetic oligonucleotide
  Target: ATXN1; (+) strand; PAM type: NRG; PAM sequence: AAG
atatgagtaagagtgaaaga

SEQ ID NO: 153293 - DNA, 20 bp, Artificial Sequence
  Description of Artificial Sequence: Synthetic oligonucleotide
  Target: ATXN1; (+) strand; PAM type: NRG; PAM sequence: AGG
tatgagtaagagtgaaagaa

SEQ ID NO: 153294 - DNA, 20 bp, Artificial Sequence
  Description of Artificial Sequence: Synthetic oligonucleotide
  Target: ATXN1; (+) strand; PAM type: NRG; PAM sequence: GGG
atgagtaagagtgaaagaaa

SEQ ID NO: 153295 - DNA, 20 bp, Artificial Sequence
  Description of Artificial Sequence: Synthetic oligonucleotide
  Target: ATXN1; (+) strand; PAM type: NRG; PAM sequence: GAG
gagtaagagtgaaagaaagg

SEQ ID NO: 153296 - DNA, 20 bp, Artificial Sequence
  Description of Artificial Sequence: Synthetic oligonucleotide
  Target: ATXN1; (+) strand; PAM type: NRG; PAM sequence: AAG
gaaagggagaaaacaccaca

SEQ ID NO: 153297 - DNA, 20 bp, Artificial Sequence
  Description of Artificial Sequence: Synthetic oligonucleotide
  Target: ATXN1; (+) strand; PAM type: NRG; PAM sequence: TGG
aaaacaccacaaagcctgca

SEQ ID NO: 153298 - DNA, 20 bp, Artificial Sequence
  Description of Artificial Sequence: Synthetic oligonucleotide
  Target: ATXN1; (+) strand; PAM type: NRG; PAM sequence: GGG
aaacaccacaaagcctgcat

SEQ ID NO: 153299 - DNA, 20 bp, Artificial Sequence
  Description of Artificial Sequence: Synthetic oligonucleotide
  Target: ATXN1; (+) strand; PAM type: NRG; PAM sequence: CAG
accacaaagcctgcatggga

SEQ ID NO: 153300 - DNA, 20 bp, Artificial Sequence
  Description of Artificial Sequence: Synthetic oligonucleotide
  Target: ATXN1; (+) strand; PAM type: NRG; PAM sequence: CAG
ctgcatgggacagcctgtgt

SEQ ID NO: 153301 - DNA, 20 bp, Artificial Sequence
  Description of Artificial Sequence: Synthetic oligonucleotide
  Target: ATXN1; (+) strand; PAM type: NRG; PAM sequence: AAG
atgggacagcctgtgtcaga

SEQ ID NO: 153302 - DNA, 20 bp, Artificial Sequence
  Description of Artificial Sequence: Synthetic oligonucleotide
  Target: ATXN1; (+) strand; PAM type: NRG; PAM sequence: CAG
aaagctcatatgtgactgaa

SEQ ID NO: 153303 - DNA, 20 bp, Artificial Sequence
  Description of Artificial Sequence: Synthetic oligonucleotide
  Target: ATXN1; (+) strand; PAM type: NRG; PAM sequence: CAG
ctcatatgtgactgaacaga

SEQ ID NO: 153304 - DNA, 20 bp, Artificial Sequence
  Description of Artificial Sequence: Synthetic oligonucleotide
  Target: ATXN1; (+) strand; PAM type: NRG; PAM sequence: AGG
tcatatgtgactgaacagac

SEQ ID NO: 153305 - DNA, 20 bp, Artificial Sequence
  Description of Artificial Sequence: Synthetic oligonucleotide
  Target: ATXN1; (+) strand; PAM type: NRG; PAM sequence: CAG
tatgtgactgaacagacagg

SEQ ID NO: 153306 - DNA, 20 bp, Artificial Sequence
  Description of Artificial Sequence: Synthetic oligonucleotide
  Target: ATXN1; (+) strand; PAM type: NRG; PAM sequence: AGG
atgtgactgaacagacaggc

SEQ ID NO: 153307 - DNA, 20 bp, Artificial Sequence
  Description of Artificial Sequence: Synthetic oligonucleotide
  Target: ATXN1; (+) strand; PAM type: NRG; PAM sequence: AAG
aacagacaggcaggcatcaa

SEQ ID NO: 153308 - DNA, 20 bp, Artificial Sequence
  Description of Artificial Sequence: Synthetic oligonucleotide
  Target: ATXN1; (+) strand; PAM type: NRG; PAM sequence: GAG
cagacaggcaggcatcaaaa

SEQ ID NO: 153309 - DNA, 20 bp, Artificial Sequence
  Description of Artificial Sequence: Synthetic oligonucleotide
  Target: ATXN1; (+) strand; PAM type: NRG; PAM sequence: AAG
acaggcaggcatcaaaagag

SEQ ID NO: 153310 - DNA, 20 bp, Artificial Sequence
  Description of Artificial Sequence: Synthetic oligonucleotide
  Target: ATXN1; (+) strand; PAM type: NRG; PAM sequence: AGG
caggcaggcatcaaaagaga

SEQ ID NO: 153311 - DNA, 20 bp, Artificial Sequence
  Description of Artificial Sequence: Synthetic oligonucleotide
  Target: ATXN1; (+) strand; PAM type: NRG; PAM sequence: AAG
gcatcaaaagagaaggctcc

SEQ ID NO: 153312 - DNA, 20 bp, Artificial Sequence
  Description of Artificial Sequence: Synthetic oligonucleotide
  Target: ATXN1; (+) strand; PAM type: NRG; PAM sequence: AGG
catcaaaagagaaggctcca

SEQ ID NO: 153313 - DNA, 20 bp, Artificial Sequence
  Description of Artificial Sequence: Synthetic oligonucleotide
  Target: ATXN1; (+) strand; PAM type: NRG; PAM sequence: AAG
caaaagagaaggctccaagg

SEQ ID NO: 153314 - DNA, 20 bp, Artificial Sequence
  Description of Artificial Sequence: Synthetic oligonucleotide
  Target: ATXN1; (+) strand; PAM type: NRG; PAM sequence: AGG
aaaagagaaggctccaagga

SEQ ID NO: 153315 - DNA, 20 bp, Artificial Sequence
  Description of Artificial Sequence: Synthetic oligonucleotide
  Target: ATXN1; (+) strand; PAM type: NRG; PAM sequence: TAG
cttccttgatcctgacttcc

SEQ ID NO: 153316 - DNA, 20 bp, Artificial Sequence
  Description of Artificial Sequence: Synthetic oligonucleotide
  Target: ATXN1; (+) strand; PAM type: NRG; PAM sequence: TGG
agactgtgttacctgtgtca

SEQ ID NO: 153317 - DNA, 20 bp, Artificial Sequence
  Description of Artificial Sequence: Synthetic oligonucleotide
  Target: ATXN1; (+) strand; PAM type: NRG; PAM sequence: AAG
ggctctttaaatattactcc

SEQ ID NO: 153318 - DNA, 20 bp, Artificial Sequence
  Description of Artificial Sequence: Synthetic oligonucleotide
  Target: ATXN1; (+) strand; PAM type: NRG; PAM sequence: AAG
tgccttatgcactcgactgt

SEQ ID NO: 153319 - DNA, 20 bp, Artificial Sequence
  Description of Artificial Sequence: Synthetic oligonucleotide
  Target: ATXN1; (+) strand; PAM type: NRG; PAM sequence: AAG
cactcgactgtaagcttctt

SEQ ID NO: 153320 - DNA, 20 bp, Artificial Sequence
  Description of Artificial Sequence: Synthetic oligonucleotide
  Target: ATXN1; (+) strand; PAM type: NRG; PAM sequence: AGG
actcgactgtaagcttctta

SEQ ID NO: 153321 - DNA, 20 bp, Artificial Sequence
  Description of Artificial Sequence: Synthetic oligonucleotide
  Target: ATXN1; (+) strand; PAM type: NRG; PAM sequence: CAG
gactgtaagcttcttaagga

SEQ ID NO: 153322 - DNA, 20 bp, Artificial Sequence
  Description of Artificial Sequence: Synthetic oligonucleotide
  Target: ATXN1; (+) strand; PAM type: NRG; PAM sequence: AGG
actgtaagcttcttaaggac

SEQ ID NO: 153323 - DNA, 20 bp, Artificial Sequence
  Description of Artificial Sequence: Synthetic oligonucleotide
  Target: ATXN1; (+) strand; PAM type: NRG; PAM sequence: GGG
ctgtaagcttcttaaggaca

SEQ ID NO: 153324 - DNA, 20 bp, Artificial Sequence
  Description of Artificial Sequence: Synthetic oligonucleotide
  Target: ATXN1; (+) strand; PAM type: NRG; PAM sequence: AAG
gcttcttaaggacagggctt

SEQ ID NO: 153325 - DNA, 20 bp, Artificial Sequence
  Description of Artificial Sequence: Synthetic oligonucleotide
  Target: ATXN1; (+) strand; PAM type: NRG; PAM sequence: AGG
cttcttaaggacagggctta

SEQ ID NO: 153326 - DNA, 20 bp, Artificial Sequence
  Description of Artificial Sequence: Synthetic oligonucleotide
  Target: ATXN1; (+) strand; PAM type: NRG; PAM sequence: CAG
taaggacagggcttaaggaa

SEQ ID NO: 153327 - DNA, 20 bp, Artificial Sequence
  Description of Artificial Sequence: Synthetic oligonucleotide
  Target: ATXN1; (+) strand; PAM type: NRG; PAM sequence: AGG
aaggacagggcttaaggaac

SEQ ID NO: 153328 - DNA, 20 bp, Artificial Sequence
  Description of Artificial Sequence: Synthetic oligonucleotide
  Target: ATXN1; (+) strand; PAM type: NRG; PAM sequence: GGG
aggacagggcttaaggaaca

SEQ ID NO: 153329 - DNA, 20 bp, Artificial Sequence
  Description of Artificial Sequence: Synthetic oligonucleotide
  Target: ATXN1; (+) strand; PAM type: NRG; PAM sequence: GAG
agggcttaaggaacagggct

SEQ ID NO: 153330 - DNA, 20 bp, Artificial Sequence
  Description of Artificial Sequence: Synthetic oligonucleotide
  Target: ATXN1; (+) strand; PAM type: NRG; PAM sequence: GAG
ggcttaaggaacagggctga

SEQ ID NO: 153331 - DNA, 20 bp, Artificial Sequence
  Description of Artificial Sequence: Synthetic oligonucleotide
  Target: ATXN1; (+) strand; PAM type: NRG; PAM sequence: TAG
aaggaacagggctgagagtg

SEQ ID NO: 153332 - DNA, 20 bp, Artificial Sequence
  Description of Artificial Sequence: Synthetic oligonucleotide
  Target: ATXN1; (+) strand; PAM type: NRG; PAM sequence: TGG
acagggctgagagtgtagac

SEQ ID NO: 153333 - DNA, 20 bp, Artificial Sequence
  Description of Artificial Sequence: Synthetic oligonucleotide
  Target: ATXN1; (+) strand; PAM type: NRG; PAM sequence: GGG
cagggctgagagtgtagact

SEQ ID NO: 153334 - DNA, 20 bp, Artificial Sequence
  Description of Artificial Sequence: Synthetic oligonucleotide
  Target: ATXN1; (+) strand; PAM type: NRG; PAM sequence: AAG
gagagtgtagactgggatcc

SEQ ID NO: 153335 - DNA, 20 bp, Artificial Sequence
  Description of Artificial Sequence: Synthetic oligonucleotide
  Target: ATXN1; (+) strand; PAM type: NRG; PAM sequence: CAG
agcacgattctatcacttaa

SEQ ID NO: 153336 - DNA, 20 bp, Artificial Sequence
  Description of Artificial Sequence: Synthetic oligonucleotide
  Target: ATXN1; (+) strand; PAM type: NRG; PAM sequence: TGG
cgattctatcacttaacagc

SEQ ID NO: 153337 - DNA, 20 bp, Artificial Sequence
  Description of Artificial Sequence: Synthetic oligonucleotide
  Target: ATXN1; (+) strand; PAM type: NRG; PAM sequence: GGG
gattctatcacttaacagct

SEQ ID NO: 153338 - DNA, 20 bp, Artificial Sequence
  Description of Artificial Sequence: Synthetic oligonucleotide
  Target: ATXN1; (+) strand; PAM type: NRG; PAM sequence: TGG
acttaacagctgggaaacct

SEQ ID NO: 153339 - DNA, 20 bp, Artificial Sequence
  Description of Artificial Sequence: Synthetic oligonucleotide
  Target: ATXN1; (+) strand; PAM type: NRG; PAM sequence: GGG
cttaacagctgggaaacctt

SEQ ID NO: 153340 - DNA, 20 bp, Artificial Sequence
  Description of Artificial Sequence: Synthetic oligonucleotide
  Target: ATXN1; (+) strand; PAM type: NRG; PAM sequence: GGG
ttaacagctgggaaaccttg

SEQ ID NO: 153341 - DNA, 20 bp, Artificial Sequence
  Description of Artificial Sequence: Synthetic oligonucleotide
  Target: ATXN1; (+) strand; PAM type: NRG; PAM sequence: CAG
tattcaccctctctgtgcca

SEQ ID NO: 153342 - DNA, 20 bp, Artificial Sequence
  Description of Artificial Sequence: Synthetic oligonucleotide
  Target: ATXN1; (+) strand; PAM type: NRG; PAM sequence: TGG
cagtttcctcgcctgtgcaa

SEQ ID NO: 153343 - DNA, 20 bp, Artificial Sequence
  Description of Artificial Sequence: Synthetic oligonucleotide
  Target: ATXN1; (+) strand; PAM type: NRG; PAM sequence: GAG
gtttcctcgcctgtgcaatg

SEQ ID NO: 153344 - DNA, 20 bp, Artificial Sequence
  Description of Artificial Sequence: Synthetic oligonucleotide
  Target: ATXN1; (+) strand; PAM type: NRG; PAM sequence: AAG
aaataatgatgcctacctca

SEQ ID NO: 153345 - DNA, 20 bp, Artificial Sequence
  Description of Artificial Sequence: Synthetic oligonucleotide
  Target: ATXN1; (+) strand; PAM type: NRG; PAM sequence: AGG
aataatgatgcctacctcaa

SEQ ID NO: 153346 - DNA, 20 bp, Artificial Sequence
  Description of Artificial Sequence: Synthetic oligonucleotide
  Target: ATXN1; (+) strand; PAM type: NRG; PAM sequence: GAG
ctacctcaaaggactgtaat

SEQ ID NO: 153347 - DNA, 20 bp, Artificial Sequence
  Description of Artificial Sequence: Synthetic oligonucleotide
  Target: ATXN1; (+) strand; PAM type: NRG; PAM sequence: AGG
tacctcaaaggactgtaatg

SEQ ID NO: 153348 - DNA, 20 bp, Artificial Sequence
  Description of Artificial Sequence: Synthetic oligonucleotide
  Target: ATXN1; (+) strand; PAM type: NRG; PAM sequence: AAG
gactgtaatgaggattcaat

SEQ ID NO: 153349 - DNA, 20 bp, Artificial Sequence
  Description of Artificial Sequence: Synthetic oligonucleotide
  Target: ATXN1; (+) strand; PAM type: NRG; PAM sequence: CAG
ggattcaataagttaatatg

SEQ ID NO: 153350 - DNA, 20 bp, Artificial Sequence
  Description of Artificial Sequence: Synthetic oligonucleotide
  Target: ATXN1; (+) strand; PAM type: NRG; PAM sequence: TAG
caataagttaatatgcagaa

SEQ ID NO: 153351 - DNA, 20 bp, Artificial Sequence
  Description of Artificial Sequence: Synthetic oligonucleotide
  Target: ATXN1; (+) strand; PAM type: NRG; PAM sequence: TAG
ttgatcatctccatattccc

SEQ ID NO: 153352 - DNA, 20 bp, Artificial Sequence
  Description of Artificial Sequence: Synthetic oligonucleotide
  Target: ATXN1; (+) strand; PAM type: NRG; PAM sequence: GAG
gatcatctccatattcccta

SEQ ID NO: 153353 - DNA, 20 bp, Artificial Sequence
  Description of Artificial Sequence: Synthetic oligonucleotide
  Target: ATXN1; (+) strand; PAM type: NRG; PAM sequence: AGG
atcatctccatattccctag

SEQ ID NO: 153354 - DNA, 20 bp, Artificial Sequence
  Description of Artificial Sequence: Synthetic oligonucleotide
  Target: ATXN1; (+) strand; PAM type: NRG; PAM sequence: GGG
tcatctccatattccctaga

SEQ ID NO: 153355 - DNA, 20 bp, Artificial Sequence
  Description of Artificial Sequence: Synthetic oligonucleotide
  Target: ATXN1; (+) strand; PAM type: NRG; PAM sequence: TGG
tattccctagagggccttgt

SEQ ID NO: 153356 - DNA, 20 bp, Artificial Sequence
  Description of Artificial Sequence: Synthetic oligonucleotide
  Target: ATXN1; (+) strand; PAM type: NRG; PAM sequence: TAG
gcataatgcgtctcatacat

SEQ ID NO: 153357 - DNA, 20 bp, Artificial Sequence
  Description of Artificial Sequence: Synthetic oligonucleotide
  Target: ATXN1; (+) strand; PAM type: NRG; PAM sequence: CAG
agatgctcattaaataattg

SEQ ID NO: 153358 - DNA, 20 bp, Artificial Sequence
  Description of Artificial Sequence: Synthetic oligonucleotide
  Target: ATXN1; (+) strand; PAM type: NRG; PAM sequence: AAG
ctcattaaataattgcagac

SEQ ID NO: 153359 - DNA, 20 bp, Artificial Sequence
  Description of Artificial Sequence: Synthetic oligonucleotide
  Target: ATXN1; (+) strand; PAM type: NRG; PAM sequence: TGG
agacaagaacgatctgcccc

SEQ ID NO: 153360 - DNA, 20 bp, Artificial Sequence
  Description of Artificial Sequence: Synthetic oligonucleotide
  Target: ATXN1; (+) strand; PAM type: NRG; PAM sequence: GAG
acaagaacgatctgcccctg

SEQ ID NO: 153361 - DNA, 20 bp, Artificial Sequence
  Description of Artificial Sequence: Synthetic oligonucleotide
  Target: ATXN1; (+) strand; PAM type: NRG; PAM sequence: AAG
aaccttcttgtctttgatga

SEQ ID NO: 153362 - DNA, 20 bp, Artificial Sequence
  Description of Artificial Sequence: Synthetic oligonucleotide
  Target: ATXN1; (+) strand; PAM type: NRG; PAM sequence: AAG
gtctttgatgaaagttaaat

SEQ ID NO: 153363 - DNA, 20 bp, Artificial Sequence
  Description of Artificial Sequence: Synthetic oligonucleotide
  Target: ATXN1; (+) strand; PAM type: NRG; PAM sequence: GAG
taagtcactgcttttattct

SEQ ID NO: 153364 - DNA, 20 bp, Artificial Sequence
  Description of Artificial Sequence: Synthetic oligonucleotide
  Target: ATXN1; (+) strand; PAM type: NRG; PAM sequence: TGG
gcttttattctgagcccttt

SEQ ID NO: 153365 - DNA, 20 bp, Artificial Sequence
  Description of Artificial Sequence: Synthetic oligonucleotide
  Target: ATXN1; (+) strand; PAM type: NRG; PAM sequence: GGG
cttttattctgagccctttt

SEQ ID NO: 153366 - DNA, 20 bp, Artificial Sequence
  Description of Artificial Sequence: Synthetic oligonucleotide
  Target: ATXN1; (+) strand; PAM type: NRG; PAM sequence: CAG
ctgagcccttttgggctaca

SEQ ID NO: 153367 - DNA, 20 bp, Artificial Sequence
  Description of Artificial Sequence: Synthetic oligonucleotide
  Target: ATXN1; (+) strand; PAM type: NRG; PAM sequence: GAG
gagcccttttgggctacaca

SEQ ID NO: 153368 - DNA, 20 bp, Artificial Sequence
  Description of Artificial Sequence: Synthetic oligonucleotide
  Target: ATXN1; (+) strand; PAM type: NRG; PAM sequence: GAG
gcccttttgggctacacaga

SEQ ID NO: 153369 - DNA, 20 bp, Artificial Sequence
  Description of Artificial Sequence: Synthetic oligonucleotide
  Target: ATXN1; (+) strand; PAM type: NRG; PAM sequence: CAG
agagcccatcctaactaact

SEQ ID NO: 153370 - DNA, 20 bp, Artificial Sequence
  Description of Artificial Sequence: Synthetic oligonucleotide
  Target: ATXN1; (+) strand; PAM type: NRG; PAM sequence: CAG
tttctctcattacattaaat

SEQ ID NO: 153371 - DNA, 20 bp, Artificial Sequence
  Description of Artificial Sequence: Synthetic oligonucleotide
  Target: ATXN1; (+) strand; PAM type: NRG; PAM sequence: CAG
catcatcgtaacatcatctc

SEQ ID NO: 153372 - DNA, 20 bp, Artificial Sequence
  Description of Artificial Sequence: Synthetic oligonucleotide
  Target: ATXN1; (+) strand; PAM type: NRG; PAM sequence: CAG
ccttctctttcactttacat

SEQ ID NO: 153373 - DNA, 20 bp, Artificial Sequence
  Description of Artificial Sequence: Synthetic oligonucleotide
  Target: ATXN1; (+) strand; PAM type: NRG; PAM sequence: AGG
cttctctttcactttacatc

SEQ ID NO: 153374 - DNA, 20 bp, Artificial Sequence
  Description of Artificial Sequence: Synthetic oligonucleotide
  Target: ATXN1; (+) strand; PAM type: NRG; PAM sequence: AAG
ctctttcactttacatcagg

SEQ ID NO: 153375 - DNA, 20 bp, Artificial Sequence
  Description of Artificial Sequence: Synthetic oligonucleotide
  Target: ATXN1; (+) strand; PAM type: NRG; PAM sequence: TAG
cactttacatcaggaagtct

SEQ ID NO: 153376 - DNA, 20 bp, Artificial Sequence
  Description of Artificial Sequence: Synthetic oligonucleotide
  Target: ATXN1; (+) strand; PAM type: NRG; PAM sequence: CAG
tcttagactaactttctccc

SEQ ID NO: 153377 - DNA, 20 bp, Artificial Sequence
  Description of Artificial Sequence: Synthetic oligonucleotide
  Target: ATXN1; (+) strand; PAM type: NRG; PAM sequence: AAG
ctaactttctccccagaccc

SEQ ID NO: 153378 - DNA, 20 bp, Artificial Sequence
  Description of Artificial Sequence: Synthetic oligonucleotide
  Target: ATXN1; (+) strand; PAM type: NRG; PAM sequence: AAG
atatctctttattttctata

SEQ ID NO: 153379 - DNA, 20 bp, Artificial Sequence
  Description of Artificial Sequence: Synthetic oligonucleotide
  Target: ATXN1; (+) strand; PAM type: NRG; PAM sequence: TGG
tattttctataaagtataaa

SEQ ID NO: 153380 - DNA, 20 bp, Artificial Sequence
  Description of Artificial Sequence: Synthetic oligonucleotide
  Target: ATXN1; (+) strand; PAM type: NRG; PAM sequence: GGG
attttctataaagtataaat

SEQ ID NO: 153381 - DNA, 20 bp, Artificial Sequence
  Description of Artificial Sequence: Synthetic oligonucleotide
  Target: ATXN1; (+) strand; PAM type: NRG; PAM sequence: AAG
ttctataaagtataaatggg

SEQ ID NO: 153382 - DNA, 20 bp, Artificial Sequence
  Description of Artificial Sequence: Synthetic oligonucleotide
  Target: ATXN1; (+) strand; PAM type: NRG; PAM sequence: AAG
atgggaagccaaattgttca

SEQ ID NO: 153383 - DNA, 20 bp, Artificial Sequence
  Description of Artificial Sequence: Synthetic oligonucleotide
  Target: ATXN1; (+) strand; PAM type: NRG; PAM sequence: GAG
gggaagccaaattgttcaaa

SEQ ID NO: 153384 - DNA, 20 bp, Artificial Sequence
  Description of Artificial Sequence: Synthetic oligonucleotide
  Target: ATXN1; (+) strand; PAM type: NRG; PAM sequence: TAG
attgttcaaagagctgtgtc

SEQ ID NO: 153385 - DNA, 20 bp, Artificial Sequence
  Description of Artificial Sequence: Synthetic oligonucleotide
  Target: ATXN1; (+) strand; PAM type: NRG; PAM sequence: TAG
gttcaaagagctgtgtctag

SEQ ID NO: 153386 - DNA, 20 bp, Artificial Sequence
  Description of Artificial Sequence: Synthetic oligonucleotide
  Target: ATXN1; (+) strand; PAM type: NRG; PAM sequence: TAG
aaagagctgtgtctagtagc

SEQ ID NO: 153387 - DNA, 20 bp, Artificial Sequence
  Description of Artificial Sequence: Synthetic oligonucleotide
  Target: ATXN1; (+) strand; PAM type: NRG; PAM sequence: AGG
aagagctgtgtctagtagct

SEQ ID NO: 153388 - DNA, 20 bp, Artificial Sequence
  Description of Artificial Sequence: Synthetic oligonucleotide
  Target: ATXN1; (+) strand; PAM type: NRG; PAM sequence: CAG
gtctagtagctaggtatata

SEQ ID NO: 153389 - DNA, 20 bp, Artificial Sequence
  Description of Artificial Sequence: Synthetic oligonucleotide
  Target: ATXN1; (+) strand; PAM type: NRG; PAM sequence: AAG
cacacacatctcacatttta

SEQ ID NO: 153390 - DNA, 20 bp, Artificial Sequence
  Description of Artificial Sequence: Synthetic oligonucleotide
  Target: ATXN1; (+) strand; PAM type: NRG; PAM sequence: GAG
cacacatctcacattttaaa

SEQ ID NO: 153391 - DNA, 20 bp, Artificial Sequence
  Description of Artificial Sequence: Synthetic oligonucleotide
  Target: ATXN1; (+) strand; PAM type: NRG; PAM sequence: CAG
ctcacattttaaagagtctg

SEQ ID NO: 153392 - DNA, 20 bp, Artificial Sequence
  Description of Artificial Sequence: Synthetic oligonucleotide
  Target: ATXN1; (+) strand; PAM type: NRG; PAM sequence: AAG
cattttaaagagtctgcaga

SEQ ID NO: 153393 - DNA, 20 bp, Artificial Sequence
  Description of Artificial Sequence: Synthetic oligonucleotide
  Target: ATXN1; (+) strand; PAM type: NRG; PAM sequence: CAG
aagagtctgcagaaagcctc

SEQ ID NO: 153394 - DNA, 20 bp, Artificial Sequence
  Description of Artificial Sequence: Synthetic oligonucleotide
  Target: ATXN1; (+) strand; PAM type: NRG; PAM sequence: AGG
agagtctgcagaaagcctcc

SEQ ID NO: 153395 - DNA, 20 bp, Artificial Sequence
  Description of Artificial Sequence: Synthetic oligonucleotide
  Target: ATXN1; (+) strand; PAM type: NRG; PAM sequence: GGG
gagtctgcagaaagcctcca

SEQ ID NO: 153396 - DNA, 20 bp, Artificial Sequence
  Description of Artificial Sequence: Synthetic oligonucleotide
  Target: ATXN1; (+) strand; PAM type: NRG; PAM sequence: AAG
agcctccagggaatcctcta

SEQ ID NO: 153397 - DNA, 20 bp, Artificial Sequence
  Description of Artificial Sequence: Synthetic oligonucleotide
  Target: ATXN1; (+) strand; PAM type: NRG; PAM sequence: TGG
aaaacacacccaaattaatg

SEQ ID NO: 153398 - DNA, 20 bp, Artificial Sequence
  Description of Artificial Sequence: Synthetic oligonucleotide
  Target: ATXN1; (+) strand; PAM type: NRG; PAM sequence: AAG
caaattaatgtggtttatca

SEQ ID NO: 153399 - DNA, 20 bp, Artificial Sequence
  Description of Artificial Sequence: Synthetic oligonucleotide
  Target: ATXN1; (+) strand; PAM type: NRG; PAM sequence: CAG
taatgtggtttatcaaagta

SEQ ID NO: 153400 - DNA, 20 bp, Artificial Sequence
  Description of Artificial Sequence: Synthetic oligonucleotide
  Target: ATXN1; (+) strand; PAM type: NRG; PAM sequence: CAG
ccacaaatgaacaattgcta

SEQ ID NO: 153401 - DNA, 20 bp, Artificial Sequence
  Description of Artificial Sequence: Synthetic oligonucleotide
  Target: ATXN1; (+) strand; PAM type: NRG; PAM sequence: GAG
acaaatgaacaattgctaca

SEQ ID NO: 153402 - DNA, 20 bp, Artificial Sequence
  Description of Artificial Sequence: Synthetic oligonucleotide
  Target: ATXN1; (+) strand; PAM type: NRG; PAM sequence: AAG
tgaacaattgctacagagtc

SEQ ID NO: 153403 - DNA, 20 bp, Artificial Sequence
  Description of Artificial Sequence: Synthetic oligonucleotide
  Target: ATXN1; (+) strand; PAM type: NRG; PAM sequence: TAG
acaattgctacagagtcaag

SEQ ID NO: 153404 - DNA, 20 bp, Artificial Sequence
  Description of Artificial Sequence: Synthetic oligonucleotide
  Target: ATXN1; (+) strand; PAM type: NRG; PAM sequence: TGG
ttgctacagagtcaagtaga

SEQ ID NO: 153405 - DNA, 20 bp, Artificial Sequence
  Description of Artificial Sequence: Synthetic oligonucleotide
  Target: ATXN1; (+) strand; PAM type: NRG; PAM sequence: GAG
gtgatttacgcatatcatgt

SEQ ID NO: 153406 - DNA, 20 bp, Artificial Sequence
  Description of Artificial Sequence: Synthetic oligonucleotide
  Target: ATXN1; (+) strand; PAM type: NRG; PAM sequence: CGG
atgtgagatgaataaatcaa

SEQ ID NO: 153407 - DNA, 20 bp, Artificial Sequence
  Description of Artificial Sequence: Synthetic oligonucleotide
  Target: ATXN1; (+) strand; PAM type: NRG; PAM sequence: TAG
tgagatgaataaatcaacgg

SEQ ID NO: 153408 - DNA, 20 bp, Artificial Sequence
  Description of Artificial Sequence: Synthetic oligonucleotide
  Target: ATXN1; (+) strand; PAM type: NRG; PAM sequence: AAG
tgaataaatcaacggtagaa

SEQ ID NO: 153409 - DNA, 20 bp, Artificial Sequence
  Description of Artificial Sequence: Synthetic oligonucleotide
  Target: ATXN1; (+) strand; PAM type: NRG; PAM sequence: AAG
atcaacggtagaaaagatca

SEQ ID NO: 153410 - DNA, 20 bp, Artificial Sequence
  Description of Artificial Sequence: Synthetic oligonucleotide
  Target: ATXN1; (+) strand; PAM type: NRG; PAM sequence: TGG
agaaaagatcaaagaaatgc

SEQ ID NO: 153411 - DNA, 20 bp, Artificial Sequence
  Description of Artificial Sequence: Synthetic oligonucleotide
  Target: ATXN1; (+) strand; PAM type: NRG; PAM sequence: CAG
ggaattgttgttaaaacgta

SEQ ID NO: 153412 - DNA, 20 bp, Artificial Sequence
  Description of Artificial Sequence: Synthetic oligonucleotide
  Target: ATXN1; (+) strand; PAM type: NRG; PAM sequence: AGG
gaattgttgttaaaacgtac

SEQ ID NO: 153413 - DNA, 20 bp, Artificial Sequence
  Description of Artificial Sequence: Synthetic oligonucleotide
  Target: ATXN1; (+) strand; PAM type: NRG; PAM sequence: GGG
aattgttgttaaaacgtaca

SEQ ID NO: 153414 - DNA, 20 bp, Artificial Sequence
  Description of Artificial Sequence: Synthetic oligonucleotide
  Target: ATXN1; (+) strand; PAM type: NRG; PAM sequence: TAG
aaaatcttaataaaactgtt

SEQ ID NO: 153415 - DNA, 20 bp, Artificial Sequence
  Description of Artificial Sequence: Synthetic oligonucleotide
  Target: ATXN1; (+) strand; PAM type: NRG; PAM sequence: GAG
aatcttaataaaactgttta

SEQ ID NO: 153416 - DNA, 20 bp, Artificial Sequence
  Description of Artificial Sequence: Synthetic oligonucleotide
  Target: ATXN1; (+) strand; PAM type: NRG; PAM sequence: AGG
atcttaataaaactgtttag

SEQ ID NO: 153417 - DNA, 20 bp, Artificial Sequence
  Description of Artificial Sequence: Synthetic oligonucleotide
  Target: ATXN1; (+) strand; PAM type: NRG; PAM sequence: TAG
taaaactgtttagaggaaaa

SEQ ID NO: 153418 - DNA, 20 bp, Artificial Sequence
  Description of Artificial Sequence: Synthetic oligonucleotide
  Target: ATXN1; (+) strand; PAM type: NRG; PAM sequence: AAG
aactgtttagaggaaaatag

SEQ ID NO: 153419 - DNA, 20 bp, Artificial Sequence
  Description of Artificial Sequence: Synthetic oligonucleotide
  Target: ATXN1; (+) strand; PAM type: NRG; PAM sequence: AGG
actgtttagaggaaaataga

SEQ ID NO: 153420 - DNA, 20 bp, Artificial Sequence
  Description of Artificial Sequence: Synthetic oligonucleotide
  Target: ATXN1; (+) strand; PAM type: NRG; PAM sequence: GAG
agaaggatcatttgtttaac

SEQ ID NO: 153421 - DNA, 20 bp, Artificial Sequence
  Description of Artificial Sequence: Synthetic oligonucleotide
  Target: ATXN1; (+) strand; PAM type: NRG; PAM sequence: CAG
catacgctgaatttcaaacg

SEQ ID NO: 153422 - DNA, 20 bp, Artificial Sequence
  Description of Artificial Sequence: Synthetic oligonucleotide
  Target: ATXN1; (+) strand; PAM type: NRG; PAM sequence: TAG
atttttatacacacacacat

SEQ ID NO: 153423 - DNA, 20 bp, Artificial Sequence
  Description of Artificial Sequence: Synthetic oligonucleotide
  Target: ATXN1; (+) strand; PAM type: NRG; PAM sequence: TAG
atacacacacacattagatt

SEQ ID NO: 153424 - DNA, 20 bp, Artificial Sequence
  Description of Artificial Sequence: Synthetic oligonucleotide
  Target: ATXN1; (+) strand; PAM type: NRG; PAM sequence: TAG
acattagatttagctaaaat

SEQ ID NO: 153425 - DNA, 20 bp, Artificial Sequence
  Description of Artificial Sequence: Synthetic oligonucleotide
  Target: ATXN1; (+) strand; PAM type: NRG; PAM sequence: AAG
gatttagctaaaattagctc

SEQ ID NO: 153426 - DNA, 20 bp, Artificial Sequence
  Description of Artificial Sequence: Synthetic oligonucleotide
  Target: ATXN1; (+) strand; PAM type: NRG; PAM sequence: AAG
ctcaagttcctattttttta

SEQ ID NO: 153427 - DNA, 20 bp, Artificial Sequence
  Description of Artificial Sequence: Synthetic oligonucleotide
  Target: ATXN1; (+) strand; PAM type: NRG; PAM sequence: AGG
tcaagttcctatttttttaa

SEQ ID NO: 153428 - DNA, 20 bp, Artificial Sequence
  Description of Artificial Sequence: Synthetic oligonucleotide
  Target: ATXN1; (+) strand; PAM type: NRG; PAM sequence: AAG
ctatttttttaaaggtctta

SEQ ID NO: 153429 - DNA, 20 bp, Artificial Sequence
  Description of Artificial Sequence: Synthetic oligonucleotide
  Target: ATXN1; (+) strand; PAM type: NRG; PAM sequence: AGG
tatttttttaaaggtcttaa

SEQ ID NO: 153430 - DNA, 20 bp, Artificial Sequence
  Description of Artificial Sequence: Synthetic oligonucleotide
  Target: ATXN1; (+) strand; PAM type: NRG; PAM sequence: AAG
ttttttaaaggtcttaaagg

SEQ ID NO: 153431 - DNA, 20 bp, Artificial Sequence
  Description of Artificial Sequence: Synthetic oligonucleotide
  Target: ATXN1; (+) strand; PAM type: NRG; PAM sequence: GAG
ttttaaaggtcttaaaggaa

SEQ ID NO: 153432 - DNA, 20 bp, Artificial Sequence
  Description of Artificial Sequence: Synthetic oligonucleotide
  Target: ATXN1; (+) strand; PAM type: NRG; PAM sequence: GAG
ttaaaggtcttaaaggaaga

SEQ ID NO: 153433 - DNA, 20 bp, Artificial Sequence
  Description of Artificial Sequence: Synthetic oligonucleotide
  Target: ATXN1; (+) strand; PAM type: NRG; PAM sequence: AGG
taaaggtcttaaaggaagag

SEQ ID NO: 153434 - DNA, 20 bp, Artificial Sequence
  Description of Artificial Sequence: Synthetic oligonucleotide
  Target: ATXN1; (+) strand; PAM type: NRG; PAM sequence: AAG
aaaggaagagaggttttgac

SEQ ID NO: 153435 - DNA, 20 bp, Artificial Sequence
  Description of Artificial Sequence: Synthetic oligonucleotide
  Target: ATXN1; (+) strand; PAM type: NRG; PAM sequence: TAG
gacaagatttcattgaactg

SEQ ID NO: 153436 - DNA, 20 bp, Artificial Sequence
  Description of Artificial Sequence: Synthetic oligonucleotide
  Target: ATXN1; (+) strand; PAM type: NRG; PAM sequence: CAG
gatttcattgaactgtagtt

SEQ ID NO: 153437 - DNA, 20 bp, Artificial Sequence
  Description of Artificial Sequence: Synthetic oligonucleotide
  Target: ATXN1; (+) strand; PAM type: NRG; PAM sequence: GAG
ttgaactgtagttcagcact

SEQ ID NO: 153438 - DNA, 20 bp, Artificial Sequence
  Description of Artificial Sequence: Synthetic oligonucleotide
  Target: ATXN1; (+) strand; PAM type: NRG; PAM sequence: AAG
tagttcagcactgagtttcc

SEQ ID NO: 153439 - DNA, 20 bp, Artificial Sequence
  Description of Artificial Sequence: Synthetic oligonucleotide
  Target: ATXN1; (+) strand; PAM type: NRG; PAM sequence: AGG
agttcagcactgagtttcca

SEQ ID NO: 153440 - DNA, 20 bp, Artificial Sequence
  Description of Artificial Sequence: Synthetic oligonucleotide
  Target: ATXN1; (+) strand; PAM type: NRG; PAM sequence: GAG
actgagtttccaaggtgcct

SEQ ID NO: 153441 - DNA, 20 bp, Artificial Sequence
  Description of Artificial Sequence: Synthetic oligonucleotide
  Target: ATXN1; (+) strand; PAM type: NRG; PAM sequence: CAG
tttccaaggtgcctgagctg

SEQ ID NO: 153442 - DNA, 20 bp, Artificial Sequence
  Description of Artificial Sequence: Synthetic oligonucleotide
  Target: ATXN1; (+) strand; PAM type: NRG; PAM sequence: AAG
ccaaggtgcctgagctgcag

SEQ ID NO: 153443 - DNA, 20 bp, Artificial Sequence
  Description of Artificial Sequence: Synthetic oligonucleotide
  Target: ATXN1; (+) strand; PAM type: NRG; PAM sequence: GAG
aaggtgcctgagctgcagaa

SEQ ID NO: 153444 - DNA, 20 bp, Artificial Sequence
  Description of Artificial Sequence: Synthetic oligonucleotide
  Target: ATXN1; (+) strand; PAM type: NRG; PAM sequence: TGG
gagctgcagaagagtcctta

SEQ ID NO: 153445 - DNA, 20 bp, Artificial Sequence
  Description of Artificial Sequence: Synthetic oligonucleotide
  Target: ATXN1; (+) strand; PAM type: NRG; PAM sequence: CAG
catacatcacccaactcctc

SEQ ID NO: 153446 - DNA, 20 bp, Artificial Sequence
  Description of Artificial Sequence: Synthetic oligonucleotide
  Target: ATXN1; (+) strand; PAM type: NRG; PAM sequence: CAG
acccaactcctccagccacc

SEQ ID NO: 153447 - DNA, 20 bp, Artificial Sequence
  Description of Artificial Sequence: Synthetic oligonucleotide
  Target: ATXN1; (+) strand; PAM type: NRG; PAM sequence: CAG
ccacccagcctccttcaccc

SEQ ID NO: 153448 - DNA, 20 bp, Artificial Sequence
  Description of Artificial Sequence: Synthetic oligonucleotide
  Target: ATXN1; (+) strand; PAM type: NRG; PAM sequence: AAG
ccttcaccccagatcatgaa

SEQ ID NO: 153449 - DNA, 20 bp, Artificial Sequence
  Description of Artificial Sequence: Synthetic oligonucleotide
  Target: ATXN1; (+) strand; PAM type: NRG; PAM sequence: AAG
tcaccccagatcatgaaaag

SEQ ID NO: 153450 - DNA, 20 bp, Artificial Sequence
  Description of Artificial Sequence: Synthetic oligonucleotide
  Target: ATXN1; (+) strand; PAM type: NRG; PAM sequence: AGG
caccccagatcatgaaaaga

SEQ ID NO: 153451 - DNA, 20 bp, Artificial Sequence
  Description of Artificial Sequence: Synthetic oligonucleotide
  Target: ATXN1; (+) strand; PAM type: NRG; PAM sequence: CAG
cccagatcatgaaaagaagg

SEQ ID NO: 153452 - DNA, 20 bp, Artificial Sequence
  Description of Artificial Sequence: Synthetic oligonucleotide
  Target: ATXN1; (+) strand; PAM type: NRG; PAM sequence: AAG
tcatgaaaagaaggcagacg

SEQ ID NO: 153453 - DNA, 20 bp, Artificial Sequence
  Description of Artificial Sequence: Synthetic oligonucleotide
  Target: ATXN1; (+) strand; PAM type: NRG; PAM sequence: AGG
catgaaaagaaggcagacga

SEQ ID NO: 153454 - DNA, 20 bp, Artificial Sequence
  Description of Artificial Sequence: Synthetic oligonucleotide
  Target: ATXN1; (+) strand; PAM type: NRG; PAM sequence: AAG
gccatgccacatcaatgttg

SEQ ID NO: 153455 - DNA, 20 bp, Artificial Sequence
  Description of Artificial Sequence: Synthetic oligonucleotide
  Target: ATXN1; (+) strand; PAM type: NRG; PAM sequence: CAG
tctctctacacattctacac

SEQ ID NO: 153456 - DNA, 20 bp, Artificial Sequence
  Description of Artificial Sequence: Synthetic oligonucleotide
  Target: ATXN1; (+) strand; PAM type: NRG; PAM sequence: CAG
gctgacgtcatccctgaatt

SEQ ID NO: 153457 - DNA, 20 bp, Artificial Sequence
  Description of Artificial Sequence: Synthetic oligonucleotide
  Target: ATXN1; (+) strand; PAM type: NRG; PAM sequence: TGG
gaattcagtcatccccctcc

SEQ ID NO: 153458 - DNA, 20 bp, Artificial Sequence
  Description of Artificial Sequence: Synthetic oligonucleotide
  Target: ATXN1; (+) strand; PAM type: NRG; PAM sequence: GGG
aattcagtcatccccctcct

SEQ ID NO: 153459 - DNA, 20 bp, Artificial Sequence
  Description of Artificial Sequence: Synthetic oligonucleotide
  Target: ATXN1; (+) strand; PAM type: NRG; PAM sequence: CAG
ctgggtgtcaaactttttgc

SEQ ID NO: 153460 - DNA, 20 bp, Artificial Sequence
  Description of Artificial Sequence: Synthetic oligonucleotide
  Target: ATXN1; (+) strand; PAM type: NRG; PAM sequence: AGG
tgggtgtcaaactttttgcc

SEQ ID NO: 153461 - DNA, 20 bp, Artificial Sequence
  Description of Artificial Sequence: Synthetic oligonucleotide
  Target: ATXN1; (+) strand; PAM type: NRG; PAM sequence: AAG
tcaaactttttgccaggccc

SEQ ID NO: 153462 - DNA, 20 bp, Artificial Sequence
  Description of Artificial Sequence: Synthetic oligonucleotide
  Target: ATXN1; (+) strand; PAM type: NRG; PAM sequence: AAG
ggcccaagaacccaatttca

SEQ ID NO: 153463 - DNA, 20 bp, Artificial Sequence
  Description of Artificial Sequence: Synthetic oligonucleotide
  Target: ATXN1; (+) strand; PAM type: NRG; PAM sequence: AAG
tcaaagatcacttttatgcc

SEQ ID NO: 153464 - DNA, 20 bp, Artificial Sequence
  Description of Artificial Sequence: Synthetic oligonucleotide
  Target: ATXN1; (+) strand; PAM type: NRG; PAM sequence: AGG
caaagatcacttttatgcca

SEQ ID NO: 153465 - DNA, 20 bp, Artificial Sequence
  Description of Artificial Sequence: Synthetic oligonucleotide
  Target: ATXN1; (+) strand; PAM type: NRG; PAM sequence: CAG
gactcctccaaatttatctt

SEQ ID NO: 153466 - DNA, 20 bp, Artificial Sequence
  Description of Artificial Sequence: Synthetic oligonucleotide
  Target: ATXN1; (+) strand; PAM type: NRG; PAM sequence: CGG
tatcttcagacttgacctct

SEQ ID NO: 153467 - DNA, 20 bp, Artificial Sequence
  Description of Artificial Sequence: Synthetic oligonucleotide
  Target: ATXN1; (+) strand; PAM type: NRG; PAM sequence: CAG
cttcagacttgacctctcgg

SEQ ID NO: 153468 - DNA, 20 bp, Artificial Sequence
  Description of Artificial Sequence: Synthetic oligonucleotide
  Target: ATXN1; (+) strand; PAM type: NRG; PAM sequence: CAG
ctctactgtctgctcgaatc

SEQ ID NO: 153469 - DNA, 20 bp, Artificial Sequence
  Description of Artificial Sequence: Synthetic oligonucleotide
  Target: ATXN1; (+) strand; PAM type: NRG; PAM sequence: CAG
tctgctcgaatccagaaatt

SEQ ID NO: 153470 - DNA, 20 bp, Artificial Sequence
  Description of Artificial Sequence: Synthetic oligonucleotide
  Target: ATXN1; (+) strand; PAM type: NRG; PAM sequence: CAG
ccagaaattcagatgtccac

SEQ ID NO: 153471 - DNA, 20 bp, Artificial Sequence
  Description of Artificial Sequence: Synthetic oligonucleotide
  Target: ATXN1; (+) strand; PAM type: NRG; PAM sequence: TAG
ttcagatgtccaccagcacc

SEQ ID NO: 153472 - DNA, 20 bp, Artificial Sequence
  Description of Artificial Sequence: Synthetic oligonucleotide
  Target: ATXN1; (+) strand; PAM type: NRG; PAM sequence: AGG
tcagatgtccaccagcacct

SEQ ID NO: 153473 - DNA, 20 bp, Artificial Sequence
  Description of Artificial Sequence: Synthetic oligonucleotide
  Target: ATXN1; (+) strand; PAM type: NRG; PAM sequence: CAG
gtccaccagcacctaggctt

SEQ ID NO: 153474 - DNA, 20 bp, Artificial Sequence
  Description of Artificial Sequence: Synthetic oligonucleotide
  Target: ATXN1; (+) strand; PAM type: NRG; PAM sequence: TGG
aggcttcagtcaaaatgtcc

SEQ ID NO: 153475 - DNA, 20 bp, Artificial Sequence
  Description of Artificial Sequence: Synthetic oligonucleotide
  Target: ATXN1; (+) strand; PAM type: NRG; PAM sequence: CAG
ttcagtcaaaatgtcctggt

SEQ ID NO: 153476 - DNA, 20 bp, Artificial Sequence
  Description of Artificial Sequence: Synthetic oligonucleotide
  Target: ATXN1; (+) strand; PAM type: NRG; PAM sequence: TGG
gtcagttacataccgtgcat

SEQ ID NO: 153477 - DNA, 20 bp, Artificial Sequence
  Description of Artificial Sequence: Synthetic oligonucleotide
  Target: ATXN1; (+) strand; PAM type: NRG; PAM sequence: CAG
tgcattggcttgttatgtcc

SEQ ID NO: 153478 - DNA, 20 bp, Artificial Sequence
  Description of Artificial Sequence: Synthetic oligonucleotide
  Target: ATXN1; (+) strand; PAM type: NRG; PAM sequence: TGG
ttatgtcccagacacacaca

SEQ ID NO: 153479 - DNA, 20 bp, Artificial Sequence
  Description of Artificial Sequence: Synthetic oligonucleotide
  Target: ATXN1; (+) strand; PAM type: NRG; PAM sequence: CAG
gctccatccatctcttccca

SEQ ID NO: 153480 - DNA, 20 bp, Artificial Sequence
  Description of Artificial Sequence: Synthetic oligonucleotide
  Target: ATXN1; (+) strand; PAM type: NRG; PAM sequence: TAG
cttcccacagaaatgcaatc

SEQ ID NO: 153481 - DNA, 20 bp, Artificial Sequence
  Description of Artificial Sequence: Synthetic oligonucleotide
  Target: ATXN1; (+) strand; PAM type: NRG; PAM sequence: CAG
ccacagaaatgcaatctagt

SEQ ID NO: 153482 - DNA, 20 bp, Artificial Sequence
  Description of Artificial Sequence: Synthetic oligonucleotide
  Target: ATXN1; (+) strand; PAM type: NRG; PAM sequence: CAG
cagaaatgcaatctagtcag

SEQ ID NO: 153483 - DNA, 20 bp, Artificial Sequence
  Description of Artificial Sequence: Synthetic oligonucleotide
  Target: ATXN1; (+) strand; PAM type: NRG; PAM sequence: GAG
gaaatgcaatctagtcagca

SEQ ID NO: 153484 - DNA, 20 bp, Artificial Sequence
  Description of Artificial Sequence: Synthetic oligonucleotide
  Target: ATXN1; (+) strand; PAM type: NRG; PAM sequence: AAG
tagtcagcagagctcaactc

SEQ ID NO: 153485 - DNA, 20 bp, Artificial Sequence
  Description of Artificial Sequence: Synthetic oligonucleotide
  Target: ATXN1; (+) strand; PAM type: NRG; PAM sequence: AAG
caagtgatccctcctcctca

SEQ ID NO: 153486 - DNA, 20 bp, Artificial Sequence
  Description of Artificial Sequence: Synthetic oligonucleotide
  Target: ATXN1; (+) strand; PAM type: NRG; PAM sequence: CAG
ctttcctgatcactcctact

SEQ ID NO: 153487 - DNA, 20 bp, Artificial Sequence
  Description of Artificial Sequence: Synthetic oligonucleotide
  Target: ATXN1; (+) strand; PAM type: NRG; PAM sequence: TAG
cttctgaattccttcactgt

SEQ ID NO: 153488 - DNA, 20 bp, Artificial Sequence
  Description of Artificial Sequence: Synthetic oligonucleotide
  Target: ATXN1; (+) strand; PAM type: NRG; PAM sequence: TAG
cttcactgttagaacactgt

SEQ ID NO: 153489 - DNA, 20 bp, Artificial Sequence
  Description of Artificial Sequence: Synthetic oligonucleotide
  Target: ATXN1; (+) strand; PAM type: NRG; PAM sequence: CAG
tctattcgtattcattattt

SEQ ID NO: 153490 - DNA, 20 bp, Artificial Sequence
  Description of Artificial Sequence: Synthetic oligonucleotide
  Target: ATXN1; (+) strand; PAM type: NRG; PAM sequence: GAG
tattcgtattcattatttca

SEQ ID NO: 153491 - DNA, 20 bp, Artificial Sequence
  Description of Artificial Sequence: Synthetic oligonucleotide
  Target: ATXN1; (+) strand; PAM type: NRG; PAM sequence: GAG
ttcgtattcattatttcaga

SEQ ID NO: 153492 - DNA, 20 bp, Artificial Sequence
  Description of Artificial Sequence: Synthetic oligonucleotide
  Target: ATXN1; (+) strand; PAM type: NRG; PAM sequence: CAG
tcttctttcccctgcctgac

SEQ ID NO: 153493 - DNA, 20 bp, Artificial Sequence
  Description of Artificial Sequence: Synthetic oligonucleotide
  Target: ATXN1; (+) strand; PAM type: NRG; PAM sequence: AGG
cttctttcccctgcctgacc

SEQ ID NO: 153494 - DNA, 20 bp, Artificial Sequence
  Description of Artificial Sequence: Synthetic oligonucleotide
  Target: ATXN1; (+) strand; PAM type: NRG; PAM sequence: AAG
ctttcccctgcctgaccagg

SEQ ID NO: 153495 - DNA, 20 bp, Artificial Sequence
  Description of Artificial Sequence: Synthetic oligonucleotide
  Target: ATXN1; (+) strand; PAM type: NRG; PAM sequence: CGG
ggaagaaaataactgccttc

SEQ ID NO: 153496 - DNA, 20 bp, Artificial Sequence
  Description of Artificial Sequence: Synthetic oligonucleotide
  Target: ATXN1; (+) strand; PAM type: NRG; PAM sequence: TAG
agaaaataactgccttccgg

SEQ ID NO: 153497 - DNA, 20 bp, Artificial Sequence
  Description of Artificial Sequence: Synthetic oligonucleotide
  Target: ATXN1; (+) strand; PAM type: NRG; PAM sequence: CAG
cttattcacttccattccca

SEQ ID NO: 153498 - DNA, 20 bp, Artificial Sequence
  Description of Artificial Sequence: Synthetic oligonucleotide
  Target: ATXN1; (+) strand; PAM type: NRG; PAM sequence: CAG
tccattcccacagcaccatg

SEQ ID NO: 153499 - DNA, 20 bp, Artificial Sequence
  Description of Artificial Sequence: Synthetic oligonucleotide
  Target: ATXN1; (+) strand; PAM type: NRG; PAM sequence: TAG
attcccacagcaccatgcag

SEQ ID NO: 153500 - DNA, 20 bp, Artificial Sequence
  Description of Artificial Sequence: Synthetic oligonucleotide
  Target: ATXN1; (+) strand; PAM type: NRG; PAM sequence: TAG
gaatcatttctttacataaa

SEQ ID NO: 153501 - DNA, 20 bp, Artificial Sequence
  Description of Artificial Sequence: Synthetic oligonucleotide
  Target: ATXN1; (+) strand; PAM type: NRG; PAM sequence: AAG
cataaatagtgactgtgaac

SEQ ID NO: 153502 - DNA, 20 bp, Artificial Sequence
  Description of Artificial Sequence: Synthetic oligonucleotide
  Target: ATXN1; (+) strand; PAM type: NRG; PAM sequence: TAG
aatagtgactgtgaacaagt

SEQ ID NO: 153503 - DNA, 20 bp, Artificial Sequence
  Description of Artificial Sequence: Synthetic oligonucleotide
  Target: ATXN1; (+) strand; PAM type: NRG; PAM sequence: AGG
atagtgactgtgaacaagtt

SEQ ID NO: 153504 - DNA, 20 bp, Artificial Sequence
  Description of Artificial Sequence: Synthetic oligonucleotide
  Target: ATXN1; (+) strand; PAM type: NRG; PAM sequence: TAG
agttaggtcataacttgcta

SEQ ID NO: 153505 - DNA, 20 bp, Artificial Sequence
  Description of Artificial Sequence: Synthetic oligonucleotide
  Target: ATXN1; (+) strand; PAM type: NRG; PAM sequence: TAG
tatcatatttataaaataac

SEQ ID NO: 153506 - DNA, 20 bp, Artificial Sequence
  Description of Artificial Sequence: Synthetic oligonucleotide
  Target: ATXN1; (+) strand; PAM type: NRG; PAM sequence: CAG
atttataaaataactagaac

SEQ ID NO: 153507 - DNA, 20 bp, Artificial Sequence
  Description of Artificial Sequence: Synthetic oligonucleotide
  Target: ATXN1; (+) strand; PAM type: NRG; PAM sequence: AAG
ataaaataactagaaccaga

SEQ ID NO: 153508 - DNA, 20 bp, Artificial Sequence
  Description of Artificial Sequence: Synthetic oligonucleotide
  Target: ATXN1; (+) strand; PAM type: NRG; PAM sequence: TAG
aaccagaaagaactataatg

SEQ ID NO: 153509 - DNA, 20 bp, Artificial Sequence
  Description of Artificial Sequence: Synthetic oligonucleotide
  Target: ATXN1; (+) strand; PAM type: NRG; PAM sequence: AGG
accagaaagaactataatgt

SEQ ID NO: 153510 - DNA, 20 bp, Artificial Sequence
  Description of Artificial Sequence: Synthetic oligonucleotide
  Target: ATXN1; (+) strand; PAM type: NRG; PAM sequence: AAG
aagaactataatgtaggttt

SEQ ID NO: 153511 - DNA, 20 bp, Artificial Sequence
  Description of Artificial Sequence: Synthetic oligonucleotide
  Target: ATXN1; (+) strand; PAM type: NRG; PAM sequence: AAG
aaaaaactgaatgaatataa

SEQ ID NO: 153512 - DNA, 20 bp, Artificial Sequence
  Description of Artificial Sequence: Synthetic oligonucleotide
  Target: ATXN1; (+) strand; PAM type: NRG; PAM sequence: GAG
aaaactgaatgaatataaaa

SEQ ID NO: 153513 - DNA, 20 bp, Artificial Sequence
  Description of Artificial Sequence: Synthetic oligonucleotide
  Target: ATXN1; (+) strand; PAM type: NRG; PAM sequence: GAG
actatttttctgcctacgtt

SEQ ID NO: 153514 - DNA, 20 bp, Artificial Sequence
  Description of Artificial Sequence: Synthetic oligonucleotide
  Target: ATXN1; (+) strand; PAM type: NRG; PAM sequence: GAG
tacgttgagccgtcaatcgt

SEQ ID NO: 153515 - DNA, 20 bp, Artificial Sequence
  Description of Artificial Sequence: Synthetic oligonucleotide
  Target: ATXN1; (+) strand; PAM type: NRG; PAM sequence: AGG
acgttgagccgtcaatcgtg

SEQ ID NO: 153516 - DNA, 20 bp, Artificial Sequence
  Description of Artificial Sequence: Synthetic oligonucleotide
  Target: ATXN1; (+) strand; PAM type: NRG; PAM sequence: GAG
tcaatcgtgaggactgtaat

SEQ ID NO: 153517 - DNA, 20 bp, Artificial Sequence
  Description of Artificial Sequence: Synthetic oligonucleotide
  Target: ATXN1; (+) strand; PAM type: NRG; PAM sequence: AGG
caatcgtgaggactgtaatg

SEQ ID NO: 153518 - DNA, 20 bp, Artificial Sequence
  Description of Artificial Sequence: Synthetic oligonucleotide
  Target: ATXN1; (+) strand; PAM type: NRG; PAM sequence: TAG
cattattgatgcaaaatgtt

SEQ ID NO: 153519 - DNA, 20 bp, Artificial Sequence
  Description of Artificial Sequence: Synthetic oligonucleotide
  Target: ATXN1; (+) strand; PAM type: NRG; PAM sequence: AAG
aatgtttagataatgcttat

SEQ ID NO: 153520 - DNA, 20 bp, Artificial Sequence
  Description of Artificial Sequence: Synthetic oligonucleotide
  Target: ATXN1; (+) strand; PAM type: NRG; PAM sequence: TAG
gctttctttaaatgcaatca

SEQ ID NO: 153521 - DNA, 20 bp, Artificial Sequence
  Description of Artificial Sequence: Synthetic oligonucleotide
  Target: ATXN1; (+) strand; PAM type: NRG; PAM sequence: CAG
aatgcaatcatagaaaatgt

SEQ ID NO: 153522 - DNA, 20 bp, Artificial Sequence
  Description of Artificial Sequence: Synthetic oligonucleotide
  Target: ATXN1; (+) strand; PAM type: NRG; PAM sequence: AAG
aatgtcagcgcttaaaattc

SEQ ID NO: 153523 - DNA, 20 bp, Artificial Sequence
  Description of Artificial Sequence: Synthetic oligonucleotide
  Target: ATXN1; (+) strand; PAM type: NRG; PAM sequence: AGG
atgtcagcgcttaaaattca

SEQ ID NO: 153524 - DNA, 20 bp, Artificial Sequence
  Description of Artificial Sequence: Synthetic oligonucleotide
  Target: ATXN1; (+) strand; PAM type: NRG; PAM sequence: CAG
gtgactttgcgctacttcgt

SEQ ID NO: 153525 - DNA, 20 bp, Artificial Sequence
  Description of Artificial Sequence: Synthetic oligonucleotide
  Target: ATXN1; (+) strand; PAM type: NRG; PAM sequence: TAG
gcgctacttcgtcagtattt

SEQ ID NO: 153526 - DNA, 20 bp, Artificial Sequence
  Description of Artificial Sequence: Synthetic oligonucleotide
  Target: ATXN1; (+) strand; PAM type: NRG; PAM sequence: AAG
gtcagtattttagtattcat

SEQ ID NO: 153527 - DNA, 20 bp, Artificial Sequence
  Description of Artificial Sequence: Synthetic oligonucleotide
  Target: ATXN1; (+) strand; PAM type: NRG; PAM sequence: TAG
cctaacatattataaaaacc

SEQ ID NO: 153528 - DNA, 20 bp, Artificial Sequence
  Description of Artificial Sequence: Synthetic oligonucleotide
  Target: ATXN1; (+) strand; PAM type: NRG; PAM sequence: AGG
ctaacatattataaaaacct

SEQ ID NO: 153529 - DNA, 20 bp, Artificial Sequence
  Description of Artificial Sequence: Synthetic oligonucleotide
  Target: ATXN1; (+) strand; PAM type: NRG; PAM sequence: AAG
aacctaggtctcttctcaat

SEQ ID NO: 153530 - DNA, 20 bp, Artificial Sequence
  Description of Artificial Sequence: Synthetic oligonucleotide
  Target: ATXN1; (+) strand; PAM type: NRG; PAM sequence: AAG
ataagctgcccatattgacc

SEQ ID NO: 153531 - DNA, 20 bp, Artificial Sequence
  Description of Artificial Sequence: Synthetic oligonucleotide
  Target: ATXN1; (+) strand; PAM type: NRG; PAM sequence: GAG
aagctgcccatattgaccaa

SEQ ID NO: 153532 - DNA, 20 bp, Artificial Sequence
  Description of Artificial Sequence: Synthetic oligonucleotide
  Target: ATXN1; (+) strand; PAM type: NRG; PAM sequence: GAG
tttttcacaataaaattctt

SEQ ID NO: 153533 - DNA, 20 bp, Artificial Sequence
  Description of Artificial Sequence: Synthetic oligonucleotide
  Target: ATXN1; (+) strand; PAM type: NRG; PAM sequence: CAG
atgactccctttcaacacca

SEQ ID NO: 153534 - DNA, 20 bp, Artificial Sequence
  Description of Artificial Sequence: Synthetic oligonucleotide
  Target: ATXN1; (+) strand; PAM type: NRG; PAM sequence: AGG
tgactccctttcaacaccac

SEQ ID NO: 153535 - DNA, 20 bp, Artificial Sequence
  Description of Artificial Sequence: Synthetic oligonucleotide
  Target: ATXN1; (+) strand; PAM type: NRG; PAM sequence: AAG
gcaattaaactatttcccca

SEQ ID NO: 153536 - DNA, 20 bp, Artificial Sequence
  Description of Artificial Sequence: Synthetic oligonucleotide
  Target: ATXN1; (+) strand; PAM type: NRG; PAM sequence: GAG
ttccccaaagatctaaatgt

SEQ ID NO: 153537 - DNA, 20 bp, Artificial Sequence
  Description of Artificial Sequence: Synthetic oligonucleotide
  Target: ATXN1; (+) strand; PAM type: NRG; PAM sequence: AGG
tccccaaagatctaaatgtg

SEQ ID NO: 153538 - DNA, 20 bp, Artificial Sequence
  Description of Artificial Sequence: Synthetic oligonucleotide
  Target: ATXN1; (+) strand; PAM type: NRG; PAM sequence: CAG
gatctaaatgtgaggatttt

SEQ ID NO: 153539 - DNA, 20 bp, Artificial Sequence
  Description of Artificial Sequence: Synthetic oligonucleotide
  Target: ATXN1; (+) strand; PAM type: NRG; PAM sequence: TAG
aaatgtgaggattttcagcc

SEQ ID NO: 153540 - DNA, 20 bp, Artificial Sequence
  Description of Artificial Sequence: Synthetic oligonucleotide
  Target: ATXN1; (+) strand; PAM type: NRG; PAM sequence: GAG
tagcacataaccgttaaaat

SEQ ID NO: 153541 - DNA, 20 bp, Artificial Sequence
  Description of Artificial Sequence: Synthetic oligonucleotide
  Target: ATXN1; (+) strand; PAM type: NRG; PAM sequence: AAG
ttaaaatgagtatcatccct

SEQ ID NO: 153542 - DNA, 20 bp, Artificial Sequence
  Description of Artificial Sequence: Synthetic oligonucleotide
  Target: ATXN1; (+) strand; PAM type: NRG; PAM sequence: GAG
aaaatgagtatcatccctaa

SEQ ID NO: 153543 - DNA, 20 bp, Artificial Sequence
  Description of Artificial Sequence: Synthetic oligonucleotide
  Target: ATXN1; (+) strand; PAM type: NRG; PAM sequence: AAG
agtatcatccctaagagata

SEQ ID NO: 153544 - DNA, 20 bp, Artificial Sequence
  Description of Artificial Sequence: Synthetic oligonucleotide
  Target: ATXN1; (+) strand; PAM type: NRG; PAM sequence: TAG
atcatccctaagagataaag

SEQ ID NO: 153545 - DNA, 20 bp, Artificial Sequence
  Description of Artificial Sequence: Synthetic oligonucleotide
  Target: ATXN1; (+) strand; PAM type: NRG; PAM sequence: CAG
atccctaagagataaagtag

SEQ ID NO: 153546 - DNA, 20 bp, Artificial Sequence
  Description of Artificial Sequence: Synthetic oligonucleotide
  Target: ATXN1; (+) strand; PAM type: NRG; PAM sequence: AAG
ctaagagataaagtagcagt

SEQ ID NO: 153547 - DNA, 20 bp, Artificial Sequence
  Description of Artificial Sequence: Synthetic oligonucleotide
  Target: ATXN1; (+) strand; PAM type: NRG; PAM sequence: GAG
tctttttttttttttttttt

SEQ ID NO: 153548 - DNA, 20 bp, Artificial Sequence
  Description of Artificial Sequence: Synthetic oligonucleotide
  Target: ATXN1; (+) strand; PAM type: NRG; PAM sequence: TGG
ttttttttttttttttgaga

SEQ ID NO: 153549 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttttgagatg

SEQ ID NO: 153550 - DNA, 20 bp, Artificial Sequence
  Description of Artificial Sequence: Synthetic oligonucleotide
  Target: ATXN1; (+) strand; PAM type: NRG; PAM sequence: CAG
tggagtctcactctgtcgcc

SEQ ID NO: 153551 - DNA, 20 bp, Artificial Sequence
  Description of Artificial Sequence: Synthetic oligonucleotide
  Target: ATXN1; (+) strand; PAM type: NRG; PAM sequence: AGG
ggagtctcactctgtcgccc

SEQ ID NO: 153552 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcgcccaggc

SEQ ID NO: 153553 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcgcccaggctg

SEQ ID NO: 153554 - DNA, 20 bp, Artificial Sequence
  Description of Artificial Sequence: Synthetic oligonucleotide
  Target: ATXN1; (+) strand; PAM type: NRG; PAM sequence: CAG
ctgtcgcccaggctggagtg

SEQ ID NO: 153555 - DNA, 20 bp, Artificial Sequence
  Description of Artificial Sequence: Synthetic oligonucleotide
  Target: ATXN1; (+) strand; PAM type: NRG; PAM sequence: TGG
tcgcccaggctggagtgcag

SEQ ID NO: 153556 - DNA, 20 bp, Artificial Sequence
  Description of Artificial Sequence: Synthetic oligonucleotide
  Target: ATXN1; (+) strand; PAM type: NRG; PAM sequence: GAG
ccaggctggagtgcagtggc

SEQ ID NO: 153557 - DNA, 20 bp, Artificial Sequence
  Description of Artificial Sequence: Synthetic oligonucleotide
  Target: ATXN1; (+) strand; PAM type: NRG; PAM sequence: TGG
tggagtgcagtggcgagacc

SEQ ID NO: 153558 - DNA, 20 bp, Artificial Sequence
  Description of Artificial Sequence: Synthetic oligonucleotide
  Target: ATXN1; (+) strand; PAM type: NRG; PAM sequence: GGG
ggagtgcagtggcgagacct

SEQ ID NO: 153559 - DNA, 20 bp, Artificial Sequence
  Description of Artificial Sequence: Synthetic oligonucleotide
  Target: ATXN1; (+) strand; PAM type: NRG; PAM sequence: CAG
ctcactgcaacctctgcctc

SEQ ID NO: 153560 - DNA, 20 bp, Artificial Sequence
  Description of Artificial Sequence: Synthetic oligonucleotide
  Target: ATXN1; (+) strand; PAM type: NRG; PAM sequence: AGG
tcactgcaacctctgcctcc

SEQ ID NO: 153561 - DNA, 20 bp, Artificial Sequence
  Description of Artificial Sequence: Synthetic oligonucleotide
  Target: ATXN1; (+) strand; PAM type: NRG; PAM sequence: AAG
aacctctgcctccaggattc

SEQ ID NO: 153562 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgattctcctgcct

SEQ ID NO: 153563 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcctcagtgtccc

SEQ ID NO: 153564 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagtgtcccaag

SEQ ID NO: 153565 - DNA, 20 bp, Artificial Sequence
  Description of Artificial Sequence: Synthetic oligonucleotide
  Target: ATXN1; (+) strand; PAM type: NRG; PAM sequence: TGG
gcctcagtgtcccaagtagc

SEQ ID NO: 153566 - DNA, 20 bp, Artificial Sequence
  Description of Artificial Sequence: Synthetic oligonucleotide
  Target: ATXN1; (+) strand; PAM type: NRG; PAM sequence: GGG
cctcagtgtcccaagtagct

SEQ ID NO: 153567 - DNA, 20 bp, Artificial Sequence
  Description of Artificial Sequence: Synthetic oligonucleotide
  Target: ATXN1; (+) strand; PAM type: NRG; PAM sequence: CAG
gtcccaagtagctgggatta

SEQ ID NO: 153568 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggattac

SEQ ID NO: 153569 - DNA, 20 bp, Artificial Sequence
  Description of Artificial Sequence: Synthetic oligonucleotide
  Target: ATXN1; (+) strand; PAM type: NRG; PAM sequence: TGG
caggaacctgccacaatgcc

SEQ ID NO: 153570 - DNA, 20 bp, Artificial Sequence
  Description of Artificial Sequence: Synthetic oligonucleotide
  Target: ATXN1; (+) strand; PAM type: NRG; PAM sequence: TAG
ctggctaatttttatatttt

SEQ ID NO: 153571 - DNA, 20 bp, Artificial Sequence
  Description of Artificial Sequence: Synthetic oligonucleotide
  Target: ATXN1; (+) strand; PAM type: NRG; PAM sequence: TAG
gctaatttttatatttttag

SEQ ID NO: 153572 - DNA, 20 bp, Artificial Sequence
  Description of Artificial Sequence: Synthetic oligonucleotide
  Target: ATXN1; (+) strand; PAM type: NRG; PAM sequence: GAG
taatttttatatttttagta

SEQ ID NO: 153573 - DNA, 20 bp, Artificial Sequence
  Description of Artificial Sequence: Synthetic oligonucleotide
  Target: ATXN1; (+) strand; PAM type: NRG; PAM sequence: CAG
ttttatatttttagtagaga

SEQ ID NO: 153574 - DNA, 20 bp, Artificial Sequence
  Description of Artificial Sequence: Synthetic oligonucleotide
  Target: ATXN1; (+) strand; PAM type: NRG; PAM sequence: AGG
tttatatttttagtagagac

SEQ ID NO: 153575 - DNA, 20 bp, Artificial Sequence
  Description of Artificial Sequence: Synthetic oligonucleotide
  Target: ATXN1; (+) strand; PAM type: NRG; PAM sequence: TGG
gagacaggatttcatcatgt

SEQ ID NO: 153576 - DNA, 20 bp, Artificial Sequence
  Description of Artificial Sequence: Synthetic oligonucleotide
  Target: ATXN1; (+) strand; PAM type: NRG; PAM sequence: CAG
caggatttcatcatgttggc

SEQ ID NO: 153577 - DNA, 20 bp, Artificial Sequence
  Description of Artificial Sequence: Synthetic oligonucleotide
  Target: ATXN1; (+) strand; PAM type: NRG; PAM sequence: AGG
aggatttcatcatgttggcc

SEQ ID NO: 153578 - DNA, 20 bp, Artificial Sequence
  Description of Artificial Sequence: Synthetic oligonucleotide
  Target: ATXN1; (+) strand; PAM type: NRG; PAM sequence: TGG
tttcatcatgttggccaggc

SEQ ID NO: 153579 - DNA, 20 bp, Artificial Sequence
  Description of Artificial Sequence: Synthetic oligonucleotide
  Target: ATXN1; (+) strand; PAM type: NRG; PAM sequence: AAG
ggtctcaaactcctgacctc

SEQ ID NO: 153580 - DNA, 20 bp, Artificial Sequence
  Description of Artificial Sequence: Synthetic oligonucleotide
  Target: ATXN1; (+) strand; PAM type: NRG; PAM sequence: CAG
ctcaagtgattcacccacct

SEQ ID NO: 153581 - DNA, 20 bp, Artificial Sequence
  Description of Artificial Sequence: Synthetic oligonucleotide
  Target: ATXN1; (+) strand; PAM type: NRG; PAM sequence: AAG
tcacccacctcagcctccca

SEQ ID NO: 153582 - DNA, 20 bp, Artificial Sequence
  Description of Artificial Sequence: Synthetic oligonucleotide
  Target: ATXN1; (+) strand; PAM type: NRG; PAM sequence: TGG
acctcagcctcccaaagtgc

SEQ ID NO: 153583 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaaagtgct

SEQ ID NO: 153584 - DNA, 20 bp, Artificial Sequence
  Description of Artificial Sequence: Synthetic oligonucleotide
  Target: ATXN1; (+) strand; PAM type: NRG; PAM sequence: AAG
ctcccaaagtgctgggatta

SEQ ID NO: 153585 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattaa

SEQ ID NO: 153586 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattaaaggcat

SEQ ID NO: 153587 - DNA, 20 bp, Artificial Sequence
  Description of Artificial Sequence: Synthetic oligonucleotide
  Target: ATXN1; (+) strand; PAM type: NRG; PAM sequence: TGG
aaggcatgagccactgtgcc

SEQ ID NO: 153588 - DNA, 20 bp, Artificial Sequence
  Description of Artificial Sequence: Synthetic oligonucleotide
  Target: ATXN1; (+) strand; PAM type: NRG; PAM sequence: CAG
cccaccctacctttttcatt

SEQ ID NO: 153589 - DNA, 20 bp, Artificial Sequence
  Description of Artificial Sequence: Synthetic oligonucleotide
  Target: ATXN1; (+) strand; PAM type: NRG; PAM sequence: TAG
tttcattcagctgacacttg

SEQ ID NO: 153590 - DNA, 20 bp, Artificial Sequence
  Description of Artificial Sequence: Synthetic oligonucleotide
  Target: ATXN1; (+) strand; PAM type: NRG; PAM sequence: AAG
agctgacacttgtagatctt

SEQ ID NO: 153591 - DNA, 20 bp, Artificial Sequence
  Description of Artificial Sequence: Synthetic oligonucleotide
  Target: ATXN1; (+) strand; PAM type: NRG; PAM sequence: GAG
ctgacacttgtagatcttaa

SEQ ID NO: 153592 - DNA, 20 bp, Artificial Sequence
  Description of Artificial Sequence: Synthetic oligonucleotide
  Target: ATXN1; (+) strand; PAM type: NRG; PAM sequence: AGG
tgacacttgtagatcttaag

SEQ ID NO: 153593 - DNA, 20 bp, Artificial Sequence
  Description of Artificial Sequence: Synthetic oligonucleotide
  Target: ATXN1; (+) strand; PAM type: NRG; PAM sequence: TAG
cttacctttgcatgtaactt

SEQ ID NO: 153594 - DNA, 20 bp, Artificial Sequence
  Description of Artificial Sequence: Synthetic oligonucleotide
  Target: ATXN1; (+) strand; PAM type: NRG; PAM sequence: AGG
ttacctttgcatgtaacttt

SEQ ID NO: 153595 - DNA, 20 bp, Artificial Sequence
  Description of Artificial Sequence: Synthetic oligonucleotide
  Target: ATXN1; (+) strand; PAM type: NRG; PAM sequence: AAG
ttaggttacatttccactta

SEQ ID NO: 153596 - DNA, 20 bp, Artificial Sequence
  Description of Artificial Sequence: Synthetic oligonucleotide
  Target: ATXN1; (+) strand; PAM type: NRG; PAM sequence: CAG
aagaacacctctctaatcca

SEQ ID NO: 153597 - DNA, 20 bp, Artificial Sequence
  Description of Artificial Sequence: Synthetic oligonucleotide
  Target: ATXN1; (+) strand; PAM type: NRG; PAM sequence: AAG
atccacagccaataaaatgt

SEQ ID NO: 153598 - DNA, 20 bp, Artificial Sequence
  Description of Artificial Sequence: Synthetic oligonucleotide
  Target: ATXN1; (+) strand; PAM type: NRG; PAM sequence: AGG
tccacagccaataaaatgta

SEQ ID NO: 153599 - DNA, 20 bp, Artificial Sequence
  Description of Artificial Sequence: Synthetic oligonucleotide
  Target: ATXN1; (+) strand; PAM type: NRG; PAM sequence: CAG
ccaataaaatgtaaggaatc

SEQ ID NO: 153600 - DNA, 20 bp, Artificial Sequence
  Description of Artificial Sequence: Synthetic oligonucleotide
  Target: ATXN1; (+) strand; PAM type: NRG; PAM sequence: AAG
aatccagttccatattttac

SEQ ID NO: 153601 - DNA, 20 bp, Artificial Sequence
  Description of Artificial Sequence: Synthetic oligonucleotide
  Target: ATXN1; (+) strand; PAM type: NRG; PAM sequence: GAG
tccagttccatattttacaa

SEQ ID NO: 153602 - DNA, 20 bp, Artificial Sequence
  Description of Artificial Sequence: Synthetic oligonucleotide
  Target: ATXN1; (+) strand; PAM type: NRG; PAM sequence: TGG
tcctccaccttgtcccccac

SEQ ID NO: 153603 - DNA, 20 bp, Artificial Sequence
  Description of Artificial Sequence: Synthetic oligonucleotide
  Target: ATXN1; (+) strand; PAM type: NRG; PAM sequence: GGG
cctccaccttgtcccccact

SEQ ID NO: 153604 - DNA, 20 bp, Artificial Sequence
  Description of Artificial Sequence: Synthetic oligonucleotide
  Target: ATXN1; (+) strand; PAM type: NRG; PAM sequence: TGG
gtcccccactgggacttttt

SEQ ID NO: 153605 - DNA, 20 bp, Artificial Sequence
  Description of Artificial Sequence: Synthetic oligonucleotide
  Target: ATXN1; (+) strand; PAM type: NRG; PAM sequence: GAG
cttttttggctgtttttcct

SEQ ID NO: 153606 - DNA, 20 bp, Artificial Sequence
  Description of Artificial Sequence: Synthetic oligonucleotide
  Target: ATXN1; (+) strand; PAM type: NRG; PAM sequence: AGG
ttttttggctgtttttcctg

SEQ ID NO: 153607 - DNA, 20 bp, Artificial Sequence
  Description of Artificial Sequence: Synthetic oligonucleotide
  Target: ATXN1; (+) strand; PAM type: NRG; PAM sequence: CAG
tttcctgaggcataatactt

SEQ ID NO: 153608 - DNA, 20 bp, Artificial Sequence
  Description of Artificial Sequence: Synthetic oligonucleotide
  Target: ATXN1; (+) strand; PAM type: NRG; PAM sequence: CAG
ggcataatacttcagtcact

SEQ ID NO: 153609 - DNA, 20 bp, Artificial Sequence
  Description of Artificial Sequence: Synthetic oligonucleotide
  Target: ATXN1; (+) strand; PAM type: NRG; PAM sequence: AGG
gcataatacttcagtcactc

SEQ ID NO: 153610 - DNA, 20 bp, Artificial Sequence
  Description of Artificial Sequence: Synthetic oligonucleotide
  Target: ATXN1; (+) strand; PAM type: NRG; PAM sequence: CAG
ggtttttgtttatttttact

SEQ ID NO: 153611 - DNA, 20 bp, Artificial Sequence
  Description of Artificial Sequence: Synthetic oligonucleotide
  Target: ATXN1; (+) strand; PAM type: NRG; PAM sequence: CAG
catttatgcatgcaattcat

SEQ ID NO: 153612 - DNA, 20 bp, Artificial Sequence
  Description of Artificial Sequence: Synthetic oligonucleotide
  Target: ATXN1; (+) strand; PAM type: NRG; PAM sequence: CAG
aaaccacacatgcatcccat

SEQ ID NO: 153613 - DNA, 20 bp, Artificial Sequence
  Description of Artificial Sequence: Synthetic oligonucleotide
  Target: ATXN1; (+) strand; PAM type: NRG; PAM sequence: CAG
cacacatgcatcccatcagt

SEQ ID NO: 153614 - DNA, 20 bp, Artificial Sequence
  Description of Artificial Sequence: Synthetic oligonucleotide
  Target: ATXN1; (+) strand; PAM type: NRG; PAM sequence: GAG
cacatgcatcccatcagtca

SEQ ID NO: 153615 - DNA, 20 bp, Artificial Sequence
  Description of Artificial Sequence: Synthetic oligonucleotide
  Target: ATXN1; (+) strand; PAM type: NRG; PAM sequence: GAG
catgcatcccatcagtcaga

SEQ ID NO: 153616 - DNA, 20 bp, Artificial Sequence
  Description of Artificial Sequence: Synthetic oligonucleotide
  Target: ATXN1; (+) strand; PAM type: NRG; PAM sequence: CAG
tcagagagttgtgataaatt

SEQ ID NO: 153617 - DNA, 20 bp, Artificial Sequence
  Description of Artificial Sequence: Synthetic oligonucleotide
  Target: ATXN1; (+) strand; PAM type: NRG; PAM sequence: CAG
taaattcagaatttaaaatt

SEQ ID NO: 153618 - DNA, 20 bp, Artificial Sequence
  Description of Artificial Sequence: Synthetic oligonucleotide
  Target: ATXN1; (+) strand; PAM type: NRG; PAM sequence: AAG
aattcagcaaaaacaaataa

SEQ ID NO: 153619 - DNA, 20 bp, Artificial Sequence
  Description of Artificial Sequence: Synthetic oligonucleotide
  Target: ATXN1; (+) strand; PAM type: NRG; PAM sequence: AGG
attcagcaaaaacaaataaa

SEQ ID NO: 153620 - DNA, 20 bp, Artificial Sequence
  Description of Artificial Sequence: Synthetic oligonucleotide
  Target: ATXN1; (+) strand; PAM type: NRG; PAM sequence: TGG
aaaacaaataaaaggctcct

SEQ ID NO: 153621 - DNA, 20 bp, Artificial Sequence
  Description of Artificial Sequence: Synthetic oligonucleotide
  Target: ATXN1; (+) strand; PAM type: NRG; PAM sequence: CAG
taaaaggctccttggctttg

SEQ ID NO: 153622 - DNA, 20 bp, Artificial Sequence
  Description of Artificial Sequence: Synthetic oligonucleotide
  Target: ATXN1; (+) strand; PAM type: NRG; PAM sequence: GAG
aaaggctccttggctttgca

SEQ ID NO: 153623 - DNA, 20 bp, Artificial Sequence
  Description of Artificial Sequence: Synthetic oligonucleotide
  Target: ATXN1; (+) strand; PAM type: NRG; PAM sequence: TAG
tccttggctttgcagagccg

SEQ ID NO: 153624 - DNA, 20 bp, Artificial Sequence
  Description of Artificial Sequence: Synthetic oligonucleotide
  Target: ATXN1; (+) strand; PAM type: NRG; PAM sequence: CAG
tgcagagccgtagatgtcta

SEQ ID NO: 153625 - DNA, 20 bp, Artificial Sequence
  Description of Artificial Sequence: Synthetic oligonucleotide
  Target: ATXN1; (+) strand; PAM type: NRG; PAM sequence: AGG
gcagagccgtagatgtctac

SEQ ID NO: 153626 - DNA, 20 bp, Artificial Sequence
  Description of Artificial Sequence: Synthetic oligonucleotide
  Target: ATXN1; (+) strand; PAM type: NRG; PAM sequence: GGG
cagagccgtagatgtctaca

SEQ ID NO: 153627 - DNA, 20 bp, Artificial Sequence
  Description of Artificial Sequence: Synthetic oligonucleotide
  Target: ATXN1; (+) strand; PAM type: NRG; PAM sequence: TGG
agccgtagatgtctacaggg

SEQ ID NO: 153628 - DNA, 20 bp, Artificial Sequence
  Description of Artificial Sequence: Synthetic oligonucleotide
  Target: ATXN1; (+) strand; PAM type: NRG; PAM sequence: GGG
gccgtagatgtctacagggt

SEQ ID NO: 153629 - DNA, 20 bp, Artificial Sequence
  Description of Artificial Sequence: Synthetic oligonucleotide
  Target: ATXN1; (+) strand; PAM type: NRG; PAM sequence: AAG
atgtctacagggtgggtcca

SEQ ID NO: 153630 - DNA, 20 bp, Artificial Sequence
  Description of Artificial Sequence: Synthetic oligonucleotide
  Target: ATXN1; (+) strand; PAM type: NRG; PAM sequence: AAG
acagggtgggtccaaagacc

SEQ ID NO: 153631 - DNA, 20 bp, Artificial Sequence
  Description of Artificial Sequence: Synthetic oligonucleotide
  Target: ATXN1; (+) strand; PAM type: NRG; PAM sequence: AGG
cagggtgggtccaaagacca

SEQ ID NO: 153632 - DNA, 20 bp, Artificial Sequence
  Description of Artificial Sequence: Synthetic oligonucleotide
  Target: ATXN1; (+) strand; PAM type: NRG; PAM sequence: CAG
tgggtccaaagaccaaggtc

SEQ ID NO: 153633 - DNA, 20 bp, Artificial Sequence
  Description of Artificial Sequence: Synthetic oligonucleotide
  Target: ATXN1; (+) strand; PAM type: NRG; PAM sequence: AGG
gggtccaaagaccaaggtcc

SEQ ID NO: 153634 - DNA, 20 bp, Artificial Sequence
  Description of Artificial Sequence: Synthetic oligonucleotide
  Target: ATXN1; (+) strand; PAM type: NRG; PAM sequence: TAG
caggtatatttacatatttc

SEQ ID NO: 153635 - DNA, 20 bp, Artificial Sequence
  Description of Artificial Sequence: Synthetic oligonucleotide
  Target: ATXN1; (+) strand; PAM type: NRG; PAM sequence: TGG
tacatatttctagtcatgta

SEQ ID NO: 153636 - DNA, 20 bp, Artificial Sequence
  Description of Artificial Sequence: Synthetic oligonucleotide
  Target: ATXN1; (+) strand; PAM type: NRG; PAM sequence: CAG
atttctagtcatgtatggtt

SEQ ID NO: 153637 - DNA, 20 bp, Artificial Sequence
  Description of Artificial Sequence: Synthetic oligonucleotide
  Target: ATXN1; (+) strand; PAM type: NRG; PAM sequence: AGG
tttctagtcatgtatggttc

SEQ ID NO: 153638 - DNA, 20 bp, Artificial Sequence
  Description of Artificial Sequence: Synthetic oligonucleotide
  Target: ATXN1; (+) strand; PAM type: NRG; PAM sequence: GAG
tctagtcatgtatggttcag

SEQ ID NO: 153639 - DNA, 20 bp, Artificial Sequence
  Description of Artificial Sequence: Synthetic oligonucleotide
  Target: ATXN1; (+) strand; PAM type: NRG; PAM sequence: GAG
accataacaatcaacctgtt

SEQ ID NO: 153640 - DNA, 20 bp, Artificial Sequence
  Description of Artificial Sequence: Synthetic oligonucleotide
  Target: ATXN1; (+) strand; PAM type: NRG; PAM sequence: AGG
ccataacaatcaacctgttg

SEQ ID NO: 153641 - DNA, 20 bp, Artificial Sequence
  Description of Artificial Sequence: Synthetic oligonucleotide
  Target: ATXN1; (+) strand; PAM type: NRG; PAM sequence: GGG
cataacaatcaacctgttga

SEQ ID NO: 153642 - DNA, 20 bp, Artificial Sequence
  Description of Artificial Sequence: Synthetic oligonucleotide
  Target: ATXN1; (+) strand; PAM type: NRG; PAM sequence: AAG
caatcaacctgttgagggat

SEQ ID NO: 153643 - DNA, 20 bp, Artificial Sequence
  Description of Artificial Sequence: Synthetic oligonucleotide
  Target: ATXN1; (+) strand; PAM type: NRG; PAM sequence: TAG
ttgagggataagttacttga

SEQ ID NO: 153644 - DNA, 20 bp, Artificial Sequence
  Description of Artificial Sequence: Synthetic oligonucleotide
  Target: ATXN1; (+) strand; PAM type: NRG; PAM sequence: AAG
tacttgatagcatctgttaa

SEQ ID NO: 153645 - DNA, 20 bp, Artificial Sequence
  Description of Artificial Sequence: Synthetic oligonucleotide
  Target: ATXN1; (+) strand; PAM type: NRG; PAM sequence: CAG
aaaagatacaaaccatacac

SEQ ID NO: 153646 - DNA, 20 bp, Artificial Sequence
  Description of Artificial Sequence: Synthetic oligonucleotide
  Target: ATXN1; (+) strand; PAM type: NRG; PAM sequence: AGG
aaagatacaaaccatacacc

SEQ ID NO: 153647 - DNA, 20 bp, Artificial Sequence
  Description of Artificial Sequence: Synthetic oligonucleotide
  Target: ATXN1; (+) strand; PAM type: NRG; PAM sequence: CAG
accaggtactattctaccca

SEQ ID NO: 153648 - DNA, 20 bp, Artificial Sequence
  Description of Artificial Sequence: Synthetic oligonucleotide
  Target: ATXN1; (+) strand; PAM type: NRG; PAM sequence: CAG
gtatatctactattttactc

SEQ ID NO: 153649 - DNA, 20 bp, Artificial Sequence
  Description of Artificial Sequence: Synthetic oligonucleotide
  Target: ATXN1; (+) strand; PAM type: NRG; PAM sequence: CAG
tttactccagtccatcctca

SEQ ID NO: 153650 - DNA, 20 bp, Artificial Sequence
  Description of Artificial Sequence: Synthetic oligonucleotide
  Target: ATXN1; (+) strand; PAM type: NRG; PAM sequence: CAG
actccagtccatcctcacag

SEQ ID NO: 153651 - DNA, 20 bp, Artificial Sequence
  Description of Artificial Sequence: Synthetic oligonucleotide
  Target: ATXN1; (+) strand; PAM type: NRG; PAM sequence: AAG
catcctcacagcagccctat

SEQ ID NO: 153652 - DNA, 20 bp, Artificial Sequence
  Description of Artificial Sequence: Synthetic oligonucleotide
  Target: ATXN1; (+) strand; PAM type: NRG; PAM sequence: AAG
ctcacagcagccctataaga

SEQ ID NO: 153653 - DNA, 20 bp, Artificial Sequence
  Description of Artificial Sequence: Synthetic oligonucleotide
  Target: ATXN1; (+) strand; PAM type: NRG; PAM sequence: GAG
atcttatacatgaataaact

SEQ ID NO: 153654 - DNA, 20 bp, Artificial Sequence
  Description of Artificial Sequence: Synthetic oligonucleotide
  Target: ATXN1; (+) strand; PAM type: NRG; PAM sequence: AGG
tcttatacatgaataaactg

SEQ ID NO: 153655 - DNA, 20 bp, Artificial Sequence
  Description of Artificial Sequence: Synthetic oligonucleotide
  Target: ATXN1; (+) strand; PAM type: NRG; PAM sequence: AAG
tgaataaactgaggcattga

SEQ ID NO: 153656 - DNA, 20 bp, Artificial Sequence
  Description of Artificial Sequence: Synthetic oligonucleotide
  Target: ATXN1; (+) strand; PAM type: NRG; PAM sequence: AGG
gaataaactgaggcattgaa

SEQ ID NO: 153657 - DNA, 20 bp, Artificial Sequence
  Description of Artificial Sequence: Synthetic oligonucleotide
  Target: ATXN1; (+) strand; PAM type: NRG; PAM sequence: TAG
actgaggcattgaaaggaca

SEQ ID NO: 153658 - DNA, 20 bp, Artificial Sequence
  Description of Artificial Sequence: Synthetic oligonucleotide
  Target: ATXN1; (+) strand; PAM type: NRG; PAM sequence: AGG
ctgaggcattgaaaggacat

SEQ ID NO: 153659 - DNA, 20 bp, Artificial Sequence
  Description of Artificial Sequence: Synthetic oligonucleotide
  Target: ATXN1; (+) strand; PAM type: NRG; PAM sequence: AAG
gaaaggacataggactactc

SEQ ID NO: 153660 - DNA, 20 bp, Artificial Sequence
  Description of Artificial Sequence: Synthetic oligonucleotide
  Target: ATXN1; (+) strand; PAM type: NRG; PAM sequence: AGG
aaaggacataggactactca

SEQ ID NO: 153661 - DNA, 20 bp, Artificial Sequence
  Description of Artificial Sequence: Synthetic oligonucleotide
  Target: ATXN1; (+) strand; PAM type: NRG; PAM sequence: TAG
cataggactactcaaggtca

SEQ ID NO: 153662 - DNA, 20 bp, Artificial Sequence
  Description of Artificial Sequence: Synthetic oligonucleotide
  Target: ATXN1; (+) strand; PAM type: NRG; PAM sequence: TGG
aggactactcaaggtcatag

SEQ ID NO: 153663 - DNA, 20 bp, Artificial Sequence
  Description of Artificial Sequence: Synthetic oligonucleotide
  Target: ATXN1; (+) strand; PAM type: NRG; PAM sequence: CAG
actactcaaggtcatagtgg

SEQ ID NO: 153664 - DNA, 20 bp, Artificial Sequence
  Description of Artificial Sequence: Synthetic oligonucleotide
  Target: ATXN1; (+) strand; PAM type: NRG; PAM sequence: CAG
caaggtcatagtggcagctc

SEQ ID NO: 153665 - DNA, 20 bp, Artificial Sequence
  Description of Artificial Sequence: Synthetic oligonucleotide
  Target: ATXN1; (+) strand; PAM type: NRG; PAM sequence: AAG
tagtggcagctccagatctt

SEQ ID NO: 153666 - DNA, 20 bp, Artificial Sequence
  Description of Artificial Sequence: Synthetic oligonucleotide
  Target: ATXN1; (+) strand; PAM type: NRG; PAM sequence: CAG
gcagctccagatcttaagtc

SEQ ID NO: 153667 - DNA, 20 bp, Artificial Sequence
  Description of Artificial Sequence: Synthetic oligonucleotide
  Target: ATXN1; (+) strand; PAM type: NRG; PAM sequence: TGG
ctccagatcttaagtccaga

SEQ ID NO: 153668 - DNA, 20 bp, Artificial Sequence
  Description of Artificial Sequence: Synthetic oligonucleotide
  Target: ATXN1; (+) strand; PAM type: NRG; PAM sequence: GGG
tccagatcttaagtccagat

SEQ ID NO: 153669 - DNA, 20 bp, Artificial Sequence
  Description of Artificial Sequence: Synthetic oligonucleotide
  Target: ATXN1; (+) strand; PAM type: NRG; PAM sequence: CGG
aagtccagatgggttgatta

SEQ ID NO: 153670 - DNA, 20 bp, Artificial Sequence
  Description of Artificial Sequence: Synthetic oligonucleotide
  Target: ATXN1; (+) strand; PAM type: NRG; PAM sequence: GAG
gtccagatgggttgattacg

SEQ ID NO: 153671 - DNA, 20 bp, Artificial Sequence
  Description of Artificial Sequence: Synthetic oligonucleotide
  Target: ATXN1; (+) strand; PAM type: NRG; PAM sequence: AAG
ggagctccatgctcttatct

SEQ ID NO: 153672 - DNA, 20 bp, Artificial Sequence
  Description of Artificial Sequence: Synthetic oligonucleotide
  Target: ATXN1; (+) strand; PAM type: NRG; PAM sequence: CAG
catgctcttatctaagatgc

SEQ ID NO: 153673 - DNA, 20 bp, Artificial Sequence
  Description of Artificial Sequence: Synthetic oligonucleotide
  Target: ATXN1; (+) strand; PAM type: NRG; PAM sequence: GAG
tgctcttatctaagatgcca

SEQ ID NO: 153674 - DNA, 20 bp, Artificial Sequence
  Description of Artificial Sequence: Synthetic oligonucleotide
  Target: ATXN1; (+) strand; PAM type: NRG; PAM sequence: TGG
tttatatgtaacttaaaaat

SEQ ID NO: 153675 - DNA, 20 bp, Artificial Sequence
  Description of Artificial Sequence: Synthetic oligonucleotide
  Target: ATXN1; (+) strand; PAM type: NRG; PAM sequence: CGG
aacttaaaaattggctctta

SEQ ID NO: 153676 - DNA, 20 bp, Artificial Sequence
  Description of Artificial Sequence: Synthetic oligonucleotide
  Target: ATXN1; (+) strand; PAM type: NRG; PAM sequence: AAG
aaaaattggctcttacggta

SEQ ID NO: 153677 - DNA, 20 bp, Artificial Sequence
  Description of Artificial Sequence: Synthetic oligonucleotide
  Target: ATXN1; (+) strand; PAM type: NRG; PAM sequence: GAG
aaattggctcttacggtaaa

SEQ ID NO: 153678 - DNA, 20 bp, Artificial Sequence
  Description of Artificial Sequence: Synthetic oligonucleotide
  Target: ATXN1; (+) strand; PAM type: NRG; PAM sequence: AGG
aattggctcttacggtaaag

SEQ ID NO: 153679 - DNA, 20 bp, Artificial Sequence
  Description of Artificial Sequence: Synthetic oligonucleotide
  Target: ATXN1; (+) strand; PAM type: NRG; PAM sequence: CAG
tggctcttacggtaaagagg

SEQ ID NO: 153680 - DNA, 20 bp, Artificial Sequence
  Description of Artificial Sequence: Synthetic oligonucleotide
  Target: ATXN1; (+) strand; PAM type: NRG; PAM sequence: AAG
aagaggcagctctttcttca

SEQ ID NO: 153681 - DNA, 20 bp, Artificial Sequence
  Description of Artificial Sequence: Synthetic oligonucleotide
  Target: ATXN1; (+) strand; PAM type: NRG; PAM sequence: TGG
gctctttcttcaaagaaatc

SEQ ID NO: 153682 - DNA, 20 bp, Artificial Sequence
  Description of Artificial Sequence: Synthetic oligonucleotide
  Target: ATXN1; (+) strand; PAM type: NRG; PAM sequence: AAG
gtttaaatgaacctgttata

SEQ ID NO: 153683 - DNA, 20 bp, Artificial Sequence
  Description of Artificial Sequence: Synthetic oligonucleotide
  Target: ATXN1; (+) strand; PAM type: NRG; PAM sequence: GAG
ccatctacctcttgaaaaat

SEQ ID NO: 153684 - DNA, 20 bp, Artificial Sequence
  Description of Artificial Sequence: Synthetic oligonucleotide
  Target: ATXN1; (+) strand; PAM type: NRG; PAM sequence: TGG
tgaaaattcaaattttcaaa

SEQ ID NO: 153685 - DNA, 20 bp, Artificial Sequence
  Description of Artificial Sequence: Synthetic oligonucleotide
  Target: ATXN1; (+) strand; PAM type: NRG; PAM sequence: GGG
gaaaattcaaattttcaaat

SEQ ID NO: 153686 - DNA, 20 bp, Artificial Sequence
  Description of Artificial Sequence: Synthetic oligonucleotide
  Target: ATXN1; (+) strand; PAM type: NRG; PAM sequence: GAG
aaattcaaattttcaaatgg

SEQ ID NO: 153687 - DNA, 20 bp, Artificial Sequence
  Description of Artificial Sequence: Synthetic oligonucleotide
  Target: ATXN1; (+) strand; PAM type: NRG; PAM sequence: AAG
tcaaatgggagatttgctaa

SEQ ID NO: 153688 - DNA, 20 bp, Artificial Sequence
  Description of Artificial Sequence: Synthetic oligonucleotide
  Target: ATXN1; (+) strand; PAM type: NRG; PAM sequence: TAG
aatgggagatttgctaaaag

SEQ ID NO: 153689 - DNA, 20 bp, Artificial Sequence
  Description of Artificial Sequence: Synthetic oligonucleotide
  Target: ATXN1; (+) strand; PAM type: NRG; PAM sequence: GAG
agatttgctaaaagtagaat

SEQ ID NO: 153690 - DNA, 20 bp, Artificial Sequence
  Description of Artificial Sequence: Synthetic oligonucleotide
  Target: ATXN1; (+) strand; PAM type: NRG; PAM sequence: AAG
gaatgagcttctcaccaact

SEQ ID NO: 153691 - DNA, 20 bp, Artificial Sequence
  Description of Artificial Sequence: Synthetic oligonucleotide
  Target: ATXN1; (+) strand; PAM type: NRG; PAM sequence: CAG
cttctcaccaactaagtcta

SEQ ID NO: 153692 - DNA, 20 bp, Artificial Sequence
  Description of Artificial Sequence: Synthetic oligonucleotide
  Target: ATXN1; (+) strand; PAM type: NRG; PAM sequence: TAG
taagtctacagaacataact

SEQ ID NO: 153693 - DNA, 20 bp, Artificial Sequence
  Description of Artificial Sequence: Synthetic oligonucleotide
  Target: ATXN1; (+) strand; PAM type: NRG; PAM sequence: AGG
aagtctacagaacataactt

SEQ ID NO: 153694 - DNA, 20 bp, Artificial Sequence
  Description of Artificial Sequence: Synthetic oligonucleotide
  Target: ATXN1; (+) strand; PAM type: NRG; PAM sequence: AAG
tctacagaacataacttagg

SEQ ID NO: 153695 - DNA, 20 bp, Artificial Sequence
  Description of Artificial Sequence: Synthetic oligonucleotide
  Target: ATXN1; (+) strand; PAM type: NRG; PAM sequence: GAG
tacagaacataacttaggaa

SEQ ID NO: 153696 - DNA, 20 bp, Artificial Sequence
  Description of Artificial Sequence: Synthetic oligonucleotide
  Target: ATXN1; (+) strand; PAM type: NRG; PAM sequence: TGG
cataacttaggaagagttgc

SEQ ID NO: 153697 - DNA, 20 bp, Artificial Sequence
  Description of Artificial Sequence: Synthetic oligonucleotide
  Target: ATXN1; (+) strand; PAM type: NRG; PAM sequence: AAG
aacttaggaagagttgctgg

SEQ ID NO: 153698 - DNA, 20 bp, Artificial Sequence
  Description of Artificial Sequence: Synthetic oligonucleotide
  Target: ATXN1; (+) strand; PAM type: NRG; PAM sequence: CGG
aggaagagttgctggaagac

SEQ ID NO: 153699 - DNA, 20 bp, Artificial Sequence
  Description of Artificial Sequence: Synthetic oligonucleotide
  Target: ATXN1; (+) strand; PAM type: NRG; PAM sequence: CAG
tgctggaagaccggccgacc

SEQ ID NO: 153700 - DNA, 20 bp, Artificial Sequence
  Description of Artificial Sequence: Synthetic oligonucleotide
  Target: ATXN1; (+) strand; PAM type: NRG; PAM sequence: AGG
gctggaagaccggccgaccc

SEQ ID NO: 153701 - DNA, 20 bp, Artificial Sequence
  Description of Artificial Sequence: Synthetic oligonucleotide
  Target: ATXN1; (+) strand; PAM type: NRG; PAM sequence: GGG
ctggaagaccggccgaccca

SEQ ID NO: 153702 - DNA, 20 bp, Artificial Sequence
  Description of Artificial Sequence: Synthetic oligonucleotide
  Target: ATXN1; (+) strand; PAM type: NRG; PAM sequence: GGG
tggaagaccggccgacccag

SEQ ID NO: 153703 - DNA, 20 bp, Artificial Sequence
  Description of Artificial Sequence: Synthetic oligonucleotide
  Target: ATXN1; (+) strand; PAM type: NRG; PAM sequence: TGG
cccaggggttcccaaacctg

SEQ ID NO: 153704 - DNA, 20 bp, Artificial Sequence
  Description of Artificial Sequence: Synthetic oligonucleotide
  Target: ATXN1; (+) strand; PAM type: NRG; PAM sequence: GAG
caggggttcccaaacctgtg

SEQ ID NO: 153705 - DNA, 20 bp, Artificial Sequence
  Description of Artificial Sequence: Synthetic oligonucleotide
  Target: ATXN1; (+) strand; PAM type: NRG; PAM sequence: CAG
ttcccaaacctgtggagcat

SEQ ID NO: 153706 - DNA, 20 bp, Artificial Sequence
  Description of Artificial Sequence: Synthetic oligonucleotide
  Target: ATXN1; (+) strand; PAM type: NRG; PAM sequence: TAG
acctgtggagcatcagtgcc

SEQ ID NO: 153707 - DNA, 20 bp, Artificial Sequence
  Description of Artificial Sequence: Synthetic oligonucleotide
  Target: ATXN1; (+) strand; PAM type: NRG; PAM sequence: CAG
gtggagcatcagtgcctaga

SEQ ID NO: 153708 - DNA, 20 bp, Artificial Sequence
  Description of Artificial Sequence: Synthetic oligonucleotide
  Target: ATXN1; (+) strand; PAM type: NRG; PAM sequence: CAG
cctagacagatcaatgattc

SEQ ID NO: 153709 - DNA, 20 bp, Artificial Sequence
  Description of Artificial Sequence: Synthetic oligonucleotide
  Target: ATXN1; (+) strand; PAM type: NRG; PAM sequence: CAG
agacagatcaatgattccag

SEQ ID NO: 153710 - DNA, 20 bp, Artificial Sequence
  Description of Artificial Sequence: Synthetic oligonucleotide
  Target: ATXN1; (+) strand; PAM type: NRG; PAM sequence: AGG
gacagatcaatgattccagc

SEQ ID NO: 153711 - DNA, 20 bp, Artificial Sequence
  Description of Artificial Sequence: Synthetic oligonucleotide
  Target: ATXN1; (+) strand; PAM type: NRG; PAM sequence: AAG
aggaaacattctgattcatc

SEQ ID NO: 153712 - DNA, 20 bp, Artificial Sequence
  Description of Artificial Sequence: Synthetic oligonucleotide
  Target: ATXN1; (+) strand; PAM type: NRG; PAM sequence: TAG
acattctgattcatcaagtc

SEQ ID NO: 153713 - DNA, 20 bp, Artificial Sequence
  Description of Artificial Sequence: Synthetic oligonucleotide
  Target: ATXN1; (+) strand; PAM type: NRG; PAM sequence: AGG
cattctgattcatcaagtct

SEQ ID NO: 153714 - DNA, 20 bp, Artificial Sequence
  Description of Artificial Sequence: Synthetic oligonucleotide
  Target: ATXN1; (+) strand; PAM type: NRG; PAM sequence: GGG
attctgattcatcaagtcta

SEQ ID NO: 153715 - DNA, 20 bp, Artificial Sequence
  Description of Artificial Sequence: Synthetic oligonucleotide
  Target: ATXN1; (+) strand; PAM type: NRG; PAM sequence: TGG
ctgattcatcaagtctaggg

SEQ ID NO: 153716 - DNA, 20 bp, Artificial Sequence
  Description of Artificial Sequence: Synthetic oligonucleotide
  Target: ATXN1; (+) strand; PAM type: NRG; PAM sequence: GAG
gattcatcaagtctagggtg

SEQ ID NO: 153717 - DNA, 20 bp, Artificial Sequence
  Description of Artificial Sequence: Synthetic oligonucleotide
  Target: ATXN1; (+) strand; PAM type: NRG; PAM sequence: AAG
gctccaaattctattttttt

SEQ ID NO: 153718 - DNA, 20 bp, Artificial Sequence
  Description of Artificial Sequence: Synthetic oligonucleotide
  Target: ATXN1; (+) strand; PAM type: NRG; PAM sequence: CAG
ttctatttttttaagctctc

SEQ ID NO: 153719 - DNA, 20 bp, Artificial Sequence
  Description of Artificial Sequence: Synthetic oligonucleotide
  Target: ATXN1; (+) strand; PAM type: NRG; PAM sequence: AGG
tctatttttttaagctctcc

SEQ ID NO: 153720 - DNA, 20 bp, Artificial Sequence
  Description of Artificial Sequence: Synthetic oligonucleotide
  Target: ATXN1; (+) strand; PAM type: NRG; PAM sequence: TAG
ctccaggtgattctgttgcc

SEQ ID NO: 153721 - DNA, 20 bp, Artificial Sequence
  Description of Artificial Sequence: Synthetic oligonucleotide
  Target: ATXN1; (+) strand; PAM type: NRG; PAM sequence: CAG
aggtgattctgttgcctagc

SEQ ID NO: 153722 - DNA, 20 bp, Artificial Sequence
  Description of Artificial Sequence: Synthetic oligonucleotide
  Target: ATXN1; (+) strand; PAM type: NRG; PAM sequence: AGG
ggtgattctgttgcctagcc

SEQ ID NO: 153723 - DNA, 20 bp, Artificial Sequence
  Description of Artificial Sequence: Synthetic oligonucleotide
  Target: ATXN1; (+) strand; PAM type: NRG; PAM sequence: TGG
ttctgttgcctagccaggct

SEQ ID NO: 153724 - DNA, 20 bp, Artificial Sequence
  Description of Artificial Sequence: Synthetic oligonucleotide
  Target: ATXN1; (+) strand; PAM type: NRG; PAM sequence: GGG
tctgttgcctagccaggctt

SEQ ID NO: 153725 - DNA, 20 bp, Artificial Sequence
  Description of Artificial Sequence: Synthetic oligonucleotide
  Target: ATXN1; (+) strand; PAM type: NRG; PAM sequence: TAG
aggcttgggaacctctaatc

SEQ ID NO: 153726 - DNA, 20 bp, Artificial Sequence
  Description of Artificial Sequence: Synthetic oligonucleotide
  Target: ATXN1; (+) strand; PAM type: NRG; PAM sequence: CAG
tctaatctagtctgtcttca

SEQ ID NO: 153727 - DNA, 20 bp, Artificial Sequence
  Description of Artificial Sequence: Synthetic oligonucleotide
  Target: ATXN1; (+) strand; PAM type: NRG; PAM sequence: AAG
tagtctgtcttcacagtttc

SEQ ID NO: 153728 - DNA, 20 bp, Artificial Sequence
  Description of Artificial Sequence: Synthetic oligonucleotide
  Target: ATXN1; (+) strand; PAM type: NRG; PAM sequence: CAG
tctgtcttcacagtttcaag

SEQ ID NO: 153729 - DNA, 20 bp, Artificial Sequence
  Description of Artificial Sequence: Synthetic oligonucleotide
  Target: ATXN1; (+) strand; PAM type: NRG; PAM sequence: AGG
ctgtcttcacagtttcaagc

SEQ ID NO: 153730 - DNA, 20 bp, Artificial Sequence
  Description of Artificial Sequence: Synthetic oligonucleotide
  Target: ATXN1; (+) strand; PAM type: NRG; PAM sequence: AAG
tttcaagcaggtccatttcc

SEQ ID NO: 153731 - DNA, 20 bp, Artificial Sequence
  Description of Artificial Sequence: Synthetic oligonucleotide
  Target: ATXN1; (+) strand; PAM type: NRG; PAM sequence: AGG
ttcaagcaggtccatttcca

SEQ ID NO: 153732 - DNA, 20 bp, Artificial Sequence
  Description of Artificial Sequence: Synthetic oligonucleotide
  Target: ATXN1; (+) strand; PAM type: NRG; PAM sequence: TAG
aggtccatttccaaggcaaa

SEQ ID NO: 153733 - DNA, 20 bp, Artificial Sequence
  Description of Artificial Sequence: Synthetic oligonucleotide
  Target: ATXN1; (+) strand; PAM type: NRG; PAM sequence: TGG
ttctatttcacaatctccct

SEQ ID NO: 153734 - DNA, 20 bp, Artificial Sequence
  Description of Artificial Sequence: Synthetic oligonucleotide
  Target: ATXN1; (+) strand; PAM type: NRG; PAM sequence: AAG
actcaaacccttgtgttccc

SEQ ID NO: 153735 - DNA, 20 bp, Artificial Sequence
  Description of Artificial Sequence: Synthetic oligonucleotide
  Target: ATXN1; (+) strand; PAM type: NRG; PAM sequence: AAG
tcccaagcccttactgcccc

SEQ ID NO: 153736 - DNA, 20 bp, Artificial Sequence
  Description of Artificial Sequence: Synthetic oligonucleotide
  Target: ATXN1; (+) strand; PAM type: NRG; PAM sequence: TAG
gcccttactgccccaagttc

SEQ ID NO: 153737 - DNA, 20 bp, Artificial Sequence
  Description of Artificial Sequence: Synthetic oligonucleotide
  Target: ATXN1; (+) strand; PAM type: NRG; PAM sequence: GAG
tttccttcctgatttaattt

SEQ ID NO: 153738 - DNA, 20 bp, Artificial Sequence
  Description of Artificial Sequence: Synthetic oligonucleotide
  Target: ATXN1; (+) strand; PAM type: NRG; PAM sequence: AGG
ttccttcctgatttaatttg

SEQ ID NO: 153739 - DNA, 20 bp, Artificial Sequence
  Description of Artificial Sequence: Synthetic oligonucleotide
  Target: ATXN1; (+) strand; PAM type: NRG; PAM sequence: TGG
taatttgaggcaatatcctc

SEQ ID NO: 153740 - DNA, 20 bp, Artificial Sequence
  Description of Artificial Sequence: Synthetic oligonucleotide
  Target: ATXN1; (+) strand; PAM type: NRG; PAM sequence: TAG
tcctctggccctttcttcaa

SEQ ID NO: 153741 - DNA, 20 bp, Artificial Sequence
  Description of Artificial Sequence: Synthetic oligonucleotide
  Target: ATXN1; (+) strand; PAM type: NRG; PAM sequence: GAG
ctctggccctttcttcaata

SEQ ID NO: 153742 - DNA, 20 bp, Artificial Sequence
  Description of Artificial Sequence: Synthetic oligonucleotide
  Target: ATXN1; (+) strand; PAM type: NRG; PAM sequence: GAG
tttcttcaatagagaaccat

SEQ ID NO: 153743 - DNA, 20 bp, Artificial Sequence
  Description of Artificial Sequence: Synthetic oligonucleotide
  Target: ATXN1; (+) strand; PAM type: NRG; PAM sequence: CAG
cctatgtctgcatgactctc

SEQ ID NO: 153744 - DNA, 20 bp, Artificial Sequence
  Description of Artificial Sequence: Synthetic oligonucleotide
  Target: ATXN1; (+) strand; PAM type: NRG; PAM sequence: AGG
ctatgtctgcatgactctcc

SEQ ID NO: 153745 - DNA, 20 bp, Artificial Sequence
  Description of Artificial Sequence: Synthetic oligonucleotide
  Target: ATXN1; (+) strand; PAM type: NRG; PAM sequence: CAG
gtctgcatgactctccaggc

SEQ ID NO: 153746 - DNA, 20 bp, Artificial Sequence
  Description of Artificial Sequence: Synthetic oligonucleotide
  Target: ATXN1; (+) strand; PAM type: NRG; PAM sequence: TGG
ccagaaaaacttactgtacg

SEQ ID NO: 153747 - DNA, 20 bp, Artificial Sequence
  Description of Artificial Sequence: Synthetic oligonucleotide
  Target: ATXN1; (+) strand; PAM type: NRG; PAM sequence: GGG
cagaaaaacttactgtacgt

SEQ ID NO: 153748 - DNA, 20 bp, Artificial Sequence
  Description of Artificial Sequence: Synthetic oligonucleotide
  Target: ATXN1; (+) strand; PAM type: NRG; PAM sequence: CAG
cttactgtacgtgggaaaat

SEQ ID NO: 153749 - DNA, 20 bp, Artificial Sequence
  Description of Artificial Sequence: Synthetic oligonucleotide
  Target: ATXN1; (+) strand; PAM type: NRG; PAM sequence: AGG
ttactgtacgtgggaaaatc

SEQ ID NO: 153750 - DNA, 20 bp, Artificial Sequence
  Description of Artificial Sequence: Synthetic oligonucleotide
  Target: ATXN1; (+) strand; PAM type: NRG; PAM sequence: AAG
ctgtacgtgggaaaatcagg

SEQ ID NO: 153751 - DNA, 20 bp, Artificial Sequence
  Description of Artificial Sequence: Synthetic oligonucleotide
  Target: ATXN1; (+) strand; PAM type: NRG; PAM sequence: CAG
aggaagttgtaaaatccaaa

SEQ ID NO: 153752 - DNA, 20 bp, Artificial Sequence
  Description of Artificial Sequence: Synthetic oligonucleotide
  Target: ATXN1; (+) strand; PAM type: NRG; PAM sequence: AAG
gtaaaatccaaacagacaca

SEQ ID NO: 153753 - DNA, 20 bp, Artificial Sequence
  Description of Artificial Sequence: Synthetic oligonucleotide
  Target: ATXN1; (+) strand; PAM type: NRG; PAM sequence: AAG
aaacagacacaaagaaattc

SEQ ID NO: 153754 - DNA, 20 bp, Artificial Sequence
  Description of Artificial Sequence: Synthetic oligonucleotide
  Target: ATXN1; (+) strand; PAM type: NRG; PAM sequence: TGG
attcaagattcaacaaatac

SEQ ID NO: 153755 - DNA, 20 bp, Artificial Sequence
  Description of Artificial Sequence: Synthetic oligonucleotide
  Target: ATXN1; (+) strand; PAM type: NRG; PAM sequence: TAG
tactggttcccctaaacaaa

SEQ ID NO: 153756 - DNA, 20 bp, Artificial Sequence
  Description of Artificial Sequence: Synthetic oligonucleotide
  Target: ATXN1; (+) strand; PAM type: NRG; PAM sequence: AGG
actggttcccctaaacaaat

SEQ ID NO: 153757 - DNA, 20 bp, Artificial Sequence
  Description of Artificial Sequence: Synthetic oligonucleotide
  Target: ATXN1; (+) strand; PAM type: NRG; PAM sequence: CAG
acgcacatattatactacaa

SEQ ID NO: 153758 - DNA, 20 bp, Artificial Sequence
  Description of Artificial Sequence: Synthetic oligonucleotide
  Target: ATXN1; (+) strand; PAM type: NRG; PAM sequence: AAG
aaatgcaaaaactgtgactt

SEQ ID NO: 153759 - DNA, 20 bp, Artificial Sequence
  Description of Artificial Sequence: Synthetic oligonucleotide
  Target: ATXN1; (+) strand; PAM type: NRG; PAM sequence: TGG
aaactgtgacttaagatatc

SEQ ID NO: 153760 - DNA, 20 bp, Artificial Sequence
  Description of Artificial Sequence: Synthetic oligonucleotide
  Target: ATXN1; (+) strand; PAM type: NRG; PAM sequence: TAG
ctgtgacttaagatatctgg

SEQ ID NO: 153761 - DNA, 20 bp, Artificial Sequence
  Description of Artificial Sequence: Synthetic oligonucleotide
  Target: ATXN1; (+) strand; PAM type: NRG; PAM sequence: TAG
acttaagatatctggtagca

SEQ ID NO: 153762 - DNA, 20 bp, Artificial Sequence
  Description of Artificial Sequence: Synthetic oligonucleotide
  Target: ATXN1; (+) strand; PAM type: NRG; PAM sequence: AAG
atagcattcttaattgtatt

SEQ ID NO: 153763 - DNA, 20 bp, Artificial Sequence
  Description of Artificial Sequence: Synthetic oligonucleotide
  Target: ATXN1; (+) strand; PAM type: NRG; PAM sequence: AGG
tagcattcttaattgtatta

SEQ ID NO: 153764 - DNA, 20 bp, Artificial Sequence
  Description of Artificial Sequence: Synthetic oligonucleotide
  Target: ATXN1; (+) strand; PAM type: NRG; PAM sequence: GAG
aaactgacaattaaaatgat

SEQ ID NO: 153765 - DNA, 20 bp, Artificial Sequence
  Description of Artificial Sequence: Synthetic oligonucleotide
  Target: ATXN1; (+) strand; PAM type: NRG; PAM sequence: AGG
aactgacaattaaaatgatg

SEQ ID NO: 153766 - DNA, 20 bp, Artificial Sequence
  Description of Artificial Sequence: Synthetic oligonucleotide
  Target: ATXN1; (+) strand; PAM type: NRG; PAM sequence: AAG
caattaaaatgatgaggttc

SEQ ID NO: 153767 - DNA, 20 bp, Artificial Sequence
  Description of Artificial Sequence: Synthetic oligonucleotide
  Target: ATXN1; (+) strand; PAM type: NRG; PAM sequence: TGG
gatgaggttcaagccccaat

SEQ ID NO: 153768 - DNA, 20 bp, Artificial Sequence
  Description of Artificial Sequence: Synthetic oligonucleotide
  Target: ATXN1; (+) strand; PAM type: NRG; PAM sequence: AAG
ggcaattatcaatcatcgca

SEQ ID NO: 153769 - DNA, 20 bp, Artificial Sequence
  Description of Artificial Sequence: Synthetic oligonucleotide
  Target: ATXN1; (+) strand; PAM type: NRG; PAM sequence: AAG
atcatcgcaaagtcaaatga

SEQ ID NO: 153770 - DNA, 20 bp, Artificial Sequence
  Description of Artificial Sequence: Synthetic oligonucleotide
  Target: ATXN1; (+) strand; PAM type: NRG; PAM sequence: TAG
tgaaagtcttcatgaacata

SEQ ID NO: 153771 - DNA, 20 bp, Artificial Sequence
  Description of Artificial Sequence: Synthetic oligonucleotide
  Target: ATXN1; (+) strand; PAM type: NRG; PAM sequence: TAG
aacatatagattaaaccaaa

SEQ ID NO: 153772 - DNA, 20 bp, Artificial Sequence
  Description of Artificial Sequence: Synthetic oligonucleotide
  Target: ATXN1; (+) strand; PAM type: NRG; PAM sequence: TAG
tatagattaaaccaaataga

SEQ ID NO: 153773 - DNA, 20 bp, Artificial Sequence
  Description of Artificial Sequence: Synthetic oligonucleotide
  Target: ATXN1; (+) strand; PAM type: NRG; PAM sequence: AAG
atagatagatactttaatcg

SEQ ID NO: 153774 - DNA, 20 bp, Artificial Sequence
  Description of Artificial Sequence: Synthetic oligonucleotide
  Target: ATXN1; (+) strand; PAM type: NRG; PAM sequence: TGG
gaagttttaaaaaacaatct

SEQ ID NO: 153775 - DNA, 20 bp, Artificial Sequence
  Description of Artificial Sequence: Synthetic oligonucleotide
  Target: ATXN1; (+) strand; PAM type: NRG; PAM sequence: CAG
cttcccacactatgcccaaa

SEQ ID NO: 153776 - DNA, 20 bp, Artificial Sequence
  Description of Artificial Sequence: Synthetic oligonucleotide
  Target: ATXN1; (+) strand; PAM type: NRG; PAM sequence: GAG
tcccacactatgcccaaaca

SEQ ID NO: 153777 - DNA, 20 bp, Artificial Sequence
  Description of Artificial Sequence: Synthetic oligonucleotide
  Target: ATXN1; (+) strand; PAM type: NRG; PAM sequence: AAG
atgcccaaacagagtttgca

SEQ ID NO: 153778 - DNA, 20 bp, Artificial Sequence
  Description of Artificial Sequence: Synthetic oligonucleotide
  Target: ATXN1; (+) strand; PAM type: NRG; PAM sequence: CAG
gcaaagaaaatgatattcaa

SEQ ID NO: 153779 - DNA, 20 bp, Artificial Sequence
  Description of Artificial Sequence: Synthetic oligonucleotide
  Target: ATXN1; (+) strand; PAM type: NRG; PAM sequence: AAG
atgatattcaacagccaaca

SEQ ID NO: 153780 - DNA, 20 bp, Artificial Sequence
  Description of Artificial Sequence: Synthetic oligonucleotide
  Target: ATXN1; (+) strand; PAM type: NRG; PAM sequence: AAG
tattcaacagccaacaaagt

SEQ ID NO: 153781 - DNA, 20 bp, Artificial Sequence
  Description of Artificial Sequence: Synthetic oligonucleotide
  Target: ATXN1; (+) strand; PAM type: NRG; PAM sequence: AGG
attcaacagccaacaaagta

SEQ ID NO: 153782 - DNA, 20 bp, Artificial Sequence
  Description of Artificial Sequence: Synthetic oligonucleotide
  Target: ATXN1; (+) strand; PAM type: NRG; PAM sequence: GGG
ttcaacagccaacaaagtaa

SEQ ID NO: 153783 - DNA, 20 bp, Artificial Sequence
  Description of Artificial Sequence: Synthetic oligonucleotide
  Target: ATXN1; (+) strand; PAM type: NRG; PAM sequence: GAG
caacagccaacaaagtaagg

SEQ ID NO: 153784 - DNA, 20 bp, Artificial Sequence
  Description of Artificial Sequence: Synthetic oligonucleotide
  Target: ATXN1; (+) strand; PAM type: NRG; PAM sequence: TGG
gccaacaaagtaagggagca

SEQ ID NO: 153785 - DNA, 20 bp, Artificial Sequence
  Description of Artificial Sequence: Synthetic oligonucleotide
  Target: ATXN1; (+) strand; PAM type: NRG; PAM sequence: TAG
acaaagtaagggagcatggc

SEQ ID NO: 153786 - DNA, 20 bp, Artificial Sequence
  Description of Artificial Sequence: Synthetic oligonucleotide
  Target: ATXN1; (+) strand; PAM type: NRG; PAM sequence: AGG
caaagtaagggagcatggct

SEQ ID NO: 153787 - DNA, 20 bp, Artificial Sequence
  Description of Artificial Sequence: Synthetic oligonucleotide
  Target: ATXN1; (+) strand; PAM type: NRG; PAM sequence: GAG
aagtaagggagcatggctag

SEQ ID NO: 153788 - DNA, 20 bp, Artificial Sequence
  Description of Artificial Sequence: Synthetic oligonucleotide
  Target: ATXN1; (+) strand; PAM type: NRG; PAM sequence: AGG
agtaagggagcatggctagg

SEQ ID NO: 153789 - DNA, 20 bp, Artificial Sequence
  Description of Artificial Sequence: Synthetic oligonucleotide
  Target: ATXN1; (+) strand; PAM type: NRG; PAM sequence: CAG
atggctaggaggcaattttc

SEQ ID NO: 153790 - DNA, 20 bp, Artificial Sequence
  Description of Artificial Sequence: Synthetic oligonucleotide
  Target: ATXN1; (+) strand; PAM type: NRG; PAM sequence: AGG
tggctaggaggcaattttcc

SEQ ID NO: 153791 - DNA, 20 bp, Artificial Sequence
  Description of Artificial Sequence: Synthetic oligonucleotide
  Target: ATXN1; (+) strand; PAM type: NRG; PAM sequence: CAG
taggaggcaattttccaggt

SEQ ID NO: 153792 - DNA, 20 bp, Artificial Sequence
  Description of Artificial Sequence: Synthetic oligonucleotide
  Target: ATXN1; (+) strand; PAM type: NRG; PAM sequence: AGG
aggaggcaattttccaggtc

SEQ ID NO: 153793 - DNA, 20 bp, Artificial Sequence
  Description of Artificial Sequence: Synthetic oligonucleotide
  Target: ATXN1; (+) strand; PAM type: NRG; PAM sequence: CAG
ccaggtcaggactttatcct

SEQ ID NO: 153794 - DNA, 20 bp, Artificial Sequence
  Description of Artificial Sequence: Synthetic oligonucleotide
  Target: ATXN1; (+) strand; PAM type: NRG; PAM sequence: TGG
gtcaggactttatcctcaga

SEQ ID NO: 153795 - DNA, 20 bp, Artificial Sequence
  Description of Artificial Sequence: Synthetic oligonucleotide
  Target: ATXN1; (+) strand; PAM type: NRG; PAM sequence: CAG
ctttatcctcagatggaaaa

SEQ ID NO: 153796 - DNA, 20 bp, Artificial Sequence
  Description of Artificial Sequence: Synthetic oligonucleotide
  Target: ATXN1; (+) strand; PAM type: NRG; PAM sequence: GAG
ttatcctcagatggaaaaca

SEQ ID NO: 153797 - DNA, 20 bp, Artificial Sequence
  Description of Artificial Sequence: Synthetic oligonucleotide
  Target: ATXN1; (+) strand; PAM type: NRG; PAM sequence: GAG
atcctcagatggaaaacaga

SEQ ID NO: 153798 - DNA, 20 bp, Artificial Sequence
  Description of Artificial Sequence: Synthetic oligonucleotide
  Target: ATXN1; (+) strand; PAM type: NRG; PAM sequence: TAG
acatgtgatgcacttccctg

SEQ ID NO: 153799 - DNA, 20 bp, Artificial Sequence
  Description of Artificial Sequence: Synthetic oligonucleotide
  Target: ATXN1; (+) strand; PAM type: NRG; PAM sequence: TGG
tgtgatgcacttccctgtag

SEQ ID NO: 153800 - DNA, 20 bp, Artificial Sequence
  Description of Artificial Sequence: Synthetic oligonucleotide
  Target: ATXN1; (+) strand; PAM type: NRG; PAM sequence: CAG
gatgcacttccctgtagtgg

SEQ ID NO: 153801 - DNA, 20 bp, Artificial Sequence
  Description of Artificial Sequence: Synthetic oligonucleotide
  Target: ATXN1; (+) strand; PAM type: NRG; PAM sequence: TGG
gcacttccctgtagtggcag

SEQ ID NO: 153802 - DNA, 20 bp, Artificial Sequence
  Description of Artificial Sequence: Synthetic oligonucleotide
  Target: ATXN1; (+) strand; PAM type: NRG; PAM sequence: GAG
acttccctgtagtggcagtg

SEQ ID NO: 153803 - DNA, 20 bp, Artificial Sequence
  Description of Artificial Sequence: Synthetic oligonucleotide
  Target: ATXN1; (+) strand; PAM type: NRG; PAM sequence: AGG
cttccctgtagtggcagtgg

SEQ ID NO: 153804 - DNA, 20 bp, Artificial Sequence
  Description of Artificial Sequence: Synthetic oligonucleotide
  Target: ATXN1; (+) strand; PAM type: NRG; PAM sequence: GAG
tccctgtagtggcagtggag

SEQ ID NO: 153805 - DNA, 20 bp, Artificial Sequence
  Description of Artificial Sequence: Synthetic oligonucleotide
  Target: ATXN1; (+) strand; PAM type: NRG; PAM sequence: AGG
ccctgtagtggcagtggagg

SEQ ID NO: 153806 - DNA, 20 bp, Artificial Sequence
  Description of Artificial Sequence: Synthetic oligonucleotide
  Target: ATXN1; (+) strand; PAM type: NRG; PAM sequence: GAG
ctgtagtggcagtggaggag

SEQ ID NO: 153807 - DNA, 20 bp, Artificial Sequence
  Description of Artificial Sequence: Synthetic oligonucleotide
  Target: ATXN1; (+) strand; PAM type: NRG; PAM sequence: AAG
ggaggaggagattgctgtac

SEQ ID NO: 153808 - DNA, 20 bp, Artificial Sequence
  Description of Artificial Sequence: Synthetic oligonucleotide
  Target: ATXN1; (+) strand; PAM type: NRG; PAM sequence: AGG
gaggaggagattgctgtaca

SEQ ID NO: 153809 - DNA, 20 bp, Artificial Sequence
  Description of Artificial Sequence: Synthetic oligonucleotide
  Target: ATXN1; (+) strand; PAM type: NRG; PAM sequence: CAG
aaggatgacaaacaaatctg

SEQ ID NO: 153810 - DNA, 20 bp, Artificial Sequence
  Description of Artificial Sequence: Synthetic oligonucleotide
  Target: ATXN1; (+) strand; PAM type: NRG; PAM sequence: TGG
aaacaaatctgcagcttgaa

SEQ ID NO: 153811 - DNA, 20 bp, Artificial Sequence
  Description of Artificial Sequence: Synthetic oligonucleotide
  Target: ATXN1; (+) strand; PAM type: NRG; PAM sequence: TGG
gcagcttgaatggaccaccc

SEQ ID NO: 153812 - DNA, 20 bp, Artificial Sequence
  Description of Artificial Sequence: Synthetic oligonucleotide
  Target: ATXN1; (+) strand; PAM type: NRG; PAM sequence: TGG
gatgcacgatgctcctgcaa

SEQ ID NO: 153813 - DNA, 20 bp, Artificial Sequence
  Description of Artificial Sequence: Synthetic oligonucleotide
  Target: ATXN1; (+) strand; PAM type: NRG; PAM sequence: GAG
acgatgctcctgcaatggtc

SEQ ID NO: 153814 - DNA, 20 bp, Artificial Sequence
  Description of Artificial Sequence: Synthetic oligonucleotide
  Target: ATXN1; (+) strand; PAM type: NRG; PAM sequence: AGG
cgatgctcctgcaatggtcg

SEQ ID NO: 153815 - DNA, 20 bp, Artificial Sequence
  Description of Artificial Sequence: Synthetic oligonucleotide
  Target: ATXN1; (+) strand; PAM type: NRG; PAM sequence: GGG
gatgctcctgcaatggtcga

SEQ ID NO: 153816 - DNA, 20 bp, Artificial Sequence
  Description of Artificial Sequence: Synthetic oligonucleotide
  Target: ATXN1; (+) strand; PAM type: NRG; PAM sequence: GAG
tgctcctgcaatggtcgagg

SEQ ID NO: 153817 - DNA, 20 bp, Artificial Sequence
  Description of Artificial Sequence: Synthetic oligonucleotide
  Target: ATXN1; (+) strand; PAM type: NRG; PAM sequence: CAG
ctgcaatggtcgagggagtg

SEQ ID NO: 153818 - DNA, 20 bp, Artificial Sequence
  Description of Artificial Sequence: Synthetic oligonucleotide
  Target: ATXN1; (+) strand; PAM type: NRG; PAM sequence: AGG
tgcaatggtcgagggagtgc

SEQ ID NO: 153819 - DNA, 20 bp, Artificial Sequence
  Description of Artificial Sequence: Synthetic oligonucleotide
  Target: ATXN1; (+) strand; PAM type: NRG; PAM sequence: GAG
caatggtcgagggagtgcag

SEQ ID NO: 153820 - DNA, 20 bp, Artificial Sequence
  Description of Artificial Sequence: Synthetic oligonucleotide
  Target: ATXN1; (+) strand; PAM type: NRG; PAM sequence: GAG
atggtcgagggagtgcagga

SEQ ID NO: 153821 - DNA, 20 bp, Artificial Sequence
  Description of Artificial Sequence: Synthetic oligonucleotide
  Target: ATXN1; (+) strand; PAM type: NRG; PAM sequence: AGG
tggtcgagggagtgcaggag

SEQ ID NO: 153822 - DNA, 20 bp, Artificial Sequence
  Description of Artificial Sequence: Synthetic oligonucleotide
  Target: ATXN1; (+) strand; PAM type: NRG; PAM sequence: CAG
aggaaatccaaaatgaaaaa

SEQ ID NO: 153823 - DNA, 20 bp, Artificial Sequence
  Description of Artificial Sequence: Synthetic oligonucleotide
  Target: ATXN1; (+) strand; PAM type: NRG; PAM sequence: TAG
atccaaaatgaaaaacagaa

SEQ ID NO: 153824 - DNA, 20 bp, Artificial Sequence
  Description of Artificial Sequence: Synthetic oligonucleotide
  Target: ATXN1; (+) strand; PAM type: NRG; PAM sequence: AAG
aatagactgctttaaaaaat

SEQ ID NO: 153825 - DNA, 20 bp, Artificial Sequence
  Description of Artificial Sequence: Synthetic oligonucleotide
  Target: ATXN1; (+) strand; PAM type: NRG; PAM sequence: AAG
ttaaaaaataagtccacctt

SEQ ID NO: 153826 - DNA, 20 bp, Artificial Sequence
  Description of Artificial Sequence: Synthetic oligonucleotide
  Target: ATXN1; (+) strand; PAM type: NRG; PAM sequence: AAG
tgcaccgaaatacaaatttt

SEQ ID NO: 153827 - DNA, 20 bp, Artificial Sequence
  Description of Artificial Sequence: Synthetic oligonucleotide
  Target: ATXN1; (+) strand; PAM type: NRG; PAM sequence: CGG
aattttaagaacatcacatt

SEQ ID NO: 153828 - DNA, 20 bp, Artificial Sequence
  Description of Artificial Sequence: Synthetic oligonucleotide
  Target: ATXN1; (+) strand; PAM type: NRG; PAM sequence: GAG
cattcggcattctgttgtat

SEQ ID NO: 153829 - DNA, 20 bp, Artificial Sequence
  Description of Artificial Sequence: Synthetic oligonucleotide
  Target: ATXN1; (+) strand; PAM type: NRG; PAM sequence: CAG
tctgttgtatgagaattaca

SEQ ID NO: 153830 - DNA, 20 bp, Artificial Sequence
  Description of Artificial Sequence: Synthetic oligonucleotide
  Target: ATXN1; (+) strand; PAM type: NRG; PAM sequence: CAG
tatgagaattacacagatcc

SEQ ID NO: 153831 - DNA, 20 bp, Artificial Sequence
  Description of Artificial Sequence: Synthetic oligonucleotide
  Target: ATXN1; (+) strand; PAM type: NRG; PAM sequence: CAG
agaattacacagatcccagc

SEQ ID NO: 153832 - DNA, 20 bp, Artificial Sequence
  Description of Artificial Sequence: Synthetic oligonucleotide
  Target: ATXN1; (+) strand; PAM type: NRG; PAM sequence: AAG
acagatcccagccagctcaa

SEQ ID NO: 153833 - DNA, 20 bp, Artificial Sequence
  Description of Artificial Sequence: Synthetic oligonucleotide
  Target: ATXN1; (+) strand; PAM type: NRG; PAM sequence: AGG
cagatcccagccagctcaaa

SEQ ID NO: 153834 - DNA, 20 bp, Artificial Sequence
  Description of Artificial Sequence: Synthetic oligonucleotide
  Target: ATXN1; (+) strand; PAM type: NRG; PAM sequence: CAG
atcccagccagctcaaaagg

SEQ ID NO: 153835 - DNA, 20 bp, Artificial Sequence
  Description of Artificial Sequence: Synthetic oligonucleotide
  Target: ATXN1; (+) strand; PAM type: NRG; PAM sequence: AGG
tcccagccagctcaaaaggc

SEQ ID NO: 153836 - DNA, 20 bp, Artificial Sequence
  Description of Artificial Sequence: Synthetic oligonucleotide
  Target: ATXN1; (+) strand; PAM type: NRG; PAM sequence: TGG
gccagctcaaaaggcaggtc

SEQ ID NO: 153837 - DNA, 20 bp, Artificial Sequence
  Description of Artificial Sequence: Synthetic oligonucleotide
  Target: ATXN1; (+) strand; PAM type: NRG; PAM sequence: AAG
caggtctggttttactcaac

SEQ ID NO: 153838 - DNA, 20 bp, Artificial Sequence
  Description of Artificial Sequence: Synthetic oligonucleotide
  Target: ATXN1; (+) strand; PAM type: NRG; PAM sequence: AGG
aggtctggttttactcaaca

SEQ ID NO: 153839 - DNA, 20 bp, Artificial Sequence
  Description of Artificial Sequence: Synthetic oligonucleotide
  Target: ATXN1; (+) strand; PAM type: NRG; PAM sequence: CAG
tggttttactcaacaaggct

SEQ ID NO: 153840 - DNA, 20 bp, Artificial Sequence
  Description of Artificial Sequence: Synthetic oligonucleotide
  Target: ATXN1; (+) strand; PAM type: NRG; PAM sequence: GAG
gttttactcaacaaggctca

SEQ ID NO: 153841 - DNA, 20 bp, Artificial Sequence
  Description of Artificial Sequence: Synthetic oligonucleotide
  Target: ATXN1; (+) strand; PAM type: NRG; PAM sequence: AGG
ttttactcaacaaggctcag

SEQ ID NO: 153842 - DNA, 20 bp, Artificial Sequence
  Description of Artificial Sequence: Synthetic oligonucleotide
  Target: ATXN1; (+) strand; PAM type: NRG; PAM sequence: GGG
tttactcaacaaggctcaga

SEQ ID NO: 153843 - DNA, 20 bp, Artificial Sequence
  Description of Artificial Sequence: Synthetic oligonucleotide
  Target: ATXN1; (+) strand; PAM type: NRG; PAM sequence: GAG
tactcaacaaggctcagagg

SEQ ID NO: 153844 - DNA, 20 bp, Artificial Sequence
  Description of Artificial Sequence: Synthetic oligonucleotide
  Target: ATXN1; (+) strand; PAM type: NRG; PAM sequence: AGG
actcaacaaggctcagaggg

SEQ ID NO: 153845 - DNA, 20 bp, Artificial Sequence
  Description of Artificial Sequence: Synthetic oligonucleotide
  Target: ATXN1; (+) strand; PAM type: NRG; PAM sequence: AAG
gagggaggccaacatacaaa

SEQ ID NO: 153846 - DNA, 20 bp, Artificial Sequence
  Description of Artificial Sequence: Synthetic oligonucleotide
  Target: ATXN1; (+) strand; PAM type: NRG; PAM sequence: AGG
agggaggccaacatacaaaa

SEQ ID NO: 153847 - DNA, 20 bp, Artificial Sequence
  Description of Artificial Sequence: Synthetic oligonucleotide
  Target: ATXN1; (+) strand; PAM type: NRG; PAM sequence: AAG
gtcatcccttccatcaaatt

SEQ ID NO: 153848 - DNA, 20 bp, Artificial Sequence
  Description of Artificial Sequence: Synthetic oligonucleotide
  Target: ATXN1; (+) strand; PAM type: NRG; PAM sequence: GAG
catcccttccatcaaattaa

SEQ ID NO: 153849 - DNA, 20 bp, Artificial Sequence
  Description of Artificial Sequence: Synthetic oligonucleotide
  Target: ATXN1; (+) strand; PAM type: NRG; PAM sequence: AGG
atcccttccatcaaattaag

SEQ ID NO: 153850 - DNA, 20 bp, Artificial Sequence
  Description of Artificial Sequence: Synthetic oligonucleotide
  Target: ATXN1; (+) strand; PAM type: NRG; PAM sequence: TGG
cttccatcaaattaagagga

SEQ ID NO: 153851 - DNA, 20 bp, Artificial Sequence
  Description of Artificial Sequence: Synthetic oligonucleotide
  Target: ATXN1; (+) strand; PAM type: NRG; PAM sequence: GAG
agaggatggtctccccattt

SEQ ID NO: 153852 - DNA, 20 bp, Artificial Sequence
  Description of Artificial Sequence: Synthetic oligonucleotide
  Target: ATXN1; (+) strand; PAM type: NRG; PAM sequence: CAG
gatggtctccccatttgagc

SEQ ID NO: 153853 - DNA, 20 bp, Artificial Sequence
  Description of Artificial Sequence: Synthetic oligonucleotide
  Target: ATXN1; (+) strand; PAM type: NRG; PAM sequence: TAG
attcttttctccaatgattc

SEQ ID NO: 153854 - DNA, 20 bp, Artificial Sequence
  Description of Artificial Sequence: Synthetic oligonucleotide
  Target: ATXN1; (+) strand; PAM type: NRG; PAM sequence: TGG
atcatctgataaacacatgc

SEQ ID NO: 153855 - DNA, 20 bp, Artificial Sequence
  Description of Artificial Sequence: Synthetic oligonucleotide
  Target: ATXN1; (+) strand; PAM type: NRG; PAM sequence: AAG
aaacacatgctggtaactac

SEQ ID NO: 153856 - DNA, 20 bp, Artificial Sequence
  Description of Artificial Sequence: Synthetic oligonucleotide
  Target: ATXN1; (+) strand; PAM type: NRG; PAM sequence: AGG
aacacatgctggtaactaca

SEQ ID NO: 153857 - DNA, 20 bp, Artificial Sequence
  Description of Artificial Sequence: Synthetic oligonucleotide
  Target: ATXN1; (+) strand; PAM type: NRG; PAM sequence: GAG
cacatgctggtaactacaag

SEQ ID NO: 153858 - DNA, 20 bp, Artificial Sequence
  Description of Artificial Sequence: Synthetic oligonucleotide
  Target: ATXN1; (+) strand; PAM type: NRG; PAM sequence: CAG
ctggtaactacaaggagtat

SEQ ID NO: 153859 - DNA, 20 bp, Artificial Sequence
  Description of Artificial Sequence: Synthetic oligonucleotide
  Target: ATXN1; (+) strand; PAM type: NRG; PAM sequence: AGG
tggtaactacaaggagtatc

SEQ ID NO: 153860 - DNA, 20 bp, Artificial Sequence
  Description of Artificial Sequence: Synthetic oligonucleotide
  Target: ATXN1; (+) strand; PAM type: NRG; PAM sequence: TGG
caaggagtatcaggtgaaaa

SEQ ID NO: 153861 - DNA, 20 bp, Artificial Sequence
  Description of Artificial Sequence: Synthetic oligonucleotide
  Target: ATXN1; (+) strand; PAM type: NRG; PAM sequence: GGG
aaggagtatcaggtgaaaat

SEQ ID NO: 153862 - DNA, 20 bp, Artificial Sequence
  Description of Artificial Sequence: Synthetic oligonucleotide
  Target: ATXN1; (+) strand; PAM type: NRG; PAM sequence: TGG
gtatcaggtgaaaatgggca

SEQ ID NO: 153863 - DNA, 20 bp, Artificial Sequence
  Description of Artificial Sequence: Synthetic oligonucleotide
  Target: ATXN1; (+) strand; PAM type: NRG; PAM sequence: TAG
gaaaatgggcatggattgaa

SEQ ID NO: 153864 - DNA, 20 bp, Artificial Sequence
  Description of Artificial Sequence: Synthetic oligonucleotide
  Target: ATXN1; (+) strand; PAM type: NRG; PAM sequence: GAG
gcatggattgaatagtaatt

SEQ ID NO: 153865 - DNA, 20 bp, Artificial Sequence
  Description of Artificial Sequence: Synthetic oligonucleotide
  Target: ATXN1; (+) strand; PAM type: NRG; PAM sequence: AAG
attgaatagtaattgagcca

SEQ ID NO: 153866 - DNA, 20 bp, Artificial Sequence
  Description of Artificial Sequence: Synthetic oligonucleotide
  Target: ATXN1; (+) strand; PAM type: NRG; PAM sequence: TGG
gccaaagcctaattttaatg

SEQ ID NO: 153867 - DNA, 20 bp, Artificial Sequence
  Description of Artificial Sequence: Synthetic oligonucleotide
  Target: ATXN1; (+) strand; PAM type: NRG; PAM sequence: AAG
aacttgaaacacaatgatga

SEQ ID NO: 153868 - DNA, 20 bp, Artificial Sequence
  Description of Artificial Sequence: Synthetic oligonucleotide
  Target: ATXN1; (+) strand; PAM type: NRG; PAM sequence: CAG
aacacaatgatgaaagtgca

SEQ ID NO: 153869 - DNA, 20 bp, Artificial Sequence
  Description of Artificial Sequence: Synthetic oligonucleotide
  Target: ATXN1; (+) strand; PAM type: NRG; PAM sequence: TAG
tgatgaaagtgcacagctat

SEQ ID NO: 153870 - DNA, 20 bp, Artificial Sequence
  Description of Artificial Sequence: Synthetic oligonucleotide
  Target: ATXN1; (+) strand; PAM type: NRG; PAM sequence: CAG
gtgcacagctattagcatac

SEQ ID NO: 153871 - DNA, 20 bp, Artificial Sequence
  Description of Artificial Sequence: Synthetic oligonucleotide
  Target: ATXN1; (+) strand; PAM type: NRG; PAM sequence: TGG
ctattagcataccagtccaa

SEQ ID NO: 153872 - DNA, 20 bp, Artificial Sequence
  Description of Artificial Sequence: Synthetic oligonucleotide
  Target: ATXN1; (+) strand; PAM type: NRG; PAM sequence: TAG
agcataccagtccaatggaa

SEQ ID NO: 153873 - DNA, 20 bp, Artificial Sequence
  Description of Artificial Sequence: Synthetic oligonucleotide
  Target: ATXN1; (+) strand; PAM type: NRG; PAM sequence: AAG
ataccagtccaatggaatag

SEQ ID NO: 153874 - DNA, 20 bp, Artificial Sequence
  Description of Artificial Sequence: Synthetic oligonucleotide
  Target: ATXN1; (+) strand; PAM type: NRG; PAM sequence: AAG
cagtccaatggaatagaaga

SEQ ID NO: 153875 - DNA, 20 bp, Artificial Sequence
  Description of Artificial Sequence: Synthetic oligonucleotide
  Target: ATXN1; (+) strand; PAM type: NRG; PAM sequence: AGG
agtccaatggaatagaagaa

SEQ ID NO: 153876 - DNA, 20 bp, Artificial Sequence
  Description of Artificial Sequence: Synthetic oligonucleotide
  Target: ATXN1; (+) strand; PAM type: NRG; PAM sequence: CAG
atagaagaaaggaaaaaatg

SEQ ID NO: 153877 - DNA, 20 bp, Artificial Sequence
  Description of Artificial Sequence: Synthetic oligonucleotide
  Target: ATXN1; (+) strand; PAM type: NRG; PAM sequence: AAG
aaggaaaaaatgcagaaaaa

SEQ ID NO: 153878 - DNA, 20 bp, Artificial Sequence
  Description of Artificial Sequence: Synthetic oligonucleotide
  Target: ATXN1; (+) strand; PAM type: NRG; PAM sequence: AAG
aaatgcagaaaaaaagtgta

SEQ ID NO: 153879 - DNA, 20 bp, Artificial Sequence
  Description of Artificial Sequence: Synthetic oligonucleotide
  Target: ATXN1; (+) strand; PAM type: NRG; PAM sequence: TGG
ttgccacaattccttgcaca

SEQ ID NO: 153880 - DNA, 20 bp, Artificial Sequence
  Description of Artificial Sequence: Synthetic oligonucleotide
  Target: ATXN1; (+) strand; PAM type: NRG; PAM sequence: AAG
acaattccttgcacatggtt

SEQ ID NO: 153881 - DNA, 20 bp, Artificial Sequence
  Description of Artificial Sequence: Synthetic oligonucleotide
  Target: ATXN1; (+) strand; PAM type: NRG; PAM sequence: GAG
ttttccattgtatgatgaat

SEQ ID NO: 153882 - DNA, 20 bp, Artificial Sequence
  Description of Artificial Sequence: Synthetic oligonucleotide
  Target: ATXN1; (+) strand; PAM type: NRG; PAM sequence: TGG
tgaatgagtgaatgtgtgaa

SEQ ID NO: 153883 - DNA, 20 bp, Artificial Sequence
  Description of Artificial Sequence: Synthetic oligonucleotide
  Target: ATXN1; (+) strand; PAM type: NRG; PAM sequence: AAG
atgtgtgaatggatgaatga

SEQ ID NO: 153884 - DNA, 20 bp, Artificial Sequence
  Description of Artificial Sequence: Synthetic oligonucleotide
  Target: ATXN1; (+) strand; PAM type: NRG; PAM sequence: AAG
gtgaatggatgaatgaaaga

SEQ ID NO: 153885 - DNA, 20 bp, Artificial Sequence
  Description of Artificial Sequence: Synthetic oligonucleotide
  Target: ATXN1; (+) strand; PAM type: NRG; PAM sequence: CAG
tcttccatatacctttccat

SEQ ID NO: 153886 - DNA, 20 bp, Artificial Sequence
  Description of Artificial Sequence: Synthetic oligonucleotide
  Target: ATXN1; (+) strand; PAM type: NRG; PAM sequence: AGG
cttccatatacctttccatc

SEQ ID NO: 153887 - DNA, 20 bp, Artificial Sequence
  Description of Artificial Sequence: Synthetic oligonucleotide
  Target: ATXN1; (+) strand; PAM type: NRG; PAM sequence: GGG
ttccatatacctttccatca

SEQ ID NO: 153888 - DNA, 20 bp, Artificial Sequence
  Description of Artificial Sequence: Synthetic oligonucleotide
  Target: ATXN1; (+) strand; PAM type: NRG; PAM sequence: GAG
ccatatacctttccatcagg

SEQ ID NO: 153889 - DNA, 20 bp, Artificial Sequence
  Description of Artificial Sequence: Synthetic oligonucleotide
  Target: ATXN1; (+) strand; PAM type: NRG; PAM sequence: TGG
tacctttccatcagggagct

SEQ ID NO: 153890 - DNA, 20 bp, Artificial Sequence
  Description of Artificial Sequence: Synthetic oligonucleotide
  Target: ATXN1; (+) strand; PAM type: NRG; PAM sequence: TAG
atcagggagcttggtgcttg

SEQ ID NO: 153891 - DNA, 20 bp, Artificial Sequence
  Description of Artificial Sequence: Synthetic oligonucleotide
  Target: ATXN1; (+) strand; PAM type: NRG; PAM sequence: TAG
agggagcttggtgcttgtag

SEQ ID NO: 153892 - DNA, 20 bp, Artificial Sequence
  Description of Artificial Sequence: Synthetic oligonucleotide
  Target: ATXN1; (+) strand; PAM type: NRG; PAM sequence: GAG
gtgcttgtagtagtttttgt

SEQ ID NO: 153893 - DNA, 20 bp, Artificial Sequence
  Description of Artificial Sequence: Synthetic oligonucleotide
  Target: ATXN1; (+) strand; PAM type: NRG; PAM sequence: AGG
tgcttgtagtagtttttgtg

SEQ ID NO: 153894 - DNA, 20 bp, Artificial Sequence
  Description of Artificial Sequence: Synthetic oligonucleotide
  Target: ATXN1; (+) strand; PAM type: NRG; PAM sequence: TAG
tgtgaggtaaaacctatgca

SEQ ID NO: 153895 - DNA, 20 bp, Artificial Sequence
  Description of Artificial Sequence: Synthetic oligonucleotide
  Target: ATXN1; (+) strand; PAM type: NRG; PAM sequence: CGG
gtaaaacctatgcatagaaa

SEQ ID NO: 153896 - DNA, 20 bp, Artificial Sequence
  Description of Artificial Sequence: Synthetic oligonucleotide
  Target: ATXN1; (+) strand; PAM type: NRG; PAM sequence: AAG
aaacctatgcatagaaacgg

SEQ ID NO: 153897 - DNA, 20 bp, Artificial Sequence
  Description of Artificial Sequence: Synthetic oligonucleotide
  Target: ATXN1; (+) strand; PAM type: NRG; PAM sequence: AAG
cctatgcatagaaacggaag

SEQ ID NO: 153898 - DNA, 20 bp, Artificial Sequence
  Description of Artificial Sequence: Synthetic oligonucleotide
  Target: ATXN1; (+) strand; PAM type: NRG; PAM sequence: GAG
gcatagaaacggaagaagtt

SEQ ID NO: 153899 - DNA, 20 bp, Artificial Sequence
  Description of Artificial Sequence: Synthetic oligonucleotide
  Target: ATXN1; (+) strand; PAM type: NRG; PAM sequence: AGG
catagaaacggaagaagttg

SEQ ID NO: 153900 - DNA, 20 bp, Artificial Sequence
  Description of Artificial Sequence: Synthetic oligonucleotide
  Target: ATXN1; (+) strand; PAM type: NRG; PAM sequence: TAG
gatctgctaacgtatttttt

SEQ ID NO: 153901 - DNA, 20 bp, Artificial Sequence
  Description of Artificial Sequence: Synthetic oligonucleotide
  Target: ATXN1; (+) strand; PAM type: NRG; PAM sequence: CGG
aaaattatattcttaaatac

SEQ ID NO: 153902 - DNA, 20 bp, Artificial Sequence
  Description of Artificial Sequence: Synthetic oligonucleotide
  Target: ATXN1; (+) strand; PAM type: NRG; PAM sequence: CAG
taccaattatccacattaaa

SEQ ID NO: 153903 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaatttttttaaaat

SEQ ID NO: 153904 - DNA, 20 bp, Artificial Sequence
  Description of Artificial Sequence: Synthetic oligonucleotide
  Target: ATXN1; (+) strand; PAM type: NRG; PAM sequence: TAG
aaaaatttttttaaaatcag

SEQ ID NO: 153905 - DNA, 20 bp, Artificial Sequence
  Description of Artificial Sequence: Synthetic oligonucleotide
  Target: ATXN1; (+) strand; PAM type: NRG; PAM sequence: CAG
aatttttttaaaatcagtag

SEQ ID NO: 153906 - DNA, 20 bp, Artificial Sequence
  Description of Artificial Sequence: Synthetic oligonucleotide
  Target: ATXN1; (+) strand; PAM type: NRG; PAM sequence: AGG
atttttttaaaatcagtagc

SEQ ID NO: 153907 - DNA, 20 bp, Artificial Sequence
  Description of Artificial Sequence: Synthetic oligonucleotide
  Target: ATXN1; (+) strand; PAM type: NRG; PAM sequence: GGG
tttttttaaaatcagtagca

SEQ ID NO: 153908 - DNA, 20 bp, Artificial Sequence
  Description of Artificial Sequence: Synthetic oligonucleotide
  Target: ATXN1; (+) strand; PAM type: NRG; PAM sequence: TAG
ctataaaatcatccccaaac

SEQ ID NO: 153909 - DNA, 20 bp, Artificial Sequence
  Description of Artificial Sequence: Synthetic oligonucleotide
  Target: ATXN1; (+) strand; PAM type: NRG; PAM sequence: TGG
atccccaaactagtgaatgc

SEQ ID NO: 153910 - DNA, 20 bp, Artificial Sequence
  Description of Artificial Sequence: Synthetic oligonucleotide
  Target: ATXN1; (+) strand; PAM type: NRG; PAM sequence: CAG
gtgaatgctggactgatttt

SEQ ID NO: 153911 - DNA, 20 bp, Artificial Sequence
  Description of Artificial Sequence: Synthetic oligonucleotide
  Target: ATXN1; (+) strand; PAM type: NRG; PAM sequence: TGG
gattttcagtctttgattac

SEQ ID NO: 153912 - DNA, 20 bp, Artificial Sequence
  Description of Artificial Sequence: Synthetic oligonucleotide
  Target: ATXN1; (+) strand; PAM type: NRG; PAM sequence: GAG
ttttcagtctttgattactg

SEQ ID NO: 153913 - DNA, 20 bp, Artificial Sequence
  Description of Artificial Sequence: Synthetic oligonucleotide
  Target: ATXN1; (+) strand; PAM type: NRG; PAM sequence: TAG
agctgatctgcacatttgct

SEQ ID NO: 153914 - DNA, 20 bp, Artificial Sequence
  Description of Artificial Sequence: Synthetic oligonucleotide
  Target: ATXN1; (+) strand; PAM type: NRG; PAM sequence: AGG
gctgatctgcacatttgctt

SEQ ID NO: 153915 - DNA, 20 bp, Artificial Sequence
  Description of Artificial Sequence: Synthetic oligonucleotide
  Target: ATXN1; (+) strand; PAM type: NRG; PAM sequence: TAG
gcttaggctgattttaaact

SEQ ID NO: 153916 - DNA, 20 bp, Artificial Sequence
  Description of Artificial Sequence: Synthetic oligonucleotide
  Target: ATXN1; (+) strand; PAM type: NRG; PAM sequence: TGG
ggctgattttaaacttagtt

SEQ ID NO: 153917 - DNA, 20 bp, Artificial Sequence
  Description of Artificial Sequence: Synthetic oligonucleotide
  Target: ATXN1; (+) strand; PAM type: NRG; PAM sequence: GGG
gctgattttaaacttagttt

SEQ ID NO: 153918 - DNA, 20 bp, Artificial Sequence
  Description of Artificial Sequence: Synthetic oligonucleotide
  Target: ATXN1; (+) strand; PAM type: NRG; PAM sequence: AAG
aaacttagtttgggtttcct

SEQ ID NO: 153919 - DNA, 20 bp, Artificial Sequence
  Description of Artificial Sequence: Synthetic oligonucleotide
  Target: ATXN1; (+) strand; PAM type: NRG; PAM sequence: CAG
tgggtttcctaagctcacgc

SEQ ID NO: 153920 - DNA, 20 bp, Artificial Sequence
  Description of Artificial Sequence: Synthetic oligonucleotide
  Target: ATXN1; (+) strand; PAM type: NRG; PAM sequence: AGG
gggtttcctaagctcacgcc

SEQ ID NO: 153921 - DNA, 20 bp, Artificial Sequence
  Description of Artificial Sequence: Synthetic oligonucleotide
  Target: ATXN1; (+) strand; PAM type: NRG; PAM sequence: CAG
cctaagctcacgccaggtaa

SEQ ID NO: 153922 - DNA, 20 bp, Artificial Sequence
  Description of Artificial Sequence: Synthetic oligonucleotide
  Target: ATXN1; (+) strand; PAM type: NRG; PAM sequence: TAG
aagctcacgccaggtaacag

SEQ ID NO: 153923 - DNA, 20 bp, Artificial Sequence
  Description of Artificial Sequence: Synthetic oligonucleotide
  Target: ATXN1; (+) strand; PAM type: NRG; PAM sequence: AGG
agctcacgccaggtaacagt

SEQ ID NO: 153924 - DNA, 20 bp, Artificial Sequence
  Description of Artificial Sequence: Synthetic oligonucleotide
  Target: ATXN1; (+) strand; PAM type: NRG; PAM sequence: AAG
tcacgccaggtaacagtagg

SEQ ID NO: 153925 - DNA, 20 bp, Artificial Sequence
  Description of Artificial Sequence: Synthetic oligonucleotide
  Target: ATXN1; (+) strand; PAM type: NRG; PAM sequence: AAG
cgccaggtaacagtaggaag

SEQ ID NO: 153926 - DNA, 20 bp, Artificial Sequence
  Description of Artificial Sequence: Synthetic oligonucleotide
  Target: ATXN1; (+) strand; PAM type: NRG; PAM sequence: AGG
gccaggtaacagtaggaaga

SEQ ID NO: 153927 - DNA, 20 bp, Artificial Sequence
  Description of Artificial Sequence: Synthetic oligonucleotide
  Target: ATXN1; (+) strand; PAM type: NRG; PAM sequence: GAG
caggtaacagtaggaagaag

SEQ ID NO: 153928 - DNA, 20 bp, Artificial Sequence
  Description of Artificial Sequence: Synthetic oligonucleotide
  Target: ATXN1; (+) strand; PAM type: NRG; PAM sequence: AGG
aggtaacagtaggaagaagg

SEQ ID NO: 153929 - DNA, 20 bp, Artificial Sequence
  Description of Artificial Sequence: Synthetic oligonucleotide
  Target: ATXN1; (+) strand; PAM type: NRG; PAM sequence: CAG
acagtaggaagaaggaggcc

SEQ ID NO: 153930 - DNA, 20 bp, Artificial Sequence
  Description of Artificial Sequence: Synthetic oligonucleotide
  Target: ATXN1; (+) strand; PAM type: NRG; PAM sequence: AGG
cagtaggaagaaggaggccc

SEQ ID NO: 153931 - DNA, 20 bp, Artificial Sequence
  Description of Artificial Sequence: Synthetic oligonucleotide
  Target: ATXN1; (+) strand; PAM type: NRG; PAM sequence: TGG
aaggaggcccaggtttatat

SEQ ID NO: 153932 - DNA, 20 bp, Artificial Sequence
  Description of Artificial Sequence: Synthetic oligonucleotide
  Target: ATXN1; (+) strand; PAM type: NRG; PAM sequence: CAG
cccaggtttatattggatgt

SEQ ID NO: 153933 - DNA, 20 bp, Artificial Sequence
  Description of Artificial Sequence: Synthetic oligonucleotide
  Target: ATXN1; (+) strand; PAM type: NRG; PAM sequence: AAG
ggtttatattggatgtcaga

SEQ ID NO: 153934 - DNA, 20 bp, Artificial Sequence
  Description of Artificial Sequence: Synthetic oligonucleotide
  Target: ATXN1; (+) strand; PAM type: NRG; PAM sequence: TGG
atgtcagaaagaaactattc

SEQ ID NO: 153935 - DNA, 20 bp, Artificial Sequence
  Description of Artificial Sequence: Synthetic oligonucleotide
  Target: ATXN1; (+) strand; PAM type: NRG; PAM sequence: GAG
gtcagaaagaaactattctg

SEQ ID NO: 153936 - DNA, 20 bp, Artificial Sequence
  Description of Artificial Sequence: Synthetic oligonucleotide
  Target: ATXN1; (+) strand; PAM type: NRG; PAM sequence: CAG
caatgtgaataatccgtaaa

SEQ ID NO: 153937 - DNA, 20 bp, Artificial Sequence
  Description of Artificial Sequence: Synthetic oligonucleotide
  Target: ATXN1; (+) strand; PAM type: NRG; PAM sequence: AGG
aatgtgaataatccgtaaac

SEQ ID NO: 153938 - DNA, 20 bp, Artificial Sequence
  Description of Artificial Sequence: Synthetic oligonucleotide
  Target: ATXN1; (+) strand; PAM type: NRG; PAM sequence: AAG
tgaataatccgtaaacaggt

SEQ ID NO: 153939 - DNA, 20 bp, Artificial Sequence
  Description of Artificial Sequence: Synthetic oligonucleotide
  Target: ATXN1; (+) strand; PAM type: NRG; PAM sequence: GAG
taatccgtaaacaggtaagt

SEQ ID NO: 153940 - DNA, 20 bp, Artificial Sequence
  Description of Artificial Sequence: Synthetic oligonucleotide
  Target: ATXN1; (+) strand; PAM type: NRG; PAM sequence: TGG
gtaagtgagccaattatcct

SEQ ID NO: 153941 - DNA, 20 bp, Artificial Sequence
  Description of Artificial Sequence: Synthetic oligonucleotide
  Target: ATXN1; (+) strand; PAM type: NRG; PAM sequence: GGG
taagtgagccaattatcctt

SEQ ID NO: 153942 - DNA, 20 bp, Artificial Sequence
  Description of Artificial Sequence: Synthetic oligonucleotide
  Target: ATXN1; (+) strand; PAM type: NRG; PAM sequence: TGG
gccaattatccttgggtaca

SEQ ID NO: 153943 - DNA, 20 bp, Artificial Sequence
  Description of Artificial Sequence: Synthetic oligonucleotide
  Target: ATXN1; (+) strand; PAM type: NRG; PAM sequence: CGG
gggtacatggcaacacatct

SEQ ID NO: 153944 - DNA, 20 bp, Artificial Sequence
  Description of Artificial Sequence: Synthetic oligonucleotide
  Target: ATXN1; (+) strand; PAM type: NRG; PAM sequence: AAG
catacacactcactattttt

SEQ ID NO: 153945 - DNA, 20 bp, Artificial Sequence
  Description of Artificial Sequence: Synthetic oligonucleotide
  Target: ATXN1; (+) strand; PAM type: NRG; PAM sequence: GAG
tacacactcactatttttaa

SEQ ID NO: 153946 - DNA, 20 bp, Artificial Sequence
  Description of Artificial Sequence: Synthetic oligonucleotide
  Target: ATXN1; (+) strand; PAM type: NRG; PAM sequence: CAG
actcactatttttaagagca

SEQ ID NO: 153947 - DNA, 20 bp, Artificial Sequence
  Description of Artificial Sequence: Synthetic oligonucleotide
  Target: ATXN1; (+) strand; PAM type: NRG; PAM sequence: CAG
ctatttttaagagcacagcc

SEQ ID NO: 153948 - DNA, 20 bp, Artificial Sequence
  Description of Artificial Sequence: Synthetic oligonucleotide
  Target: ATXN1; (+) strand; PAM type: NRG; PAM sequence: TGG
ttttaagagcacagcccagc

SEQ ID NO: 153949 - DNA, 20 bp, Artificial Sequence
  Description of Artificial Sequence: Synthetic oligonucleotide
  Target: ATXN1; (+) strand; PAM type: NRG; PAM sequence: AAG
aagagcacagcccagctgga

SEQ ID NO: 153950 - DNA, 20 bp, Artificial Sequence
  Description of Artificial Sequence: Synthetic oligonucleotide
  Target: ATXN1; (+) strand; PAM type: NRG; PAM sequence: AGG
agagcacagcccagctggaa

SEQ ID NO: 153951 - DNA, 20 bp, Artificial Sequence
  Description of Artificial Sequence: Synthetic oligonucleotide
  Target: ATXN1; (+) strand; PAM type: NRG; PAM sequence: CAG
aaataacttccacttctttc

SEQ ID NO: 153952 - DNA, 20 bp, Artificial Sequence
  Description of Artificial Sequence: Synthetic oligonucleotide
  Target: ATXN1; (+) strand; PAM type: NRG; PAM sequence: AAG
cttctttccagcacttttca

SEQ ID NO: 153953 - DNA, 20 bp, Artificial Sequence
  Description of Artificial Sequence: Synthetic oligonucleotide
  Target: ATXN1; (+) strand; PAM type: NRG; PAM sequence: CAG
gcacttttcaaagtaatgaa

SEQ ID NO: 153954 - DNA, 20 bp, Artificial Sequence
  Description of Artificial Sequence: Synthetic oligonucleotide
  Target: ATXN1; (+) strand; PAM type: NRG; PAM sequence: TAG
cttttcaaagtaatgaacag

SEQ ID NO: 153955 - DNA, 20 bp, Artificial Sequence
  Description of Artificial Sequence: Synthetic oligonucleotide
  Target: ATXN1; (+) strand; PAM type: NRG; PAM sequence: AAG
ttctaactaatccattcacc

SEQ ID NO: 153956 - DNA, 20 bp, Artificial Sequence
  Description of Artificial Sequence: Synthetic oligonucleotide
  Target: ATXN1; (+) strand; PAM type: NRG; PAM sequence: AAG
cattcaccaagcatttattt

SEQ ID NO: 153957 - DNA, 20 bp, Artificial Sequence
  Description of Artificial Sequence: Synthetic oligonucleotide
  Target: ATXN1; (+) strand; PAM type: NRG; PAM sequence: GAG
ttaagcattgattgcctgcc

SEQ ID NO: 153958 - DNA, 20 bp, Artificial Sequence
  Description of Artificial Sequence: Synthetic oligonucleotide
  Target: ATXN1; (+) strand; PAM type: NRG; PAM sequence: AGG
taagcattgattgcctgccg

SEQ ID NO: 153959 - DNA, 20 bp, Artificial Sequence
  Description of Artificial Sequence: Synthetic oligonucleotide
  Target: ATXN1; (+) strand; PAM type: NRG; PAM sequence: AAG
tgccgaggactgatatgcaa

SEQ ID NO: 153960 - DNA, 20 bp, Artificial Sequence
  Description of Artificial Sequence: Synthetic oligonucleotide
  Target: ATXN1; (+) strand; PAM type: NRG; PAM sequence: AAG
cgaggactgatatgcaaaag

SEQ ID NO: 153961 - DNA, 20 bp, Artificial Sequence
  Description of Artificial Sequence: Synthetic oligonucleotide
  Target: ATXN1; (+) strand; PAM type: NRG; PAM sequence: AGG
gaggactgatatgcaaaaga

SEQ ID NO: 153962 - DNA, 20 bp, Artificial Sequence
  Description of Artificial Sequence: Synthetic oligonucleotide
  Target: ATXN1; (+) strand; PAM type: NRG; PAM sequence: TAG
tgcaaaagaaggaattcttg

SEQ ID NO: 153963 - DNA, 20 bp, Artificial Sequence
  Description of Artificial Sequence: Synthetic oligonucleotide
  Target: ATXN1; (+) strand; PAM type: NRG; PAM sequence: TGG
gaaggaattcttgtagtcct

SEQ ID NO: 153964 - DNA, 20 bp, Artificial Sequence
  Description of Artificial Sequence: Synthetic oligonucleotide
  Target: ATXN1; (+) strand; PAM type: NRG; PAM sequence: CAG
ccacatgtgatctgtgcgta

SEQ ID NO: 153965 - DNA, 20 bp, Artificial Sequence
  Description of Artificial Sequence: Synthetic oligonucleotide
  Target: ATXN1; (+) strand; PAM type: NRG; PAM sequence: GAG
acatgtgatctgtgcgtaca

SEQ ID NO: 153966 - DNA, 20 bp, Artificial Sequence
  Description of Artificial Sequence: Synthetic oligonucleotide
  Target: ATXN1; (+) strand; PAM type: NRG; PAM sequence: AAG
tgtgatctgtgcgtacagag

SEQ ID NO: 153967 - DNA, 20 bp, Artificial Sequence
  Description of Artificial Sequence: Synthetic oligonucleotide
  Target: ATXN1; (+) strand; PAM type: NRG; PAM sequence: AGG
gtgatctgtgcgtacagaga

SEQ ID NO: 153968 - DNA, 20 bp, Artificial Sequence
  Description of Artificial Sequence: Synthetic oligonucleotide
  Target: ATXN1; (+) strand; PAM type: NRG; PAM sequence: AAG
atctgtgcgtacagagaagg

SEQ ID NO: 153969 - DNA, 20 bp, Artificial Sequence
  Description of Artificial Sequence: Synthetic oligonucleotide
  Target: ATXN1; (+) strand; PAM type: NRG; PAM sequence: AGG
tctgtgcgtacagagaagga

SEQ ID NO: 153970 - DNA, 20 bp, Artificial Sequence
  Description of Artificial Sequence: Synthetic oligonucleotide
  Target: ATXN1; (+) strand; PAM type: NRG; PAM sequence: AAG
tgcgtacagagaaggaaggt

SEQ ID NO: 153971 - DNA, 20 bp, Artificial Sequence
  Description of Artificial Sequence: Synthetic oligonucleotide
  Target: ATXN1; (+) strand; PAM type: NRG; PAM sequence: AAG
ggtaagctgttatacactat

SEQ ID NO: 153972 - DNA, 20 bp, Artificial Sequence
  Description of Artificial Sequence: Synthetic oligonucleotide
  Target: ATXN1; (+) strand; PAM type: NRG; PAM sequence: AGG
gtaagctgttatacactata

SEQ ID NO: 153973 - DNA, 20 bp, Artificial Sequence
  Description of Artificial Sequence: Synthetic oligonucleotide
  Target: ATXN1; (+) strand; PAM type: NRG; PAM sequence: CAG
ttatacactataaggtcttt

SEQ ID NO: 153974 - DNA, 20 bp, Artificial Sequence
  Description of Artificial Sequence: Synthetic oligonucleotide
  Target: ATXN1; (+) strand; PAM type: NRG; PAM sequence: TAG
tataaggtctttcagatctt

SEQ ID NO: 153975 - DNA, 20 bp, Artificial Sequence
  Description of Artificial Sequence: Synthetic oligonucleotide
  Target: ATXN1; (+) strand; PAM type: NRG; PAM sequence: AAG
aaggtctttcagatctttag

SEQ ID NO: 153976 - DNA, 20 bp, Artificial Sequence
  Description of Artificial Sequence: Synthetic oligonucleotide
  Target: ATXN1; (+) strand; PAM type: NRG; PAM sequence: AGG
aggtctttcagatctttaga

SEQ ID NO: 153977 - DNA, 20 bp, Artificial Sequence
  Description of Artificial Sequence: Synthetic oligonucleotide
  Target: ATXN1; (+) strand; PAM type: NRG; PAM sequence: CAG
tttcagatctttagaaggca

SEQ ID NO: 153978 - DNA, 20 bp, Artificial Sequence
  Description of Artificial Sequence: Synthetic oligonucleotide
  Target: ATXN1; (+) strand; PAM type: NRG; PAM sequence: AAG
gaaggcacagtccctccacc

SEQ ID NO: 153979 - DNA, 20 bp, Artificial Sequence
  Description of Artificial Sequence: Synthetic oligonucleotide
  Target: ATXN1; (+) strand; PAM type: NRG; PAM sequence: AAG
ggcacagtccctccaccaag

SEQ ID NO: 153980 - DNA, 20 bp, Artificial Sequence
  Description of Artificial Sequence: Synthetic oligonucleotide
  Target: ATXN1; (+) strand; PAM type: NRG; PAM sequence: GAG
cctccaccaagaagcctgtt

SEQ ID NO: 153981 - DNA, 20 bp, Artificial Sequence
  Description of Artificial Sequence: Synthetic oligonucleotide
  Target: ATXN1; (+) strand; PAM type: NRG; PAM sequence: TGG
tgagttacaaatataaataa

SEQ ID NO: 153982 - DNA, 20 bp, Artificial Sequence
  Description of Artificial Sequence: Synthetic oligonucleotide
  Target: ATXN1; (+) strand; PAM type: NRG; PAM sequence: AAG
tacaaatataaataatggcc

SEQ ID NO: 153983 - DNA, 20 bp, Artificial Sequence
  Description of Artificial Sequence: Synthetic oligonucleotide
  Target: ATXN1; (+) strand; PAM type: NRG; PAM sequence: AAG
atataaataatggccaagtt

SEQ ID NO: 153984 - DNA, 20 bp, Artificial Sequence
  Description of Artificial Sequence: Synthetic oligonucleotide
  Target: ATXN1; (+) strand; PAM type: NRG; PAM sequence: TAG
taaataatggccaagttaag

SEQ ID NO: 153985 - DNA, 20 bp, Artificial Sequence
  Description of Artificial Sequence: Synthetic oligonucleotide
  Target: ATXN1; (+) strand; PAM type: NRG; PAM sequence: AAG
ataatggccaagttaagtag

SEQ ID NO: 153986 - DNA, 20 bp, Artificial Sequence
  Description of Artificial Sequence: Synthetic oligonucleotide
  Target: ATXN1; (+) strand; PAM type: NRG; PAM sequence: TAG
gacaaaattctatttaatct

SEQ ID NO: 153987 - DNA, 20 bp, Artificial Sequence
  Description of Artificial Sequence: Synthetic oligonucleotide
  Target: ATXN1; (+) strand; PAM type: NRG; PAM sequence: AAG
tttaatcttagtacttcttt

SEQ ID NO: 153988 - DNA, 20 bp, Artificial Sequence
  Description of Artificial Sequence: Synthetic oligonucleotide
  Target: ATXN1; (+) strand; PAM type: NRG; PAM sequence: AGG
ttaatcttagtacttcttta

SEQ ID NO: 153989 - DNA, 20 bp, Artificial Sequence
  Description of Artificial Sequence: Synthetic oligonucleotide
  Target: ATXN1; (+) strand; PAM type: NRG; PAM sequence: GAG
cttagtacttctttaaggat

SEQ ID NO: 153990 - DNA, 20 bp, Artificial Sequence
  Description of Artificial Sequence: Synthetic oligonucleotide
  Target: ATXN1; (+) strand; PAM type: NRG; PAM sequence: AGG
ttagtacttctttaaggatg

SEQ ID NO: 153991 - DNA, 20 bp, Artificial Sequence
  Description of Artificial Sequence: Synthetic oligonucleotide
  Target: ATXN1; (+) strand; PAM type: NRG; PAM sequence: AAG
gtacttctttaaggatgagg

SEQ ID NO: 153992 - DNA, 20 bp, Artificial Sequence
  Description of Artificial Sequence: Synthetic oligonucleotide
  Target: ATXN1; (+) strand; PAM type: NRG; PAM sequence: CAG
cttctttaaggatgaggaag

SEQ ID NO: 153993 - DNA, 20 bp, Artificial Sequence
  Description of Artificial Sequence: Synthetic oligonucleotide
  Target: ATXN1; (+) strand; PAM type: NRG; PAM sequence: AGG
ttctttaaggatgaggaagc

SEQ ID NO: 153994 - DNA, 20 bp, Artificial Sequence
  Description of Artificial Sequence: Synthetic oligonucleotide
  Target: ATXN1; (+) strand; PAM type: NRG; PAM sequence: GGG
tctttaaggatgaggaagca

SEQ ID NO: 153995 - DNA, 20 bp, Artificial Sequence
  Description of Artificial Sequence: Synthetic oligonucleotide
  Target: ATXN1; (+) strand; PAM type: NRG; PAM sequence: GAG
tttaaggatgaggaagcagg

SEQ ID NO: 153996 - DNA, 20 bp, Artificial Sequence
  Description of Artificial Sequence: Synthetic oligonucleotide
  Target: ATXN1; (+) strand; PAM type: NRG; PAM sequence: AGG
ttaaggatgaggaagcaggg

SEQ ID NO: 153997 - DNA, 20 bp, Artificial Sequence
  Description of Artificial Sequence: Synthetic oligonucleotide
  Target: ATXN1; (+) strand; PAM type: NRG; PAM sequence: GGG
taaggatgaggaagcaggga

SEQ ID NO: 153998 - DNA, 20 bp, Artificial Sequence
  Description of Artificial Sequence: Synthetic oligonucleotide
  Target: ATXN1; (+) strand; PAM type: NRG; PAM sequence: GAG
aggatgaggaagcagggagg

SEQ ID NO: 153999 - DNA, 20 bp, Artificial Sequence
  Description of Artificial Sequence: Synthetic oligonucleotide
  Target: ATXN1; (+) strand; PAM type: NRG; PAM sequence: AGG
ggatgaggaagcagggaggg

SEQ ID NO: 154000 - DNA, 20 bp, Artificial Sequence
  Description of Artificial Sequence: Synthetic oligonucleotide
  Target: ATXN1; (+) strand; PAM type: NRG; PAM sequence: AAG
tcatgatgtcatctcaaatt

SEQ ID NO: 154001 - DNA, 20 bp, Artificial Sequence
  Description of Artificial Sequence: Synthetic oligonucleotide
  Target: ATXN1; (+) strand; PAM type: NRG; PAM sequence: GAG
aaaatacttgattctcaaat

SEQ ID NO: 154002 - DNA, 20 bp, Artificial Sequence
  Description of Artificial Sequence: Synthetic oligonucleotide
  Target: ATXN1; (+) strand; PAM type: NRG; PAM sequence: AGG
aaatacttgattctcaaatg

SEQ ID NO: 154003 - DNA, 20 bp, Artificial Sequence
  Description of Artificial Sequence: Synthetic oligonucleotide
  Target: ATXN1; (+) strand; PAM type: NRG; PAM sequence: CAG
cttgattctcaaatgaggtg

SEQ ID NO: 154004 - DNA, 20 bp, Artificial Sequence
  Description of Artificial Sequence: Synthetic oligonucleotide
  Target: ATXN1; (+) strand; PAM type: NRG; PAM sequence: AGG
ttgattctcaaatgaggtgc

SEQ ID NO: 154005 - DNA, 20 bp, Artificial Sequence
  Description of Artificial Sequence: Synthetic oligonucleotide
  Target: ATXN1; (+) strand; PAM type: NRG; PAM sequence: CAG
gtgcaggtaccataaattta

SEQ ID NO: 154006 - DNA, 20 bp, Artificial Sequence
  Description of Artificial Sequence: Synthetic oligonucleotide
  Target: ATXN1; (+) strand; PAM type: NRG; PAM sequence: CAG
aggtaccataaatttacaga

SEQ ID NO: 154007 - DNA, 20 bp, Artificial Sequence
  Description of Artificial Sequence: Synthetic oligonucleotide
  Target: ATXN1; (+) strand; PAM type: NRG; PAM sequence: GAG
ttacagacagtgctttttat

SEQ ID NO: 154008 - DNA, 20 bp, Artificial Sequence
  Description of Artificial Sequence: Synthetic oligonucleotide
  Target: ATXN1; (+) strand; PAM type: NRG; PAM sequence: CAG
agtgctttttatgagctcac

SEQ ID NO: 154009 - DNA, 20 bp, Artificial Sequence
  Description of Artificial Sequence: Synthetic oligonucleotide
  Target: ATXN1; (+) strand; PAM type: NRG; PAM sequence: TGG
ctttttatgagctcaccagt

SEQ ID NO: 154010 - DNA, 20 bp, Artificial Sequence
  Description of Artificial Sequence: Synthetic oligonucleotide
  Target: ATXN1; (+) strand; PAM type: NRG; PAM sequence: GGG
tttttatgagctcaccagtt

SEQ ID NO: 154011 - DNA, 20 bp, Artificial Sequence
  Description of Artificial Sequence: Synthetic oligonucleotide
  Target: ATXN1; (+) strand; PAM type: NRG; PAM sequence: GAG
tttatgagctcaccagttgg

SEQ ID NO: 154012 - DNA, 20 bp, Artificial Sequence
  Description of Artificial Sequence: Synthetic oligonucleotide
  Target: ATXN1; (+) strand; PAM type: NRG; PAM sequence: GAG
tatgagctcaccagttggga

SEQ ID NO: 154013 - DNA, 20 bp, Artificial Sequence
  Description of Artificial Sequence: Synthetic oligonucleotide
  Target: ATXN1; (+) strand; PAM type: NRG; PAM sequence: TGG
aatcctgtttacatatcacc

SEQ ID NO: 154014 - DNA, 20 bp, Artificial Sequence
  Description of Artificial Sequence: Synthetic oligonucleotide
  Target: ATXN1; (+) strand; PAM type: NRG; PAM sequence: CAG
cctgtttacatatcacctgg

SEQ ID NO: 154015 - DNA, 20 bp, Artificial Sequence
  Description of Artificial Sequence: Synthetic oligonucleotide
  Target: ATXN1; (+) strand; PAM type: NRG; PAM sequence: AAG
ttacatatcacctggcagat

SEQ ID NO: 154016 - DNA, 20 bp, Artificial Sequence
  Description of Artificial Sequence: Synthetic oligonucleotide
  Target: ATXN1; (+) strand; PAM type: NRG; PAM sequence: AGG
tacatatcacctggcagata

SEQ ID NO: 154017 - DNA, 20 bp, Artificial Sequence
  Description of Artificial Sequence: Synthetic oligonucleotide
  Target: ATXN1; (+) strand; PAM type: NRG; PAM sequence: TAG
acctggcagataaggtttta

SEQ ID NO: 154018 - DNA, 20 bp, Artificial Sequence
  Description of Artificial Sequence: Synthetic oligonucleotide
  Target: ATXN1; (+) strand; PAM type: NRG; PAM sequence: GAG
ctggcagataaggttttata

SEQ ID NO: 154019 - DNA, 20 bp, Artificial Sequence
  Description of Artificial Sequence: Synthetic oligonucleotide
  Target: ATXN1; (+) strand; PAM type: NRG; PAM sequence: AAG
gataaggttttatagagtcc

SEQ ID NO: 154020 - DNA, 20 bp, Artificial Sequence
  Description of Artificial Sequence: Synthetic oligonucleotide
  Target: ATXN1; (+) strand; PAM type: NRG; PAM sequence: TAG
tccaagttacaacctcctcc

SEQ ID NO: 154021 - DNA, 20 bp, Artificial Sequence
  Description of Artificial Sequence: Synthetic oligonucleotide
  Target: ATXN1; (+) strand; PAM type: NRG; PAM sequence: AAG
aacctcctcctagtttgctg

SEQ ID NO: 154022 - DNA, 20 bp, Artificial Sequence
  Description of Artificial Sequence: Synthetic oligonucleotide
  Target: ATXN1; (+) strand; PAM type: NRG; PAM sequence: CAG
cctcctagtttgctgaagtg

SEQ ID NO: 154023 - DNA, 20 bp, Artificial Sequence
  Description of Artificial Sequence: Synthetic oligonucleotide
  Target: ATXN1; (+) strand; PAM type: NRG; PAM sequence: GAG
tcctagtttgctgaagtgca

SEQ ID NO: 154024 - DNA, 20 bp, Artificial Sequence
  Description of Artificial Sequence: Synthetic oligonucleotide
  Target: ATXN1; (+) strand; PAM type: NRG; PAM sequence: AGG
cctagtttgctgaagtgcag

SEQ ID NO: 154025 - DNA, 20 bp, Artificial Sequence
  Description of Artificial Sequence: Synthetic oligonucleotide
  Target: ATXN1; (+) strand; PAM type: NRG; PAM sequence: GAG
tagtttgctgaagtgcagag

SEQ ID NO: 154026 - DNA, 20 bp, Artificial Sequence
  Description of Artificial Sequence: Synthetic oligonucleotide
  Target: ATXN1; (+) strand; PAM type: NRG; PAM sequence: AGG
agtttgctgaagtgcagagg

SEQ ID NO: 154027 - DNA, 20 bp, Artificial Sequence
  Description of Artificial Sequence: Synthetic oligonucleotide
  Target: ATXN1; (+) strand; PAM type: NRG; PAM sequence: GGG
gtttgctgaagtgcagagga

SEQ ID NO: 154028 - DNA, 20 bp, Artificial Sequence
  Description of Artificial Sequence: Synthetic oligonucleotide
  Target: ATXN1; (+) strand; PAM type: NRG; PAM sequence: TAG
caaacatgatgtaaatgcca

SEQ ID NO: 154029 - DNA, 20 bp, Artificial Sequence
  Description of Artificial Sequence: Synthetic oligonucleotide
  Target: ATXN1; (+) strand; PAM type: NRG; PAM sequence: AAG
acatgatgtaaatgccatag

SEQ ID NO: 154030 - DNA, 20 bp, Artificial Sequence
  Description of Artificial Sequence: Synthetic oligonucleotide
  Target: ATXN1; (+) strand; PAM type: NRG; PAM sequence: GAG
agattactttactcttgcat

SEQ ID NO: 154031 - DNA, 20 bp, Artificial Sequence
  Description of Artificial Sequence: Synthetic oligonucleotide
  Target: ATXN1; (+) strand; PAM type: NRG; PAM sequence: AAG
agtatgctttcttatttcaa

SEQ ID NO: 154032 - DNA, 20 bp, Artificial Sequence
  Description of Artificial Sequence: Synthetic oligonucleotide
  Target: ATXN1; (+) strand; PAM type: NRG; PAM sequence: TAG
aagtatttgtgttgctgcac

SEQ ID NO: 154033 - DNA, 20 bp, Artificial Sequence
  Description of Artificial Sequence: Synthetic oligonucleotide
  Target: ATXN1; (+) strand; PAM type: NRG; PAM sequence: TAG
atttgtgttgctgcactagt

SEQ ID NO: 154034 - DNA, 20 bp, Artificial Sequence
  Description of Artificial Sequence: Synthetic oligonucleotide
  Target: ATXN1; (+) strand; PAM type: NRG; PAM sequence: AGG
tttgtgttgctgcactagtt

SEQ ID NO: 154035 - DNA, 20 bp, Artificial Sequence
  Description of Artificial Sequence: Synthetic oligonucleotide
  Target: ATXN1; (+) strand; PAM type: NRG; PAM sequence: CAG
ctgcactagttaggataata

SEQ ID NO: 154036 - DNA, 20 bp, Artificial Sequence
  Description of Artificial Sequence: Synthetic oligonucleotide
  Target: ATXN1; (+) strand; PAM type: NRG; PAM sequence: GAG
gcactagttaggataataca

SEQ ID NO: 154037 - DNA, 20 bp, Artificial Sequence
  Description of Artificial Sequence: Synthetic oligonucleotide
  Target: ATXN1; (+) strand; PAM type: NRG; PAM sequence: GAG
actagttaggataatacaga

SEQ ID NO: 154038 - DNA, 20 bp, Artificial Sequence
  Description of Artificial Sequence: Synthetic oligonucleotide
  Target: ATXN1; (+) strand; PAM type: NRG; PAM sequence: CAG
ttacataacttgtattccat

SEQ ID NO: 154039 - DNA, 20 bp, Artificial Sequence
  Description of Artificial Sequence: Synthetic oligonucleotide
  Target: ATXN1; (+) strand; PAM type: NRG; PAM sequence: GAG
acataacttgtattccatca

SEQ ID NO: 154040 - DNA, 20 bp, Artificial Sequence
  Description of Artificial Sequence: Synthetic oligonucleotide
  Target: ATXN1; (+) strand; PAM type: NRG; PAM sequence: AGG
cataacttgtattccatcag

SEQ ID NO: 154041 - DNA, 20 bp, Artificial Sequence
  Description of Artificial Sequence: Synthetic oligonucleotide
  Target: ATXN1; (+) strand; PAM type: NRG; PAM sequence: GGG
ataacttgtattccatcaga

SEQ ID NO: 154042 - DNA, 20 bp, Artificial Sequence
  Description of Artificial Sequence: Synthetic oligonucleotide
  Target: ATXN1; (+) strand; PAM type: NRG; PAM sequence: AAG
acttgtattccatcagaggg

SEQ ID NO: 154043 - DNA, 20 bp, Artificial Sequence
  Description of Artificial Sequence: Synthetic oligonucleotide
  Target: ATXN1; (+) strand; PAM type: NRG; PAM sequence: AAG
tgtattccatcagagggaag

SEQ ID NO: 154044 - DNA, 20 bp, Artificial Sequence
  Description of Artificial Sequence: Synthetic oligonucleotide
  Target: ATXN1; (+) strand; PAM type: NRG; PAM sequence: AGG
gtattccatcagagggaaga

SEQ ID NO: 154045 - DNA, 20 bp, Artificial Sequence
  Description of Artificial Sequence: Synthetic oligonucleotide
  Target: ATXN1; (+) strand; PAM type: NRG; PAM sequence: AAG
tccatcagagggaagaaggc

SEQ ID NO: 154046 - DNA, 20 bp, Artificial Sequence
  Description of Artificial Sequence: Synthetic oligonucleotide
  Target: ATXN1; (+) strand; PAM type: NRG; PAM sequence: AAG
agggaagaaggcaagaatac

SEQ ID NO: 154047 - DNA, 20 bp, Artificial Sequence
  Description of Artificial Sequence: Synthetic oligonucleotide
  Target: ATXN1; (+) strand; PAM type: NRG; PAM sequence: AAG
aagaaggcaagaatacaagc

SEQ ID NO: 154048 - DNA, 20 bp, Artificial Sequence
  Description of Artificial Sequence: Synthetic oligonucleotide
  Target: ATXN1; (+) strand; PAM type: NRG; PAM sequence: AGG
agaaggcaagaatacaagca

SEQ ID NO: 154049 - DNA, 20 bp, Artificial Sequence
  Description of Artificial Sequence: Synthetic oligonucleotide
  Target: ATXN1; (+) strand; PAM type: NRG; PAM sequence: CAG
aggcaagaatacaagcaagg

SEQ ID NO: 154050 - DNA, 20 bp, Artificial Sequence
  Description of Artificial Sequence: Synthetic oligonucleotide
  Target: ATXN1; (+) strand; PAM type: NRG; PAM sequence: CAG
aaacttacaaaataatatac

SEQ ID NO: 154051 - DNA, 20 bp, Artificial Sequence
  Description of Artificial Sequence: Synthetic oligonucleotide
  Target: ATXN1; (+) strand; PAM type: NRG; PAM sequence: TAG
atataccagaaaataattta

SEQ ID NO: 154052 - DNA, 20 bp, Artificial Sequence
  Description of Artificial Sequence: Synthetic oligonucleotide
  Target: ATXN1; (+) strand; PAM type: NRG; PAM sequence: AGG
tataccagaaaataatttat

SEQ ID NO: 154053 - DNA, 20 bp, Artificial Sequence
  Description of Artificial Sequence: Synthetic oligonucleotide
  Target: ATXN1; (+) strand; PAM type: NRG; PAM sequence: TGG
acaataatatacaccaaaaa

SEQ ID NO: 154054 - DNA, 20 bp, Artificial Sequence
  Description of Artificial Sequence: Synthetic oligonucleotide
  Target: ATXN1; (+) strand; PAM type: NRG; PAM sequence: CAG
tactcaatatttttaaaacc

SEQ ID NO: 154055 - DNA, 20 bp, Artificial Sequence
  Description of Artificial Sequence: Synthetic oligonucleotide
  Target: ATXN1; (+) strand; PAM type: NRG; PAM sequence: CAG
tcaatatttttaaaacccag

SEQ ID NO: 154056 - DNA, 20 bp, Artificial Sequence
  Description of Artificial Sequence: Synthetic oligonucleotide
  Target: ATXN1; (+) strand; PAM type: NRG; PAM sequence: GAG
aatatttttaaaacccagca

SEQ ID NO: 154057 - DNA, 20 bp, Artificial Sequence
  Description of Artificial Sequence: Synthetic oligonucleotide
  Target: ATXN1; (+) strand; PAM type: NRG; PAM sequence: TGG
taatacaatactattaatat

SEQ ID NO: 154058 - DNA, 20 bp, Artificial Sequence
  Description of Artificial Sequence: Synthetic oligonucleotide
  Target: ATXN1; (+) strand; PAM type: NRG; PAM sequence: AAG
tacaatactattaatattgg

SEQ ID NO: 154059 - DNA, 20 bp, Artificial Sequence
  Description of Artificial Sequence: Synthetic oligonucleotide
  Target: ATXN1; (+) strand; PAM type: NRG; PAM sequence: AAG
attaatattggaagattaac

SEQ ID NO: 154060 - DNA, 20 bp, Artificial Sequence
  Description of Artificial Sequence: Synthetic oligonucleotide
  Target: ATXN1; (+) strand; PAM type: NRG; PAM sequence: AAG
atattggaagattaacaaga

SEQ ID NO: 154061 - DNA, 20 bp, Artificial Sequence
  Description of Artificial Sequence: Synthetic oligonucleotide
  Target: ATXN1; (+) strand; PAM type: NRG; PAM sequence: CGG
tggaagattaacaagaaaga

SEQ ID NO: 154062 - DNA, 20 bp, Artificial Sequence
  Description of Artificial Sequence: Synthetic oligonucleotide
  Target: ATXN1; (+) strand; PAM type: NRG; PAM sequence: GAG
aagacggcctaaacaaaact

SEQ ID NO: 154063 - DNA, 20 bp, Artificial Sequence
  Description of Artificial Sequence: Synthetic oligonucleotide
  Target: ATXN1; (+) strand; PAM type: NRG; PAM sequence: AGG
agacggcctaaacaaaactg

SEQ ID NO: 154064 - DNA, 20 bp, Artificial Sequence
  Description of Artificial Sequence: Synthetic oligonucleotide
  Target: ATXN1; (+) strand; PAM type: NRG; PAM sequence: TGG
cctaaacaaaactgaggtaa

SEQ ID NO: 154065 - DNA, 20 bp, Artificial Sequence
  Description of Artificial Sequence: Synthetic oligonucleotide
  Target: ATXN1; (+) strand; PAM type: NRG; PAM sequence: CAG
aacaaaactgaggtaatggt

SEQ ID NO: 154066 - DNA, 20 bp, Artificial Sequence
  Description of Artificial Sequence: Synthetic oligonucleotide
  Target: ATXN1; (+) strand; PAM type: NRG; PAM sequence: AAG
aaactgaggtaatggtcagt

SEQ ID NO: 154067 - DNA, 20 bp, Artificial Sequence
  Description of Artificial Sequence: Synthetic oligonucleotide
  Target: ATXN1; (+) strand; PAM type: NRG; PAM sequence: CAG
aggtaatggtcagtaagtac

SEQ ID NO: 154068 - DNA, 20 bp, Artificial Sequence
  Description of Artificial Sequence: Synthetic oligonucleotide
  Target: ATXN1; (+) strand; PAM type: NRG; PAM sequence: AGG
ggtaatggtcagtaagtacc

SEQ ID NO: 154069 - DNA, 20 bp, Artificial Sequence
  Description of Artificial Sequence: Synthetic oligonucleotide
  Target: ATXN1; (+) strand; PAM type: NRG; PAM sequence: GAG
taatggtcagtaagtaccag

SEQ ID NO: 154070 - DNA, 20 bp, Artificial Sequence
  Description of Artificial Sequence: Synthetic oligonucleotide
  Target: ATXN1; (+) strand; PAM type: NRG; PAM sequence: GAG
taagtaccaggagataatgt

SEQ ID NO: 154071 - DNA, 20 bp, Artificial Sequence
  Description of Artificial Sequence: Synthetic oligonucleotide
  Target: ATXN1; (+) strand; PAM type: NRG; PAM sequence: AAG
taccaggagataatgtgaga

SEQ ID NO: 154072 - DNA, 20 bp, Artificial Sequence
  Description of Artificial Sequence: Synthetic oligonucleotide
  Target: ATXN1; (+) strand; PAM type: NRG; PAM sequence: AGG
accaggagataatgtgagaa

SEQ ID NO: 154073 - DNA, 20 bp, Artificial Sequence
  Description of Artificial Sequence: Synthetic oligonucleotide
  Target: ATXN1; (+) strand; PAM type: NRG; PAM sequence: GGG
ccaggagataatgtgagaaa

SEQ ID NO: 154074 - DNA, 20 bp, Artificial Sequence
  Description of Artificial Sequence: Synthetic oligonucleotide
  Target: ATXN1; (+) strand; PAM type: NRG; PAM sequence: GGG
caggagataatgtgagaaag

SEQ ID NO: 154075 - DNA, 20 bp, Artificial Sequence
  Description of Artificial Sequence: Synthetic oligonucleotide
  Target: ATXN1; (+) strand; PAM type: NRG; PAM sequence: AAG
tgagaaaggggaacaaaatt

SEQ ID NO: 154076 - DNA, 20 bp, Artificial Sequence
  Description of Artificial Sequence: Synthetic oligonucleotide
  Target: ATXN1; (+) strand; PAM type: NRG; PAM sequence: AGG
gagaaaggggaacaaaatta

SEQ ID NO: 154077 - DNA, 20 bp, Artificial Sequence
  Description of Artificial Sequence: Synthetic oligonucleotide
  Target: ATXN1; (+) strand; PAM type: NRG; PAM sequence: GGG
agaaaggggaacaaaattaa

SEQ ID NO: 154078 - DNA, 20 bp, Artificial Sequence
  Description of Artificial Sequence: Synthetic oligonucleotide
  Target: ATXN1; (+) strand; PAM type: NRG; PAM sequence: AAG
gggaacaaaattaagggcac

SEQ ID NO: 154079 - DNA, 20 bp, Artificial Sequence
  Description of Artificial Sequence: Synthetic oligonucleotide
  Target: ATXN1; (+) strand; PAM type: NRG; PAM sequence: AAG
attaagggcacaagaaaata

SEQ ID NO: 154080 - DNA, 20 bp, Artificial Sequence
  Description of Artificial Sequence: Synthetic oligonucleotide
  Target: ATXN1; (+) strand; PAM type: NRG; PAM sequence: CAG
aaaataaagtttgccataca

SEQ ID NO: 154081 - DNA, 20 bp, Artificial Sequence
  Description of Artificial Sequence: Synthetic oligonucleotide
  Target: ATXN1; (+) strand; PAM type: NRG; PAM sequence: CAG
aagtttgccatacacagtga

SEQ ID NO: 154082 - DNA, 20 bp, Artificial Sequence
  Description of Artificial Sequence: Synthetic oligonucleotide
  Target: ATXN1; (+) strand; PAM type: NRG; PAM sequence: TAG
aatatattttctttgaacgt

SEQ ID NO: 154083 - DNA, 20 bp, Artificial Sequence
  Description of Artificial Sequence: Synthetic oligonucleotide
  Target: ATXN1; (+) strand; PAM type: NRG; PAM sequence: AAG
atattttctttgaacgttag

SEQ ID NO: 154084 - DNA, 20 bp, Artificial Sequence
  Description of Artificial Sequence: Synthetic oligonucleotide
  Target: ATXN1; (+) strand; PAM type: NRG; PAM sequence: AGG
tattttctttgaacgttaga

SEQ ID NO: 154085 - DNA, 20 bp, Artificial Sequence
  Description of Artificial Sequence: Synthetic oligonucleotide
  Target: ATXN1; (+) strand; PAM type: NRG; PAM sequence: TAG
ttctttgaacgttagaagga

SEQ ID NO: 154086 - DNA, 20 bp, Artificial Sequence
  Description of Artificial Sequence: Synthetic oligonucleotide
  Target: ATXN1; (+) strand; PAM type: NRG; PAM sequence: TAG
cgttagaaggatagatgcta

SEQ ID NO: 154087 - DNA, 20 bp, Artificial Sequence
  Description of Artificial Sequence: Synthetic oligonucleotide
  Target: ATXN1; (+) strand; PAM type: NRG; PAM sequence: AGG
gttagaaggatagatgctat

SEQ ID NO: 154088 - DNA, 20 bp, Artificial Sequence
  Description of Artificial Sequence: Synthetic oligonucleotide
  Target: ATXN1; (+) strand; PAM type: NRG; PAM sequence: TAG
gaaggatagatgctataggt

SEQ ID NO: 154089 - DNA, 20 bp, Artificial Sequence
  Description of Artificial Sequence: Synthetic oligonucleotide
  Target: ATXN1; (+) strand; PAM type: NRG; PAM sequence: TAG
ggatagatgctataggttag

SEQ ID NO: 154090 - DNA, 20 bp, Artificial Sequence
  Description of Artificial Sequence: Synthetic oligonucleotide
  Target: ATXN1; (+) strand; PAM type: NRG; PAM sequence: AAG
attcaaaacttgtcatgtta

SEQ ID NO: 154091 - DNA, 20 bp, Artificial Sequence
  Description of Artificial Sequence: Synthetic oligonucleotide
  Target: ATXN1; (+) strand; PAM type: NRG; PAM sequence: AGG
ttcaaaacttgtcatgttaa

SEQ ID NO: 154092 - DNA, 20 bp, Artificial Sequence
  Description of Artificial Sequence: Synthetic oligonucleotide
  Target: ATXN1; (+) strand; PAM type: NRG; PAM sequence: GGG
tcaaaacttgtcatgttaaa

SEQ ID NO: 154093 - DNA, 20 bp, Artificial Sequence
  Description of Artificial Sequence: Synthetic oligonucleotide
  Target: ATXN1; (+) strand; PAM type: NRG; PAM sequence: AAG
tgtcatgttaaagggcacct

SEQ ID NO: 154094 - DNA, 20 bp, Artificial Sequence
  Description of Artificial Sequence: Synthetic oligonucleotide
  Target: ATXN1; (+) strand; PAM type: NRG; PAM sequence: AAG
taagtgtaaaaaaaaaaaaa

SEQ ID NO: 154095 - DNA, 20 bp, Artificial Sequence
  Description of Artificial Sequence: Synthetic oligonucleotide
  Target: ATXN1; (+) strand; PAM type: NRG; PAM sequence: GAG
agtgtaaaaaaaaaaaaaaa

SEQ ID NO: 154096 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaaagagttcctct

SEQ ID NO: 154097 - DNA, 20 bp, Artificial Sequence
  Description of Artificial Sequence: Synthetic oligonucleotide
  Target: ATXN1; (+) strand; PAM type: NRG; PAM sequence: CGG
ccaaatcaaaacatcacaat

SEQ ID NO: 154098 - DNA, 20 bp, Artificial Sequence
  Description of Artificial Sequence: Synthetic oligonucleotide
  Target: ATXN1; (+) strand; PAM type: NRG; PAM sequence: GGG
caaatcaaaacatcacaatc

SEQ ID NO: 154099 - DNA, 20 bp, Artificial Sequence
  Description of Artificial Sequence: Synthetic oligonucleotide
  Target: ATXN1; (+) strand; PAM type: NRG; PAM sequence: GGG
aaatcaaaacatcacaatcg

SEQ ID NO: 154100 - DNA, 20 bp, Artificial Sequence
  Description of Artificial Sequence: Synthetic oligonucleotide
  Target: ATXN1; (+) strand; PAM type: NRG; PAM sequence: GAG
ggggaaacctctgccctctt

SEQ ID NO: 154101 - DNA, 20 bp, Artificial Sequence
  Description of Artificial Sequence: Synthetic oligonucleotide
  Target: ATXN1; (+) strand; PAM type: NRG; PAM sequence: GAG
cctcttgagtctcaaattct

SEQ ID NO: 154102 - DNA, 20 bp, Artificial Sequence
  Description of Artificial Sequence: Synthetic oligonucleotide
  Target: ATXN1; (+) strand; PAM type: NRG; PAM sequence: TGG
gtacactaccatgaattttc

SEQ ID NO: 154103 - DNA, 20 bp, Artificial Sequence
  Description of Artificial Sequence: Synthetic oligonucleotide
  Target: ATXN1; (+) strand; PAM type: NRG; PAM sequence: AAG
actaccatgaattttctgga

SEQ ID NO: 154104 - DNA, 20 bp, Artificial Sequence
  Description of Artificial Sequence: Synthetic oligonucleotide
  Target: ATXN1; (+) strand; PAM type: NRG; PAM sequence: CAG
attttctggaaagtaatttt

SEQ ID NO: 154105 - DNA, 20 bp, Artificial Sequence
  Description of Artificial Sequence: Synthetic oligonucleotide
  Target: ATXN1; (+) strand; PAM type: NRG; PAM sequence: AGG
ttttctggaaagtaattttc

SEQ ID NO: 154106 - DNA, 20 bp, Artificial Sequence
  Description of Artificial Sequence: Synthetic oligonucleotide
  Target: ATXN1; (+) strand; PAM type: NRG; PAM sequence: TAG
tctggaaagtaattttcagg

SEQ ID NO: 154107 - DNA, 20 bp, Artificial Sequence
  Description of Artificial Sequence: Synthetic oligonucleotide
  Target: ATXN1; (+) strand; PAM type: NRG; PAM sequence: AGG
ctggaaagtaattttcaggt

SEQ ID NO: 154108 - DNA, 20 bp, Artificial Sequence
  Description of Artificial Sequence: Synthetic oligonucleotide
  Target: ATXN1; (+) strand; PAM type: NRG; PAM sequence: TGG
tacaatttttgcttacattg

SEQ ID NO: 154109 - DNA, 20 bp, Artificial Sequence
  Description of Artificial Sequence: Synthetic oligonucleotide
  Target: ATXN1; (+) strand; PAM type: NRG; PAM sequence: TGG
cattttcattactccacaaa

SEQ ID NO: 154110 - DNA, 20 bp, Artificial Sequence
  Description of Artificial Sequence: Synthetic oligonucleotide
  Target: ATXN1; (+) strand; PAM type: NRG; PAM sequence: GGG
attttcattactccacaaat

SEQ ID NO: 154111 - DNA, 20 bp, Artificial Sequence
  Description of Artificial Sequence: Synthetic oligonucleotide
  Target: ATXN1; (+) strand; PAM type: NRG; PAM sequence: AAG
ccacaaatgggatgcattaa

SEQ ID NO: 154112 - DNA, 20 bp, Artificial Sequence
  Description of Artificial Sequence: Synthetic oligonucleotide
  Target: ATXN1; (+) strand; PAM type: NRG; PAM sequence: CAG
atgggatgcattaaaagtta

SEQ ID NO: 154113 - DNA, 20 bp, Artificial Sequence
  Description of Artificial Sequence: Synthetic oligonucleotide
  Target: ATXN1; (+) strand; PAM type: NRG; PAM sequence: TGG
tgttctctctaaacgtgttt

SEQ ID NO: 154114 - DNA, 20 bp, Artificial Sequence
  Description of Artificial Sequence: Synthetic oligonucleotide
  Target: ATXN1; (+) strand; PAM type: NRG; PAM sequence: TGG
taaacgtgttttggtacatt

SEQ ID NO: 154115 - DNA, 20 bp, Artificial Sequence
  Description of Artificial Sequence: Synthetic oligonucleotide
  Target: ATXN1; (+) strand; PAM type: NRG; PAM sequence: GGG
aaacgtgttttggtacattt

SEQ ID NO: 154116 - DNA, 20 bp, Artificial Sequence
  Description of Artificial Sequence: Synthetic oligonucleotide
  Target: ATXN1; (+) strand; PAM type: NRG; PAM sequence: TGG
gtgttttggtacatttggga

SEQ ID NO: 154117 - DNA, 20 bp, Artificial Sequence
  Description of Artificial Sequence: Synthetic oligonucleotide
  Target: ATXN1; (+) strand; PAM type: NRG; PAM sequence: TAG
ttttggtacatttgggatgg

SEQ ID NO: 154118 - DNA, 20 bp, Artificial Sequence
  Description of Artificial Sequence: Synthetic oligonucleotide
  Target: ATXN1; (+) strand; PAM type: NRG; PAM sequence: TAG
atgcgtaatacaaatattta

SEQ ID NO: 154119 - DNA, 20 bp, Artificial Sequence
  Description of Artificial Sequence: Synthetic oligonucleotide
  Target: ATXN1; (+) strand; PAM type: NRG; PAM sequence: TAG
tacaaatatttatagtacat

SEQ ID NO: 154120 - DNA, 20 bp, Artificial Sequence
  Description of Artificial Sequence: Synthetic oligonucleotide
  Target: ATXN1; (+) strand; PAM type: NRG; PAM sequence: AAG
tttatagtacattagcctga

SEQ ID NO: 154121 - DNA, 20 bp, Artificial Sequence
  Description of Artificial Sequence: Synthetic oligonucleotide
  Target: ATXN1; (+) strand; PAM type: NRG; PAM sequence: GAG
agcctgaaagttcaaattat

SEQ ID NO: 154122 - DNA, 20 bp, Artificial Sequence
  Description of Artificial Sequence: Synthetic oligonucleotide
  Target: ATXN1; (+) strand; PAM type: NRG; PAM sequence: AAG
aatatattactacactaata

SEQ ID NO: 154123 - DNA, 20 bp, Artificial Sequence
  Description of Artificial Sequence: Synthetic oligonucleotide
  Target: ATXN1; (+) strand; PAM type: NRG; PAM sequence: AAG
atccataaatataattataa

SEQ ID NO: 154124 - DNA, 20 bp, Artificial Sequence
  Description of Artificial Sequence: Synthetic oligonucleotide
  Target: ATXN1; (+) strand; PAM type: NRG; PAM sequence: AAG
taaaataaaaaactttccat

SEQ ID NO: 154125 - DNA, 20 bp, Artificial Sequence
  Description of Artificial Sequence: Synthetic oligonucleotide
  Target: ATXN1; (+) strand; PAM type: NRG; PAM sequence: AAG
tttattacttctgtaatttt

SEQ ID NO: 154126 - DNA, 20 bp, Artificial Sequence
  Description of Artificial Sequence: Synthetic oligonucleotide
  Target: ATXN1; (+) strand; PAM type: NRG; PAM sequence: CAG
caatgtaattaccgttcttt

SEQ ID NO: 154127 - DNA, 20 bp, Artificial Sequence
  Description of Artificial Sequence: Synthetic oligonucleotide
  Target: ATXN1; (+) strand; PAM type: NRG; PAM sequence: GAG
ttcttaaaaaaattttgaat

SEQ ID NO: 154128 - DNA, 20 bp, Artificial Sequence
  Description of Artificial Sequence: Synthetic oligonucleotide
  Target: ATXN1; (+) strand; PAM type: NRG; PAM sequence: TAG
atgacttaaaattcttatct

SEQ ID NO: 154129 - DNA, 20 bp, Artificial Sequence
  Description of Artificial Sequence: Synthetic oligonucleotide
  Target: ATXN1; (+) strand; PAM type: NRG; PAM sequence: AAG
ttaaaattcttatcttagaa

SEQ ID NO: 154130 - DNA, 20 bp, Artificial Sequence
  Description of Artificial Sequence: Synthetic oligonucleotide
  Target: ATXN1; (+) strand; PAM type: NRG; PAM sequence: AGG
taaaattcttatcttagaaa

SEQ ID NO: 154131 - DNA, 20 bp, Artificial Sequence
  Description of Artificial Sequence: Synthetic oligonucleotide
  Target: ATXN1; (+) strand; PAM type: NRG; PAM sequence: AAG
aattcttatcttagaaaagg

SEQ ID NO: 154132 - DNA, 20 bp, Artificial Sequence
  Description of Artificial Sequence: Synthetic oligonucleotide
  Target: ATXN1; (+) strand; PAM type: NRG; PAM sequence: AAG
gaaaaggaagttctatatgt

SEQ ID NO: 154133 - DNA, 20 bp, Artificial Sequence
  Description of Artificial Sequence: Synthetic oligonucleotide
  Target: ATXN1; (+) strand; PAM type: NRG; PAM sequence: AGG
aaaaggaagttctatatgta

SEQ ID NO: 154134 - DNA, 20 bp, Artificial Sequence
  Description of Artificial Sequence: Synthetic oligonucleotide
  Target: ATXN1; (+) strand; PAM type: NRG; PAM sequence: CAG
ctatatgtaaggtcctaaaa

SEQ ID NO: 154135 - DNA, 20 bp, Artificial Sequence
  Description of Artificial Sequence: Synthetic oligonucleotide
  Target: ATXN1; (+) strand; PAM type: NRG; PAM sequence: AAG
ttcaatgcttttatcaaaat

SEQ ID NO: 154136 - DNA, 20 bp, Artificial Sequence
  Description of Artificial Sequence: Synthetic oligonucleotide
  Target: ATXN1; (+) strand; PAM type: NRG; PAM sequence: AGG
tcaatgcttttatcaaaata

SEQ ID NO: 154137 - DNA, 20 bp, Artificial Sequence
  Description of Artificial Sequence: Synthetic oligonucleotide
  Target: ATXN1; (+) strand; PAM type: NRG; PAM sequence: GAG
aatgcttttatcaaaataag

SEQ ID NO: 154138 - DNA, 20 bp, Artificial Sequence
  Description of Artificial Sequence: Synthetic oligonucleotide
  Target: ATXN1; (+) strand; PAM type: NRG; PAM sequence: AGG
atgcttttatcaaaataagg

SEQ ID NO: 154139 - DNA, 20 bp, Artificial Sequence
  Description of Artificial Sequence: Synthetic oligonucleotide
  Target: ATXN1; (+) strand; PAM type: NRG; PAM sequence: GGG
tgcttttatcaaaataagga

SEQ ID NO: 154140 - DNA, 20 bp, Artificial Sequence
  Description of Artificial Sequence: Synthetic oligonucleotide
  Target: ATXN1; (+) strand; PAM type: NRG; PAM sequence: TGG
gggcctgcttctgataacct

SEQ ID NO: 154141 - DNA, 20 bp, Artificial Sequence
  Description of Artificial Sequence: Synthetic oligonucleotide
  Target: ATXN1; (+) strand; PAM type: NRG; PAM sequence: AAG
cctgcttctgataaccttgg

SEQ ID NO: 154142 - DNA, 20 bp, Artificial Sequence
  Description of Artificial Sequence: Synthetic oligonucleotide
  Target: ATXN1; (+) strand; PAM type: NRG; PAM sequence: CAG
gataaccttggaagtatgac

SEQ ID NO: 154143 - DNA, 20 bp, Artificial Sequence
  Description of Artificial Sequence: Synthetic oligonucleotide
  Target: ATXN1; (+) strand; PAM type: NRG; PAM sequence: AAG
agaactaaatctgttatttg

SEQ ID NO: 154144 - DNA, 20 bp, Artificial Sequence
  Description of Artificial Sequence: Synthetic oligonucleotide
  Target: ATXN1; (+) strand; PAM type: NRG; PAM sequence: AAG
atctgttatttgaagcaatt

SEQ ID NO: 154145 - DNA, 20 bp, Artificial Sequence
  Description of Artificial Sequence: Synthetic oligonucleotide
  Target: ATXN1; (+) strand; PAM type: NRG; PAM sequence: CAG
tttgaagcaattaagctgca

SEQ ID NO: 154146 - DNA, 20 bp, Artificial Sequence
  Description of Artificial Sequence: Synthetic oligonucleotide
  Target: ATXN1; (+) strand; PAM type: NRG; PAM sequence: CAG
gcacagatctaaatctctca

SEQ ID NO: 154147 - DNA, 20 bp, Artificial Sequence
  Description of Artificial Sequence: Synthetic oligonucleotide
  Target: ATXN1; (+) strand; PAM type: NRG; PAM sequence: CAG
attgaattactctgaaaata

SEQ ID NO: 154148 - DNA, 20 bp, Artificial Sequence
  Description of Artificial Sequence: Synthetic oligonucleotide
  Target: ATXN1; (+) strand; PAM type: NRG; PAM sequence: GAG
tgaattactctgaaaataca

SEQ ID NO: 154149 - DNA, 20 bp, Artificial Sequence
  Description of Artificial Sequence: Synthetic oligonucleotide
  Target: ATXN1; (+) strand; PAM type: NRG; PAM sequence: AAG
ttactctgaaaatacagagc

SEQ ID NO: 154150 - DNA, 20 bp, Artificial Sequence
  Description of Artificial Sequence: Synthetic oligonucleotide
  Target: ATXN1; (+) strand; PAM type: NRG; PAM sequence: AGG
tactctgaaaatacagagca

SEQ ID NO: 154151 - DNA, 20 bp, Artificial Sequence
  Description of Artificial Sequence: Synthetic oligonucleotide
  Target: ATXN1; (+) strand; PAM type: NRG; PAM sequence: AAG
ctgaaaatacagagcaagga

SEQ ID NO: 154152 - DNA, 20 bp, Artificial Sequence
  Description of Artificial Sequence: Synthetic oligonucleotide
  Target: ATXN1; (+) strand; PAM type: NRG; PAM sequence: TAG
tatctctcccctaaaaataa

SEQ ID NO: 154153 - DNA, 20 bp, Artificial Sequence
  Description of Artificial Sequence: Synthetic oligonucleotide
  Target: ATXN1; (+) strand; PAM type: NRG; PAM sequence: AAG
tattgtcactttaccgatgc

SEQ ID NO: 154154 - DNA, 20 bp, Artificial Sequence
  Description of Artificial Sequence: Synthetic oligonucleotide
  Target: ATXN1; (+) strand; PAM type: NRG; PAM sequence: AAG
ctttaccgatgcaagtattt

SEQ ID NO: 154155 - DNA, 20 bp, Artificial Sequence
  Description of Artificial Sequence: Synthetic oligonucleotide
  Target: ATXN1; (+) strand; PAM type: NRG; PAM sequence: CAG
atgcaagtatttaagctgtt

SEQ ID NO: 154156 - DNA, 20 bp, Artificial Sequence
  Description of Artificial Sequence: Synthetic oligonucleotide
  Target: ATXN1; (+) strand; PAM type: NRG; PAM sequence: CAG
cctaatctatgtgttatttt

SEQ ID NO: 154157 - DNA, 20 bp, Artificial Sequence
  Description of Artificial Sequence: Synthetic oligonucleotide
  Target: ATXN1; (+) strand; PAM type: NRG; PAM sequence: CAG
gtgttattttcagataacta

SEQ ID NO: 154158 - DNA, 20 bp, Artificial Sequence
  Description of Artificial Sequence: Synthetic oligonucleotide
  Target: ATXN1; (+) strand; PAM type: NRG; PAM sequence: AAG
tttcagataactacagttta

SEQ ID NO: 154159 - DNA, 20 bp, Artificial Sequence
  Description of Artificial Sequence: Synthetic oligonucleotide
  Target: ATXN1; (+) strand; PAM type: NRG; PAM sequence: GAG
ccacatttacctacttacgt

SEQ ID NO: 154160 - DNA, 20 bp, Artificial Sequence
  Description of Artificial Sequence: Synthetic oligonucleotide
  Target: ATXN1; (+) strand; PAM type: NRG; PAM sequence: CAG
ttacctacttacgtgagttt

SEQ ID NO: 154161 - DNA, 20 bp, Artificial Sequence
  Description of Artificial Sequence: Synthetic oligonucleotide
  Target: ATXN1; (+) strand; PAM type: NRG; PAM sequence: TAG
ttacgtgagtttcagaattt

SEQ ID NO: 154162 - DNA, 20 bp, Artificial Sequence
  Description of Artificial Sequence: Synthetic oligonucleotide
  Target: ATXN1; (+) strand; PAM type: NRG; PAM sequence: TAG
gtttattgcttaacttttaa

SEQ ID NO: 154163 - DNA, 20 bp, Artificial Sequence
  Description of Artificial Sequence: Synthetic oligonucleotide
  Target: ATXN1; (+) strand; PAM type: NRG; PAM sequence: AGG
tttattgcttaacttttaat

SEQ ID NO: 154164 - DNA, 20 bp, Artificial Sequence
  Description of Artificial Sequence: Synthetic oligonucleotide
  Target: ATXN1; (+) strand; PAM type: NRG; PAM sequence: GAG
cttttaataggaaacaaaat

SEQ ID NO: 154165 - DNA, 20 bp, Artificial Sequence
  Description of Artificial Sequence: Synthetic oligonucleotide
  Target: ATXN1; (+) strand; PAM type: NRG; PAM sequence: TAG
ataggaaacaaaatgagtgt

SEQ ID NO: 154166 - DNA, 20 bp, Artificial Sequence
  Description of Artificial Sequence: Synthetic oligonucleotide
  Target: ATXN1; (+) strand; PAM type: NRG; PAM sequence: TAG
aacaaaatgagtgttagtgt

SEQ ID NO: 154167 - DNA, 20 bp, Artificial Sequence
  Description of Artificial Sequence: Synthetic oligonucleotide
  Target: ATXN1; (+) strand; PAM type: NRG; PAM sequence: CAG
tgagtgttagtgttagtcat

SEQ ID NO: 154168 - DNA, 20 bp, Artificial Sequence
  Description of Artificial Sequence: Synthetic oligonucleotide
  Target: ATXN1; (+) strand; PAM type: NRG; PAM sequence: AAG
gtcatcagaaactgtcactc

SEQ ID NO: 154169 - DNA, 20 bp, Artificial Sequence
  Description of Artificial Sequence: Synthetic oligonucleotide
  Target: ATXN1; (+) strand; PAM type: NRG; PAM sequence: AGG
tcatcagaaactgtcactca

SEQ ID NO: 154170 - DNA, 20 bp, Artificial Sequence
  Description of Artificial Sequence: Synthetic oligonucleotide
  Target: ATXN1; (+) strand; PAM type: NRG; PAM sequence: AAG
cactcaaggtatgtgcaaaa

SEQ ID NO: 154171 - DNA, 20 bp, Artificial Sequence
  Description of Artificial Sequence: Synthetic oligonucleotide
  Target: ATXN1; (+) strand; PAM type: NRG; PAM sequence: CAG
gtaaaatccacttgacattt

SEQ ID NO: 154172 - DNA, 20 bp, Artificial Sequence
  Description of Artificial Sequence: Synthetic oligonucleotide
  Target: ATXN1; (+) strand; PAM type: NRG; PAM sequence: AAG
tttcagaatgaaaaacaata

SEQ ID NO: 154173 - DNA, 20 bp, Artificial Sequence
  Description of Artificial Sequence: Synthetic oligonucleotide
  Target: ATXN1; (+) strand; PAM type: NRG; PAM sequence: AGG
ttcagaatgaaaaacaataa

SEQ ID NO: 154174 - DNA, 20 bp, Artificial Sequence
  Description of Artificial Sequence: Synthetic oligonucleotide
  Target: ATXN1; (+) strand; PAM type: NRG; PAM sequence: AAG
taaaggcacaacattattca

SEQ ID NO: 154175 - DNA, 20 bp, Artificial Sequence
  Description of Artificial Sequence: Synthetic oligonucleotide
  Target: ATXN1; (+) strand; PAM type: NRG; PAM sequence: TGG
ttcaaagaaatgtgcgtcct

SEQ ID NO: 154176 - DNA, 20 bp, Artificial Sequence
  Description of Artificial Sequence: Synthetic oligonucleotide
  Target: ATXN1; (+) strand; PAM type: NRG; PAM sequence: CAG
ctccataatgacaacaaaaa

SEQ ID NO: 154177 - DNA, 20 bp, Artificial Sequence
  Description of Artificial Sequence: Synthetic oligonucleotide
  Target: ATXN1; (+) strand; PAM type: NRG; PAM sequence: AGG
tccataatgacaacaaaaac

SEQ ID NO: 154178 - DNA, 20 bp, Artificial Sequence
  Description of Artificial Sequence: Synthetic oligonucleotide
  Target: ATXN1; (+) strand; PAM type: NRG; PAM sequence: GAG
cataatgacaacaaaaacag

SEQ ID NO: 154179 - DNA, 20 bp, Artificial Sequence
  Description of Artificial Sequence: Synthetic oligonucleotide
  Target: ATXN1; (+) strand; PAM type: NRG; PAM sequence: TAG
gacaacaaaaacaggagtca

SEQ ID NO: 154180 - DNA, 20 bp, Artificial Sequence
  Description of Artificial Sequence: Synthetic oligonucleotide
  Target: ATXN1; (+) strand; PAM type: NRG; PAM sequence: CAG
tactaatatttcaataatct

SEQ ID NO: 154181 - DNA, 20 bp, Artificial Sequence
  Description of Artificial Sequence: Synthetic oligonucleotide
  Target: ATXN1; (+) strand; PAM type: NRG; PAM sequence: TGG
tatttcaataatctcagcac

SEQ ID NO: 154182 - DNA, 20 bp, Artificial Sequence
  Description of Artificial Sequence: Synthetic oligonucleotide
  Target: ATXN1; (+) strand; PAM type: NRG; PAM sequence: CAG
atctcagcactggcctttcc

SEQ ID NO: 154183 - DNA, 20 bp, Artificial Sequence
  Description of Artificial Sequence: Synthetic oligonucleotide
  Target: ATXN1; (+) strand; PAM type: NRG; PAM sequence: AGG
tctcagcactggcctttccc

SEQ ID NO: 154184 - DNA, 20 bp, Artificial Sequence
  Description of Artificial Sequence: Synthetic oligonucleotide
  Target: ATXN1; (+) strand; PAM type: NRG; PAM sequence: TAG
ctggcctttcccaggactcc

SEQ ID NO: 154185 - DNA, 20 bp, Artificial Sequence
  Description of Artificial Sequence: Synthetic oligonucleotide
  Target: ATXN1; (+) strand; PAM type: NRG; PAM sequence: AGG
tggcctttcccaggactcct

SEQ ID NO: 154186 - DNA, 20 bp, Artificial Sequence
  Description of Artificial Sequence: Synthetic oligonucleotide
  Target: ATXN1; (+) strand; PAM type: NRG; PAM sequence: TAG
ggactcctaggcaactgact

SEQ ID NO: 154187 - DNA, 20 bp, Artificial Sequence
  Description of Artificial Sequence: Synthetic oligonucleotide
  Target: ATXN1; (+) strand; PAM type: NRG; PAM sequence: AGG
gactcctaggcaactgactt

SEQ ID NO: 154188 - DNA, 20 bp, Artificial Sequence
  Description of Artificial Sequence: Synthetic oligonucleotide
  Target: ATXN1; (+) strand; PAM type: NRG; PAM sequence: CAG
cttaggtatgttgaaactta

SEQ ID NO: 154189 - DNA, 20 bp, Artificial Sequence
  Description of Artificial Sequence: Synthetic oligonucleotide
  Target: ATXN1; (+) strand; PAM type: NRG; PAM sequence: AGG
ttaggtatgttgaaacttac

SEQ ID NO: 154190 - DNA, 20 bp, Artificial Sequence
  Description of Artificial Sequence: Synthetic oligonucleotide
  Target: ATXN1; (+) strand; PAM type: NRG; PAM sequence: TGG
gcatttgacatgtaatcttg

SEQ ID NO: 154191 - DNA, 20 bp, Artificial Sequence
  Description of Artificial Sequence: Synthetic oligonucleotide
  Target: ATXN1; (+) strand; PAM type: NRG; PAM sequence: AAG
gacatgtaatcttgtggcta

SEQ ID NO: 154192 - DNA, 20 bp, Artificial Sequence
  Description of Artificial Sequence: Synthetic oligonucleotide
  Target: ATXN1; (+) strand; PAM type: NRG; PAM sequence: GAG
catgtaatcttgtggctaaa

SEQ ID NO: 154193 - DNA, 20 bp, Artificial Sequence
  Description of Artificial Sequence: Synthetic oligonucleotide
  Target: ATXN1; (+) strand; PAM type: NRG; PAM sequence: AAG
tttctgtttaatcttcctct

SEQ ID NO: 154194 - DNA, 20 bp, Artificial Sequence
  Description of Artificial Sequence: Synthetic oligonucleotide
  Target: ATXN1; (+) strand; PAM type: NRG; PAM sequence: AAG
taatcttcctctaagtgtaa

SEQ ID NO: 154195 - DNA, 20 bp, Artificial Sequence
  Description of Artificial Sequence: Synthetic oligonucleotide
  Target: ATXN1; (+) strand; PAM type: NRG; PAM sequence: CAG
tctaagtgtaaaagacaatt

SEQ ID NO: 154196 - DNA, 20 bp, Artificial Sequence
  Description of Artificial Sequence: Synthetic oligonucleotide
  Target: ATXN1; (+) strand; PAM type: NRG; PAM sequence: AAG
aagtgtaaaagacaattcag

SEQ ID NO: 154197 - DNA, 20 bp, Artificial Sequence
  Description of Artificial Sequence: Synthetic oligonucleotide
  Target: ATXN1; (+) strand; PAM type: NRG; PAM sequence: AAG
aagacaattcagaagtcctg

SEQ ID NO: 154198 - DNA, 20 bp, Artificial Sequence
  Description of Artificial Sequence: Synthetic oligonucleotide
  Target: ATXN1; (+) strand; PAM type: NRG; PAM sequence: TAG
aattcagaagtcctgaagtc

SEQ ID NO: 154199 - DNA, 20 bp, Artificial Sequence
  Description of Artificial Sequence: Synthetic oligonucleotide
  Target: ATXN1; (+) strand; PAM type: NRG; PAM sequence: AAG
tagtcgtaacatttttgaca

SEQ ID NO: 154200 - DNA, 20 bp, Artificial Sequence
  Description of Artificial Sequence: Synthetic oligonucleotide
  Target: ATXN1; (+) strand; PAM type: NRG; PAM sequence: AAG
cctcttaaaacgaaatccgc

SEQ ID NO: 154201 - DNA, 20 bp, Artificial Sequence
  Description of Artificial Sequence: Synthetic oligonucleotide
  Target: ATXN1; (+) strand; PAM type: NRG; PAM sequence: AGG
ctcttaaaacgaaatccgca

SEQ ID NO: 154202 - DNA, 20 bp, Artificial Sequence
  Description of Artificial Sequence: Synthetic oligonucleotide
  Target: ATXN1; (+) strand; PAM type: NRG; PAM sequence: TGG
gcaaggaaaaatattgcctt

SEQ ID NO: 154203 - DNA, 20 bp, Artificial Sequence
  Description of Artificial Sequence: Synthetic oligonucleotide
  Target: ATXN1; (+) strand; PAM type: NRG; PAM sequence: CGG
aggaaaaatattgcctttgg

SEQ ID NO: 154204 - DNA, 20 bp, Artificial Sequence
  Description of Artificial Sequence: Synthetic oligonucleotide
  Target: ATXN1; (+) strand; PAM type: NRG; PAM sequence: CAG
ttgcctttggcggttcccac

SEQ ID NO: 154205 - DNA, 20 bp, Artificial Sequence
  Description of Artificial Sequence: Synthetic oligonucleotide
  Target: ATXN1; (+) strand; PAM type: NRG; PAM sequence: AGG
tgcctttggcggttcccacc

SEQ ID NO: 154206 - DNA, 20 bp, Artificial Sequence
  Description of Artificial Sequence: Synthetic oligonucleotide
  Target: ATXN1; (+) strand; PAM type: NRG; PAM sequence: AAG
atatgttcacattttactgc

SEQ ID NO: 154207 - DNA, 20 bp, Artificial Sequence
  Description of Artificial Sequence: Synthetic oligonucleotide
  Target: ATXN1; (+) strand; PAM type: NRG; PAM sequence: AAG
ttcacattttactgcaagta

SEQ ID NO: 154208 - DNA, 20 bp, Artificial Sequence
  Description of Artificial Sequence: Synthetic oligonucleotide
  Target: ATXN1; (+) strand; PAM type: NRG; PAM sequence: TAG
tttttctatatgttgcaaaa

SEQ ID NO: 154209 - DNA, 20 bp, Artificial Sequence
  Description of Artificial Sequence: Synthetic oligonucleotide
  Target: ATXN1; (+) strand; PAM type: NRG; PAM sequence: CAG
atatgttgcaaaatagaatc

SEQ ID NO: 154210 - DNA, 20 bp, Artificial Sequence
  Description of Artificial Sequence: Synthetic oligonucleotide
  Target: ATXN1; (+) strand; PAM type: NRG; PAM sequence: AGG
tatgttgcaaaatagaatcc

SEQ ID NO: 154211 - DNA, 20 bp, Artificial Sequence
  Description of Artificial Sequence: Synthetic oligonucleotide
  Target: ATXN1; (+) strand; PAM type: NRG; PAM sequence: AAG
aaatagaatccaggacctcc

SEQ ID NO: 154212 - DNA, 20 bp, Artificial Sequence
  Description of Artificial Sequence: Synthetic oligonucleotide
  Target: ATXN1; (+) strand; PAM type: NRG; PAM sequence: AGG
aatagaatccaggacctcca

SEQ ID NO: 154213 - DNA, 20 bp, Artificial Sequence
  Description of Artificial Sequence: Synthetic oligonucleotide
  Target: ATXN1; (+) strand; PAM type: NRG; PAM sequence: AAG
atctatttaccaccttataa

SEQ ID NO: 154214 - DNA, 20 bp, Artificial Sequence
  Description of Artificial Sequence: Synthetic oligonucleotide
  Target: ATXN1; (+) strand; PAM type: NRG; PAM sequence: GAG
tttaccaccttataaaagtt

SEQ ID NO: 154215 - DNA, 20 bp, Artificial Sequence
  Description of Artificial Sequence: Synthetic oligonucleotide
  Target: ATXN1; (+) strand; PAM type: NRG; PAM sequence: TAG
accaccttataaaagttgag

SEQ ID NO: 154216 - DNA, 20 bp, Artificial Sequence
  Description of Artificial Sequence: Synthetic oligonucleotide
  Target: ATXN1; (+) strand; PAM type: NRG; PAM sequence: TAG
ccttataaaagttgagtagc

SEQ ID NO: 154217 - DNA, 20 bp, Artificial Sequence
  Description of Artificial Sequence: Synthetic oligonucleotide
  Target: ATXN1; (+) strand; PAM type: NRG; PAM sequence: AAG
tataaaagttgagtagctag

SEQ ID NO: 154218 - DNA, 20 bp, Artificial Sequence
  Description of Artificial Sequence: Synthetic oligonucleotide
  Target: ATXN1; (+) strand; PAM type: NRG; PAM sequence: TAG
tgagtagctagaagaaataa

SEQ ID NO: 154219 - DNA, 20 bp, Artificial Sequence
  Description of Artificial Sequence: Synthetic oligonucleotide
  Target: ATXN1; (+) strand; PAM type: NRG; PAM sequence: CAG
ataatagctcattttaacta

SEQ ID NO: 154220 - DNA, 20 bp, Artificial Sequence
  Description of Artificial Sequence: Synthetic oligonucleotide
  Target: ATXN1; (+) strand; PAM type: NRG; PAM sequence: CAG
atagctcattttaactacag

SEQ ID NO: 154221 - DNA, 20 bp, Artificial Sequence
  Description of Artificial Sequence: Synthetic oligonucleotide
  Target: ATXN1; (+) strand; PAM type: NRG; PAM sequence: CAG
acagcagtgcttcatctgac

SEQ ID NO: 154222 - DNA, 20 bp, Artificial Sequence
  Description of Artificial Sequence: Synthetic oligonucleotide
  Target: ATXN1; (+) strand; PAM type: NRG; PAM sequence: AGG
cagcagtgcttcatctgacc

SEQ ID NO: 154223 - DNA, 20 bp, Artificial Sequence
  Description of Artificial Sequence: Synthetic oligonucleotide
  Target: ATXN1; (+) strand; PAM type: NRG; PAM sequence: CGG
aaccacataaactcacaaaa

SEQ ID NO: 154224 - DNA, 20 bp, Artificial Sequence
  Description of Artificial Sequence: Synthetic oligonucleotide
  Target: ATXN1; (+) strand; PAM type: NRG; PAM sequence: TGG
gtaaaaactcataaaccccc

SEQ ID NO: 154225 - DNA, 20 bp, Artificial Sequence
  Description of Artificial Sequence: Synthetic oligonucleotide
  Target: ATXN1; (+) strand; PAM type: NRG; PAM sequence: GGG
taaaaactcataaaccccct

SEQ ID NO: 154226 - DNA, 20 bp, Artificial Sequence
  Description of Artificial Sequence: Synthetic oligonucleotide
  Target: ATXN1; (+) strand; PAM type: NRG; PAM sequence: TAG
actcataaaccccctgggaa

SEQ ID NO: 154227 - DNA, 20 bp, Artificial Sequence
  Description of Artificial Sequence: Synthetic oligonucleotide
  Target: ATXN1; (+) strand; PAM type: NRG; PAM sequence: GAG
tcataaaccccctgggaata

SEQ ID NO: 154228 - DNA, 20 bp, Artificial Sequence
  Description of Artificial Sequence: Synthetic oligonucleotide
  Target: ATXN1; (+) strand; PAM type: NRG; PAM sequence: GAG
aaccccctgggaatagagtt

SEQ ID NO: 154229 - DNA, 20 bp, Artificial Sequence
  Description of Artificial Sequence: Synthetic oligonucleotide
  Target: ATXN1; (+) strand; PAM type: NRG; PAM sequence: TAG
cccctgggaatagagttgag

SEQ ID NO: 154230 - DNA, 20 bp, Artificial Sequence
  Description of Artificial Sequence: Synthetic oligonucleotide
  Target: ATXN1; (+) strand; PAM type: NRG; PAM sequence: TAG
ttgagtagctctctcaatcc

SEQ ID NO: 154231 - DNA, 20 bp, Artificial Sequence
  Description of Artificial Sequence: Synthetic oligonucleotide
  Target: ATXN1; (+) strand; PAM type: NRG; PAM sequence: TGG
agctctctcaatcctagccc

SEQ ID NO: 154232 - DNA, 20 bp, Artificial Sequence
  Description of Artificial Sequence: Synthetic oligonucleotide
  Target: ATXN1; (+) strand; PAM type: NRG; PAM sequence: GGG
gctctctcaatcctagccct

SEQ ID NO: 154233 - DNA, 20 bp, Artificial Sequence
  Description of Artificial Sequence: Synthetic oligonucleotide
  Target: ATXN1; (+) strand; PAM type: NRG; PAM sequence: GGG
ctctctcaatcctagccctg

SEQ ID NO: 154234 - DNA, 20 bp, Artificial Sequence
  Description of Artificial Sequence: Synthetic oligonucleotide
  Target: ATXN1; (+) strand; PAM type: NRG; PAM sequence: GGG
tctctcaatcctagccctgg

SEQ ID NO: 154235 - DNA, 20 bp, Artificial Sequence
  Description of Artificial Sequence: Synthetic oligonucleotide
  Target: ATXN1; (+) strand; PAM type: NRG; PAM sequence: CAG
ccctgggggaaaaaatttac

SEQ ID NO: 154236 - DNA, 20 bp, Artificial Sequence
  Description of Artificial Sequence: Synthetic oligonucleotide
  Target: ATXN1; (+) strand; PAM type: NRG; PAM sequence: TAG
ggggaaaaaatttaccagtt

SEQ ID NO: 154237 - DNA, 20 bp, Artificial Sequence
  Description of Artificial Sequence: Synthetic oligonucleotide
  Target: ATXN1; (+) strand; PAM type: NRG; PAM sequence: TGG
atttaccagtttagctttgt

SEQ ID NO: 154238 - DNA, 20 bp, Artificial Sequence
  Description of Artificial Sequence: Synthetic oligonucleotide
  Target: ATXN1; (+) strand; PAM type: NRG; PAM sequence: TGG
ccataaaattgtaaactgac

SEQ ID NO: 154239 - DNA, 20 bp, Artificial Sequence
  Description of Artificial Sequence: Synthetic oligonucleotide
  Target: ATXN1; (+) strand; PAM type: NRG; PAM sequence: CAG
taaaattgtaaactgactgg

SEQ ID NO: 154240 - DNA, 20 bp, Artificial Sequence
  Description of Artificial Sequence: Synthetic oligonucleotide
  Target: ATXN1; (+) strand; PAM type: NRG; PAM sequence: AAG
ctggcagtcacaactaaatc

SEQ ID NO: 154241 - DNA, 20 bp, Artificial Sequence
  Description of Artificial Sequence: Synthetic oligonucleotide
  Target: ATXN1; (+) strand; PAM type: NRG; PAM sequence: CAG
ttatcttttctttcaaatac

SEQ ID NO: 154242 - DNA, 20 bp, Artificial Sequence
  Description of Artificial Sequence: Synthetic oligonucleotide
  Target: ATXN1; (+) strand; PAM type: NRG; PAM sequence: AGG
tatcttttctttcaaatacc

SEQ ID NO: 154243 - DNA, 20 bp, Artificial Sequence
  Description of Artificial Sequence: Synthetic oligonucleotide
  Target: ATXN1; (+) strand; PAM type: NRG; PAM sequence: GGG
atcttttctttcaaatacca

SEQ ID NO: 154244 - DNA, 20 bp, Artificial Sequence
  Description of Artificial Sequence: Synthetic oligonucleotide
  Target: ATXN1; (+) strand; PAM type: NRG; PAM sequence: TAG
cgcccgccccctgccccact

SEQ ID NO: 154245 - DNA, 20 bp, Artificial Sequence
  Description of Artificial Sequence: Synthetic oligonucleotide
  Target: ATXN1; (+) strand; PAM type: NRG; PAM sequence: TGG
cgccccctgccccacttagt

SEQ ID NO: 154246 - DNA, 20 bp, Artificial Sequence
  Description of Artificial Sequence: Synthetic oligonucleotide
  Target: ATXN1; (+) strand; PAM type: NRG; PAM sequence: GAG
cccacttagttggattgcct

SEQ ID NO: 154247 - DNA, 20 bp, Artificial Sequence
  Description of Artificial Sequence: Synthetic oligonucleotide
  Target: ATXN1; (+) strand; PAM type: NRG; PAM sequence: CAG
acttagttggattgcctgag

SEQ ID NO: 154248 - DNA, 20 bp, Artificial Sequence
  Description of Artificial Sequence: Synthetic oligonucleotide
  Target: ATXN1; (+) strand; PAM type: NRG; PAM sequence: CAG
gttggattgcctgagcagca

SEQ ID NO: 154249 - DNA, 20 bp, Artificial Sequence
  Description of Artificial Sequence: Synthetic oligonucleotide
  Target: ATXN1; (+) strand; PAM type: NRG; PAM sequence: GAG
tggattgcctgagcagcaca

SEQ ID NO: 154250 - DNA, 20 bp, Artificial Sequence
  Description of Artificial Sequence: Synthetic oligonucleotide
  Target: ATXN1; (+) strand; PAM type: NRG; PAM sequence: CAG
gcctgagcagcacagagctt

SEQ ID NO: 154251 - DNA, 20 bp, Artificial Sequence
  Description of Artificial Sequence: Synthetic oligonucleotide
  Target: ATXN1; (+) strand; PAM type: NRG; PAM sequence: AAG
gcacagagcttcagcaacta

SEQ ID NO: 154252 - DNA, 20 bp, Artificial Sequence
  Description of Artificial Sequence: Synthetic oligonucleotide
  Target: ATXN1; (+) strand; PAM type: NRG; PAM sequence: TAG
taatattatttctctttgct

SEQ ID NO: 154253 - DNA, 20 bp, Artificial Sequence
  Description of Artificial Sequence: Synthetic oligonucleotide
  Target: ATXN1; (+) strand; PAM type: NRG; PAM sequence: CAG
attatttctctttgcttagc

SEQ ID NO: 154254 - DNA, 20 bp, Artificial Sequence
  Description of Artificial Sequence: Synthetic oligonucleotide
  Target: ATXN1; (+) strand; PAM type: NRG; PAM sequence: CAG
ctttgcttagccagctttat

SEQ ID NO: 154255 - DNA, 20 bp, Artificial Sequence
  Description of Artificial Sequence: Synthetic oligonucleotide
  Target: ATXN1; (+) strand; PAM type: NRG; PAM sequence: TGG
tgcttagccagctttatcag

SEQ ID NO: 154256 - DNA, 20 bp, Artificial Sequence
  Description of Artificial Sequence: Synthetic oligonucleotide
  Target: ATXN1; (+) strand; PAM type: NRG; PAM sequence: AAG
atcagtggtgccctaatgca

SEQ ID NO: 154257 - DNA, 20 bp, Artificial Sequence
  Description of Artificial Sequence: Synthetic oligonucleotide
  Target: ATXN1; (+) strand; PAM type: NRG; PAM sequence: TAG
tggtgccctaatgcaaagac

SEQ ID NO: 154258 - DNA, 20 bp, Artificial Sequence
  Description of Artificial Sequence: Synthetic oligonucleotide
  Target: ATXN1; (+) strand; PAM type: NRG; PAM sequence: AAG
ctaaattacatcctaaaata

SEQ ID NO: 154259 - DNA, 20 bp, Artificial Sequence
  Description of Artificial Sequence: Synthetic oligonucleotide
  Target: ATXN1; (+) strand; PAM type: NRG; PAM sequence: AAG
agtacatgtttattgtccaa

SEQ ID NO: 154260 - DNA, 20 bp, Artificial Sequence
  Description of Artificial Sequence: Synthetic oligonucleotide
  Target: ATXN1; (+) strand; PAM type: NRG; PAM sequence: CAG
ccaaaagcaccatgcactat

SEQ ID NO: 154261 - DNA, 20 bp, Artificial Sequence
  Description of Artificial Sequence: Synthetic oligonucleotide
  Target: ATXN1; (+) strand; PAM type: NRG; PAM sequence: TAG
accatgcactatcagtcctc

SEQ ID NO: 154262 - DNA, 20 bp, Artificial Sequence
  Description of Artificial Sequence: Synthetic oligonucleotide
  Target: ATXN1; (+) strand; PAM type: NRG; PAM sequence: TAG
cactatcagtcctctagcta

SEQ ID NO: 154263 - DNA, 20 bp, Artificial Sequence
  Description of Artificial Sequence: Synthetic oligonucleotide
  Target: ATXN1; (+) strand; PAM type: NRG; PAM sequence: AGG
actatcagtcctctagctat

SEQ ID NO: 154264 - DNA, 20 bp, Artificial Sequence
  Description of Artificial Sequence: Synthetic oligonucleotide
  Target: ATXN1; (+) strand; PAM type: NRG; PAM sequence: TAG
ggcctctatcgtttctcgct

SEQ ID NO: 154265 - DNA, 20 bp, Artificial Sequence
  Description of Artificial Sequence: Synthetic oligonucleotide
  Target: ATXN1; (+) strand; PAM type: NRG; PAM sequence: AAG
ctatcgtttctcgcttagct

SEQ ID NO: 154266 - DNA, 20 bp, Artificial Sequence
  Description of Artificial Sequence: Synthetic oligonucleotide
  Target: ATXN1; (+) strand; PAM type: NRG; PAM sequence: AGG
tatcgtttctcgcttagcta

SEQ ID NO: 154267 - DNA, 20 bp, Artificial Sequence
  Description of Artificial Sequence: Synthetic oligonucleotide
  Target: ATXN1; (+) strand; PAM type: NRG; PAM sequence: AAG
atccttttaacttactacca

SEQ ID NO: 154268 - DNA, 20 bp, Artificial Sequence
  Description of Artificial Sequence: Synthetic oligonucleotide
  Target: ATXN1; (+) strand; PAM type: NRG; PAM sequence: CAG
accaaagatcattcaaatca

SEQ ID NO: 154269 - DNA, 20 bp, Artificial Sequence
  Description of Artificial Sequence: Synthetic oligonucleotide
  Target: ATXN1; (+) strand; PAM type: NRG; PAM sequence: TAG
atcattcaaatcacagccaa

SEQ ID NO: 154270 - DNA, 20 bp, Artificial Sequence
  Description of Artificial Sequence: Synthetic oligonucleotide
  Target: ATXN1; (+) strand; PAM type: NRG; PAM sequence: AAG
acagccaatagatccaaatt

SEQ ID NO: 154271 - DNA, 20 bp, Artificial Sequence
  Description of Artificial Sequence: Synthetic oligonucleotide
  Target: ATXN1; (+) strand; PAM type: NRG; PAM sequence: CAG
aaattaagaatgaatacatt

SEQ ID NO: 154272 - DNA, 20 bp, Artificial Sequence
  Description of Artificial Sequence: Synthetic oligonucleotide
  Target: ATXN1; (+) strand; PAM type: NRG; PAM sequence: CAG
tcagaatgtctgcctactgt

SEQ ID NO: 154273 - DNA, 20 bp, Artificial Sequence
  Description of Artificial Sequence: Synthetic oligonucleotide
  Target: ATXN1; (+) strand; PAM type: NRG; PAM sequence: CAG
tgtctgcctactgtcagtac

SEQ ID NO: 154274 - DNA, 20 bp, Artificial Sequence
  Description of Artificial Sequence: Synthetic oligonucleotide
  Target: ATXN1; (+) strand; PAM type: NRG; PAM sequence: TGG
agtaccagtttttgttatga

SEQ ID NO: 154275 - DNA, 20 bp, Artificial Sequence
  Description of Artificial Sequence: Synthetic oligonucleotide
  Target: ATXN1; (+) strand; PAM type: NRG; PAM sequence: AAG
tttttgttatgatggctgtc

SEQ ID NO: 154276 - DNA, 20 bp, Artificial Sequence
  Description of Artificial Sequence: Synthetic oligonucleotide
  Target: ATXN1; (+) strand; PAM type: NRG; PAM sequence: TGG
caagttttaaaatgtgacaa

SEQ ID NO: 154277 - DNA, 20 bp, Artificial Sequence
  Description of Artificial Sequence: Synthetic oligonucleotide
  Target: ATXN1; (+) strand; PAM type: NRG; PAM sequence: GGG
aagttttaaaatgtgacaat

SEQ ID NO: 154278 - DNA, 20 bp, Artificial Sequence
  Description of Artificial Sequence: Synthetic oligonucleotide
  Target: ATXN1; (+) strand; PAM type: NRG; PAM sequence: AAG
tgggaatatattttccgaat

SEQ ID NO: 154279 - DNA, 20 bp, Artificial Sequence
  Description of Artificial Sequence: Synthetic oligonucleotide
  Target: ATXN1; (+) strand; PAM type: NRG; PAM sequence: GAG
tccgaataagttattcccct

SEQ ID NO: 154280 - DNA, 20 bp, Artificial Sequence
  Description of Artificial Sequence: Synthetic oligonucleotide
  Target: ATXN1; (+) strand; PAM type: NRG; PAM sequence: TAG
attcccctgagtaaaccctt

SEQ ID NO: 154281 - DNA, 20 bp, Artificial Sequence
  Description of Artificial Sequence: Synthetic oligonucleotide
  Target: ATXN1; (+) strand; PAM type: NRG; PAM sequence: CAG
gagtaaaccctttagaaatc

SEQ ID NO: 154282 - DNA, 20 bp, Artificial Sequence
  Description of Artificial Sequence: Synthetic oligonucleotide
  Target: ATXN1; (+) strand; PAM type: NRG; PAM sequence: TGG
tagaaatccagccatcgcta

SEQ ID NO: 154283 - DNA, 20 bp, Artificial Sequence
  Description of Artificial Sequence: Synthetic oligonucleotide
  Target: ATXN1; (+) strand; PAM type: NRG; PAM sequence: GGG
agaaatccagccatcgctat

SEQ ID NO: 154284 - DNA, 20 bp, Artificial Sequence
  Description of Artificial Sequence: Synthetic oligonucleotide
  Target: ATXN1; (+) strand; PAM type: NRG; PAM sequence: TGG
ccagccatcgctatgggcaa

SEQ ID NO: 154285 - DNA, 20 bp, Artificial Sequence
  Description of Artificial Sequence: Synthetic oligonucleotide
  Target: ATXN1; (+) strand; PAM type: NRG; PAM sequence: GAG
agccatcgctatgggcaatg

SEQ ID NO: 154286 - DNA, 20 bp, Artificial Sequence
  Description of Artificial Sequence: Synthetic oligonucleotide
  Target: ATXN1; (+) strand; PAM type: NRG; PAM sequence: AGG
gccatcgctatgggcaatgg

SEQ ID NO: 154287 - DNA, 20 bp, Artificial Sequence
  Description of Artificial Sequence: Synthetic oligonucleotide
  Target: ATXN1; (+) strand; PAM type: NRG; PAM sequence: AAG
tgaacgctcttcacacttga

SEQ ID NO: 154288 - DNA, 20 bp, Artificial Sequence
  Description of Artificial Sequence: Synthetic oligonucleotide
  Target: ATXN1; (+) strand; PAM type: NRG; PAM sequence: AGG
gaacgctcttcacacttgaa

SEQ ID NO: 154289 - DNA, 20 bp, Artificial Sequence
  Description of Artificial Sequence: Synthetic oligonucleotide
  Target: ATXN1; (+) strand; PAM type: NRG; PAM sequence: GGG
aacgctcttcacacttgaaa

SEQ ID NO: 154290 - DNA, 20 bp, Artificial Sequence
  Description of Artificial Sequence: Synthetic oligonucleotide
  Target: ATXN1; (+) strand; PAM type: NRG; PAM sequence: AAG
tcttcacacttgaaagggtt

SEQ ID NO: 154291 - DNA, 20 bp, Artificial Sequence
  Description of Artificial Sequence: Synthetic oligonucleotide
  Target: ATXN1; (+) strand; PAM type: NRG; PAM sequence: AAG
agggttaagtgactgactgc

SEQ ID NO: 154292 - DNA, 20 bp, Artificial Sequence
  Description of Artificial Sequence: Synthetic oligonucleotide
  Target: ATXN1; (+) strand; PAM type: NRG; PAM sequence: AGG
gggttaagtgactgactgca

SEQ ID NO: 154293 - DNA, 20 bp, Artificial Sequence
  Description of Artificial Sequence: Synthetic oligonucleotide
  Target: ATXN1; (+) strand; PAM type: NRG; PAM sequence: AAG
agtgactgactgcaaggcca

SEQ ID NO: 154294 - DNA, 20 bp, Artificial Sequence
  Description of Artificial Sequence: Synthetic oligonucleotide
  Target: ATXN1; (+) strand; PAM type: NRG; PAM sequence: AGG
gtgactgactgcaaggccaa

SEQ ID NO: 154295 - DNA, 20 bp, Artificial Sequence
  Description of Artificial Sequence: Synthetic oligonucleotide
  Target: ATXN1; (+) strand; PAM type: NRG; PAM sequence: CAG
gactgcaaggccaaaggcac

SEQ ID NO: 154296 - DNA, 20 bp, Artificial Sequence
  Description of Artificial Sequence: Synthetic oligonucleotide
  Target: ATXN1; (+) strand; PAM type: NRG; PAM sequence: AAG
ccaaaggcaccagactgcaa

SEQ ID NO: 154297 - DNA, 20 bp, Artificial Sequence
  Description of Artificial Sequence: Synthetic oligonucleotide
  Target: ATXN1; (+) strand; PAM type: NRG; PAM sequence: TAG
ctgcaaaagaaatgttgctt

SEQ ID NO: 154298 - DNA, 20 bp, Artificial Sequence
  Description of Artificial Sequence: Synthetic oligonucleotide
  Target: ATXN1; (+) strand; PAM type: NRG; PAM sequence: GAG
aaaagaaatgttgctttagt

SEQ ID NO: 154299 - DNA, 20 bp, Artificial Sequence
  Description of Artificial Sequence: Synthetic oligonucleotide
  Target: ATXN1; (+) strand; PAM type: NRG; PAM sequence: AAG
gttgctttagtgagctctga

SEQ ID NO: 154300 - DNA, 20 bp, Artificial Sequence
  Description of Artificial Sequence: Synthetic oligonucleotide
  Target: ATXN1; (+) strand; PAM type: NRG; PAM sequence: AGG
ttgctttagtgagctctgaa

SEQ ID NO: 154301 - DNA, 20 bp, Artificial Sequence
  Description of Artificial Sequence: Synthetic oligonucleotide
  Target: ATXN1; (+) strand; PAM type: NRG; PAM sequence: AAG
agctctgaaaggtttctaac

SEQ ID NO: 154302 - DNA, 20 bp, Artificial Sequence
  Description of Artificial Sequence: Synthetic oligonucleotide
  Target: ATXN1; (+) strand; PAM type: NRG; PAM sequence: CAG
gatctgttcacaataaacac

SEQ ID NO: 154303 - DNA, 20 bp, Artificial Sequence
  Description of Artificial Sequence: Synthetic oligonucleotide
  Target: ATXN1; (+) strand; PAM type: NRG; PAM sequence: CAG
ctgttcacaataaacaccag

SEQ ID NO: 154304 - DNA, 20 bp, Artificial Sequence
  Description of Artificial Sequence: Synthetic oligonucleotide
  Target: ATXN1; (+) strand; PAM type: NRG; PAM sequence: AGG
tgttcacaataaacaccagc

SEQ ID NO: 154305 - DNA, 20 bp, Artificial Sequence
  Description of Artificial Sequence: Synthetic oligonucleotide
  Target: ATXN1; (+) strand; PAM type: NRG; PAM sequence: CAG
ataaacaccagcaggattgt

SEQ ID NO: 154306 - DNA, 20 bp, Artificial Sequence
  Description of Artificial Sequence: Synthetic oligonucleotide
  Target: ATXN1; (+) strand; PAM type: NRG; PAM sequence: AGG
taaacaccagcaggattgtc

SEQ ID NO: 154307 - DNA, 20 bp, Artificial Sequence
  Description of Artificial Sequence: Synthetic oligonucleotide
  Target: ATXN1; (+) strand; PAM type: NRG; PAM sequence: TGG
gtcaggctcctttcactgtc

SEQ ID NO: 154308 - DNA, 20 bp, Artificial Sequence
  Description of Artificial Sequence: Synthetic oligonucleotide
  Target: ATXN1; (+) strand; PAM type: NRG; PAM sequence: GGG
tcaggctcctttcactgtct

SEQ ID NO: 154309 - DNA, 20 bp, Artificial Sequence
  Description of Artificial Sequence: Synthetic oligonucleotide
  Target: ATXN1; (+) strand; PAM type: NRG; PAM sequence: GGG
caggctcctttcactgtctg

SEQ ID NO: 154310 - DNA, 20 bp, Artificial Sequence
  Description of Artificial Sequence: Synthetic oligonucleotide
  Target: ATXN1; (+) strand; PAM type: NRG; PAM sequence: GAG
ggctcctttcactgtctggg

SEQ ID NO: 154311 - DNA, 20 bp, Artificial Sequence
  Description of Artificial Sequence: Synthetic oligonucleotide
  Target: ATXN1; (+) strand; PAM type: NRG; PAM sequence: TAG
atgcatttacatactgcacc

SEQ ID NO: 154312 - DNA, 20 bp, Artificial Sequence
  Description of Artificial Sequence: Synthetic oligonucleotide
  Target: ATXN1; (+) strand; PAM type: NRG; PAM sequence: AGG
tgcatttacatactgcacct

SEQ ID NO: 154313 - DNA, 20 bp, Artificial Sequence
  Description of Artificial Sequence: Synthetic oligonucleotide
  Target: ATXN1; (+) strand; PAM type: NRG; PAM sequence: AAG
atttacatactgcacctagg

SEQ ID NO: 154314 - DNA, 20 bp, Artificial Sequence
  Description of Artificial Sequence: Synthetic oligonucleotide
  Target: ATXN1; (+) strand; PAM type: NRG; PAM sequence: CAG
catactgcacctaggaagaa

SEQ ID NO: 154315 - DNA, 20 bp, Artificial Sequence
  Description of Artificial Sequence: Synthetic oligonucleotide
  Target: ATXN1; (+) strand; PAM type: NRG; PAM sequence: TGG
acctaggaagaacagcttgt

SEQ ID NO: 154316 - DNA, 20 bp, Artificial Sequence
  Description of Artificial Sequence: Synthetic oligonucleotide
  Target: ATXN1; (+) strand; PAM type: NRG; PAM sequence: AAG
cttgttggtctcctttataa

SEQ ID NO: 154317 - DNA, 20 bp, Artificial Sequence
  Description of Artificial Sequence: Synthetic oligonucleotide
  Target: ATXN1; (+) strand; PAM type: NRG; PAM sequence: GAG
tggtctcctttataaaagtt

SEQ ID NO: 154318 - DNA, 20 bp, Artificial Sequence
  Description of Artificial Sequence: Synthetic oligonucleotide
  Target: ATXN1; (+) strand; PAM type: NRG; PAM sequence: TAG
tctcctttataaaagttgag

SEQ ID NO: 154319 - DNA, 20 bp, Artificial Sequence
  Description of Artificial Sequence: Synthetic oligonucleotide
  Target: ATXN1; (+) strand; PAM type: NRG; PAM sequence: TAG
ctttataaaagttgagtagc

SEQ ID NO: 154320 - DNA, 20 bp, Artificial Sequence
  Description of Artificial Sequence: Synthetic oligonucleotide
  Target: ATXN1; (+) strand; PAM type: NRG; PAM sequence: AAG
tataaaagttgagtagctag

SEQ ID NO: 154321 - DNA, 20 bp, Artificial Sequence
  Description of Artificial Sequence: Synthetic oligonucleotide
  Target: ATXN1; (+) strand; PAM type: NRG; PAM sequence: CAG
gagtagctagaagcctcatt

SEQ ID NO: 154322 - DNA, 20 bp, Artificial Sequence
  Description of Artificial Sequence: Synthetic oligonucleotide
  Target: ATXN1; (+) strand; PAM type: NRG; PAM sequence: AAG
tctcccatccaaatgactga

SEQ ID NO: 154323 - DNA, 20 bp, Artificial Sequence
  Description of Artificial Sequence: Synthetic oligonucleotide
  Target: ATXN1; (+) strand; PAM type: NRG; PAM sequence: AAG
cccatccaaatgactgaaag

SEQ ID NO: 154324 - DNA, 20 bp, Artificial Sequence
  Description of Artificial Sequence: Synthetic oligonucleotide
  Target: ATXN1; (+) strand; PAM type: NRG; PAM sequence: TAG
gaaagaagatgcaattgaaa

SEQ ID NO: 154325 - DNA, 20 bp, Artificial Sequence
  Description of Artificial Sequence: Synthetic oligonucleotide
  Target: ATXN1; (+) strand; PAM type: NRG; PAM sequence: TGG
agaagatgcaattgaaatag

SEQ ID NO: 154326 - DNA, 20 bp, Artificial Sequence
  Description of Artificial Sequence: Synthetic oligonucleotide
  Target: ATXN1; (+) strand; PAM type: NRG; PAM sequence: GAG
aagatgcaattgaaatagtg

SEQ ID NO: 154327 - DNA, 20 bp, Artificial Sequence
  Description of Artificial Sequence: Synthetic oligonucleotide
  Target: ATXN1; (+) strand; PAM type: NRG; PAM sequence: TGG
aaatagtggagtctctcgtc

SEQ ID NO: 154328 - DNA, 20 bp, Artificial Sequence
  Description of Artificial Sequence: Synthetic oligonucleotide
  Target: ATXN1; (+) strand; PAM type: NRG; PAM sequence: TGG
gtggagtctctcgtctggct

SEQ ID NO: 154329 - DNA, 20 bp, Artificial Sequence
  Description of Artificial Sequence: Synthetic oligonucleotide
  Target: ATXN1; (+) strand; PAM type: NRG; PAM sequence: GGG
tggagtctctcgtctggctt

SEQ ID NO: 154330 - DNA, 20 bp, Artificial Sequence
  Description of Artificial Sequence: Synthetic oligonucleotide
  Target: ATXN1; (+) strand; PAM type: NRG; PAM sequence: CAG
agtctctcgtctggcttggg

SEQ ID NO: 154331 - DNA, 20 bp, Artificial Sequence
  Description of Artificial Sequence: Synthetic oligonucleotide
  Target: ATXN1; (+) strand; PAM type: NRG; PAM sequence: TGG
aatgctgtgcataaaacact

SEQ ID NO: 154332 - DNA, 20 bp, Artificial Sequence
  Description of Artificial Sequence: Synthetic oligonucleotide
  Target: ATXN1; (+) strand; PAM type: NRG; PAM sequence: GAG
tgctgtgcataaaacacttg

SEQ ID NO: 154333 - DNA, 20 bp, Artificial Sequence
  Description of Artificial Sequence: Synthetic oligonucleotide
  Target: ATXN1; (+) strand; PAM type: NRG; PAM sequence: TAG
tgtgcataaaacacttggag

SEQ ID NO: 154334 - DNA, 20 bp, Artificial Sequence
  Description of Artificial Sequence: Synthetic oligonucleotide
  Target: ATXN1; (+) strand; PAM type: NRG; PAM sequence: CAG
ataaaacacttggagtagtt

SEQ ID NO: 154335 - DNA, 20 bp, Artificial Sequence
  Description of Artificial Sequence: Synthetic oligonucleotide
  Target: ATXN1; (+) strand; PAM type: NRG; PAM sequence: AGG
taaaacacttggagtagttc

SEQ ID NO: 154336 - DNA, 20 bp, Artificial Sequence
  Description of Artificial Sequence: Synthetic oligonucleotide
  Target: ATXN1; (+) strand; PAM type: NRG; PAM sequence: AAG
acttggagtagttcaggcac

SEQ ID NO: 154337 - DNA, 20 bp, Artificial Sequence
  Description of Artificial Sequence: Synthetic oligonucleotide
  Target: ATXN1; (+) strand; PAM type: NRG; PAM sequence: TGG
acaagacaaacccacctgaa

SEQ ID NO: 154338 - DNA, 20 bp, Artificial Sequence
  Description of Artificial Sequence: Synthetic oligonucleotide
  Target: ATXN1; (+) strand; PAM type: NRG; PAM sequence: GAG
acaaacccacctgaatggac

SEQ ID NO: 154339 - DNA, 20 bp, Artificial Sequence
  Description of Artificial Sequence: Synthetic oligonucleotide
  Target: ATXN1; (+) strand; PAM type: NRG; PAM sequence: AGG
caaacccacctgaatggacg

SEQ ID NO: 154340 - DNA, 20 bp, Artificial Sequence
  Description of Artificial Sequence: Synthetic oligonucleotide
  Target: ATXN1; (+) strand; PAM type: NRG; PAM sequence: TGG
aggaacactgtctgttgcca

SEQ ID NO: 154341 - DNA, 20 bp, Artificial Sequence
  Description of Artificial Sequence: Synthetic oligonucleotide
  Target: ATXN1; (+) strand; PAM type: NRG; PAM sequence: CAG
aacactgtctgttgccatgg

SEQ ID NO: 154342 - DNA, 20 bp, Artificial Sequence
  Description of Artificial Sequence: Synthetic oligonucleotide
  Target: ATXN1; (+) strand; PAM type: NRG; PAM sequence: GAG
gcagcctgatctaattacat

SEQ ID NO: 154343 - DNA, 20 bp, Artificial Sequence
  Description of Artificial Sequence: Synthetic oligonucleotide
  Target: ATXN1; (+) strand; PAM type: NRG; PAM sequence: CAG
gatctaattacatgagtgat

SEQ ID NO: 154344 - DNA, 20 bp, Artificial Sequence
  Description of Artificial Sequence: Synthetic oligonucleotide
  Target: ATXN1; (+) strand; PAM type: NRG; PAM sequence: AGG
atctaattacatgagtgatc

SEQ ID NO: 154345 - DNA, 20 bp, Artificial Sequence
  Description of Artificial Sequence: Synthetic oligonucleotide
  Target: ATXN1; (+) strand; PAM type: NRG; PAM sequence: TGG
attacatgagtgatcaggac

SEQ ID NO: 154346 - DNA, 20 bp, Artificial Sequence
  Description of Artificial Sequence: Synthetic oligonucleotide
  Target: ATXN1; (+) strand; PAM type: NRG; PAM sequence: GAG
tacatgagtgatcaggactg

SEQ ID NO: 154347 - DNA, 20 bp, Artificial Sequence
  Description of Artificial Sequence: Synthetic oligonucleotide
  Target: ATXN1; (+) strand; PAM type: NRG; PAM sequence: AAG
tgagtgatcaggactggagt

SEQ ID NO: 154348 - DNA, 20 bp, Artificial Sequence
  Description of Artificial Sequence: Synthetic oligonucleotide
  Target: ATXN1; (+) strand; PAM type: NRG; PAM sequence: CAG
ccgaaaacctacaccactga

SEQ ID NO: 154349 - DNA, 20 bp, Artificial Sequence
  Description of Artificial Sequence: Synthetic oligonucleotide
  Target: ATXN1; (+) strand; PAM type: NRG; PAM sequence: AGG
cgaaaacctacaccactgac

SEQ ID NO: 154350 - DNA, 20 bp, Artificial Sequence
  Description of Artificial Sequence: Synthetic oligonucleotide
  Target: ATXN1; (+) strand; PAM type: NRG; PAM sequence: CAG
aaacctacaccactgacagg

SEQ ID NO: 154351 - DNA, 20 bp, Artificial Sequence
  Description of Artificial Sequence: Synthetic oligonucleotide
  Target: ATXN1; (+) strand; PAM type: NRG; PAM sequence: CAG
ctacaccactgacaggcagc

SEQ ID NO: 154352 - DNA, 20 bp, Artificial Sequence
  Description of Artificial Sequence: Synthetic oligonucleotide
  Target: ATXN1; (+) strand; PAM type: NRG; PAM sequence: AGG
tacaccactgacaggcagcc

SEQ ID NO: 154353 - DNA, 20 bp, Artificial Sequence
  Description of Artificial Sequence: Synthetic oligonucleotide
  Target: ATXN1; (+) strand; PAM type: NRG; PAM sequence: GAG
caccactgacaggcagccag

SEQ ID NO: 154354 - DNA, 20 bp, Artificial Sequence
  Description of Artificial Sequence: Synthetic oligonucleotide
  Target: ATXN1; (+) strand; PAM type: NRG; PAM sequence: AGG
accactgacaggcagccagg

SEQ ID NO: 154355 - DNA, 20 bp, Artificial Sequence
  Description of Artificial Sequence: Synthetic oligonucleotide
  Target: ATXN1; (+) strand; PAM type: NRG; PAM sequence: CAG
tgacaggcagccaggaggtt

SEQ ID NO: 154356 - DNA, 20 bp, Artificial Sequence
  Description of Artificial Sequence: Synthetic oligonucleotide
  Target: ATXN1; (+) strand; PAM type: NRG; PAM sequence: AGG
gacaggcagccaggaggttc

SEQ ID NO: 154357 - DNA, 20 bp, Artificial Sequence
  Description of Artificial Sequence: Synthetic oligonucleotide
  Target: ATXN1; (+) strand; PAM type: NRG; PAM sequence: GGG
acaggcagccaggaggttca

SEQ ID NO: 154358 - DNA, 20 bp, Artificial Sequence
  Description of Artificial Sequence: Synthetic oligonucleotide
  Target: ATXN1; (+) strand; PAM type: NRG; PAM sequence: GGG
caggcagccaggaggttcag

SEQ ID NO: 154359 - DNA, 20 bp, Artificial Sequence
  Description of Artificial Sequence: Synthetic oligonucleotide
  Target: ATXN1; (+) strand; PAM type: NRG; PAM sequence: GAG
ggcagccaggaggttcaggg

SEQ ID NO: 154360 - DNA, 20 bp, Artificial Sequence
  Description of Artificial Sequence: Synthetic oligonucleotide
  Target: ATXN1; (+) strand; PAM type: NRG; PAM sequence: TAG
ccttcaacctctgctttatg

SEQ ID NO: 154361 - DNA, 20 bp, Artificial Sequence
  Description of Artificial Sequence: Synthetic oligonucleotide
  Target: ATXN1; (+) strand; PAM type: NRG; PAM sequence: AAG
tcaacctctgctttatgtag

SEQ ID NO: 154362 - DNA, 20 bp, Artificial Sequence
  Description of Artificial Sequence: Synthetic oligonucleotide
  Target: ATXN1; (+) strand; PAM type: NRG; PAM sequence: TGG
cctctgctttatgtagaaga

SEQ ID NO: 154363 - DNA, 20 bp, Artificial Sequence
  Description of Artificial Sequence: Synthetic oligonucleotide
  Target: ATXN1; (+) strand; PAM type: NRG; PAM sequence: AAG
ttatgtagaagatggcattc

SEQ ID NO: 154364 - DNA, 20 bp, Artificial Sequence
  Description of Artificial Sequence: Synthetic oligonucleotide
  Target: ATXN1; (+) strand; PAM type: NRG; PAM sequence: CGG
cattcaagtccatttatttg

SEQ ID NO: 154365 - DNA, 20 bp, Artificial Sequence
  Description of Artificial Sequence: Synthetic oligonucleotide
  Target: ATXN1; (+) strand; PAM type: NRG; PAM sequence: GAG
ttcaagtccatttatttgcg

SEQ ID NO: 154366 - DNA, 20 bp, Artificial Sequence
  Description of Artificial Sequence: Synthetic oligonucleotide
  Target: ATXN1; (+) strand; PAM type: NRG; PAM sequence: CAG
aatattgactgatgcatgca

SEQ ID NO: 154367 - DNA, 20 bp, Artificial Sequence
  Description of Artificial Sequence: Synthetic oligonucleotide
  Target: ATXN1; (+) strand; PAM type: NRG; PAM sequence: GAG
ttgactgatgcatgcacagt

SEQ ID NO: 154368 - DNA, 20 bp, Artificial Sequence
  Description of Artificial Sequence: Synthetic oligonucleotide
  Target: ATXN1; (+) strand; PAM type: NRG; PAM sequence: GAG
gactgatgcatgcacagtga

SEQ ID NO: 154369 - DNA, 20 bp, Artificial Sequence
  Description of Artificial Sequence: Synthetic oligonucleotide
  Target: ATXN1; (+) strand; PAM type: NRG; PAM sequence: AGG
actgatgcatgcacagtgag

SEQ ID NO: 154370 - DNA, 20 bp, Artificial Sequence
  Description of Artificial Sequence: Synthetic oligonucleotide
  Target: ATXN1; (+) strand; PAM type: NRG; PAM sequence: GGG
ctgatgcatgcacagtgaga

SEQ ID NO: 154371 - DNA, 20 bp, Artificial Sequence
  Description of Artificial Sequence: Synthetic oligonucleotide
  Target: ATXN1; (+) strand; PAM type: NRG; PAM sequence: CAG
atgcacagtgagagggcaat

SEQ ID NO: 154372 - DNA, 20 bp, Artificial Sequence
  Description of Artificial Sequence: Synthetic oligonucleotide
  Target: ATXN1; (+) strand; PAM type: NRG; PAM sequence: GAG
gcacagtgagagggcaatca

SEQ ID NO: 154373 - DNA, 20 bp, Artificial Sequence
  Description of Artificial Sequence: Synthetic oligonucleotide
  Target: ATXN1; (+) strand; PAM type: NRG; PAM sequence: AGG
cacagtgagagggcaatcag

SEQ ID NO: 154374 - DNA, 20 bp, Artificial Sequence
  Description of Artificial Sequence: Synthetic oligonucleotide
  Target: ATXN1; (+) strand; PAM type: NRG; PAM sequence: GAG
cagtgagagggcaatcagag

SEQ ID NO: 154375 - DNA, 20 bp, Artificial Sequence
  Description of Artificial Sequence: Synthetic oligonucleotide
  Target: ATXN1; (+) strand; PAM type: NRG; PAM sequence: CAG
tcagaggagattaaatgcca

SEQ ID NO: 154376 - DNA, 20 bp, Artificial Sequence
  Description of Artificial Sequence: Synthetic oligonucleotide
  Target: ATXN1; (+) strand; PAM type: NRG; PAM sequence: TAG
gagattaaatgccacagcgc

SEQ ID NO: 154377 - DNA, 20 bp, Artificial Sequence
  Description of Artificial Sequence: Synthetic oligonucleotide
  Target: ATXN1; (+) strand; PAM type: NRG; PAM sequence: TGG
tgccacagcgctagccgtta

SEQ ID NO: 154378 - DNA, 20 bp, Artificial Sequence
  Description of Artificial Sequence: Synthetic oligonucleotide
  Target: ATXN1; (+) strand; PAM type: NRG; PAM sequence: AAG
ttatggtgcaatccctttcc

SEQ ID NO: 154379 - DNA, 20 bp, Artificial Sequence
  Description of Artificial Sequence: Synthetic oligonucleotide
  Target: ATXN1; (+) strand; PAM type: NRG; PAM sequence: GAG
atggtgcaatccctttccaa

SEQ ID NO: 154380 - DNA, 20 bp, Artificial Sequence
  Description of Artificial Sequence: Synthetic oligonucleotide
  Target: ATXN1; (+) strand; PAM type: NRG; PAM sequence: CAG
cctttccaagagttcctgtg

SEQ ID NO: 154381 - DNA, 20 bp, Artificial Sequence
  Description of Artificial Sequence: Synthetic oligonucleotide
  Target: ATXN1; (+) strand; PAM type: NRG; PAM sequence: AGG
ctttccaagagttcctgtgc

SEQ ID NO: 154382 - DNA, 20 bp, Artificial Sequence
  Description of Artificial Sequence: Synthetic oligonucleotide
  Target: ATXN1; (+) strand; PAM type: NRG; PAM sequence: TGG
gcaggattttctcttctctc

SEQ ID NO: 154383 - DNA, 20 bp, Artificial Sequence
  Description of Artificial Sequence: Synthetic oligonucleotide
  Target: ATXN1; (+) strand; PAM type: NRG; PAM sequence: TGG
ggattttctcttctctctgg

SEQ ID NO: 154384 - DNA, 20 bp, Artificial Sequence
  Description of Artificial Sequence: Synthetic oligonucleotide
  Target: ATXN1; (+) strand; PAM type: NRG; PAM sequence: CAG
cttctctctggtggtttcct

SEQ ID NO: 154385 - DNA, 20 bp, Artificial Sequence
  Description of Artificial Sequence: Synthetic oligonucleotide
  Target: ATXN1; (+) strand; PAM type: NRG; PAM sequence: AAG
ctggtggtttcctcagacat

SEQ ID NO: 154386 - DNA, 20 bp, Artificial Sequence
  Description of Artificial Sequence: Synthetic oligonucleotide
  Target: ATXN1; (+) strand; PAM type: NRG; PAM sequence: AAG
cataagcttcactccaaaaa

SEQ ID NO: 154387 - DNA, 20 bp, Artificial Sequence
  Description of Artificial Sequence: Synthetic oligonucleotide
  Target: ATXN1; (+) strand; PAM type: NRG; PAM sequence: AAG
cttcactccaaaaaaagctc

SEQ ID NO: 154388 - DNA, 20 bp, Artificial Sequence
  Description of Artificial Sequence: Synthetic oligonucleotide
  Target: ATXN1; (+) strand; PAM type: NRG; PAM sequence: AAG
tttacccatcaaataaaccg

SEQ ID NO: 154389 - DNA, 20 bp, Artificial Sequence
  Description of Artificial Sequence: Synthetic oligonucleotide
  Target: ATXN1; (+) strand; PAM type: NRG; PAM sequence: AGG
ttacccatcaaataaaccga

SEQ ID NO: 154390 - DNA, 20 bp, Artificial Sequence
  Description of Artificial Sequence: Synthetic oligonucleotide
  Target: ATXN1; (+) strand; PAM type: NRG; PAM sequence: GGG
tacccatcaaataaaccgaa

SEQ ID NO: 154391 - DNA, 20 bp, Artificial Sequence
  Description of Artificial Sequence: Synthetic oligonucleotide
  Target: ATXN1; (+) strand; PAM type: NRG; PAM sequence: TGG
ccatcaaataaaccgaaggg

SEQ ID NO: 154392 - DNA, 20 bp, Artificial Sequence
  Description of Artificial Sequence: Synthetic oligonucleotide
  Target: ATXN1; (+) strand; PAM type: NRG; PAM sequence: GGG
catcaaataaaccgaagggt

SEQ ID NO: 154393 - DNA, 20 bp, Artificial Sequence
  Description of Artificial Sequence: Synthetic oligonucleotide
  Target: ATXN1; (+) strand; PAM type: NRG; PAM sequence: AAG
ataaaccgaagggtgggctt

SEQ ID NO: 154394 - DNA, 20 bp, Artificial Sequence
  Description of Artificial Sequence: Synthetic oligonucleotide
  Target: ATXN1; (+) strand; PAM type: NRG; PAM sequence: AGG
taaaccgaagggtgggctta

SEQ ID NO: 154395 - DNA, 20 bp, Artificial Sequence
  Description of Artificial Sequence: Synthetic oligonucleotide
  Target: ATXN1; (+) strand; PAM type: NRG; PAM sequence: GGG
aaaccgaagggtgggcttaa

SEQ ID NO: 154396 - DNA, 20 bp, Artificial Sequence
  Description of Artificial Sequence: Synthetic oligonucleotide
  Target: ATXN1; (+) strand; PAM type: NRG; PAM sequence: GGG
aaccgaagggtgggcttaag

SEQ ID NO: 154397 - DNA, 20 bp, Artificial Sequence
  Description of Artificial Sequence: Synthetic oligonucleotide
  Target: ATXN1; (+) strand; PAM type: NRG; PAM sequence: GGG
accgaagggtgggcttaagg

SEQ ID NO: 154398 - DNA, 20 bp, Artificial Sequence
  Description of Artificial Sequence: Synthetic oligonucleotide
  Target: ATXN1; (+) strand; PAM type: NRG; PAM sequence: GGG
ccgaagggtgggcttaaggg

SEQ ID NO: 154399 - DNA, 20 bp, Artificial Sequence
  Description of Artificial Sequence: Synthetic oligonucleotide
  Target: ATXN1; (+) strand; PAM type: NRG; PAM sequence: TAG
gtgggcttaaggggggcttc

SEQ ID NO: 154400 - DNA, 20 bp, Artificial Sequence
  Description of Artificial Sequence: Synthetic oligonucleotide
  Target: ATXN1; (+) strand; PAM type: NRG; PAM sequence: AGG
tgggcttaaggggggcttct

SEQ ID NO: 154401 - DNA, 20 bp, Artificial Sequence
  Description of Artificial Sequence: Synthetic oligonucleotide
  Target: ATXN1; (+) strand; PAM type: NRG; PAM sequence: CAG
aggggggcttctaggaactg

SEQ ID NO: 154402 - DNA, 20 bp, Artificial Sequence
  Description of Artificial Sequence: Synthetic oligonucleotide
  Target: ATXN1; (+) strand; PAM type: NRG; PAM sequence: CAG
agcctcctaaaaaacccaaa

SEQ ID NO: 154403 - DNA, 20 bp, Artificial Sequence
  Description of Artificial Sequence: Synthetic oligonucleotide
  Target: ATXN1; (+) strand; PAM type: NRG; PAM sequence: CAG
aaacccaaacagaaatgtct

SEQ ID NO: 154404 - DNA, 20 bp, Artificial Sequence
  Description of Artificial Sequence: Synthetic oligonucleotide
  Target: ATXN1; (+) strand; PAM type: NRG; PAM sequence: AAG
ctcagctaacactgttgaaa

SEQ ID NO: 154405 - DNA, 20 bp, Artificial Sequence
  Description of Artificial Sequence: Synthetic oligonucleotide
  Target: ATXN1; (+) strand; PAM type: NRG; PAM sequence: TAG
aacactgttgaaaaagtaac

SEQ ID NO: 154406 - DNA, 20 bp, Artificial Sequence
  Description of Artificial Sequence: Synthetic oligonucleotide
  Target: ATXN1; (+) strand; PAM type: NRG; PAM sequence: AAG
agctgtgcctaaaaataacc

SEQ ID NO: 154407 - DNA, 20 bp, Artificial Sequence
  Description of Artificial Sequence: Synthetic oligonucleotide
  Target: ATXN1; (+) strand; PAM type: NRG; PAM sequence: CAG
tgatgtttaaatattaaaaa

SEQ ID NO: 154408 - DNA, 20 bp, Artificial Sequence
  Description of Artificial Sequence: Synthetic oligonucleotide
  Target: ATXN1; (+) strand; PAM type: NRG; PAM sequence: GAG
tataaaacacaaatgtcatt

SEQ ID NO: 154409 - DNA, 20 bp, Artificial Sequence
  Description of Artificial Sequence: Synthetic oligonucleotide
  Target: ATXN1; (+) strand; PAM type: NRG; PAM sequence: TAG
tgtcattgagatgtgactac

SEQ ID NO: 154410 - DNA, 20 bp, Artificial Sequence
  Description of Artificial Sequence: Synthetic oligonucleotide
  Target: ATXN1; (+) strand; PAM type: NRG; PAM sequence: AAG
atgtgactactagattgcca

SEQ ID NO: 154411 - DNA, 20 bp, Artificial Sequence
  Description of Artificial Sequence: Synthetic oligonucleotide
  Target: ATXN1; (+) strand; PAM type: NRG; PAM sequence: AGG
tgtgactactagattgccaa

SEQ ID NO: 154412 - DNA, 20 bp, Artificial Sequence
  Description of Artificial Sequence: Synthetic oligonucleotide
  Target: ATXN1; (+) strand; PAM type: NRG; PAM sequence: GAG
tgactactagattgccaaag

SEQ ID NO: 154413 - DNA, 20 bp, Artificial Sequence
  Description of Artificial Sequence: Synthetic oligonucleotide
  Target: ATXN1; (+) strand; PAM type: NRG; PAM sequence: CAG
acattcccgtgcatgcacga

SEQ ID NO: 154414 - DNA, 20 bp, Artificial Sequence
  Description of Artificial Sequence: Synthetic oligonucleotide
  Target: ATXN1; (+) strand; PAM type: NRG; PAM sequence: AGG
cattcccgtgcatgcacgac

SEQ ID NO: 154415 - DNA, 20 bp, Artificial Sequence
  Description of Artificial Sequence: Synthetic oligonucleotide
  Target: ATXN1; (+) strand; PAM type: NRG; PAM sequence: CAG
tgcatgcacgacaggatgtg

SEQ ID NO: 154416 - DNA, 20 bp, Artificial Sequence
  Description of Artificial Sequence: Synthetic oligonucleotide
  Target: ATXN1; (+) strand; PAM type: NRG; PAM sequence: AGG
gcatgcacgacaggatgtgc

SEQ ID NO: 154417 - DNA, 20 bp, Artificial Sequence
  Description of Artificial Sequence: Synthetic oligonucleotide
  Target: ATXN1; (+) strand; PAM type: NRG; PAM sequence: GGG
catgcacgacaggatgtgca

SEQ ID NO: 154418 - DNA, 20 bp, Artificial Sequence
  Description of Artificial Sequence: Synthetic oligonucleotide
  Target: ATXN1; (+) strand; PAM type: NRG; PAM sequence: GAG
tgcacgacaggatgtgcagg

SEQ ID NO: 154419 - DNA, 20 bp, Artificial Sequence
  Description of Artificial Sequence: Synthetic oligonucleotide
  Target: ATXN1; (+) strand; PAM type: NRG; PAM sequence: AAG
cgacaggatgtgcagggaga

SEQ ID NO: 154420 - DNA, 20 bp, Artificial Sequence
  Description of Artificial Sequence: Synthetic oligonucleotide
  Target: ATXN1; (+) strand; PAM type: NRG; PAM sequence: AAG
tgcagggagaaagccactgt

SEQ ID NO: 154421 - DNA, 20 bp, Artificial Sequence
  Description of Artificial Sequence: Synthetic oligonucleotide
  Target: ATXN1; (+) strand; PAM type: NRG; PAM sequence: AGG
gcagggagaaagccactgta

SEQ ID NO: 154422 - DNA, 20 bp, Artificial Sequence
  Description of Artificial Sequence: Synthetic oligonucleotide
  Target: ATXN1; (+) strand; PAM type: NRG; PAM sequence: TAG
agaaagccactgtaaggcat

SEQ ID NO: 154423 - DNA, 20 bp, Artificial Sequence
  Description of Artificial Sequence: Synthetic oligonucleotide
  Target: ATXN1; (+) strand; PAM type: NRG; PAM sequence: TGG
aggcattagtttttattctg

SEQ ID NO: 154424 - DNA, 20 bp, Artificial Sequence
  Description of Artificial Sequence: Synthetic oligonucleotide
  Target: ATXN1; (+) strand; PAM type: NRG; PAM sequence: GGG
ggcattagtttttattctgt

SEQ ID NO: 154425 - DNA, 20 bp, Artificial Sequence
  Description of Artificial Sequence: Synthetic oligonucleotide
  Target: ATXN1; (+) strand; PAM type: NRG; PAM sequence: TAG
tttttattctgtgggtgtaa

SEQ ID NO: 154426 - DNA, 20 bp, Artificial Sequence
  Description of Artificial Sequence: Synthetic oligonucleotide
  Target: ATXN1; (+) strand; PAM type: NRG; PAM sequence: AGG
ttttattctgtgggtgtaat

SEQ ID NO: 154427 - DNA, 20 bp, Artificial Sequence
  Description of Artificial Sequence: Synthetic oligonucleotide
  Target: ATXN1; (+) strand; PAM type: NRG; PAM sequence: GGG
tttattctgtgggtgtaata

SEQ ID NO: 154428 - DNA, 20 bp, Artificial Sequence
  Description of Artificial Sequence: Synthetic oligonucleotide
  Target: ATXN1; (+) strand; PAM type: NRG; PAM sequence: TGG
attttgctaattgtatcctg

SEQ ID NO: 154429 - DNA, 20 bp, Artificial Sequence
  Description of Artificial Sequence: Synthetic oligonucleotide
  Target: ATXN1; (+) strand; PAM type: NRG; PAM sequence: CAG
attgtatcctgtggatctcg

SEQ ID NO: 154430 - DNA, 20 bp, Artificial Sequence
  Description of Artificial Sequence: Synthetic oligonucleotide
  Target: ATXN1; (+) strand; PAM type: NRG; PAM sequence: AGG
ttgtatcctgtggatctcgc

SEQ ID NO: 154431 - DNA, 20 bp, Artificial Sequence
  Description of Artificial Sequence: Synthetic oligonucleotide
  Target: ATXN1; (+) strand; PAM type: NRG; PAM sequence: GGG
tgtatcctgtggatctcgca

SEQ ID NO: 154432 - DNA, 20 bp, Artificial Sequence
  Description of Artificial Sequence: Synthetic oligonucleotide
  Target: ATXN1; (+) strand; PAM type: NRG; PAM sequence: AAG
atcctgtggatctcgcaggg

SEQ ID NO: 154433 - DNA, 20 bp, Artificial Sequence
  Description of Artificial Sequence: Synthetic oligonucleotide
  Target: ATXN1; (+) strand; PAM type: NRG; PAM sequence: AAG
gtggatctcgcagggaagct

SEQ ID NO: 154434 - DNA, 20 bp, Artificial Sequence
  Description of Artificial Sequence: Synthetic oligonucleotide
  Target: ATXN1; (+) strand; PAM type: NRG; PAM sequence: CGG
agggaagctaagaatctctt

SEQ ID NO: 154435 - DNA, 20 bp, Artificial Sequence
  Description of Artificial Sequence: Synthetic oligonucleotide
  Target: ATXN1; (+) strand; PAM type: NRG; PAM sequence: GGG
gggaagctaagaatctcttc

SEQ ID NO: 154436 - DNA, 20 bp, Artificial Sequence
  Description of Artificial Sequence: Synthetic oligonucleotide
  Target: ATXN1; (+) strand; PAM type: NRG; PAM sequence: GGG
ggaagctaagaatctcttcg

SEQ ID NO: 154437 - DNA, 20 bp, Artificial Sequence
  Description of Artificial Sequence: Synthetic oligonucleotide
  Target: ATXN1; (+) strand; PAM type: NRG; PAM sequence: CAG
gctaagaatctcttcgggga

SEQ ID NO: 154438 - DNA, 20 bp, Artificial Sequence
  Description of Artificial Sequence: Synthetic oligonucleotide
  Target: ATXN1; (+) strand; PAM type: NRG; PAM sequence: CAG
aatctcttcggggacagaac

SEQ ID NO: 154439 - DNA, 20 bp, Artificial Sequence
  Description of Artificial Sequence: Synthetic oligonucleotide
  Target: ATXN1; (+) strand; PAM type: NRG; PAM sequence: TGG
cttcggggacagaaccagtt

SEQ ID NO: 154440 - DNA, 20 bp, Artificial Sequence
  Description of Artificial Sequence: Synthetic oligonucleotide
  Target: ATXN1; (+) strand; PAM type: NRG; PAM sequence: GAG
tcggggacagaaccagtttg

SEQ ID NO: 154441 - DNA, 20 bp, Artificial Sequence
  Description of Artificial Sequence: Synthetic oligonucleotide
  Target: ATXN1; (+) strand; PAM type: NRG; PAM sequence: AGG
cggggacagaaccagtttgg

SEQ ID NO: 154442 - DNA, 20 bp, Artificial Sequence
  Description of Artificial Sequence: Synthetic oligonucleotide
  Target: ATXN1; (+) strand; PAM type: NRG; PAM sequence: GAG
gggacagaaccagtttggag

SEQ ID NO: 154443 - DNA, 20 bp, Artificial Sequence
  Description of Artificial Sequence: Synthetic oligonucleotide
  Target: ATXN1; (+) strand; PAM type: NRG; PAM sequence: CAG
ttggaggagtccctactgca

SEQ ID NO: 154444 - DNA, 20 bp, Artificial Sequence
  Description of Artificial Sequence: Synthetic oligonucleotide
  Target: ATXN1; (+) strand; PAM type: NRG; PAM sequence: CGG
agtccctactgcacagcata

SEQ ID NO: 154445 - DNA, 20 bp, Artificial Sequence
  Description of Artificial Sequence: Synthetic oligonucleotide
  Target: ATXN1; (+) strand; PAM type: NRG; PAM sequence: TAG
tacggtaaacaaaataaaaa

SEQ ID NO: 154446 - DNA, 20 bp, Artificial Sequence
  Description of Artificial Sequence: Synthetic oligonucleotide
  Target: ATXN1; (+) strand; PAM type: NRG; PAM sequence: TAG
aaatagcttgcctttcttgt

SEQ ID NO: 154447 - DNA, 20 bp, Artificial Sequence
  Description of Artificial Sequence: Synthetic oligonucleotide
  Target: ATXN1; (+) strand; PAM type: NRG; PAM sequence: CAG
cacatcgcgcattatataac

SEQ ID NO: 154448 - DNA, 20 bp, Artificial Sequence
  Description of Artificial Sequence: Synthetic oligonucleotide
  Target: ATXN1; (+) strand; PAM type: NRG; PAM sequence: CAG
tttttgcccttactactctt

SEQ ID NO: 154449 - DNA, 20 bp, Artificial Sequence
  Description of Artificial Sequence: Synthetic oligonucleotide
  Target: ATXN1; (+) strand; PAM type: NRG; PAM sequence: TAG
ttatattacccttttatctg

SEQ ID NO: 154450 - DNA, 20 bp, Artificial Sequence
  Description of Artificial Sequence: Synthetic oligonucleotide
  Target: ATXN1; (+) strand; PAM type: NRG; PAM sequence: AGG
tatattacccttttatctgt

SEQ ID NO: 154451 - DNA, 20 bp, Artificial Sequence
  Description of Artificial Sequence: Synthetic oligonucleotide
  Target: ATXN1; (+) strand; PAM type: NRG; PAM sequence: AAG
tatctgtaggattatatacc

SEQ ID NO: 154452 - DNA, 20 bp, Artificial Sequence
  Description of Artificial Sequence: Synthetic oligonucleotide
  Target: ATXN1; (+) strand; PAM type: NRG; PAM sequence: AAG
tgtaggattatataccaaga

SEQ ID NO: 154453 - DNA, 20 bp, Artificial Sequence
  Description of Artificial Sequence: Synthetic oligonucleotide
  Target: ATXN1; (+) strand; PAM type: NRG; PAM sequence: CAG
accaagaaagcaaaacaaaa

SEQ ID NO: 154454 - DNA, 20 bp, Artificial Sequence
  Description of Artificial Sequence: Synthetic oligonucleotide
  Target: ATXN1; (+) strand; PAM type: NRG; PAM sequence: GAG
caagaaagcaaaacaaaaca

SEQ ID NO: 154455 - DNA, 20 bp, Artificial Sequence
  Description of Artificial Sequence: Synthetic oligonucleotide
  Target: ATXN1; (+) strand; PAM type: NRG; PAM sequence: CAG
gaaagcaaaacaaaacagag

SEQ ID NO: 154456 - DNA, 20 bp, Artificial Sequence
  Description of Artificial Sequence: Synthetic oligonucleotide
  Target: ATXN1; (+) strand; PAM type: NRG; PAM sequence: CGG
aaaacaaaacagagcagcca

SEQ ID NO: 154457 - DNA, 20 bp, Artificial Sequence
  Description of Artificial Sequence: Synthetic oligonucleotide
  Target: ATXN1; (+) strand; PAM type: NRG; PAM sequence: GGG
aaacaaaacagagcagccac

SEQ ID NO: 154458 - DNA, 20 bp, Artificial Sequence
  Description of Artificial Sequence: Synthetic oligonucleotide
  Target: ATXN1; (+) strand; PAM type: NRG; PAM sequence: TAG
aaccgaatccccgccgtcct

SEQ ID NO: 154459 - DNA, 20 bp, Artificial Sequence
  Description of Artificial Sequence: Synthetic oligonucleotide
  Target: ATXN1; (+) strand; PAM type: NRG; PAM sequence: CGG
atccccgccgtccttagaaa

SEQ ID NO: 154460 - DNA, 20 bp, Artificial Sequence
  Description of Artificial Sequence: Synthetic oligonucleotide
  Target: ATXN1; (+) strand; PAM type: NRG; PAM sequence: TGG
ttttgttttgttttgttttc

SEQ ID NO: 154461 - DNA, 20 bp, Artificial Sequence
  Description of Artificial Sequence: Synthetic oligonucleotide
  Target: ATXN1; (+) strand; PAM type: NRG; PAM sequence: CAG
tgttttgttttgttttctgg

SEQ ID NO: 154462 - DNA, 20 bp, Artificial Sequence
  Description of Artificial Sequence: Synthetic oligonucleotide
  Target: ATXN1; (+) strand; PAM type: NRG; PAM sequence: GAG
ttttgttttgttttctggca

SEQ ID NO: 154463 - DNA, 20 bp, Artificial Sequence
  Description of Artificial Sequence: Synthetic oligonucleotide
  Target: ATXN1; (+) strand; PAM type: NRG; PAM sequence: AAG
accctacttccacccccact

SEQ ID NO: 154464 - DNA, 20 bp, Artificial Sequence
  Description of Artificial Sequence: Synthetic oligonucleotide
  Target: ATXN1; (+) strand; PAM type: NRG; PAM sequence: AGG
ccctacttccacccccacta

SEQ ID NO: 154465 - DNA, 20 bp, Artificial Sequence
  Description of Artificial Sequence: Synthetic oligonucleotide
  Target: ATXN1; (+) strand; PAM type: NRG; PAM sequence: TAG
aggttcttgctcaatctccc

SEQ ID NO: 154466 - DNA, 20 bp, Artificial Sequence
  Description of Artificial Sequence: Synthetic oligonucleotide
  Target: ATXN1; (+) strand; PAM type: NRG; PAM sequence: CAG
ctgaattgtttcatcccttt

SEQ ID NO: 154467 - DNA, 20 bp, Artificial Sequence
  Description of Artificial Sequence: Synthetic oligonucleotide
  Target: ATXN1; (+) strand; PAM type: NRG; PAM sequence: CAG
attgtttcatccctttcagt

SEQ ID NO: 154468 - DNA, 20 bp, Artificial Sequence
  Description of Artificial Sequence: Synthetic oligonucleotide
  Target: ATXN1; (+) strand; PAM type: NRG; PAM sequence: TGG
ctttcagtcagccccctacg

SEQ ID NO: 154469 - DNA, 20 bp, Artificial Sequence
  Description of Artificial Sequence: Synthetic oligonucleotide
  Target: ATXN1; (+) strand; PAM type: NRG; PAM sequence: AAG
cgtggtctgaaacaaaatga

SEQ ID NO: 154470 - DNA, 20 bp, Artificial Sequence
  Description of Artificial Sequence: Synthetic oligonucleotide
  Target: ATXN1; (+) strand; PAM type: NRG; PAM sequence: AAG
ctgaaacaaaatgaaagcac

SEQ ID NO: 154471 - DNA, 20 bp, Artificial Sequence
  Description of Artificial Sequence: Synthetic oligonucleotide
  Target: ATXN1; (+) strand; PAM type: NRG; PAM sequence: CGG
caaaatgaaagcacaagcca

SEQ ID NO: 154472 - DNA, 20 bp, Artificial Sequence
  Description of Artificial Sequence: Synthetic oligonucleotide
  Target: ATXN1; (+) strand; PAM type: NRG; PAM sequence: GAG
aaatgaaagcacaagccacg

SEQ ID NO: 154473 - DNA, 20 bp, Artificial Sequence
  Description of Artificial Sequence: Synthetic oligonucleotide
  Target: ATXN1; (+) strand; PAM type: NRG; PAM sequence: AAG
aagcacaagccacggagttt

SEQ ID NO: 154474 - DNA, 20 bp, Artificial Sequence
  Description of Artificial Sequence: Synthetic oligonucleotide
  Target: ATXN1; (+) strand; PAM type: NRG; PAM sequence: AAG
cacaagccacggagtttaag

SEQ ID NO: 154475 - DNA, 20 bp, Artificial Sequence
  Description of Artificial Sequence: Synthetic oligonucleotide
  Target: ATXN1; (+) strand; PAM type: NRG; PAM sequence: AGG
acaagccacggagtttaaga

SEQ ID NO: 154476 - DNA, 20 bp, Artificial Sequence
  Description of Artificial Sequence: Synthetic oligonucleotide
  Target: ATXN1; (+) strand; PAM type: NRG; PAM sequence: CAG
agccacggagtttaagaagg

SEQ ID NO: 154477 - DNA, 20 bp, Artificial Sequence
  Description of Artificial Sequence: Synthetic oligonucleotide
  Target: ATXN1; (+) strand; PAM type: NRG; PAM sequence: AAG
gagtttaagaaggcagcctg

SEQ ID NO: 154478 - DNA, 20 bp, Artificial Sequence
  Description of Artificial Sequence: Synthetic oligonucleotide
  Target: ATXN1; (+) strand; PAM type: NRG; PAM sequence: AGG
agtttaagaaggcagcctga

SEQ ID NO: 154479 - DNA, 20 bp, Artificial Sequence
  Description of Artificial Sequence: Synthetic oligonucleotide
  Target: ATXN1; (+) strand; PAM type: NRG; PAM sequence: CGG
ttaagaaggcagcctgaagg

SEQ ID NO: 154480 - DNA, 20 bp, Artificial Sequence
  Description of Artificial Sequence: Synthetic oligonucleotide
  Target: ATXN1; (+) strand; PAM type: NRG; PAM sequence: GGG
taagaaggcagcctgaaggc

SEQ ID NO: 154481 - DNA, 20 bp, Artificial Sequence
  Description of Artificial Sequence: Synthetic oligonucleotide
  Target: ATXN1; (+) strand; PAM type: NRG; PAM sequence: GGG
aagaaggcagcctgaaggcg

SEQ ID NO: 154482 - DNA, 20 bp, Artificial Sequence
  Description of Artificial Sequence: Synthetic oligonucleotide
  Target: ATXN1; (+) strand; PAM type: NRG; PAM sequence: GGG
agaaggcagcctgaaggcgg

SEQ ID NO: 154483 - DNA, 20 bp, Artificial Sequence
  Description of Artificial Sequence: Synthetic oligonucleotide
  Target: ATXN1; (+) strand; PAM type: NRG; PAM sequence: GGG
gaaggcagcctgaaggcggg

SEQ ID NO: 154484 - DNA, 20 bp, Artificial Sequence
  Description of Artificial Sequence: Synthetic oligonucleotide
  Target: ATXN1; (+) strand; PAM type: NRG; PAM sequence: AAG
agcctgaaggcggggggctg

SEQ ID NO: 154485 - DNA, 20 bp, Artificial Sequence
  Description of Artificial Sequence: Synthetic oligonucleotide
  Target: ATXN1; (+) strand; PAM type: NRG; PAM sequence: GAG
cctgaaggcggggggctgaa

SEQ ID NO: 154486 - DNA, 20 bp, Artificial Sequence
  Description of Artificial Sequence: Synthetic oligonucleotide
  Target: ATXN1; (+) strand; PAM type: NRG; PAM sequence: AGG
ctgaaggcggggggctgaag

SEQ ID NO: 154487 - DNA, 20 bp, Artificial Sequence
  Description of Artificial Sequence: Synthetic oligonucleotide
  Target: ATXN1; (+) strand; PAM type: NRG; PAM sequence: GGG
tgaaggcggggggctgaaga

SEQ ID NO: 154488 - DNA, 20 bp, Artificial Sequence
  Description of Artificial Sequence: Synthetic oligonucleotide
  Target: ATXN1; (+) strand; PAM type: NRG; PAM sequence: GGG
gaaggcggggggctgaagag

SEQ ID NO: 154489 - DNA, 20 bp, Artificial Sequence
  Description of Artificial Sequence: Synthetic oligonucleotide
  Target: ATXN1; (+) strand; PAM type: NRG; PAM sequence: CGG
gcggggggctgaagaggggt

SEQ ID NO: 154490 - DNA, 20 bp, Artificial Sequence
  Description of Artificial Sequence: Synthetic oligonucleotide
  Target: ATXN1; (+) strand; PAM type: NRG; PAM sequence: GGG
cggggggctgaagaggggtc

SEQ ID NO: 154491 - DNA, 20 bp, Artificial Sequence
  Description of Artificial Sequence: Synthetic oligonucleotide
  Target: ATXN1; (+) strand; PAM type: NRG; PAM sequence: GGG
ggggggctgaagaggggtcg

SEQ ID NO: 154492 - DNA, 20 bp, Artificial Sequence
  Description of Artificial Sequence: Synthetic oligonucleotide
  Target: ATXN1; (+) strand; PAM type: NRG; PAM sequence: CAG
gaagaggggtcggggcgctg

SEQ ID NO: 154493 - DNA, 20 bp, Artificial Sequence
  Description of Artificial Sequence: Synthetic oligonucleotide
  Target: ATXN1; (+) strand; PAM type: NRG; PAM sequence: GAG
agaggggtcggggcgctgca

SEQ ID NO: 154494 - DNA, 20 bp, Artificial Sequence
  Description of Artificial Sequence: Synthetic oligonucleotide
  Target: ATXN1; (+) strand; PAM type: NRG; PAM sequence: CAG
gggtcggggcgctgcagagt

SEQ ID NO: 154495 - DNA, 20 bp, Artificial Sequence
  Description of Artificial Sequence: Synthetic oligonucleotide
  Target: ATXN1; (+) strand; PAM type: NRG; PAM sequence: AAG
ggggcgctgcagagtcagcc

SEQ ID NO: 154496 - DNA, 20 bp, Artificial Sequence
  Description of Artificial Sequence: Synthetic oligonucleotide
  Target: ATXN1; (+) strand; PAM type: NRG; PAM sequence: TAG
gcgctgcagagtcagccaag

SEQ ID NO: 154497 - DNA, 20 bp, Artificial Sequence
  Description of Artificial Sequence: Synthetic oligonucleotide
  Target: ATXN1; (+) strand; PAM type: NRG; PAM sequence: AAG
gcagagtcagccaagtagcc

SEQ ID NO: 154498 - DNA, 20 bp, Artificial Sequence
  Description of Artificial Sequence: Synthetic oligonucleotide
  Target: ATXN1; (+) strand; PAM type: NRG; PAM sequence: AGG
cagagtcagccaagtagcca

SEQ ID NO: 154499 - DNA, 20 bp, Artificial Sequence
  Description of Artificial Sequence: Synthetic oligonucleotide
  Target: ATXN1; (+) strand; PAM type: NRG; PAM sequence: AAG
agtcagccaagtagccaagg

SEQ ID NO: 154500 - DNA, 20 bp, Artificial Sequence
  Description of Artificial Sequence: Synthetic oligonucleotide
  Target: ATXN1; (+) strand; PAM type: NRG; PAM sequence: AGG
gtcagccaagtagccaagga

SEQ ID NO: 154501 - DNA, 20 bp, Artificial Sequence
  Description of Artificial Sequence: Synthetic oligonucleotide
  Target: ATXN1; (+) strand; PAM type: NRG; PAM sequence: GGG
tcagccaagtagccaaggaa

SEQ ID NO: 154502 - DNA, 20 bp, Artificial Sequence
  Description of Artificial Sequence: Synthetic oligonucleotide
  Target: ATXN1; (+) strand; PAM type: NRG; PAM sequence: CGG
gggccccctccgcgtcgcga

SEQ ID NO: 154503 - DNA, 20 bp, Artificial Sequence
  Description of Artificial Sequence: Synthetic oligonucleotide
  Target: ATXN1; (+) strand; PAM type: NRG; PAM sequence: CGG
gacggccctcgccccccgcc

SEQ ID NO: 154504 - DNA, 20 bp, Artificial Sequence
  Description of Artificial Sequence: Synthetic oligonucleotide
  Target: ATXN1; (+) strand; PAM type: NRG; PAM sequence: CAG
cgcgcacaaatacacacaca

SEQ ID NO: 154505 - DNA, 20 bp, Artificial Sequence
  Description of Artificial Sequence: Synthetic oligonucleotide
  Target: ATXN1; (+) strand; PAM type: NRG; PAM sequence: CGG
cacctctcgctccgcccgtc

SEQ ID NO: 154506 - DNA, 20 bp, Artificial Sequence
  Description of Artificial Sequence: Synthetic oligonucleotide
  Target: ATXN1; (+) strand; PAM type: NRG; PAM sequence: CGG
gcccccttccctgccccctg

SEQ ID NO: 154507 - DNA, 20 bp, Artificial Sequence
  Description of Artificial Sequence: Synthetic oligonucleotide
  Target: ATXN1; (+) strand; PAM type: NRG; PAM sequence: GGG
cccccttccctgccccctgc

SEQ ID NO: 154508 - DNA, 20 bp, Artificial Sequence
  Description of Artificial Sequence: Synthetic oligonucleotide
  Target: ATXN1; (+) strand; PAM type: NRG; PAM sequence: CGG
ttccctgccccctgcgggac

SEQ ID NO: 154509 - DNA, 20 bp, Artificial Sequence
  Description of Artificial Sequence: Synthetic oligonucleotide
  Target: ATXN1; (+) strand; PAM type: NRG; PAM sequence: CAG
ctgcgggaccggcctgcgcg

SEQ ID NO: 154510 - DNA, 20 bp, Artificial Sequence
  Description of Artificial Sequence: Synthetic oligonucleotide
  Target: ATXN1; (+) strand; PAM type: NRG; PAM sequence: TGG
gaccggcctgcgcgcagcac

SEQ ID NO: 154511 - DNA, 20 bp, Artificial Sequence
  Description of Artificial Sequence: Synthetic oligonucleotide
  Target: ATXN1; (+) strand; PAM type: NRG; PAM sequence: TAG
cgcgcagcactggaaccacg

SEQ ID NO: 154512 - DNA, 20 bp, Artificial Sequence
  Description of Artificial Sequence: Synthetic oligonucleotide
  Target: ATXN1; (+) strand; PAM type: NRG; PAM sequence: AGG
gcgcagcactggaaccacgt

SEQ ID NO: 154513 - DNA, 20 bp, Artificial Sequence
  Description of Artificial Sequence: Synthetic oligonucleotide
  Target: ATXN1; (+) strand; PAM type: NRG; PAM sequence: GAG
gcagcactggaaccacgtag

SEQ ID NO: 154514 - DNA, 20 bp, Artificial Sequence
  Description of Artificial Sequence: Synthetic oligonucleotide
  Target: ATXN1; (+) strand; PAM type: NRG; PAM sequence: AGG
cagcactggaaccacgtagg

SEQ ID NO: 154515 - DNA, 20 bp, Artificial Sequence
  Description of Artificial Sequence: Synthetic oligonucleotide
  Target: ATXN1; (+) strand; PAM type: NRG; PAM sequence: GAG
gcactggaaccacgtaggag

SEQ ID NO: 154516 - DNA, 20 bp, Artificial Sequence
  Description of Artificial Sequence: Synthetic oligonucleotide
  Target: ATXN1; (+) strand; PAM type: NRG; PAM sequence: AGG
cactggaaccacgtaggagg

SEQ ID NO: 154517 - DNA, 20 bp, Artificial Sequence
  Description of Artificial Sequence: Synthetic oligonucleotide
  Target: ATXN1; (+) strand; PAM type: NRG; PAM sequence: CGG
tggaaccacgtaggaggagg

SEQ ID NO: 154518 - DNA, 20 bp, Artificial Sequence
  Description of Artificial Sequence: Synthetic oligonucleotide
  Target: ATXN1; (+) strand; PAM type: NRG; PAM sequence: CGG
aaccacgtaggaggaggcgg

SEQ ID NO: 154519 - DNA, 20 bp, Artificial Sequence
  Description of Artificial Sequence: Synthetic oligonucleotide
  Target: ATXN1; (+) strand; PAM type: NRG; PAM sequence: CGG
ggaggaggcggcggcgcccc

SEQ ID NO: 154520 - DNA, 20 bp, Artificial Sequence
  Description of Artificial Sequence: Synthetic oligonucleotide
  Target: ATXN1; (+) strand; PAM type: NRG; PAM sequence: GGG
gaggaggcggcggcgccccc

SEQ ID NO: 154521 - DNA, 20 bp, Artificial Sequence
  Description of Artificial Sequence: Synthetic oligonucleotide
  Target: ATXN1; (+) strand; PAM type: NRG; PAM sequence: GAG
ggaggcggcggcgcccccgg

SEQ ID NO: 154522 - DNA, 20 bp, Artificial Sequence
  Description of Artificial Sequence: Synthetic oligonucleotide
  Target: ATXN1; (+) strand; PAM type: NRG; PAM sequence: TGG
ggcggcggcgcccccgggag

SEQ ID NO: 154523 - DNA, 20 bp, Artificial Sequence
  Description of Artificial Sequence: Synthetic oligonucleotide
  Target: ATXN1; (+) strand; PAM type: NRG; PAM sequence: CAG
ggcggcgcccccgggagtgg

SEQ ID NO: 154524 - DNA, 20 bp, Artificial Sequence
  Description of Artificial Sequence: Synthetic oligonucleotide
  Target: ATXN1; (+) strand; PAM type: NRG; PAM sequence: GAG
cggcgcccccgggagtggca

SEQ ID NO: 154525 - DNA, 20 bp, Artificial Sequence
  Description of Artificial Sequence: Synthetic oligonucleotide
  Target: ATXN1; (+) strand; PAM type: NRG; PAM sequence: CGG
cccgggagtggcagagtctc

SEQ ID NO: 154526 - DNA, 20 bp, Artificial Sequence
  Description of Artificial Sequence: Synthetic oligonucleotide
  Target: ATXN1; (+) strand; PAM type: NRG; PAM sequence: CGG
gagtggcagagtctccggcc

SEQ ID NO: 154527 - DNA, 20 bp, Artificial Sequence
  Description of Artificial Sequence: Synthetic oligonucleotide
  Target: ATXN1; (+) strand; PAM type: NRG; PAM sequence: CAG
gcagagtctccggcccggcc

SEQ ID NO: 154528 - DNA, 20 bp, Artificial Sequence
  Description of Artificial Sequence: Synthetic oligonucleotide
  Target: ATXN1; (+) strand; PAM type: NRG; PAM sequence: GAG
agagtctccggcccggccca

SEQ ID NO: 154529 - DNA, 20 bp, Artificial Sequence
  Description of Artificial Sequence: Synthetic oligonucleotide
  Target: ATXN1; (+) strand; PAM type: NRG; PAM sequence: GAG
cggcccggcccagagtgaac

SEQ ID NO: 154530 - DNA, 20 bp, Artificial Sequence
  Description of Artificial Sequence: Synthetic oligonucleotide
  Target: ATXN1; (+) strand; PAM type: NRG; PAM sequence: CAG
cccggcccagagtgaacgag

SEQ ID NO: 154531 - DNA, 20 bp, Artificial Sequence
  Description of Artificial Sequence: Synthetic oligonucleotide
  Target: ATXN1; (+) strand; PAM type: NRG; PAM sequence: TGG
ggcccagagtgaacgagcag

SEQ ID NO: 154532 - DNA, 20 bp, Artificial Sequence
  Description of Artificial Sequence: Synthetic oligonucleotide
  Target: ATXN1; (+) strand; PAM type: NRG; PAM sequence: GGG
gcccagagtgaacgagcagt

SEQ ID NO: 154533 - DNA, 20 bp, Artificial Sequence
  Description of Artificial Sequence: Synthetic oligonucleotide
  Target: ATXN1; (+) strand; PAM type: NRG; PAM sequence: GGG
cccagagtgaacgagcagtg

SEQ ID NO: 154534 - DNA, 20 bp, Artificial Sequence
  Description of Artificial Sequence: Synthetic oligonucleotide
  Target: ATXN1; (+) strand; PAM type: NRG; PAM sequence: CAG
gtgaacgagcagtggggctc

SEQ ID NO: 154535 - DNA, 20 bp, Artificial Sequence
  Description of Artificial Sequence: Synthetic oligonucleotide
  Target: ATXN1; (+) strand; PAM type: NRG; PAM sequence: AGG
tgaacgagcagtggggctcc

SEQ ID NO: 154536 - DNA, 20 bp, Artificial Sequence
  Description of Artificial Sequence: Synthetic oligonucleotide
  Target: ATXN1; (+) strand; PAM type: NRG; PAM sequence: GGG
gaacgagcagtggggctcca

SEQ ID NO: 154537 - DNA, 20 bp, Artificial Sequence
  Description of Artificial Sequence: Synthetic oligonucleotide
  Target: ATXN1; (+) strand; PAM type: NRG; PAM sequence: CAG
agggcgcatcccaatccccg

SEQ ID NO: 154538 - DNA, 20 bp, Artificial Sequence
  Description of Artificial Sequence: Synthetic oligonucleotide
  Target: ATXN1; (+) strand; PAM type: NRG; PAM sequence: CGG
tccccgcagcgcctcctccg

SEQ ID NO: 154539 - DNA, 20 bp, Artificial Sequence
  Description of Artificial Sequence: Synthetic oligonucleotide
  Target: ATXN1; (+) strand; PAM type: NRG; PAM sequence: CGG
ccgcagcgcctcctccgcgg

SEQ ID NO: 154540 - DNA, 20 bp, Artificial Sequence
  Description of Artificial Sequence: Synthetic oligonucleotide
  Target: ATXN1; (+) strand; PAM type: NRG; PAM sequence: TGG
cctcctccttcccctcctcc

SEQ ID NO: 154541 - DNA, 20 bp, Artificial Sequence
  Description of Artificial Sequence: Synthetic oligonucleotide
  Target: ATXN1; (+) strand; PAM type: NRG; PAM sequence: CAG
cctggcttcattcaccctcc

SEQ ID NO: 154542 - DNA, 20 bp, Artificial Sequence
  Description of Artificial Sequence: Synthetic oligonucleotide
  Target: ATXN1; (+) strand; PAM type: NRG; PAM sequence: CAG
ggcttcattcaccctcccag

SEQ ID NO: 154543 - DNA, 20 bp, Artificial Sequence
  Description of Artificial Sequence: Synthetic oligonucleotide
  Target: ATXN1; (+) strand; PAM type: NRG; PAM sequence: CAG
tcaccctcccagcagccgcg

SEQ ID NO: 154544 - DNA, 20 bp, Artificial Sequence
  Description of Artificial Sequence: Synthetic oligonucleotide
  Target: ATXN1; (+) strand; PAM type: NRG; PAM sequence: CGG
gccgcgcagccgttcactcc

SEQ ID NO: 154545 - DNA, 20 bp, Artificial Sequence
  Description of Artificial Sequence: Synthetic oligonucleotide
  Target: ATXN1; (+) strand; PAM type: NRG; PAM sequence: CAG
gcagccgttcactcccggct

SEQ ID NO: 154546 - DNA, 20 bp, Artificial Sequence
  Description of Artificial Sequence: Synthetic oligonucleotide
  Target: ATXN1; (+) strand; PAM type: NRG; PAM sequence: AGG
cagccgttcactcccggctc

SEQ ID NO: 154547 - DNA, 20 bp, Artificial Sequence
  Description of Artificial Sequence: Synthetic oligonucleotide
  Target: ATXN1; (+) strand; PAM type: NRG; PAM sequence: GGG
agccgttcactcccggctca

SEQ ID NO: 154548 - DNA, 20 bp, Artificial Sequence
  Description of Artificial Sequence: Synthetic oligonucleotide
  Target: ATXN1; (+) strand; PAM type: NRG; PAM sequence: CAG
cgttcactcccggctcaggg

SEQ ID NO: 154549 - DNA, 20 bp, Artificial Sequence
  Description of Artificial Sequence: Synthetic oligonucleotide
  Target: ATXN1; (+) strand; PAM type: NRG; PAM sequence: CGG
gctcagggcagcgcctgccg

SEQ ID NO: 154550 - DNA, 20 bp, Artificial Sequence
  Description of Artificial Sequence: Synthetic oligonucleotide
  Target: ATXN1; (+) strand; PAM type: NRG; PAM sequence: CGG
cggctcctcgtctcctgccg

SEQ ID NO: 154551 - DNA, 20 bp, Artificial Sequence
  Description of Artificial Sequence: Synthetic oligonucleotide
  Target: ATXN1; (+) strand; PAM type: NRG; PAM sequence: GGG
ggctcctcgtctcctgccgc

SEQ ID NO: 154552 - DNA, 20 bp, Artificial Sequence
  Description of Artificial Sequence: Synthetic oligonucleotide
  Target: ATXN1; (+) strand; PAM type: NRG; PAM sequence: TGG
tcgtctcctgccgcgggtgc

SEQ ID NO: 154553 - DNA, 20 bp, Artificial Sequence
  Description of Artificial Sequence: Synthetic oligonucleotide
  Target: ATXN1; (+) strand; PAM type: NRG; PAM sequence: CGG
tctcctgccgcgggtgctgg

SEQ ID NO: 154554 - DNA, 20 bp, Artificial Sequence
  Description of Artificial Sequence: Synthetic oligonucleotide
  Target: ATXN1; (+) strand; PAM type: NRG; PAM sequence: GGG
ctcctgccgcgggtgctggc

SEQ ID NO: 154555 - DNA, 20 bp, Artificial Sequence
  Description of Artificial Sequence: Synthetic oligonucleotide
  Target: ATXN1; (+) strand; PAM type: NRG; PAM sequence: GGG
tcctgccgcgggtgctggcg

SEQ ID NO: 154556 - DNA, 20 bp, Artificial Sequence
  Description of Artificial Sequence: Synthetic oligonucleotide
  Target: ATXN1; (+) strand; PAM type: NRG; PAM sequence: GGG
cctgccgcgggtgctggcgg

SEQ ID NO: 154557 - DNA, 20 bp, Artificial Sequence
  Description of Artificial Sequence: Synthetic oligonucleotide
  Target: ATXN1; (+) strand; PAM type: NRG; PAM sequence: CGG
gcgggtgctggcgggggcgc

SEQ ID NO: 154558 - DNA, 20 bp, Artificial Sequence
  Description of Artificial Sequence: Synthetic oligonucleotide
  Target: ATXN1; (+) strand; PAM type: NRG; PAM sequence: CGG
tgctggcgggggcgccggcc

SEQ ID NO: 154559 - DNA, 20 bp, Artificial Sequence
  Description of Artificial Sequence: Synthetic oligonucleotide
  Target: ATXN1; (+) strand; PAM type: NRG; PAM sequence: TGG
gcgggggcgccggcccggac

SEQ ID NO: 154560 - DNA, 20 bp, Artificial Sequence
  Description of Artificial Sequence: Synthetic oligonucleotide
  Target: ATXN1; (+) strand; PAM type: NRG; PAM sequence: GGG
cgggggcgccggcccggact

SEQ ID NO: 154561 - DNA, 20 bp, Artificial Sequence
  Description of Artificial Sequence: Synthetic oligonucleotide
  Target: ATXN1; (+) strand; PAM type: NRG; PAM sequence: GGG
gggggcgccggcccggactg

SEQ ID NO: 154562 - DNA, 20 bp, Artificial Sequence
  Description of Artificial Sequence: Synthetic oligonucleotide
  Target: ATXN1; (+) strand; PAM type: NRG; PAM sequence: CGG
ggcccggactggggcgctcg

SEQ ID NO: 154563 - DNA, 20 bp, Artificial Sequence
  Description of Artificial Sequence: Synthetic oligonucleotide
  Target: ATXN1; (+) strand; PAM type: NRG; PAM sequence: GGG
gcccggactggggcgctcgc

SEQ ID NO: 154564 - DNA, 20 bp, Artificial Sequence
  Description of Artificial Sequence: Synthetic oligonucleotide
  Target: ATXN1; (+) strand; PAM type: NRG; PAM sequence: CGG
ctggggcgctcgcgggctcc

SEQ ID NO: 154565 - DNA, 20 bp, Artificial Sequence
  Description of Artificial Sequence: Synthetic oligonucleotide
  Target: ATXN1; (+) strand; PAM type: NRG; PAM sequence: CGG
cgctcgcgggctcccggctc

SEQ ID NO: 154566 - DNA, 20 bp, Artificial Sequence
  Description of Artificial Sequence: Synthetic oligonucleotide
  Target: ATXN1; (+) strand; PAM type: NRG; PAM sequence: GGG
gctcgcgggctcccggctcc

SEQ ID NO: 154567 - DNA, 20 bp, Artificial Sequence
  Description of Artificial Sequence: Synthetic oligonucleotide
  Target: ATXN1; (+) strand; PAM type: NRG; PAM sequence: CGG
cgcgggctcccggctccggg

SEQ ID NO: 154568 - DNA, 20 bp, Artificial Sequence
  Description of Artificial Sequence: Synthetic oligonucleotide
  Target: ATXN1; (+) strand; PAM type: NRG; PAM sequence: CGG
gggctcccggctccgggcgg

SEQ ID NO: 154569 - DNA, 20 bp, Artificial Sequence
  Description of Artificial Sequence: Synthetic oligonucleotide
  Target: ATXN1; (+) strand; PAM type: NRG; PAM sequence: CAG
cggctgccgctgcacatgat

SEQ ID NO: 154570 - DNA, 20 bp, Artificial Sequence
  Description of Artificial Sequence: Synthetic oligonucleotide
  Target: ATXN1; (+) strand; PAM type: NRG; PAM sequence: AGG
ggctgccgctgcacatgatc

SEQ ID NO: 154571 - DNA, 20 bp, Artificial Sequence
  Description of Artificial Sequence: Synthetic oligonucleotide
  Target: ATXN1; (+) strand; PAM type: NRG; PAM sequence: AAG
tgccgctgcacatgatcagg

SEQ ID NO: 154572 - DNA, 20 bp, Artificial Sequence
  Description of Artificial Sequence: Synthetic oligonucleotide
  Target: ATXN1; (+) strand; PAM type: NRG; PAM sequence: CGG
cgctgcacatgatcaggaag

SEQ ID NO: 154573 - DNA, 20 bp, Artificial Sequence
  Description of Artificial Sequence: Synthetic oligonucleotide
  Target: ATXN1; (+) strand; PAM type: NRG; PAM sequence: CAG
tcaggaagcggccgcaccaa

SEQ ID NO: 154574 - DNA, 20 bp, Artificial Sequence
  Description of Artificial Sequence: Synthetic oligonucleotide
  Target: ATXN1; (+) strand; PAM type: NRG; PAM sequence: AGG
caggaagcggccgcaccaac

SEQ ID NO: 154575 - DNA, 20 bp, Artificial Sequence
  Description of Artificial Sequence: Synthetic oligonucleotide
  Target: ATXN1; (+) strand; PAM type: NRG; PAM sequence: GGG
aggaagcggccgcaccaaca

SEQ ID NO: 154576 - DNA, 20 bp, Artificial Sequence
  Description of Artificial Sequence: Synthetic oligonucleotide
  Target: ATXN1; (+) strand; PAM type: NRG; PAM sequence: CGG
aagcggccgcaccaacaggg

SEQ ID NO: 154577 - DNA, 20 bp, Artificial Sequence
  Description of Artificial Sequence: Synthetic oligonucleotide
  Target: ATXN1; (+) strand; PAM type: NRG; PAM sequence: CGG
cggccgcaccaacagggcgg

SEQ ID NO: 154578 - DNA, 20 bp, Artificial Sequence
  Description of Artificial Sequence: Synthetic oligonucleotide
  Target: ATXN1; (+) strand; PAM type: NRG; PAM sequence: TGG
ccgcaccaacagggcggcgg

SEQ ID NO: 154579 - DNA, 20 bp, Artificial Sequence
  Description of Artificial Sequence: Synthetic oligonucleotide
  Target: ATXN1; (+) strand; PAM type: NRG; PAM sequence: CGG
caccaacagggcggcggtgg

SEQ ID NO: 154580 - DNA, 20 bp, Artificial Sequence
  Description of Artificial Sequence: Synthetic oligonucleotide
  Target: ATXN1; (+) strand; PAM type: NRG; PAM sequence: CGG
caacagggcggcggtggcgg

SEQ ID NO: 154581 - DNA, 20 bp, Artificial Sequence
  Description of Artificial Sequence: Synthetic oligonucleotide
  Target: ATXN1; (+) strand; PAM type: NRG; PAM sequence: CGG
cagggcggcggtggcggcgg

SEQ ID NO: 154582 - DNA, 20 bp, Artificial Sequence
  Description of Artificial Sequence: Synthetic oligonucleotide
  Target: ATXN1; (+) strand; PAM type: NRG; PAM sequence: CAG
gcggcggtggcggcggcggc

SEQ ID NO: 154583 - DNA, 20 bp, Artificial Sequence
  Description of Artificial Sequence: Synthetic oligonucleotide
  Target: ATXN1; (+) strand; PAM type: NRG; PAM sequence: AGG
cggcggtggcggcggcggcc

SEQ ID NO: 154584 - DNA, 20 bp, Artificial Sequence
  Description of Artificial Sequence: Synthetic oligonucleotide
  Target: ATXN1; (+) strand; PAM type: NRG; PAM sequence: GGG
ggcggtggcggcggcggcca

SEQ ID NO: 154585 - DNA, 20 bp, Artificial Sequence
  Description of Artificial Sequence: Synthetic oligonucleotide
  Target: ATXN1; (+) strand; PAM type: NRG; PAM sequence: CAG
cagggccgtcaccgccactc

SEQ ID NO: 154586 - DNA, 20 bp, Artificial Sequence
  Description of Artificial Sequence: Synthetic oligonucleotide
  Target: ATXN1; (+) strand; PAM type: NRG; PAM sequence: CAG
ccgccactccagccgcgctc

SEQ ID NO: 154587 - DNA, 20 bp, Artificial Sequence
  Description of Artificial Sequence: Synthetic oligonucleotide
  Target: ATXN1; (+) strand; PAM type: NRG; PAM sequence: AGG
cgccactccagccgcgctcc

SEQ ID NO: 154588 - DNA, 20 bp, Artificial Sequence
  Description of Artificial Sequence: Synthetic oligonucleotide
  Target: ATXN1; (+) strand; PAM type: NRG; PAM sequence: CGG
gcacacccgctacccccgcg

SEQ ID NO: 154589 - DNA, 20 bp, Artificial Sequence
  Description of Artificial Sequence: Synthetic oligonucleotide
  Target: ATXN1; (+) strand; PAM type: NRG; PAM sequence: GAG
gctacccccgcgcggtcccc

SEQ ID NO: 154590 - DNA, 20 bp, Artificial Sequence
  Description of Artificial Sequence: Synthetic oligonucleotide
  Target: ATXN1; (+) strand; PAM type: NRG; PAM sequence: AGG
ctacccccgcgcggtccccg

SEQ ID NO: 154591 - DNA, 20 bp, Artificial Sequence
  Description of Artificial Sequence: Synthetic oligonucleotide
  Target: ATXN1; (+) strand; PAM type: NRG; PAM sequence: CGG
acccctctgcgccccccgcc

SEQ ID NO: 154592 - DNA, 20 bp, Artificial Sequence
  Description of Artificial Sequence: Synthetic oligonucleotide
  Target: ATXN1; (+) strand; PAM type: NRG; PAM sequence: CGG
tgcgccccccgcccggcacc

SEQ ID NO: 154593 - DNA, 20 bp, Artificial Sequence
  Description of Artificial Sequence: Synthetic oligonucleotide
  Target: ATXN1; (+) strand; PAM type: NRG; PAM sequence: AAG
ccggcacccggccgcgcgca

SEQ ID NO: 154594 - DNA, 20 bp, Artificial Sequence
  Description of Artificial Sequence: Synthetic oligonucleotide
  Target: ATXN1; (+) strand; PAM type: NRG; PAM sequence: CGG
ccgcgcgcaaagtcccgtcc

SEQ ID NO: 154595 - DNA, 20 bp, Artificial Sequence
  Description of Artificial Sequence: Synthetic oligonucleotide
  Target: ATXN1; (+) strand; PAM type: NRG; PAM sequence: CAG
gcaaagtcccgtcccggctg

SEQ ID NO: 154596 - DNA, 20 bp, Artificial Sequence
  Description of Artificial Sequence: Synthetic oligonucleotide
  Target: ATXN1; (+) strand; PAM type: NRG; PAM sequence: AGG
caaagtcccgtcccggctgc

SEQ ID NO: 154597 - DNA, 20 bp, Artificial Sequence
  Description of Artificial Sequence: Synthetic oligonucleotide
  Target: ATXN1; (+) strand; PAM type: NRG; PAM sequence: GAG
aagtcccgtcccggctgcag

SEQ ID NO: 154598 - DNA, 20 bp, Artificial Sequence
  Description of Artificial Sequence: Synthetic oligonucleotide
  Target: ATXN1; (+) strand; PAM type: NRG; PAM sequence: CAG
tcccgtcccggctgcaggag

SEQ ID NO: 154599 - DNA, 20 bp, Artificial Sequence
  Description of Artificial Sequence: Synthetic oligonucleotide
  Target: ATXN1; (+) strand; PAM type: NRG; PAM sequence: CAG
agcagtcccttccccgcccg

SEQ ID NO: 154600 - DNA, 20 bp, Artificial Sequence
  Description of Artificial Sequence: Synthetic oligonucleotide
  Target: ATXN1; (+) strand; PAM type: NRG; PAM sequence: CGG
cccgcccgcagccgcacacc

SEQ ID NO: 154601 - DNA, 20 bp, Artificial Sequence
  Description of Artificial Sequence: Synthetic oligonucleotide
  Target: ATXN1; (+) strand; PAM type: NRG; PAM sequence: GAG
cccgcagccgcacacccggc

SEQ ID NO: 154602 - DNA, 20 bp, Artificial Sequence
  Description of Artificial Sequence: Synthetic oligonucleotide
  Target: ATXN1; (+) strand; PAM type: NRG; PAM sequence: AGG
ccgcagccgcacacccggcg

SEQ ID NO: 154603 - DNA, 20 bp, Artificial Sequence
  Description of Artificial Sequence: Synthetic oligonucleotide
  Target: ATXN1; (+) strand; PAM type: NRG; PAM sequence: CGG
agccgcacacccggcgaggc

SEQ ID NO: 154604 - DNA, 20 bp, Artificial Sequence
  Description of Artificial Sequence: Synthetic oligonucleotide
  Target: ATXN1; (+) strand; PAM type: NRG; PAM sequence: GAG
cccggcgaggccggccctcc

SEQ ID NO: 154605 - DNA, 20 bp, Artificial Sequence
  Description of Artificial Sequence: Synthetic oligonucleotide
  Target: ATXN1; (+) strand; PAM type: NRG; PAM sequence: AGG
ccggcgaggccggccctccg

SEQ ID NO: 154606 - DNA, 20 bp, Artificial Sequence
  Description of Artificial Sequence: Synthetic oligonucleotide
  Target: ATXN1; (+) strand; PAM type: NRG; PAM sequence: GGG
cggcgaggccggccctccga

SEQ ID NO: 154607 - DNA, 20 bp, Artificial Sequence
  Description of Artificial Sequence: Synthetic oligonucleotide
  Target: ATXN1; (+) strand; PAM type: NRG; PAM sequence: GGG
ggcgaggccggccctccgag

SEQ ID NO: 154608 - DNA, 20 bp, Artificial Sequence
  Description of Artificial Sequence: Synthetic oligonucleotide
  Target: ATXN1; (+) strand; PAM type: NRG; PAM sequence: GAG
cgaggccggccctccgaggg

SEQ ID NO: 154609 - DNA, 20 bp, Artificial Sequence
  Description of Artificial Sequence: Synthetic oligonucleotide
  Target: ATXN1; (+) strand; PAM type: NRG; PAM sequence: CAG
ccgaggggagacccccgccc

SEQ ID NO: 154610 - DNA, 20 bp, Artificial Sequence
  Description of Artificial Sequence: Synthetic oligonucleotide
  Target: ATXN1; (+) strand; PAM type: NRG; PAM sequence: AGG
cgaggggagacccccgcccc

SEQ ID NO: 154611 - DNA, 20 bp, Artificial Sequence
  Description of Artificial Sequence: Synthetic oligonucleotide
  Target: ATXN1; (+) strand; PAM type: NRG; PAM sequence: GGG
gaggggagacccccgcccca

SEQ ID NO: 154612 - DNA, 20 bp, Artificial Sequence
  Description of Artificial Sequence: Synthetic oligonucleotide
  Target: ATXN1; (+) strand; PAM type: NRG; PAM sequence: GAG
gacccccgccccagggcgcc

SEQ ID NO: 154613 - DNA, 20 bp, Artificial Sequence
  Description of Artificial Sequence: Synthetic oligonucleotide
  Target: ATXN1; (+) strand; PAM type: NRG; PAM sequence: AGG
acccccgccccagggcgccg

SEQ ID NO: 154614 - DNA, 20 bp, Artificial Sequence
  Description of Artificial Sequence: Synthetic oligonucleotide
  Target: ATXN1; (+) strand; PAM type: NRG; PAM sequence: CGG
ccgccccagggcgccgaggc

SEQ ID NO: 154615 - DNA, 20 bp, Artificial Sequence
  Description of Artificial Sequence: Synthetic oligonucleotide
  Target: ATXN1; (+) strand; PAM type: NRG; PAM sequence: GGG
cgccccagggcgccgaggcc

SEQ ID NO: 154616 - DNA, 20 bp, Artificial Sequence
  Description of Artificial Sequence: Synthetic oligonucleotide
  Target: ATXN1; (+) strand; PAM type: NRG; PAM sequence: CGG
cgaggccgggcgaccacccg

SEQ ID NO: 154617 - DNA, 20 bp, Artificial Sequence
  Description of Artificial Sequence: Synthetic oligonucleotide
  Target: ATXN1; (+) strand; PAM type: NRG; PAM sequence: GAG
aggccgggcgaccacccgcg

SEQ ID NO: 154618 - DNA, 20 bp, Artificial Sequence
  Description of Artificial Sequence: Synthetic oligonucleotide
  Target: ATXN1; (+) strand; PAM type: NRG; PAM sequence: AAG
ccgggcgaccacccgcggag

SEQ ID NO: 154619 - DNA, 20 bp, Artificial Sequence
  Description of Artificial Sequence: Synthetic oligonucleotide
  Target: ATXN1; (+) strand; PAM type: NRG; PAM sequence: CAG
cgaccacccgcggagaagtc

SEQ ID NO: 154620 - DNA, 20 bp, Artificial Sequence
  Description of Artificial Sequence: Synthetic oligonucleotide
  Target: ATXN1; (+) strand; PAM type: NRG; PAM sequence: GAG
ggagaagtccagccctccgt

SEQ ID NO: 154621 - DNA, 20 bp, Artificial Sequence
  Description of Artificial Sequence: Synthetic oligonucleotide
  Target: ATXN1; (+) strand; PAM type: NRG; PAM sequence: CGG
ctctctctcaccgccctctc

SEQ ID NO: 154622 - DNA, 20 bp, Artificial Sequence
  Description of Artificial Sequence: Synthetic oligonucleotide
  Target: ATXN1; (+) strand; PAM type: NRG; PAM sequence: GGG
tctctctcaccgccctctcc

SEQ ID NO: 154623 - DNA, 20 bp, Artificial Sequence
  Description of Artificial Sequence: Synthetic oligonucleotide
  Target: ATXN1; (+) strand; PAM type: NRG; PAM sequence: GGG
ctctctcaccgccctctccg

SEQ ID NO: 154624 - DNA, 20 bp, Artificial Sequence
  Description of Artificial Sequence: Synthetic oligonucleotide
  Target: ATXN1; (+) strand; PAM type: NRG; PAM sequence: GAG
ctctcaccgccctctccggg

SEQ ID NO: 154625 - DNA, 20 bp, Artificial Sequence
  Description of Artificial Sequence: Synthetic oligonucleotide
  Target: ATXN1; (+) strand; PAM type: NRG; PAM sequence: AGG
tctcaccgccctctccgggg

SEQ ID NO: 154626 - DNA, 20 bp, Artificial Sequence
  Description of Artificial Sequence: Synthetic oligonucleotide
  Target: ATXN1; (+) strand; PAM type: NRG; PAM sequence: GAG
tcaccgccctctccggggag

SEQ ID NO: 154627 - DNA, 20 bp, Artificial Sequence
  Description of Artificial Sequence: Synthetic oligonucleotide
  Target: ATXN1; (+) strand; PAM type: NRG; PAM sequence: AGG
caccgccctctccggggagg

SEQ ID NO: 154628 - DNA, 20 bp, Artificial Sequence
  Description of Artificial Sequence: Synthetic oligonucleotide
  Target: ATXN1; (+) strand; PAM type: NRG; PAM sequence: TGG
ccctctccggggaggaggaa

SEQ ID NO: 154629 - DNA, 20 bp, Artificial Sequence
  Description of Artificial Sequence: Synthetic oligonucleotide
  Target: ATXN1; (+) strand; PAM type: NRG; PAM sequence: GGG
cctctccggggaggaggaat

SEQ ID NO: 154630 - DNA, 20 bp, Artificial Sequence
  Description of Artificial Sequence: Synthetic oligonucleotide
  Target: ATXN1; (+) strand; PAM type: NRG; PAM sequence: AAG
ctccggggaggaggaatggg

SEQ ID NO: 154631 - DNA, 20 bp, Artificial Sequence
  Description of Artificial Sequence: Synthetic oligonucleotide
  Target: ATXN1; (+) strand; PAM type: NRG; PAM sequence: GAG
ccggggaggaggaatgggaa

SEQ ID NO: 154632 - DNA, 20 bp, Artificial Sequence
  Description of Artificial Sequence: Synthetic oligonucleotide
  Target: ATXN1; (+) strand; PAM type: NRG; PAM sequence: AGG
cggggaggaggaatgggaag

SEQ ID NO: 154633 - DNA, 20 bp, Artificial Sequence
  Description of Artificial Sequence: Synthetic oligonucleotide
  Target: ATXN1; (+) strand; PAM type: NRG; PAM sequence: GGG
ggggaggaggaatgggaaga

SEQ ID NO: 154634 - DNA, 20 bp, Artificial Sequence
  Description of Artificial Sequence: Synthetic oligonucleotide
  Target: ATXN1; (+) strand; PAM type: NRG; PAM sequence: CGG
gaggaggaatgggaagaggg

SEQ ID NO: 154635 - DNA, 20 bp, Artificial Sequence
  Description of Artificial Sequence: Synthetic oligonucleotide
  Target: ATXN1; (+) strand; PAM type: NRG; PAM sequence: CGG
aggaatgggaagagggcggc

SEQ ID NO: 154636 - DNA, 20 bp, Artificial Sequence
  Description of Artificial Sequence: Synthetic oligonucleotide
  Target: ATXN1; (+) strand; PAM type: NRG; PAM sequence: GGG
ggaatgggaagagggcggcc

SEQ ID NO: 154637 - DNA, 20 bp, Artificial Sequence
  Description of Artificial Sequence: Synthetic oligonucleotide
  Target: ATXN1; (+) strand; PAM type: NRG; PAM sequence: AAG
tgggaagagggcggccggga

SEQ ID NO: 154638 - DNA, 20 bp, Artificial Sequence
  Description of Artificial Sequence: Synthetic oligonucleotide
  Target: ATXN1; (+) strand; PAM type: NRG; PAM sequence: AGG
gggaagagggcggccgggaa

SEQ ID NO: 154639 - DNA, 20 bp, Artificial Sequence
  Description of Artificial Sequence: Synthetic oligonucleotide
  Target: ATXN1; (+) strand; PAM type: NRG; PAM sequence: GGG
ggaagagggcggccgggaaa

SEQ ID NO: 154640 - DNA, 20 bp, Artificial Sequence
  Description of Artificial Sequence: Synthetic oligonucleotide
  Target: ATXN1; (+) strand; PAM type: NRG; PAM sequence: CAG
aagggaccaccccccaaccc

SEQ ID NO: 154641 - DNA, 20 bp, Artificial Sequence
  Description of Artificial Sequence: Synthetic oligonucleotide
  Target: ATXN1; (+) strand; PAM type: NRG; PAM sequence: CGG
cgcctcccccctgcgccacc

SEQ ID NO: 154642 - DNA, 20 bp, Artificial Sequence
  Description of Artificial Sequence: Synthetic oligonucleotide
  Target: ATXN1; (+) strand; PAM type: NRG; PAM sequence: GAG
cctcccccctgcgccacccg

SEQ ID NO: 154643 - DNA, 20 bp, Artificial Sequence
  Description of Artificial Sequence: Synthetic oligonucleotide
  Target: ATXN1; (+) strand; PAM type: NRG; PAM sequence: AGG
ctcccccctgcgccacccgg

SEQ ID NO: 154644 - DNA, 20 bp, Artificial Sequence
  Description of Artificial Sequence: Synthetic oligonucleotide
  Target: ATXN1; (+) strand; PAM type: NRG; PAM sequence: GGG
tcccccctgcgccacccgga

SEQ ID NO: 154645 - DNA, 20 bp, Artificial Sequence
  Description of Artificial Sequence: Synthetic oligonucleotide
  Target: ATXN1; (+) strand; PAM type: NRG; PAM sequence: GAG
ccccctgcgccacccggagg

SEQ ID NO: 154646 - DNA, 20 bp, Artificial Sequence
  Description of Artificial Sequence: Synthetic oligonucleotide
  Target: ATXN1; (+) strand; PAM type: NRG; PAM sequence: AGG
cccctgcgccacccggaggg

SEQ ID NO: 154647 - DNA, 20 bp, Artificial Sequence
  Description of Artificial Sequence: Synthetic oligonucleotide
  Target: ATXN1; (+) strand; PAM type: NRG; PAM sequence: GAG
cctgcgccacccggagggag

SEQ ID NO: 154648 - DNA, 20 bp, Artificial Sequence
  Description of Artificial Sequence: Synthetic oligonucleotide
  Target: ATXN1; (+) strand; PAM type: NRG; PAM sequence: AGG
ctgcgccacccggagggagg

SEQ ID NO: 154649 - DNA, 20 bp, Artificial Sequence
  Description of Artificial Sequence: Synthetic oligonucleotide
  Target: ATXN1; (+) strand; PAM type: NRG; PAM sequence: TGG
cacccggagggaggaggaca

SEQ ID NO: 154650 - DNA, 20 bp, Artificial Sequence
  Description of Artificial Sequence: Synthetic oligonucleotide
  Target: ATXN1; (+) strand; PAM type: NRG; PAM sequence: CGG
tggctctccgcacttgcgac

SEQ ID NO: 154651 - DNA, 20 bp, Artificial Sequence
  Description of Artificial Sequence: Synthetic oligonucleotide
  Target: ATXN1; (+) strand; PAM type: NRG; PAM sequence: CAG
ctccgcacttgcgaccggac

SEQ ID NO: 154652 - DNA, 20 bp, Artificial Sequence
  Description of Artificial Sequence: Synthetic oligonucleotide
  Target: ATXN1; (+) strand; PAM type: NRG; PAM sequence: CAG
cgcacttgcgaccggaccag

SEQ ID NO: 154653 - DNA, 20 bp, Artificial Sequence
  Description of Artificial Sequence: Synthetic oligonucleotide
  Target: ATXN1; (+) strand; PAM type: NRG; PAM sequence: CGG
cttgcgaccggaccagcagc

SEQ ID NO: 154654 - DNA, 20 bp, Artificial Sequence
  Description of Artificial Sequence: Synthetic oligonucleotide
  Target: ATXN1; (+) strand; PAM type: NRG; PAM sequence: GGG
ttgcgaccggaccagcagcc

SEQ ID NO: 154655 - DNA, 20 bp, Artificial Sequence
  Description of Artificial Sequence: Synthetic oligonucleotide
  Target: ATXN1; (+) strand; PAM type: NRG; PAM sequence: GGG
tgcgaccggaccagcagccg

SEQ ID NO: 154656 - DNA, 20 bp, Artificial Sequence
  Description of Artificial Sequence: Synthetic oligonucleotide
  Target: ATXN1; (+) strand; PAM type: NRG; PAM sequence: GGG
gcgaccggaccagcagccgg

SEQ ID NO: 154657 - DNA, 20 bp, Artificial Sequence
  Description of Artificial Sequence: Synthetic oligonucleotide
  Target: ATXN1; (+) strand; PAM type: NRG; PAM sequence: GAG
gaccggaccagcagccgggg

SEQ ID NO: 154658 - DNA, 20 bp, Artificial Sequence
  Description of Artificial Sequence: Synthetic oligonucleotide
  Target: ATXN1; (+) strand; PAM type: NRG; PAM sequence: CGG
cggaccagcagccgggggag

SEQ ID NO: 154659 - DNA, 20 bp, Artificial Sequence
  Description of Artificial Sequence: Synthetic oligonucleotide
  Target: ATXN1; (+) strand; PAM type: NRG; PAM sequence: GGG
ggaccagcagccgggggagc

SEQ ID NO: 154660 - DNA, 20 bp, Artificial Sequence
  Description of Artificial Sequence: Synthetic oligonucleotide
  Target: ATXN1; (+) strand; PAM type: NRG; PAM sequence: GGG
gaccagcagccgggggagcg

SEQ ID NO: 154661 - DNA, 20 bp, Artificial Sequence
  Description of Artificial Sequence: Synthetic oligonucleotide
  Target: ATXN1; (+) strand; PAM type: NRG; PAM sequence: CGG
ccccgcccgcgccccccgcc

SEQ ID NO: 154662 - DNA, 20 bp, Artificial Sequence
  Description of Artificial Sequence: Synthetic oligonucleotide
  Target: ATXN1; (+) strand; PAM type: NRG; PAM sequence: GGG
cccgcccgcgccccccgccc

SEQ ID NO: 154663 - DNA, 20 bp, Artificial Sequence
  Description of Artificial Sequence: Synthetic oligonucleotide
  Target: ATXN1; (+) strand; PAM type: NRG; PAM sequence: TAG
ccccgcccgggcgcgccccc

SEQ ID NO: 154664 - DNA, 20 bp, Artificial Sequence
  Description of Artificial Sequence: Synthetic oligonucleotide
  Target: ATXN1; (+) strand; PAM type: NRG; PAM sequence: CGG
cccgggcgcgccccctagcc

SEQ ID NO: 154665 - DNA, 20 bp, Artificial Sequence
  Description of Artificial Sequence: Synthetic oligonucleotide
  Target: ATXN1; (+) strand; PAM type: NRG; PAM sequence: CGG
gggcgcgccccctagcccgg

SEQ ID NO: 154666 - DNA, 20 bp, Artificial Sequence
  Description of Artificial Sequence: Synthetic oligonucleotide
  Target: ATXN1; (+) strand; PAM type: NRG; PAM sequence: GGG
ggcgcgccccctagcccggc

SEQ ID NO: 154667 - DNA, 20 bp, Artificial Sequence
  Description of Artificial Sequence: Synthetic oligonucleotide
  Target: ATXN1; (+) strand; PAM type: NRG; PAM sequence: CAG
tagcccggcgggcgcccacc

SEQ ID NO: 154668 - DNA, 20 bp, Artificial Sequence
  Description of Artificial Sequence: Synthetic oligonucleotide
  Target: ATXN1; (+) strand; PAM type: NRG; PAM sequence: CAG
ggcgcccacccagcccctga

SEQ ID NO: 154669 - DNA, 20 bp, Artificial Sequence
  Description of Artificial Sequence: Synthetic oligonucleotide
  Target: ATXN1; (+) strand; PAM type: NRG; PAM sequence: CGG
gcccctgacagcccccccgc

SEQ ID NO: 154670 - DNA, 20 bp, Artificial Sequence
  Description of Artificial Sequence: Synthetic oligonucleotide
  Target: ATXN1; (+) strand; PAM type: NRG; PAM sequence: CAG
ccgccggccgcccctgcgcc

SEQ ID NO: 154671 - DNA, 20 bp, Artificial Sequence
  Description of Artificial Sequence: Synthetic oligonucleotide
  Target: ATXN1; (+) strand; PAM type: NRG; PAM sequence: GAG
gccggccgcccctgcgccca

SEQ ID NO: 154672 - DNA, 20 bp, Artificial Sequence
  Description of Artificial Sequence: Synthetic oligonucleotide
  Target: ATXN1; (+) strand; PAM type: NRG; PAM sequence: TGG
ggccgcccctgcgcccagag

SEQ ID NO: 154673 - DNA, 20 bp, Artificial Sequence
  Description of Artificial Sequence: Synthetic oligonucleotide
  Target: ATXN1; (+) strand; PAM type: NRG; PAM sequence: GGG
gccgcccctgcgcccagagt

SEQ ID NO: 154674 - DNA, 20 bp, Artificial Sequence
  Description of Artificial Sequence: Synthetic oligonucleotide
  Target: ATXN1; (+) strand; PAM type: NRG; PAM sequence: GGG
ccgcccctgcgcccagagtg

SEQ ID NO: 154675 - DNA, 20 bp, Artificial Sequence
  Description of Artificial Sequence: Synthetic oligonucleotide
  Target: ATXN1; (+) strand; PAM type: NRG; PAM sequence: GGG
cgcccctgcgcccagagtgg

SEQ ID NO: 154676 - DNA, 20 bp, Artificial Sequence
  Description of Artificial Sequence: Synthetic oligonucleotide
  Target: ATXN1; (+) strand; PAM type: NRG; PAM sequence: CGG
tgcgcccagagtgggggtgt

SEQ ID NO: 154677 - DNA, 20 bp, Artificial Sequence
  Description of Artificial Sequence: Synthetic oligonucleotide
  Target: ATXN1; (+) strand; PAM type: NRG; PAM sequence: CGG
ccagagtgggggtgtcggcc

SEQ ID NO: 154678 - DNA, 20 bp, Artificial Sequence
  Description of Artificial Sequence: Synthetic oligonucleotide
  Target: ATXN1; (+) strand; PAM type: NRG; PAM sequence: GGG
cagagtgggggtgtcggccc

SEQ ID NO: 154679 - DNA, 20 bp, Artificial Sequence
  Description of Artificial Sequence: Synthetic oligonucleotide
  Target: ATXN1; (+) strand; PAM type: NRG; PAM sequence: GAG
gagtgggggtgtcggcccgg

SEQ ID NO: 154680 - DNA, 20 bp, Artificial Sequence
  Description of Artificial Sequence: Synthetic oligonucleotide
  Target: ATXN1; (+) strand; PAM type: NRG; PAM sequence: TGG
ggggtgtcggcccgggagcc

SEQ ID NO: 154681 - DNA, 20 bp, Artificial Sequence
  Description of Artificial Sequence: Synthetic oligonucleotide
  Target: ATXN1; (+) strand; PAM type: NRG; PAM sequence: GAG
ggtgtcggcccgggagcctg

SEQ ID NO: 154682 - DNA, 20 bp, Artificial Sequence
  Description of Artificial Sequence: Synthetic oligonucleotide
  Target: ATXN1; (+) strand; PAM type: NRG; PAM sequence: CGG
tcggcccgggagcctggagc

SEQ ID NO: 154683 - DNA, 20 bp, Artificial Sequence
  Description of Artificial Sequence: Synthetic oligonucleotide
  Target: ATXN1; (+) strand; PAM type: NRG; PAM sequence: GGG
cggcccgggagcctggagcc

SEQ ID NO: 154684 - DNA, 20 bp, Artificial Sequence
  Description of Artificial Sequence: Synthetic oligonucleotide
  Target: ATXN1; (+) strand; PAM type: NRG; PAM sequence: GGG
ggcccgggagcctggagccg

SEQ ID NO: 154685 - DNA, 20 bp, Artificial Sequence
  Description of Artificial Sequence: Synthetic oligonucleotide
  Target: ATXN1; (+) strand; PAM type: NRG; PAM sequence: CGG
cgggagcctggagccgggga

SEQ ID NO: 154686 - DNA, 20 bp, Artificial Sequence
  Description of Artificial Sequence: Synthetic oligonucleotide
  Target: ATXN1; (+) strand; PAM type: NRG; PAM sequence: CAG
cacacacacacgcacacaca

SEQ ID NO: 154687 - DNA, 20 bp, Artificial Sequence
  Description of Artificial Sequence: Synthetic oligonucleotide
  Target: ATXN1; (+) strand; PAM type: NRG; PAM sequence: CAG
gatttccttcgctcctcttc

SEQ ID NO: 154688 - DNA, 20 bp, Artificial Sequence
  Description of Artificial Sequence: Synthetic oligonucleotide
  Target: ATXN1; (+) strand; PAM type: NRG; PAM sequence: CAG
tcttccagctgttttccgtg

SEQ ID NO: 154689 - DNA, 20 bp, Artificial Sequence
  Description of Artificial Sequence: Synthetic oligonucleotide
  Target: ATXN1; (+) strand; PAM type: NRG; PAM sequence: TGG
ctgttttccgtgcagccgat

SEQ ID NO: 154690 - DNA, 20 bp, Artificial Sequence
  Description of Artificial Sequence: Synthetic oligonucleotide
  Target: ATXN1; (+) strand; PAM type: NRG; PAM sequence: GGG
tgttttccgtgcagccgatt

SEQ ID NO: 154691 - DNA, 20 bp, Artificial Sequence
  Description of Artificial Sequence: Synthetic oligonucleotide
  Target: ATXN1; (+) strand; PAM type: NRG; PAM sequence: GGG
gttttccgtgcagccgattg

SEQ ID NO: 154692 - DNA, 20 bp, Artificial Sequence
  Description of Artificial Sequence: Synthetic oligonucleotide
  Target: ATXN1; (+) strand; PAM type: NRG; PAM sequence: TGG
cgtgcagccgattggggttt

SEQ ID NO: 154693 - DNA, 20 bp, Artificial Sequence
  Description of Artificial Sequence: Synthetic oligonucleotide
  Target: ATXN1; (+) strand; PAM type: NRG; PAM sequence: GGG
gtgcagccgattggggtttt

SEQ ID NO: 154694 - DNA, 20 bp, Artificial Sequence
  Description of Artificial Sequence: Synthetic oligonucleotide
  Target: ATXN1; (+) strand; PAM type: NRG; PAM sequence: TGG
ggggttttgggtttgtttgc

SEQ ID NO: 154695 - DNA, 20 bp, Artificial Sequence
  Description of Artificial Sequence: Synthetic oligonucleotide
  Target: ATXN1; (+) strand; PAM type: NRG; PAM sequence: CGG
gttgttgcttttgcccctct

SEQ ID NO: 154696 - DNA, 20 bp, Artificial Sequence
  Description of Artificial Sequence: Synthetic oligonucleotide
  Target: ATXN1; (+) strand; PAM type: NRG; PAM sequence: GGG
ttgttgcttttgcccctctc

SEQ ID NO: 154697 - DNA, 20 bp, Artificial Sequence
  Description of Artificial Sequence: Synthetic oligonucleotide
  Target: ATXN1; (+) strand; PAM type: NRG; PAM sequence: GAG
gttgcttttgcccctctcgg

SEQ ID NO: 154698 - DNA, 20 bp, Artificial Sequence
  Description of Artificial Sequence: Synthetic oligonucleotide
  Target: ATXN1; (+) strand; PAM type: NRG; PAM sequence: CGG
ttttgcccctctcgggagat

SEQ ID NO: 154699 - DNA, 20 bp, Artificial Sequence
  Description of Artificial Sequence: Synthetic oligonucleotide
  Target: ATXN1; (+) strand; PAM type: NRG; PAM sequence: GGG
tttgcccctctcgggagatc

SEQ ID NO: 154700 - DNA, 20 bp, Artificial Sequence
  Description of Artificial Sequence: Synthetic oligonucleotide
  Target: ATXN1; (+) strand; PAM type: NRG; PAM sequence: GGG
ttgcccctctcgggagatcg

SEQ ID NO: 154701 - DNA, 20 bp, Artificial Sequence
  Description of Artificial Sequence: Synthetic oligonucleotide
  Target: ATXN1; (+) strand; PAM type: NRG; PAM sequence: GGG
tgcccctctcgggagatcgg

SEQ ID NO: 154702 - DNA, 20 bp, Artificial Sequence
  Description of Artificial Sequence: Synthetic oligonucleotide
  Target: ATXN1; (+) strand; PAM type: NRG; PAM sequence: GAG
cccctctcgggagatcgggg

SEQ ID NO: 154703 - DNA, 20 bp, Artificial Sequence
  Description of Artificial Sequence: Synthetic oligonucleotide
  Target: ATXN1; (+) strand; PAM type: NRG; PAM sequence: AGG
ccctctcgggagatcggggg

SEQ ID NO: 154704 - DNA, 20 bp, Artificial Sequence
  Description of Artificial Sequence: Synthetic oligonucleotide
  Target: ATXN1; (+) strand; PAM type: NRG; PAM sequence: GAG
ctctcgggagatcgggggag

SEQ ID NO: 154705 - DNA, 20 bp, Artificial Sequence
  Description of Artificial Sequence: Synthetic oligonucleotide
  Target: ATXN1; (+) strand; PAM type: NRG; PAM sequence: AGG
tctcgggagatcgggggagg

SEQ ID NO: 154706 - DNA, 20 bp, Artificial Sequence
  Description of Artificial Sequence: Synthetic oligonucleotide
  Target: ATXN1; (+) strand; PAM type: NRG; PAM sequence: GGG
ctcgggagatcgggggagga

SEQ ID NO: 154707 - DNA, 20 bp, Artificial Sequence
  Description of Artificial Sequence: Synthetic oligonucleotide
  Target: ATXN1; (+) strand; PAM type: NRG; PAM sequence: AAG
ggagggattttaatctaaat

SEQ ID NO: 154708 - DNA, 20 bp, Artificial Sequence
  Description of Artificial Sequence: Synthetic oligonucleotide
  Target: ATXN1; (+) strand; PAM type: NRG; PAM sequence: AGG
gagggattttaatctaaata

SEQ ID NO: 154709 - DNA, 20 bp, Artificial Sequence
  Description of Artificial Sequence: Synthetic oligonucleotide
  Target: ATXN1; (+) strand; PAM type: NRG; PAM sequence: GGG
agggattttaatctaaataa

SEQ ID NO: 154710 - DNA, 20 bp, Artificial Sequence
  Description of Artificial Sequence: Synthetic oligonucleotide
  Target: ATXN1; (+) strand; PAM type: NRG; PAM sequence: GGG
gggattttaatctaaataag

SEQ ID NO: 154711 - DNA, 20 bp, Artificial Sequence
  Description of Artificial Sequence: Synthetic oligonucleotide
  Target: ATXN1; (+) strand; PAM type: NRG; PAM sequence: GAG
gattttaatctaaataaggg

SEQ ID NO: 154712 - DNA, 20 bp, Artificial Sequence
  Description of Artificial Sequence: Synthetic oligonucleotide
  Target: ATXN1; (+) strand; PAM type: NRG; PAM sequence: AAG
tttaatctaaataaggggag

SEQ ID NO: 154713 - DNA, 20 bp, Artificial Sequence
  Description of Artificial Sequence: Synthetic oligonucleotide
  Target: ATXN1; (+) strand; PAM type: NRG; PAM sequence: AGG
ttaatctaaataaggggaga

SEQ ID NO: 154714 - DNA, 20 bp, Artificial Sequence
  Description of Artificial Sequence: Synthetic oligonucleotide
  Target: ATXN1; (+) strand; PAM type: NRG; PAM sequence: GGG
taatctaaataaggggagaa

SEQ ID NO: 154715 - DNA, 20 bp, Artificial Sequence
  Description of Artificial Sequence: Synthetic oligonucleotide
  Target: ATXN1; (+) strand; PAM type: NRG; PAM sequence: TGG
taaataaggggagaagggaa

SEQ ID NO: 154716 - DNA, 20 bp, Artificial Sequence
  Description of Artificial Sequence: Synthetic oligonucleotide
  Target: ATXN1; (+) strand; PAM type: NRG; PAM sequence: GGG
aaataaggggagaagggaat

SEQ ID NO: 154717 - DNA, 20 bp, Artificial Sequence
  Description of Artificial Sequence: Synthetic oligonucleotide
  Target: ATXN1; (+) strand; PAM type: NRG; PAM sequence: GGG
aataaggggagaagggaatg

SEQ ID NO: 154718 - DNA, 20 bp, Artificial Sequence
  Description of Artificial Sequence: Synthetic oligonucleotide
  Target: ATXN1; (+) strand; PAM type: NRG; PAM sequence: GGG
ataaggggagaagggaatgg

SEQ ID NO: 154719 - DNA, 20 bp, Artificial Sequence
  Description of Artificial Sequence: Synthetic oligonucleotide
  Target: ATXN1; (+) strand; PAM type: NRG; PAM sequence: GAG
aaggggagaagggaatgggg

SEQ ID NO: 154720 - DNA, 20 bp, Artificial Sequence
  Description of Artificial Sequence: Synthetic oligonucleotide
  Target: ATXN1; (+) strand; PAM type: NRG; PAM sequence: AGG
aggggagaagggaatggggg

SEQ ID NO: 154721 - DNA, 20 bp, Artificial Sequence
  Description of Artificial Sequence: Synthetic oligonucleotide
  Target: ATXN1; (+) strand; PAM type: NRG; PAM sequence: GGG
ggggagaagggaatggggga

SEQ ID NO: 154722 - DNA, 20 bp, Artificial Sequence
  Description of Artificial Sequence: Synthetic oligonucleotide
  Target: ATXN1; (+) strand; PAM type: NRG; PAM sequence: GGG
gggagaagggaatgggggag

SEQ ID NO: 154723 - DNA, 20 bp, Artificial Sequence
  Description of Artificial Sequence: Synthetic oligonucleotide
  Target: ATXN1; (+) strand; PAM type: NRG; PAM sequence: GGG
ggagaagggaatgggggagg

SEQ ID NO: 154724 - DNA, 20 bp, Artificial Sequence
  Description of Artificial Sequence: Synthetic oligonucleotide
  Target: ATXN1; (+) strand; PAM type: NRG; PAM sequence: GGG
gagaagggaatgggggaggg

SEQ ID NO: 154725 - DNA, 20 bp, Artificial Sequence
  Description of Artificial Sequence: Synthetic oligonucleotide
  Target: ATXN1; (+) strand; PAM type: NRG; PAM sequence: AAG
agggaatgggggagggggga

SEQ ID NO: 154726 - DNA, 20 bp, Artificial Sequence
  Description of Artificial Sequence: Synthetic oligonucleotide
  Target: ATXN1; (+) strand; PAM type: NRG; PAM sequence: CGG
tgggggaggggggaaagaat

SEQ ID NO: 154727 - DNA, 20 bp, Artificial Sequence
  Description of Artificial Sequence: Synthetic oligonucleotide
  Target: ATXN1; (+) strand; PAM type: NRG; PAM sequence: GAG
ggggaggggggaaagaatcg

SEQ ID NO: 154728 - DNA, 20 bp, Artificial Sequence
  Description of Artificial Sequence: Synthetic oligonucleotide
  Target: ATXN1; (+) strand; PAM type: NRG; PAM sequence: AGG
gggaggggggaaagaatcgg

SEQ ID NO: 154729 - DNA, 20 bp, Artificial Sequence
  Description of Artificial Sequence: Synthetic oligonucleotide
  Target: ATXN1; (+) strand; PAM type: NRG; PAM sequence: GAG
gaggggggaaagaatcggag

SEQ ID NO: 154730 - DNA, 20 bp, Artificial Sequence
  Description of Artificial Sequence: Synthetic oligonucleotide
  Target: ATXN1; (+) strand; PAM type: NRG; PAM sequence: AGG
aggggggaaagaatcggagg

SEQ ID NO: 154731 - DNA, 20 bp, Artificial Sequence
  Description of Artificial Sequence: Synthetic oligonucleotide
  Target: ATXN1; (+) strand; PAM type: NRG; PAM sequence: TAG
atcggaggaggaaaaaaaaa

SEQ ID NO: 154732 - DNA, 20 bp, Artificial Sequence
  Description of Artificial Sequence: Synthetic oligonucleotide
  Target: ATXN1; (+) strand; PAM type: NRG; PAM sequence: AAG
aaaaatagtcacttactgta

SEQ ID NO: 154733 - DNA, 20 bp, Artificial Sequence
  Description of Artificial Sequence: Synthetic oligonucleotide
  Target: ATXN1; (+) strand; PAM type: NRG; PAM sequence: TGG
cacttactgtaaagtgtaaa

SEQ ID NO: 154734 - DNA, 20 bp, Artificial Sequence
  Description of Artificial Sequence: Synthetic oligonucleotide
  Target: ATXN1; (+) strand; PAM type: NRG; PAM sequence: TGG
ctgtaaagtgtaaatggatc

SEQ ID NO: 154735 - DNA, 20 bp, Artificial Sequence
  Description of Artificial Sequence: Synthetic oligonucleotide
  Target: ATXN1; (+) strand; PAM type: NRG; PAM sequence: GGG
tgtaaagtgtaaatggatct

SEQ ID NO: 154736 - DNA, 20 bp, Artificial Sequence
  Description of Artificial Sequence: Synthetic oligonucleotide
  Target: ATXN1; (+) strand; PAM type: NRG; PAM sequence: GGG
gtaaagtgtaaatggatctg

SEQ ID NO: 154737 - DNA, 20 bp, Artificial Sequence
  Description of Artificial Sequence: Synthetic oligonucleotide
  Target: ATXN1; (+) strand; PAM type: NRG; PAM sequence: TGG
taaatggatctggggttgcg

SEQ ID NO: 154738 - DNA, 20 bp, Artificial Sequence
  Description of Artificial Sequence: Synthetic oligonucleotide
  Target: ATXN1; (+) strand; PAM type: NRG; PAM sequence: GGG
aaatggatctggggttgcgt

SEQ ID NO: 154739 - DNA, 20 bp, Artificial Sequence
  Description of Artificial Sequence: Synthetic oligonucleotide
  Target: ATXN1; (+) strand; PAM type: NRG; PAM sequence: GGG
aatggatctggggttgcgtg

SEQ ID NO: 154740 - DNA, 20 bp, Artificial Sequence
  Description of Artificial Sequence: Synthetic oligonucleotide
  Target: ATXN1; (+) strand; PAM type: NRG; PAM sequence: AAG
ggatctggggttgcgtgggg

SEQ ID NO: 154741 - DNA, 20 bp, Artificial Sequence
  Description of Artificial Sequence: Synthetic oligonucleotide
  Target: ATXN1; (+) strand; PAM type: NRG; PAM sequence: AGG
gatctggggttgcgtgggga

SEQ ID NO: 154742 - DNA, 20 bp, Artificial Sequence
  Description of Artificial Sequence: Synthetic oligonucleotide
  Target: ATXN1; (+) strand; PAM type: NRG; PAM sequence: GGG
atctggggttgcgtggggaa

SEQ ID NO: 154743 - DNA, 20 bp, Artificial Sequence
  Description of Artificial Sequence: Synthetic oligonucleotide
  Target: ATXN1; (+) strand; PAM type: NRG; PAM sequence: GGG
tctggggttgcgtggggaag

SEQ ID NO: 154744 - DNA, 20 bp, Artificial Sequence
  Description of Artificial Sequence: Synthetic oligonucleotide
  Target: ATXN1; (+) strand; PAM type: NRG; PAM sequence: GGG
ctggggttgcgtggggaagg

SEQ ID NO: 154745 - DNA, 20 bp, Artificial Sequence
  Description of Artificial Sequence: Synthetic oligonucleotide
  Target: ATXN1; (+) strand; PAM type: NRG; PAM sequence: GGG
tggggttgcgtggggaaggg

SEQ ID NO: 154746 - DNA, 20 bp, Artificial Sequence
  Description of Artificial Sequence: Synthetic oligonucleotide
  Target: ATXN1; (+) strand; PAM type: NRG; PAM sequence: GGG
ggggttgcgtggggaagggg

SEQ ID NO: 154747 - DNA, 20 bp, Artificial Sequence
  Description of Artificial Sequence: Synthetic oligonucleotide
  Target: ATXN1; (+) strand; PAM type: NRG; PAM sequence: CAG
gttgcgtggggaaggggggg

SEQ ID NO: 154748 - DNA, 20 bp, Artificial Sequence
  Description of Artificial Sequence: Synthetic oligonucleotide
  Target: ATXN1; (+) strand; PAM type: NRG; PAM sequence: GAG
tgcgtggggaagggggggca

SEQ ID NO: 154749 - DNA, 20 bp, Artificial Sequence
  Description of Artificial Sequence: Synthetic oligonucleotide
  Target: ATXN1; (+) strand; PAM type: NRG; PAM sequence: AGG
gcgtggggaagggggggcag

SEQ ID NO: 154750 - DNA, 20 bp, Artificial Sequence
  Description of Artificial Sequence: Synthetic oligonucleotide
  Target: ATXN1; (+) strand; PAM type: NRG; PAM sequence: GGG
cgtggggaagggggggcaga

SEQ ID NO: 154751 - DNA, 20 bp, Artificial Sequence
  Description of Artificial Sequence: Synthetic oligonucleotide
  Target: ATXN1; (+) strand; PAM type: NRG; PAM sequence: GAG
tggggaagggggggcagagg

SEQ ID NO: 154752 - DNA, 20 bp, Artificial Sequence
  Description of Artificial Sequence: Synthetic oligonucleotide
  Target: ATXN1; (+) strand; PAM type: NRG; PAM sequence: GAG
gggaagggggggcagaggga

SEQ ID NO: 154753 - DNA, 20 bp, Artificial Sequence
  Description of Artificial Sequence: Synthetic oligonucleotide
  Target: ATXN1; (+) strand; PAM type: NRG; PAM sequence: CGG
gggagagaaacaatgtcttg

SEQ ID NO: 154754 - DNA, 20 bp, Artificial Sequence
  Description of Artificial Sequence: Synthetic oligonucleotide
  Target: ATXN1; (+) strand; PAM type: NRG; PAM sequence: TGG
tcttgcggctgctgttgctc

SEQ ID NO: 154755 - DNA, 20 bp, Artificial Sequence
  Description of Artificial Sequence: Synthetic oligonucleotide
  Target: ATXN1; (+) strand; PAM type: NRG; PAM sequence: CGG
ttgctctggctgctgctcca

SEQ ID NO: 154756 - DNA, 20 bp, Artificial Sequence
  Description of Artificial Sequence: Synthetic oligonucleotide
  Target: ATXN1; (+) strand; PAM type: NRG; PAM sequence: GGG
tgctctggctgctgctccac

SEQ ID NO: 154757 - DNA, 20 bp, Artificial Sequence
  Description of Artificial Sequence: Synthetic oligonucleotide
  Target: ATXN1; (+) strand; PAM type: NRG; PAM sequence: GGG
gctctggctgctgctccacg

SEQ ID NO: 154758 - DNA, 20 bp, Artificial Sequence
  Description of Artificial Sequence: Synthetic oligonucleotide
  Target: ATXN1; (+) strand; PAM type: NRG; PAM sequence: TGG
ctgctccacggggcttgttt

SEQ ID NO: 154759 - DNA, 20 bp, Artificial Sequence
  Description of Artificial Sequence: Synthetic oligonucleotide
  Target: ATXN1; (+) strand; PAM type: NRG; PAM sequence: CAG
gcttgttttggatccccctg

SEQ ID NO: 154760 - DNA, 20 bp, Artificial Sequence
  Description of Artificial Sequence: Synthetic oligonucleotide
  Target: ATXN1; (+) strand; PAM type: NRG; PAM sequence: CAG
tggatccccctgcagtgaaa

SEQ ID NO: 154761 - DNA, 20 bp, Artificial Sequence
  Description of Artificial Sequence: Synthetic oligonucleotide
  Target: ATXN1; (+) strand; PAM type: NRG; PAM sequence: AGG
ggatccccctgcagtgaaac

SEQ ID NO: 154762 - DNA, 20 bp, Artificial Sequence
  Description of Artificial Sequence: Synthetic oligonucleotide
  Target: ATXN1; (+) strand; PAM type: NRG; PAM sequence: CGG
gcagtgaaacaggtcctgta

SEQ ID NO: 154763 - DNA, 20 bp, Artificial Sequence
  Description of Artificial Sequence: Synthetic oligonucleotide
  Target: ATXN1; (+) strand; PAM type: NRG; PAM sequence: TAG
cctgtacggctccgccactg

SEQ ID NO: 154764 - DNA, 20 bp, Artificial Sequence
  Description of Artificial Sequence: Synthetic oligonucleotide
  Target: ATXN1; (+) strand; PAM type: NRG; PAM sequence: TAG
gtacggctccgccactgtag

SEQ ID NO: 154765 - DNA, 20 bp, Artificial Sequence
  Description of Artificial Sequence: Synthetic oligonucleotide
  Target: ATXN1; (+) strand; PAM type: NRG; PAM sequence: CGG
tgtagtagaaatgatgtctg

SEQ ID NO: 154766 - DNA, 20 bp, Artificial Sequence
  Description of Artificial Sequence: Synthetic oligonucleotide
  Target: ATXN1; (+) strand; PAM type: NRG; PAM sequence: CAG
gctcgctcgctcgctcgctc

SEQ ID NO: 154767 - DNA, 20 bp, Artificial Sequence
  Description of Artificial Sequence: Synthetic oligonucleotide
  Target: ATXN1; (+) strand; PAM type: NRG; PAM sequence: TAG
tccagtatgtaaatgtgtaa

SEQ ID NO: 154768 - DNA, 20 bp, Artificial Sequence
  Description of Artificial Sequence: Synthetic oligonucleotide
  Target: ATXN1; (+) strand; PAM type: NRG; PAM sequence: AAG
agtatgtaaatgtgtaatag

SEQ ID NO: 154769 - DNA, 20 bp, Artificial Sequence
  Description of Artificial Sequence: Synthetic oligonucleotide
  Target: ATXN1; (+) strand; PAM type: NRG; PAM sequence: TGG
tgtgtaatagaagccaaata

SEQ ID NO: 154770 - DNA, 20 bp, Artificial Sequence
  Description of Artificial Sequence: Synthetic oligonucleotide
  Target: ATXN1; (+) strand; PAM type: NRG; PAM sequence: GAG
tgtaatagaagccaaatatg

SEQ ID NO: 154771 - DNA, 20 bp, Artificial Sequence
  Description of Artificial Sequence: Synthetic oligonucleotide
  Target: ATXN1; (+) strand; PAM type: NRG; PAM sequence: CAG
aatagaagccaaatatggag

SEQ ID NO: 154772 - DNA, 20 bp, Artificial Sequence
  Description of Artificial Sequence: Synthetic oligonucleotide
  Target: ATXN1; (+) strand; PAM type: NRG; PAM sequence: TGG
gaagccaaatatggagcagt

SEQ ID NO: 154773 - DNA, 20 bp, Artificial Sequence
  Description of Artificial Sequence: Synthetic oligonucleotide
  Target: ATXN1; (+) strand; PAM type: NRG; PAM sequence: CAG
gcagttggctgccgccgccg

SEQ ID NO: 154774 - DNA, 20 bp, Artificial Sequence
  Description of Artificial Sequence: Synthetic oligonucleotide
  Target: ATXN1; (+) strand; PAM type: NRG; PAM sequence: AAG
ggctgccgccgccgcagctc

SEQ ID NO: 154775 - DNA, 20 bp, Artificial Sequence
  Description of Artificial Sequence: Synthetic oligonucleotide
  Target: ATXN1; (+) strand; PAM type: NRG; PAM sequence: AGG
gctgccgccgccgcagctca

SEQ ID NO: 154776 - DNA, 20 bp, Artificial Sequence
  Description of Artificial Sequence: Synthetic oligonucleotide
  Target: ATXN1; (+) strand; PAM type: NRG; PAM sequence: TGG
agctcaaggatccgacttca

SEQ ID NO: 154777 - DNA, 20 bp, Artificial Sequence
  Description of Artificial Sequence: Synthetic oligonucleotide
  Target: ATXN1; (+) strand; PAM type: NRG; PAM sequence: GGG
gctcaaggatccgacttcat

SEQ ID NO: 154778 - DNA, 20 bp, Artificial Sequence
  Description of Artificial Sequence: Synthetic oligonucleotide
  Target: ATXN1; (+) strand; PAM type: NRG; PAM sequence: GGG
ctcaaggatccgacttcatg

SEQ ID NO: 154779 - DNA, 20 bp, Artificial Sequence
  Description of Artificial Sequence: Synthetic oligonucleotide
  Target: ATXN1; (+) strand; PAM type: NRG; PAM sequence: GGG
tcaaggatccgacttcatgg

SEQ ID NO: 154780 - DNA, 20 bp, Artificial Sequence
  Description of Artificial Sequence: Synthetic oligonucleotide
  Target: ATXN1; (+) strand; PAM type: NRG; PAM sequence: TGG
aggatccgacttcatggggg

SEQ ID NO: 154781 - DNA, 20 bp, Artificial Sequence
  Description of Artificial Sequence: Synthetic oligonucleotide
  Target: ATXN1; (+) strand; PAM type: NRG; PAM sequence: GGG
ggatccgacttcatgggggt

SEQ ID NO: 154782 - DNA, 20 bp, Artificial Sequence
  Description of Artificial Sequence: Synthetic oligonucleotide
  Target: ATXN1; (+) strand; PAM type: NRG; PAM sequence: GGG
gatccgacttcatgggggtg

SEQ ID NO: 154783 - DNA, 20 bp, Artificial Sequence
  Description of Artificial Sequence: Synthetic oligonucleotide
  Target: ATXN1; (+) strand; PAM type: NRG; PAM sequence: GGG
atccgacttcatgggggtgg

SEQ ID NO: 154784 - DNA, 20 bp, Artificial Sequence
  Description of Artificial Sequence: Synthetic oligonucleotide
  Target: ATXN1; (+) strand; PAM type: NRG; PAM sequence: GGG
tccgacttcatgggggtggg

SEQ ID NO: 154785 - DNA, 20 bp, Artificial Sequence
  Description of Artificial Sequence: Synthetic oligonucleotide
  Target: ATXN1; (+) strand; PAM type: NRG; PAM sequence: TGG
tgggggtggggggcaccctc

SEQ ID NO: 154786 - DNA, 20 bp, Artificial Sequence
  Description of Artificial Sequence: Synthetic oligonucleotide
  Target: ATXN1; (+) strand; PAM type: NRG; PAM sequence: CGG
gggtggggggcaccctctgg

SEQ ID NO: 154787 - DNA, 20 bp, Artificial Sequence
  Description of Artificial Sequence: Synthetic oligonucleotide
  Target: ATXN1; (+) strand; PAM type: NRG; PAM sequence: GGG
ggtggggggcaccctctggc

SEQ ID NO: 154788 - DNA, 20 bp, Artificial Sequence
  Description of Artificial Sequence: Synthetic oligonucleotide
  Target: ATXN1; (+) strand; PAM type: NRG; PAM sequence: CGG
ggggggcaccctctggcggg

SEQ ID NO: 154789 - DNA, 20 bp, Artificial Sequence
  Description of Artificial Sequence: Synthetic oligonucleotide
  Target: ATXN1; (+) strand; PAM type: NRG; PAM sequence: CGG
gcaccctctggcgggcggcc

SEQ ID NO: 154790 - DNA, 20 bp, Artificial Sequence
  Description of Artificial Sequence: Synthetic oligonucleotide
  Target: ATXN1; (+) strand; PAM type: NRG; PAM sequence: GAG
cctctggcgggcggcccggc

SEQ ID NO: 154791 - DNA, 20 bp, Artificial Sequence
  Description of Artificial Sequence: Synthetic oligonucleotide
  Target: ATXN1; (+) strand; PAM type: NRG; PAM sequence: CAG
gggcggcccggcgagccgca

SEQ ID NO: 154792 - DNA, 20 bp, Artificial Sequence
  Description of Artificial Sequence: Synthetic oligonucleotide
  Target: ATXN1; (+) strand; PAM type: NRG; PAM sequence: GAG
gcggcccggcgagccgcaca

SEQ ID NO: 154793 - DNA, 20 bp, Artificial Sequence
  Description of Artificial Sequence: Synthetic oligonucleotide
  Target: ATXN1; (+) strand; PAM type: NRG; PAM sequence: CGG
ccggcgagccgcacagagca

SEQ ID NO: 154794 - DNA, 20 bp, Artificial Sequence
  Description of Artificial Sequence: Synthetic oligonucleotide
  Target: ATXN1; (+) strand; PAM type: NRG; PAM sequence: GAG
cgagccgcacagagcacggc

SEQ ID NO: 154795 - DNA, 20 bp, Artificial Sequence
  Description of Artificial Sequence: Synthetic oligonucleotide
  Target: ATXN1; (+) strand; PAM type: NRG; PAM sequence: CGG
agcacggcgagcgcaccgcg

SEQ ID NO: 154796 - DNA, 20 bp, Artificial Sequence
  Description of Artificial Sequence: Synthetic oligonucleotide
  Target: ATXN1; (+) strand; PAM type: NRG; PAM sequence: CGG
acggcgagcgcaccgcgcgg

SEQ ID NO: 154797 - DNA, 20 bp, Artificial Sequence
  Description of Artificial Sequence: Synthetic oligonucleotide
  Target: ATXN1; (+) strand; PAM type: NRG; PAM sequence: CGG
cgagcgcaccgcgcggcggc

SEQ ID NO: 154798 - DNA, 20 bp, Artificial Sequence
  Description of Artificial Sequence: Synthetic oligonucleotide
  Target: ATXN1; (+) strand; PAM type: NRG; PAM sequence: CGG
acccttcgctgcgcgccgcc

SEQ ID NO: 154799 - DNA, 20 bp, Artificial Sequence
  Description of Artificial Sequence: Synthetic oligonucleotide
  Target: ATXN1; (+) strand; PAM type: NRG; PAM sequence: GGG
cccttcgctgcgcgccgccc

SEQ ID NO: 154800 - DNA, 20 bp, Artificial Sequence
  Description of Artificial Sequence: Synthetic oligonucleotide
  Target: ATXN1; (+) strand; PAM type: NRG; PAM sequence: GGG
ccttcgctgcgcgccgcccg

SEQ ID NO: 154801 - DNA, 20 bp, Artificial Sequence
  Description of Artificial Sequence: Synthetic oligonucleotide
  Target: ATXN1; (+) strand; PAM type: NRG; PAM sequence: GAG
ttcgctgcgcgccgcccggg

SEQ ID NO: 154802 - DNA, 20 bp, Artificial Sequence
  Description of Artificial Sequence: Synthetic oligonucleotide
  Target: ATXN1; (+) strand; PAM type: NRG; PAM sequence: AGG
tcgctgcgcgccgcccgggg

SEQ ID NO: 154803 - DNA, 20 bp, Artificial Sequence
  Description of Artificial Sequence: Synthetic oligonucleotide
  Target: ATXN1; (+) strand; PAM type: NRG; PAM sequence: CGG
ctgcgcgccgcccggggagg

SEQ ID NO: 154804 - DNA, 20 bp, Artificial Sequence
  Description of Artificial Sequence: Synthetic oligonucleotide
  Target: ATXN1; (+) strand; PAM type: NRG; PAM sequence: GGG
tgcgcgccgcccggggaggc

SEQ ID NO: 154805 - DNA, 20 bp, Artificial Sequence
  Description of Artificial Sequence: Synthetic oligonucleotide
  Target: ATXN1; (+) strand; PAM type: NRG; PAM sequence: AAG
ggaggcgggcacctttccca

SEQ ID NO: 154806 - DNA, 20 bp, Artificial Sequence
  Description of Artificial Sequence: Synthetic oligonucleotide
  Target: ATXN1; (+) strand; PAM type: NRG; PAM sequence: GAG
aggcgggcacctttcccaaa

SEQ ID NO: 154807 - DNA, 20 bp, Artificial Sequence
  Description of Artificial Sequence: Synthetic oligonucleotide
  Target: ATXN1; (+) strand; PAM type: NRG; PAM sequence: TGG
cgggcacctttcccaaagag

SEQ ID NO: 154808 - DNA, 20 bp, Artificial Sequence
  Description of Artificial Sequence: Synthetic oligonucleotide
  Target: ATXN1; (+) strand; PAM type: NRG; PAM sequence: CGG
acctttcccaaagagtggct

SEQ ID NO: 154809 - DNA, 20 bp, Artificial Sequence
  Description of Artificial Sequence: Synthetic oligonucleotide
  Target: ATXN1; (+) strand; PAM type: NRG; PAM sequence: GGG
cctttcccaaagagtggctc

SEQ ID NO: 154810 - DNA, 20 bp, Artificial Sequence
  Description of Artificial Sequence: Synthetic oligonucleotide
  Target: ATXN1; (+) strand; PAM type: NRG; PAM sequence: TGG
tcccaaagagtggctcggga

SEQ ID NO: 154811 - DNA, 20 bp, Artificial Sequence
  Description of Artificial Sequence: Synthetic oligonucleotide
  Target: ATXN1; (+) strand; PAM type: NRG; PAM sequence: GGG
cccaaagagtggctcgggat

SEQ ID NO: 154812 - DNA, 20 bp, Artificial Sequence
  Description of Artificial Sequence: Synthetic oligonucleotide
  Target: ATXN1; (+) strand; PAM type: NRG; PAM sequence: GGG
ccaaagagtggctcgggatg

SEQ ID NO: 154813 - DNA, 20 bp, Artificial Sequence
  Description of Artificial Sequence: Synthetic oligonucleotide
  Target: ATXN1; (+) strand; PAM type: NRG; PAM sequence: CGG
gagtggctcgggatggggtg

SEQ ID NO: 154814 - DNA, 20 bp, Artificial Sequence
  Description of Artificial Sequence: Synthetic oligonucleotide
  Target: ATXN1; (+) strand; PAM type: NRG; PAM sequence: GGG
agtggctcgggatggggtgc

SEQ ID NO: 154815 - DNA, 20 bp, Artificial Sequence
  Description of Artificial Sequence: Synthetic oligonucleotide
  Target: ATXN1; (+) strand; PAM type: NRG; PAM sequence: GGG
gtggctcgggatggggtgcg

SEQ ID NO: 154816 - DNA, 20 bp, Artificial Sequence
  Description of Artificial Sequence: Synthetic oligonucleotide
  Target: ATXN1; (+) strand; PAM type: NRG; PAM sequence: GGG
tggctcgggatggggtgcgg

SEQ ID NO: 154817 - DNA, 20 bp, Artificial Sequence
  Description of Artificial Sequence: Synthetic oligonucleotide
  Target: ATXN1; (+) strand; PAM type: NRG; PAM sequence: GAG
gctcgggatggggtgcgggg

SEQ ID NO: 154818 - DNA, 20 bp, Artificial Sequence
  Description of Artificial Sequence: Synthetic oligonucleotide
  Target: ATXN1; (+) strand; PAM type: NRG; PAM sequence: AGG
ctcgggatggggtgcggggg

SEQ ID NO: 154819 - DNA, 20 bp, Artificial Sequence
  Description of Artificial Sequence: Synthetic oligonucleotide
  Target: ATXN1; (+) strand; PAM type: NRG; PAM sequence: GGG
tcgggatggggtgcggggga

SEQ ID NO: 154820 - DNA, 20 bp, Artificial Sequence
  Description of Artificial Sequence: Synthetic oligonucleotide
  Target: ATXN1; (+) strand; PAM type: NRG; PAM sequence: GGG
cgggatggggtgcgggggag

SEQ ID NO: 154821 - DNA, 20 bp, Artificial Sequence
  Description of Artificial Sequence: Synthetic oligonucleotide
  Target: ATXN1; (+) strand; PAM type: NRG; PAM sequence: GAG
ggatggggtgcgggggaggg

SEQ ID NO: 154822 - DNA, 20 bp, Artificial Sequence
  Description of Artificial Sequence: Synthetic oligonucleotide
  Target: ATXN1; (+) strand; PAM type: NRG; PAM sequence: CGG
ggtgcgggggaggggagacg

SEQ ID NO: 154823 - DNA, 20 bp, Artificial Sequence
  Description of Artificial Sequence: Synthetic oligonucleotide
  Target: ATXN1; (+) strand; PAM type: NRG; PAM sequence: CGG
gggggaggggagacgcggac

SEQ ID NO: 154824 - DNA, 20 bp, Artificial Sequence
  Description of Artificial Sequence: Synthetic oligonucleotide
  Target: ATXN1; (+) strand; PAM type: NRG; PAM sequence: GAG
gggaggggagacgcggaccg

SEQ ID NO: 154825 - DNA, 20 bp, Artificial Sequence
  Description of Artificial Sequence: Synthetic oligonucleotide
  Target: ATXN1; (+) strand; PAM type: NRG; PAM sequence: AGG
ggaggggagacgcggaccgg

SEQ ID NO: 154826 - DNA, 20 bp, Artificial Sequence
  Description of Artificial Sequence: Synthetic oligonucleotide
  Target: ATXN1; (+) strand; PAM type: NRG; PAM sequence: GGG
gaggggagacgcggaccgga

SEQ ID NO: 154827 - DNA, 20 bp, Artificial Sequence
  Description of Artificial Sequence: Synthetic oligonucleotide
  Target: ATXN1; (+) strand; PAM type: NRG; PAM sequence: AAG
ggagacgcggaccggagggc

SEQ ID NO: 154828 - DNA, 20 bp, Artificial Sequence
  Description of Artificial Sequence: Synthetic oligonucleotide
  Target: ATXN1; (+) strand; PAM type: NRG; PAM sequence: AGG
gagacgcggaccggagggca

SEQ ID NO: 154829 - DNA, 20 bp, Artificial Sequence
  Description of Artificial Sequence: Synthetic oligonucleotide
  Target: ATXN1; (+) strand; PAM type: NRG; PAM sequence: CAG
ccggagggcaaggttccttc

SEQ ID NO: 154830 - DNA, 20 bp, Artificial Sequence
  Description of Artificial Sequence: Synthetic oligonucleotide
  Target: ATXN1; (+) strand; PAM type: NRG; PAM sequence: AGG
cggagggcaaggttccttcc

SEQ ID NO: 154831 - DNA, 20 bp, Artificial Sequence
  Description of Artificial Sequence: Synthetic oligonucleotide
  Target: ATXN1; (+) strand; PAM type: NRG; PAM sequence: TGG
ggcaaggttccttccaggtt

SEQ ID NO: 154832 - DNA, 20 bp, Artificial Sequence
  Description of Artificial Sequence: Synthetic oligonucleotide
  Target: ATXN1; (+) strand; PAM type: NRG; PAM sequence: GGG
gcaaggttccttccaggttt

SEQ ID NO: 154833 - DNA, 20 bp, Artificial Sequence
  Description of Artificial Sequence: Synthetic oligonucleotide
  Target: ATXN1; (+) strand; PAM type: NRG; PAM sequence: AAG
aggttccttccaggtttggg

SEQ ID NO: 154834 - DNA, 20 bp, Artificial Sequence
  Description of Artificial Sequence: Synthetic oligonucleotide
  Target: ATXN1; (+) strand; PAM type: NRG; PAM sequence: AGG
ggttccttccaggtttggga

SEQ ID NO: 154835 - DNA, 20 bp, Artificial Sequence
  Description of Artificial Sequence: Synthetic oligonucleotide
  Target: ATXN1; (+) strand; PAM type: NRG; PAM sequence: GGG
gttccttccaggtttgggaa

SEQ ID NO: 154836 - DNA, 20 bp, Artificial Sequence
  Description of Artificial Sequence: Synthetic oligonucleotide
  Target: ATXN1; (+) strand; PAM type: NRG; PAM sequence: GGG
ttccttccaggtttgggaag

SEQ ID NO: 154837 - DNA, 20 bp, Artificial Sequence
  Description of Artificial Sequence: Synthetic oligonucleotide
  Target: ATXN1; (+) strand; PAM type: NRG; PAM sequence: GGG
tccttccaggtttgggaagg

SEQ ID NO: 154838 - DNA, 20 bp, Artificial Sequence
  Description of Artificial Sequence: Synthetic oligonucleotide
  Target: ATXN1; (+) strand; PAM type: NRG; PAM sequence: CGG
ttccaggtttgggaaggggg

SEQ ID NO: 154839 - DNA, 20 bp, Artificial Sequence
  Description of Artificial Sequence: Synthetic oligonucleotide
  Target: ATXN1; (+) strand; PAM type: NRG; PAM sequence: GGG
tccaggtttgggaagggggc

SEQ ID NO: 154840 - DNA, 20 bp, Artificial Sequence
  Description of Artificial Sequence: Synthetic oligonucleotide
  Target: ATXN1; (+) strand; PAM type: NRG; PAM sequence: GGG
ccaggtttgggaagggggcg

SEQ ID NO: 154841 - DNA, 20 bp, Artificial Sequence
  Description of Artificial Sequence: Synthetic oligonucleotide
  Target: ATXN1; (+) strand; PAM type: NRG; PAM sequence: GAG
aggtttgggaagggggcggg

SEQ ID NO: 154842 - DNA, 20 bp, Artificial Sequence
  Description of Artificial Sequence: Synthetic oligonucleotide
  Target: ATXN1; (+) strand; PAM type: NRG; PAM sequence: TGG
ttgggaagggggcggggagc

SEQ ID NO: 154843 - DNA, 20 bp, Artificial Sequence
  Description of Artificial Sequence: Synthetic oligonucleotide
  Target: ATXN1; (+) strand; PAM type: NRG; PAM sequence: GGG
tgggaagggggcggggagct

SEQ ID NO: 154844 - DNA, 20 bp, Artificial Sequence
  Description of Artificial Sequence: Synthetic oligonucleotide
  Target: ATXN1; (+) strand; PAM type: NRG; PAM sequence: GAG
ggggcggggagctgggcgat

SEQ ID NO: 154845 - DNA, 20 bp, Artificial Sequence
  Description of Artificial Sequence: Synthetic oligonucleotide
  Target: ATXN1; (+) strand; PAM type: NRG; PAM sequence: AGG
gggcggggagctgggcgatg

SEQ ID NO: 154846 - DNA, 20 bp, Artificial Sequence
  Description of Artificial Sequence: Synthetic oligonucleotide
  Target: ATXN1; (+) strand; PAM type: NRG; PAM sequence: GAG
gctgggcgatgaggtaattt

SEQ ID NO: 154847 - DNA, 20 bp, Artificial Sequence
  Description of Artificial Sequence: Synthetic oligonucleotide
  Target: ATXN1; (+) strand; PAM type: NRG; PAM sequence: CGG
gggcgatgaggtaatttgag

SEQ ID NO: 154848 - DNA, 20 bp, Artificial Sequence
  Description of Artificial Sequence: Synthetic oligonucleotide
  Target: ATXN1; (+) strand; PAM type: NRG; PAM sequence: CGG
tgaggtaatttgagcggtga

SEQ ID NO: 154849 - DNA, 20 bp, Artificial Sequence
  Description of Artificial Sequence: Synthetic oligonucleotide
  Target: ATXN1; (+) strand; PAM type: NRG; PAM sequence: GGG
gaggtaatttgagcggtgac

SEQ ID NO: 154850 - DNA, 20 bp, Artificial Sequence
  Description of Artificial Sequence: Synthetic oligonucleotide
  Target: ATXN1; (+) strand; PAM type: NRG; PAM sequence: CGG
taatttgagcggtgacgggt

SEQ ID NO: 154851 - DNA, 20 bp, Artificial Sequence
  Description of Artificial Sequence: Synthetic oligonucleotide
  Target: ATXN1; (+) strand; PAM type: NRG; PAM sequence: TGG
tcggtcctcgcgcgcctccc

SEQ ID NO: 154852 - DNA, 20 bp, Artificial Sequence
  Description of Artificial Sequence: Synthetic oligonucleotide
  Target: ATXN1; (+) strand; PAM type: NRG; PAM sequence: GGG
cggtcctcgcgcgcctccct

SEQ ID NO: 154853 - DNA, 20 bp, Artificial Sequence
  Description of Artificial Sequence: Synthetic oligonucleotide
  Target: ATXN1; (+) strand; PAM type: NRG; PAM sequence: TAG
cctccctgggtccctgcacc

SEQ ID NO: 154854 - DNA, 20 bp, Artificial Sequence
  Description of Artificial Sequence: Synthetic oligonucleotide
  Target: ATXN1; (+) strand; PAM type: NRG; PAM sequence: TGG
cctgggtccctgcacctagt

SEQ ID NO: 154855 - DNA, 20 bp, Artificial Sequence
  Description of Artificial Sequence: Synthetic oligonucleotide
  Target: ATXN1; (+) strand; PAM type: NRG; PAM sequence: GAG
tgggtccctgcacctagttg

SEQ ID NO: 154856 - DNA, 20 bp, Artificial Sequence
  Description of Artificial Sequence: Synthetic oligonucleotide
  Target: ATXN1; (+) strand; PAM type: NRG; PAM sequence: AGG
gggtccctgcacctagttgg

SEQ ID NO: 154857 - DNA, 20 bp, Artificial Sequence
  Description of Artificial Sequence: Synthetic oligonucleotide
  Target: ATXN1; (+) strand; PAM type: NRG; PAM sequence: GGG
ggtccctgcacctagttgga

SEQ ID NO: 154858 - DNA, 20 bp, Artificial Sequence
  Description of Artificial Sequence: Synthetic oligonucleotide
  Target: ATXN1; (+) strand; PAM type: NRG; PAM sequence: GGG
gtccctgcacctagttggag

SEQ ID NO: 154859 - DNA, 20 bp, Artificial Sequence
  Description of Artificial Sequence: Synthetic oligonucleotide
  Target: ATXN1; (+) strand; PAM type: NRG; PAM sequence: CGG
tggaggggactgaacgacaa

SEQ ID NO: 154860 - DNA, 20 bp, Artificial Sequence
  Description of Artificial Sequence: Synthetic oligonucleotide
  Target: ATXN1; (+) strand; PAM type: NRG; PAM sequence: GGG
ggaggggactgaacgacaac

SEQ ID NO: 154861 - DNA, 20 bp, Artificial Sequence
  Description of Artificial Sequence: Synthetic oligonucleotide
  Target: ATXN1; (+) strand; PAM type: NRG; PAM sequence: GGG
gaggggactgaacgacaacg

SEQ ID NO: 154862 - DNA, 20 bp, Artificial Sequence
  Description of Artificial Sequence: Synthetic oligonucleotide
  Target: ATXN1; (+) strand; PAM type: NRG; PAM sequence: CAG
aacgacaacggggcgctact

SEQ ID NO: 154863 - DNA, 20 bp, Artificial Sequence
  Description of Artificial Sequence: Synthetic oligonucleotide
  Target: ATXN1; (+) strand; PAM type: NRG; PAM sequence: AGG
acgacaacggggcgctactc

SEQ ID NO: 154864 - DNA, 20 bp, Artificial Sequence
  Description of Artificial Sequence: Synthetic oligonucleotide
  Target: ATXN1; (+) strand; PAM type: NRG; PAM sequence: TGG
ggggcgctactcaggcaacc

SEQ ID NO: 154865 - DNA, 20 bp, Artificial Sequence
  Description of Artificial Sequence: Synthetic oligonucleotide
  Target: ATXN1; (+) strand; PAM type: NRG; PAM sequence: GGG
gggcgctactcaggcaacct

SEQ ID NO: 154866 - DNA, 20 bp, Artificial Sequence
  Description of Artificial Sequence: Synthetic oligonucleotide
  Target: ATXN1; (+) strand; PAM type: NRG; PAM sequence: GGG
ggcgctactcaggcaacctg

SEQ ID NO: 154867 - DNA, 20 bp, Artificial Sequence
  Description of Artificial Sequence: Synthetic oligonucleotide
  Target: ATXN1; (+) strand; PAM type: NRG; PAM sequence: GGG
gcgctactcaggcaacctgg

SEQ ID NO: 154868 - DNA, 20 bp, Artificial Sequence
  Description of Artificial Sequence: Synthetic oligonucleotide
  Target: ATXN1; (+) strand; PAM type: NRG; PAM sequence: AAG
gcaacctgggggactccccc

SEQ ID NO: 154869 - DNA, 20 bp, Artificial Sequence
  Description of Artificial Sequence: Synthetic oligonucleotide
  Target: ATXN1; (+) strand; PAM type: NRG; PAM sequence: AGG
caacctgggggactccccca

SEQ ID NO: 154870 - DNA, 20 bp, Artificial Sequence
  Description of Artificial Sequence: Synthetic oligonucleotide
  Target: ATXN1; (+) strand; PAM type: NRG; PAM sequence: GGG
aacctgggggactcccccaa

SEQ ID NO: 154871 - DNA, 20 bp, Artificial Sequence
  Description of Artificial Sequence: Synthetic oligonucleotide
  Target: ATXN1; (+) strand; PAM type: NRG; PAM sequence: CAG
gggactcccccaagggctgt

SEQ ID NO: 154872 - DNA, 20 bp, Artificial Sequence
  Description of Artificial Sequence: Synthetic oligonucleotide
  Target: ATXN1; (+) strand; PAM type: NRG; PAM sequence: AGG
ggactcccccaagggctgtc

SEQ ID NO: 154873 - DNA, 20 bp, Artificial Sequence
  Description of Artificial Sequence: Synthetic oligonucleotide
  Target: ATXN1; (+) strand; PAM type: NRG; PAM sequence: CAG
ccccaagggctgtcaggctt

SEQ ID NO: 154874 - DNA, 20 bp, Artificial Sequence
  Description of Artificial Sequence: Synthetic oligonucleotide
  Target: ATXN1; (+) strand; PAM type: NRG; PAM sequence: TGG
aagggctgtcaggcttcagc

SEQ ID NO: 154875 - DNA, 20 bp, Artificial Sequence
  Description of Artificial Sequence: Synthetic oligonucleotide
  Target: ATXN1; (+) strand; PAM type: NRG; PAM sequence: GGG
agggctgtcaggcttcagct

SEQ ID NO: 154876 - DNA, 20 bp, Artificial Sequence
  Description of Artificial Sequence: Synthetic oligonucleotide
  Target: ATXN1; (+) strand; PAM type: NRG; PAM sequence: GAG
ggctgtcaggcttcagctgg

SEQ ID NO: 154877 - DNA, 20 bp, Artificial Sequence
  Description of Artificial Sequence: Synthetic oligonucleotide
  Target: ATXN1; (+) strand; PAM type: NRG; PAM sequence: CAG
tgggagccgatgcaacaccc

SEQ ID NO: 154878 - DNA, 20 bp, Artificial Sequence
  Description of Artificial Sequence: Synthetic oligonucleotide
  Target: ATXN1; (+) strand; PAM type: NRG; PAM sequence: CGG
gagccgatgcaacaccccag

SEQ ID NO: 154879 - DNA, 20 bp, Artificial Sequence
  Description of Artificial Sequence: Synthetic oligonucleotide
  Target: ATXN1; (+) strand; PAM type: NRG; PAM sequence: GGG
agccgatgcaacaccccagc

SEQ ID NO: 154880 - DNA, 20 bp, Artificial Sequence
  Description of Artificial Sequence: Synthetic oligonucleotide
  Target: ATXN1; (+) strand; PAM type: NRG; PAM sequence: GGG
gccgatgcaacaccccagcg

SEQ ID NO: 154881 - DNA, 20 bp, Artificial Sequence
  Description of Artificial Sequence: Synthetic oligonucleotide
  Target: ATXN1; (+) strand; PAM type: NRG; PAM sequence: GAG
cgatgcaacaccccagcggg

SEQ ID NO: 154882 - DNA, 20 bp, Artificial Sequence
  Description of Artificial Sequence: Synthetic oligonucleotide
  Target: ATXN1; (+) strand; PAM type: NRG; PAM sequence: AGG
gatgcaacaccccagcgggg

SEQ ID NO: 154883 - DNA, 20 bp, Artificial Sequence
  Description of Artificial Sequence: Synthetic oligonucleotide
  Target: ATXN1; (+) strand; PAM type: NRG; PAM sequence: GGG
atgcaacaccccagcgggga

SEQ ID NO: 154884 - DNA, 20 bp, Artificial Sequence
  Description of Artificial Sequence: Synthetic oligonucleotide
  Target: ATXN1; (+) strand; PAM type: NRG; PAM sequence: GGG
tgcaacaccccagcggggag

SEQ ID NO: 154885 - DNA, 20 bp, Artificial Sequence
  Description of Artificial Sequence: Synthetic oligonucleotide
  Target: ATXN1; (+) strand; PAM type: NRG; PAM sequence: GAG
caacaccccagcggggaggg

SEQ ID NO: 154886 - DNA, 20 bp, Artificial Sequence
  Description of Artificial Sequence: Synthetic oligonucleotide
  Target: ATXN1; (+) strand; PAM type: NRG; PAM sequence: AGG
aacaccccagcggggagggg

SEQ ID NO: 154887 - DNA, 20 bp, Artificial Sequence
  Description of Artificial Sequence: Synthetic oligonucleotide
  Target: ATXN1; (+) strand; PAM type: NRG; PAM sequence: CGG
ccccagcggggaggggaggt

SEQ ID NO: 154888 - DNA, 20 bp, Artificial Sequence
  Description of Artificial Sequence: Synthetic oligonucleotide
  Target: ATXN1; (+) strand; PAM type: NRG; PAM sequence: TGG
ttctaatcccgacgtgtcct

SEQ ID NO: 154889 - DNA, 20 bp, Artificial Sequence
  Description of Artificial Sequence: Synthetic oligonucleotide
  Target: ATXN1; (+) strand; PAM type: NRG; PAM sequence: CAG
tcccgacgtgtccttggtcc

SEQ ID NO: 154890 - DNA, 20 bp, Artificial Sequence
  Description of Artificial Sequence: Synthetic oligonucleotide
  Target: ATXN1; (+) strand; PAM type: NRG; PAM sequence: AGG
cccgacgtgtccttggtccc

SEQ ID NO: 154891 - DNA, 20 bp, Artificial Sequence
  Description of Artificial Sequence: Synthetic oligonucleotide
  Target: ATXN1; (+) strand; PAM type: NRG; PAM sequence: CGG
tgtccttggtcccaggcgct

SEQ ID NO: 154892 - DNA, 20 bp, Artificial Sequence
  Description of Artificial Sequence: Synthetic oligonucleotide
  Target: ATXN1; (+) strand; PAM type: NRG; PAM sequence: GAG
tccttggtcccaggcgctcg

SEQ ID NO: 154893 - DNA, 20 bp, Artificial Sequence
  Description of Artificial Sequence: Synthetic oligonucleotide
  Target: ATXN1; (+) strand; PAM type: NRG; PAM sequence: CAG
ttggtcccaggcgctcggag

SEQ ID NO: 154894 - DNA, 20 bp, Artificial Sequence
  Description of Artificial Sequence: Synthetic oligonucleotide
  Target: ATXN1; (+) strand; PAM type: NRG; PAM sequence: GAG
aggcgctcggagcagcatct

SEQ ID NO: 154895 - DNA, 20 bp, Artificial Sequence
  Description of Artificial Sequence: Synthetic oligonucleotide
  Target: ATXN1; (+) strand; PAM type: NRG; PAM sequence: GAG
gcgctcggagcagcatctga

SEQ ID NO: 154896 - DNA, 20 bp, Artificial Sequence
  Description of Artificial Sequence: Synthetic oligonucleotide
  Target: ATXN1; (+) strand; PAM type: NRG; PAM sequence: AGG
cgctcggagcagcatctgag

SEQ ID NO: 154897 - DNA, 20 bp, Artificial Sequence
  Description of Artificial Sequence: Synthetic oligonucleotide
  Target: ATXN1; (+) strand; PAM type: NRG; PAM sequence: GGG
gctcggagcagcatctgaga

SEQ ID NO: 154898 - DNA, 20 bp, Artificial Sequence
  Description of Artificial Sequence: Synthetic oligonucleotide
  Target: ATXN1; (+) strand; PAM type: NRG; PAM sequence: CAG
agagggctcactctgatcat

SEQ ID NO: 154899 - DNA, 20 bp, Artificial Sequence
  Description of Artificial Sequence: Synthetic oligonucleotide
  Target: ATXN1; (+) strand; PAM type: NRG; PAM sequence: AAG
ctgatcatcagctgcacgtt

SEQ ID NO: 154900 - DNA, 20 bp, Artificial Sequence
  Description of Artificial Sequence: Synthetic oligonucleotide
  Target: ATXN1; (+) strand; PAM type: NRG; PAM sequence: CGG
ctgcacgttaagccacaaac

SEQ ID NO: 154901 - DNA, 20 bp, Artificial Sequence
  Description of Artificial Sequence: Synthetic oligonucleotide
  Target: ATXN1; (+) strand; PAM type: NRG; PAM sequence: CGG
gccacaaaccggcgtcgctt

SEQ ID NO: 154902 - DNA, 20 bp, Artificial Sequence
  Description of Artificial Sequence: Synthetic oligonucleotide
  Target: ATXN1; (+) strand; PAM type: NRG; PAM sequence: CGG
ccggcgtcgcttcggcgttc

SEQ ID NO: 154903 - DNA, 20 bp, Artificial Sequence
  Description of Artificial Sequence: Synthetic oligonucleotide
  Target: ATXN1; (+) strand; PAM type: NRG; PAM sequence: CAG
cgcttcggcgttccggaacc

SEQ ID NO: 154904 - DNA, 20 bp, Artificial Sequence
  Description of Artificial Sequence: Synthetic oligonucleotide
  Target: ATXN1; (+) strand; PAM type: NRG; PAM sequence: AGG
gcttcggcgttccggaaccc

SEQ ID NO: 154905 - DNA, 20 bp, Artificial Sequence
  Description of Artificial Sequence: Synthetic oligonucleotide
  Target: ATXN1; (+) strand; PAM type: NRG; PAM sequence: TGG
ggcgttccggaacccaggcc

SEQ ID NO: 154906 - DNA, 20 bp, Artificial Sequence
  Description of Artificial Sequence: Synthetic oligonucleotide
  Target: ATXN1; (+) strand; PAM type: NRG; PAM sequence: GGG
gcgttccggaacccaggcct

SEQ ID NO: 154907 - DNA, 20 bp, Artificial Sequence
  Description of Artificial Sequence: Synthetic oligonucleotide
  Target: ATXN1; (+) strand; PAM type: NRG; PAM sequence: GGG
cgttccggaacccaggcctg

SEQ ID NO: 154908 - DNA, 20 bp, Artificial Sequence
  Description of Artificial Sequence: Synthetic oligonucleotide
  Target: ATXN1; (+) strand; PAM type: NRG; PAM sequence: GGG
gttccggaacccaggcctgg

SEQ ID NO: 154909 - DNA, 20 bp, Artificial Sequence
  Description of Artificial Sequence: Synthetic oligonucleotide
  Target: ATXN1; (+) strand; PAM type: NRG; PAM sequence: CGG
gaacccaggcctgggggccg

SEQ ID NO: 154910 - DNA, 20 bp, Artificial Sequence
  Description of Artificial Sequence: Synthetic oligonucleotide
  Target: ATXN1; (+) strand; PAM type: NRG; PAM sequence: GGG
aacccaggcctgggggccgc

SEQ ID NO: 154911 - DNA, 20 bp, Artificial Sequence
  Description of Artificial Sequence: Synthetic oligonucleotide
  Target: ATXN1; (+) strand; PAM type: NRG; PAM sequence: GGG
acccaggcctgggggccgcg

SEQ ID NO: 154912 - DNA, 20 bp, Artificial Sequence
  Description of Artificial Sequence: Synthetic oligonucleotide
  Target: ATXN1; (+) strand; PAM type: NRG; PAM sequence: CGG
attgcctctgcgtgcaactc

SEQ ID NO: 154913 - DNA, 20 bp, Artificial Sequence
  Description of Artificial Sequence: Synthetic oligonucleotide
  Target: ATXN1; (+) strand; PAM type: NRG; PAM sequence: AAG
cctctgcgtgcaactccgga

SEQ ID NO: 154914 - DNA, 20 bp, Artificial Sequence
  Description of Artificial Sequence: Synthetic oligonucleotide
  Target: ATXN1; (+) strand; PAM type: NRG; PAM sequence: AAG
gtgcaactccggaaagtttc

SEQ ID NO: 154915 - DNA, 20 bp, Artificial Sequence
  Description of Artificial Sequence: Synthetic oligonucleotide
  Target: ATXN1; (+) strand; PAM type: NRG; PAM sequence: AGG
tgcaactccggaaagtttca

SEQ ID NO: 154916 - DNA, 20 bp, Artificial Sequence
  Description of Artificial Sequence: Synthetic oligonucleotide
  Target: ATXN1; (+) strand; PAM type: NRG; PAM sequence: GGG
gcaactccggaaagtttcaa

SEQ ID NO: 154917 - DNA, 20 bp, Artificial Sequence
  Description of Artificial Sequence: Synthetic oligonucleotide
  Target: ATXN1; (+) strand; PAM type: NRG; PAM sequence: GGG
caactccggaaagtttcaag

SEQ ID NO: 154918 - DNA, 20 bp, Artificial Sequence
  Description of Artificial Sequence: Synthetic oligonucleotide
  Target: ATXN1; (+) strand; PAM type: NRG; PAM sequence: CAG
caaggggtcccccgactgca

SEQ ID NO: 154919 - DNA, 20 bp, Artificial Sequence
  Description of Artificial Sequence: Synthetic oligonucleotide
  Target: ATXN1; (+) strand; PAM type: NRG; PAM sequence: AGG
aaggggtcccccgactgcac

SEQ ID NO: 154920 - DNA, 20 bp, Artificial Sequence
  Description of Artificial Sequence: Synthetic oligonucleotide
  Target: ATXN1; (+) strand; PAM type: NRG; PAM sequence: CGG
ggtaccctcacctttcctgc

SEQ ID NO: 154921 - DNA, 20 bp, Artificial Sequence
  Description of Artificial Sequence: Synthetic oligonucleotide
  Target: ATXN1; (+) strand; PAM type: NRG; PAM sequence: TGG
cctttcctgccggcgaacgc

SEQ ID NO: 154922 - DNA, 20 bp, Artificial Sequence
  Description of Artificial Sequence: Synthetic oligonucleotide
  Target: ATXN1; (+) strand; PAM type: NRG; PAM sequence: CAG
cctctttctctcttcgcacg

SEQ ID NO: 154923 - DNA, 20 bp, Artificial Sequence
  Description of Artificial Sequence: Synthetic oligonucleotide
  Target: ATXN1; (+) strand; PAM type: NRG; PAM sequence: AGG
ctctttctctcttcgcacgc

SEQ ID NO: 154924 - DNA, 20 bp, Artificial Sequence
  Description of Artificial Sequence: Synthetic oligonucleotide
  Target: ATXN1; (+) strand; PAM type: NRG; PAM sequence: CGG
tctctcttcgcacgcaggtc

SEQ ID NO: 154925 - DNA, 20 bp, Artificial Sequence
  Description of Artificial Sequence: Synthetic oligonucleotide
  Target: ATXN1; (+) strand; PAM type: NRG; PAM sequence: CGG
tcgcacgcaggtccggaaat

SEQ ID NO: 154926 - DNA, 20 bp, Artificial Sequence
  Description of Artificial Sequence: Synthetic oligonucleotide
  Target: ATXN1; (+) strand; PAM type: NRG; PAM sequence: TGG
tccggaaatcggctttgata

SEQ ID NO: 154927 - DNA, 20 bp, Artificial Sequence
  Description of Artificial Sequence: Synthetic oligonucleotide
  Target: ATXN1; (+) strand; PAM type: NRG; PAM sequence: TAG
gatatggaactactccgctc

SEQ ID NO: 154928 - DNA, 20 bp, Artificial Sequence
  Description of Artificial Sequence: Synthetic oligonucleotide
  Target: ATXN1; (+) strand; PAM type: NRG; PAM sequence: TGG
ggaactactccgctctagcc

SEQ ID NO: 154929 - DNA, 20 bp, Artificial Sequence
  Description of Artificial Sequence: Synthetic oligonucleotide
  Target: ATXN1; (+) strand; PAM type: NRG; PAM sequence: AAG
ctactccgctctagcctgga

SEQ ID NO: 154930 - DNA, 20 bp, Artificial Sequence
  Description of Artificial Sequence: Synthetic oligonucleotide
  Target: ATXN1; (+) strand; PAM type: NRG; PAM sequence: AGG
tactccgctctagcctggaa

SEQ ID NO: 154931 - DNA, 20 bp, Artificial Sequence
  Description of Artificial Sequence: Synthetic oligonucleotide
  Target: ATXN1; (+) strand; PAM type: NRG; PAM sequence: GAG
ctccgctctagcctggaaag

SEQ ID NO: 154932 - DNA, 20 bp, Artificial Sequence
  Description of Artificial Sequence: Synthetic oligonucleotide
  Target: ATXN1; (+) strand; PAM type: NRG; PAM sequence: CAG
agacccgcgcactcctctcg

SEQ ID NO: 154933 - DNA, 20 bp, Artificial Sequence
  Description of Artificial Sequence: Synthetic oligonucleotide
  Target: ATXN1; (+) strand; PAM type: NRG; PAM sequence: CGG
actcctctcgcagctaattt

SEQ ID NO: 154934 - DNA, 20 bp, Artificial Sequence
  Description of Artificial Sequence: Synthetic oligonucleotide
  Target: ATXN1; (+) strand; PAM type: NRG; PAM sequence: CGG
tttcggatcattaatttaat

SEQ ID NO: 154935 - DNA, 20 bp, Artificial Sequence
  Description of Artificial Sequence: Synthetic oligonucleotide
  Target: ATXN1; (+) strand; PAM type: NRG; PAM sequence: GAG
tcattaatttaatcggaaat

SEQ ID NO: 154936 - DNA, 20 bp, Artificial Sequence
  Description of Artificial Sequence: Synthetic oligonucleotide
  Target: ATXN1; (+) strand; PAM type: NRG; PAM sequence: AGG
cattaatttaatcggaaatg

SEQ ID NO: 154937 - DNA, 20 bp, Artificial Sequence
  Description of Artificial Sequence: Synthetic oligonucleotide
  Target: ATXN1; (+) strand; PAM type: NRG; PAM sequence: CAG
ttaatcggaaatgaggtaac

SEQ ID NO: 154938 - DNA, 20 bp, Artificial Sequence
  Description of Artificial Sequence: Synthetic oligonucleotide
  Target: ATXN1; (+) strand; PAM type: NRG; PAM sequence: TAG
cggaaatgaggtaaccagtg

SEQ ID NO: 154939 - DNA, 20 bp, Artificial Sequence
  Description of Artificial Sequence: Synthetic oligonucleotide
  Target: ATXN1; (+) strand; PAM type: NRG; PAM sequence: AGG
ggaaatgaggtaaccagtgt

SEQ ID NO: 154940 - DNA, 20 bp, Artificial Sequence
  Description of Artificial Sequence: Synthetic oligonucleotide
  Target: ATXN1; (+) strand; PAM type: NRG; PAM sequence: GAG
aaatgaggtaaccagtgtag

SEQ ID NO: 154941 - DNA, 20 bp, Artificial Sequence
  Description of Artificial Sequence: Synthetic oligonucleotide
  Target: ATXN1; (+) strand; PAM type: NRG; PAM sequence: CAG
gaggtaaccagtgtaggaga

SEQ ID NO: 154942 - DNA, 20 bp, Artificial Sequence
  Description of Artificial Sequence: Synthetic oligonucleotide
  Target: ATXN1; (+) strand; PAM type: NRG; PAM sequence: GAG
ggtaaccagtgtaggagaca

SEQ ID NO: 154943 - DNA, 20 bp, Artificial Sequence
  Description of Artificial Sequence: Synthetic oligonucleotide
  Target: ATXN1; (+) strand; PAM type: NRG; PAM sequence: AAG
accagtgtaggagacagaga

SEQ ID NO: 154944 - DNA, 20 bp, Artificial Sequence
  Description of Artificial Sequence: Synthetic oligonucleotide
  Target: ATXN1; (+) strand; PAM type: NRG; PAM sequence: CGG
taggagacagagaaagcaac

SEQ ID NO: 154945 - DNA, 20 bp, Artificial Sequence
  Description of Artificial Sequence: Synthetic oligonucleotide
  Target: ATXN1; (+) strand; PAM type: NRG; PAM sequence: GAG
ggagacagagaaagcaaccg

SEQ ID NO: 154946 - DNA, 20 bp, Artificial Sequence
  Description of Artificial Sequence: Synthetic oligonucleotide
  Target: ATXN1; (+) strand; PAM type: NRG; PAM sequence: TGG
aaagcaaccggagcatcaaa

SEQ ID NO: 154947 - DNA, 20 bp, Artificial Sequence
  Description of Artificial Sequence: Synthetic oligonucleotide
  Target: ATXN1; (+) strand; PAM type: NRG; PAM sequence: CAG
gcaaccggagcatcaaatgg

SEQ ID NO: 154948 - DNA, 20 bp, Artificial Sequence
  Description of Artificial Sequence: Synthetic oligonucleotide
  Target: ATXN1; (+) strand; PAM type: NRG; PAM sequence: GAG
agcatcaaatggcagttctc

SEQ ID NO: 154949 - DNA, 20 bp, Artificial Sequence
  Description of Artificial Sequence: Synthetic oligonucleotide
  Target: ATXN1; (+) strand; PAM type: NRG; PAM sequence: GAG
ggcagttctcgagaatcgac

SEQ ID NO: 154950 - DNA, 20 bp, Artificial Sequence
  Description of Artificial Sequence: Synthetic oligonucleotide
  Target: ATXN1; (+) strand; PAM type: NRG; PAM sequence: AGG
gcagttctcgagaatcgacg

SEQ ID NO: 154951 - DNA, 20 bp, Artificial Sequence
  Description of Artificial Sequence: Synthetic oligonucleotide
  Target: ATXN1; (+) strand; PAM type: NRG; PAM sequence: TGG
atcgacgaggaacttaaatc

SEQ ID NO: 154952 - DNA, 20 bp, Artificial Sequence
  Description of Artificial Sequence: Synthetic oligonucleotide
  Target: ATXN1; (+) strand; PAM type: NRG; PAM sequence: CAG
gaggaacttaaatctggact

SEQ ID NO: 154953 - DNA, 20 bp, Artificial Sequence
  Description of Artificial Sequence: Synthetic oligonucleotide
  Target: ATXN1; (+) strand; PAM type: NRG; PAM sequence: AGG
aggaacttaaatctggactc

SEQ ID NO: 154954 - DNA, 20 bp, Artificial Sequence
  Description of Artificial Sequence: Synthetic oligonucleotide
  Target: ATXN1; (+) strand; PAM type: NRG; PAM sequence: GGG
ggaacttaaatctggactca

SEQ ID NO: 154955 - DNA, 20 bp, Artificial Sequence
  Description of Artificial Sequence: Synthetic oligonucleotide
  Target: ATXN1; (+) strand; PAM type: NRG; PAM sequence: CAG
taaatctggactcagggttt

SEQ ID NO: 154956 - DNA, 20 bp, Artificial Sequence
  Description of Artificial Sequence: Synthetic oligonucleotide
  Target: ATXN1; (+) strand; PAM type: NRG; PAM sequence: CGG
ctggactcagggtttcagtg

SEQ ID NO: 154957 - DNA, 20 bp, Artificial Sequence
  Description of Artificial Sequence: Synthetic oligonucleotide
  Target: ATXN1; (+) strand; PAM type: NRG; PAM sequence: CAG
ccctccgcctgtctcgccgc

SEQ ID NO: 154958 - DNA, 20 bp, Artificial Sequence
  Description of Artificial Sequence: Synthetic oligonucleotide
  Target: ATXN1; (+) strand; PAM type: NRG; PAM sequence: AGG
cctccgcctgtctcgccgcc

SEQ ID NO: 154959 - DNA, 20 bp, Artificial Sequence
  Description of Artificial Sequence: Synthetic oligonucleotide
  Target: ATXN1; (+) strand; PAM type: NRG; PAM sequence: AAG
ccaggtgtgacctccacgcg

SEQ ID NO: 154960 - DNA, 20 bp, Artificial Sequence
  Description of Artificial Sequence: Synthetic oligonucleotide
  Target: ATXN1; (+) strand; PAM type: NRG; PAM sequence: AGG
caggtgtgacctccacgcga

SEQ ID NO: 154961 - DNA, 20 bp, Artificial Sequence
  Description of Artificial Sequence: Synthetic oligonucleotide
  Target: ATXN1; (+) strand; PAM type: NRG; PAM sequence: CGG
ccacgcgaaggaatcttctt

SEQ ID NO: 154962 - DNA, 20 bp, Artificial Sequence
  Description of Artificial Sequence: Synthetic oligonucleotide
  Target: ATXN1; (+) strand; PAM type: NRG; PAM sequence: TGG
gcgaaggaatcttcttcgga

SEQ ID NO: 154963 - DNA, 20 bp, Artificial Sequence
  Description of Artificial Sequence: Synthetic oligonucleotide
  Target: ATXN1; (+) strand; PAM type: NRG; PAM sequence: GGG
cgaaggaatcttcttcggat

SEQ ID NO: 154964 - DNA, 20 bp, Artificial Sequence
  Description of Artificial Sequence: Synthetic oligonucleotide
  Target: ATXN1; (+) strand; PAM type: NRG; PAM sequence: CAG
ggatgggtgcaccttgccaa

SEQ ID NO: 154965 - DNA, 20 bp, Artificial Sequence
  Description of Artificial Sequence: Synthetic oligonucleotide
  Target: ATXN1; (+) strand; PAM type: NRG; PAM sequence: AGG
gatgggtgcaccttgccaac

SEQ ID NO: 154966 - DNA, 20 bp, Artificial Sequence
  Description of Artificial Sequence: Synthetic oligonucleotide
  Target: ATXN1; (+) strand; PAM type: NRG; PAM sequence: TGG
gtgcaccttgccaacaggtg

SEQ ID NO: 154967 - DNA, 20 bp, Artificial Sequence
  Description of Artificial Sequence: Synthetic oligonucleotide
  Target: ATXN1; (+) strand; PAM type: NRG; PAM sequence: TGG
ttgccaacaggtgtggcacc

SEQ ID NO: 154968 - DNA, 20 bp, Artificial Sequence
  Description of Artificial Sequence: Synthetic oligonucleotide
  Target: ATXN1; (+) strand; PAM type: NRG; PAM sequence: GAG
gccaacaggtgtggcacctg

SEQ ID NO: 154969 - DNA, 20 bp, Artificial Sequence
  Description of Artificial Sequence: Synthetic oligonucleotide
  Target: ATXN1; (+) strand; PAM type: NRG; PAM sequence: AGG
ccaacaggtgtggcacctgg

SEQ ID NO: 154970 - DNA, 20 bp, Artificial Sequence
  Description of Artificial Sequence: Synthetic oligonucleotide
  Target: ATXN1; (+) strand; PAM type: NRG; PAM sequence: TAG
aggtgtggcacctggaggac

SEQ ID NO: 154971 - DNA, 20 bp, Artificial Sequence
  Description of Artificial Sequence: Synthetic oligonucleotide
  Target: ATXN1; (+) strand; PAM type: NRG; PAM sequence: AGG
ggtgtggcacctggaggact

SEQ ID NO: 154972 - DNA, 20 bp, Artificial Sequence
  Description of Artificial Sequence: Synthetic oligonucleotide
  Target: ATXN1; (+) strand; PAM type: NRG; PAM sequence: GAG
tgtggcacctggaggactag

SEQ ID NO: 154973 - DNA, 20 bp, Artificial Sequence
  Description of Artificial Sequence: Synthetic oligonucleotide
  Target: ATXN1; (+) strand; PAM type: NRG; PAM sequence: AGG
gtggcacctggaggactagg

SEQ ID NO: 154974 - DNA, 20 bp, Artificial Sequence
  Description of Artificial Sequence: Synthetic oligonucleotide
  Target: ATXN1; (+) strand; PAM type: NRG; PAM sequence: CAG
ggaggactaggaggcgcctc

SEQ ID NO: 154975 - DNA, 20 bp, Artificial Sequence
  Description of Artificial Sequence: Synthetic oligonucleotide
  Target: ATXN1; (+) strand; PAM type: NRG; PAM sequence: AAG
ctaggaggcgcctccagact

SEQ ID NO: 154976 - DNA, 20 bp, Artificial Sequence
  Description of Artificial Sequence: Synthetic oligonucleotide
  Target: ATXN1; (+) strand; PAM type: NRG; PAM sequence: AGG
taggaggcgcctccagacta

SEQ ID NO: 154977 - DNA, 20 bp, Artificial Sequence
  Description of Artificial Sequence: Synthetic oligonucleotide
  Target: ATXN1; (+) strand; PAM type: NRG; PAM sequence: GGG
aggaggcgcctccagactaa

SEQ ID NO: 154978 - DNA, 20 bp, Artificial Sequence
  Description of Artificial Sequence: Synthetic oligonucleotide
  Target: ATXN1; (+) strand; PAM type: NRG; PAM sequence: CAG
gcctccagactaagggcgct

SEQ ID NO: 154979 - DNA, 20 bp, Artificial Sequence
  Description of Artificial Sequence: Synthetic oligonucleotide
  Target: ATXN1; (+) strand; PAM type: NRG; PAM sequence: CGG
cagactaagggcgctcagtg

SEQ ID NO: 154980 - DNA, 20 bp, Artificial Sequence
  Description of Artificial Sequence: Synthetic oligonucleotide
  Target: ATXN1; (+) strand; PAM type: NRG; PAM sequence: CAG
tcagtgcggcgttcttgttg

SEQ ID NO: 154981 - DNA, 20 bp, Artificial Sequence
  Description of Artificial Sequence: Synthetic oligonucleotide
  Target: ATXN1; (+) strand; PAM type: NRG; PAM sequence: TGG
gttcttgttgcagatgattc

SEQ ID NO: 154982 - DNA, 20 bp, Artificial Sequence
  Description of Artificial Sequence: Synthetic oligonucleotide
  Target: ATXN1; (+) strand; PAM type: NRG; PAM sequence: AAG
cttgttgcagatgattctgg

SEQ ID NO: 154983 - DNA, 20 bp, Artificial Sequence
  Description of Artificial Sequence: Synthetic oligonucleotide
  Target: ATXN1; (+) strand; PAM type: NRG; PAM sequence: AGG
ttgttgcagatgattctgga

SEQ ID NO: 154984 - DNA, 20 bp, Artificial Sequence
  Description of Artificial Sequence: Synthetic oligonucleotide
  Target: ATXN1; (+) strand; PAM type: NRG; PAM sequence: CGG
tgcagatgattctggaaggc

SEQ ID NO: 154985 - DNA, 20 bp, Artificial Sequence
  Description of Artificial Sequence: Synthetic oligonucleotide
  Target: ATXN1; (+) strand; PAM type: NRG; PAM sequence: TAG
agatgattctggaaggccgg

SEQ ID NO: 154986 - DNA, 20 bp, Artificial Sequence
  Description of Artificial Sequence: Synthetic oligonucleotide
  Target: ATXN1; (+) strand; PAM type: NRG; PAM sequence: AGG
gatgattctggaaggccggt

SEQ ID NO: 154987 - DNA, 20 bp, Artificial Sequence
  Description of Artificial Sequence: Synthetic oligonucleotide
  Target: ATXN1; (+) strand; PAM type: NRG; PAM sequence: CGG
tctggaaggccggtaggtgt

SEQ ID NO: 154988 - DNA, 20 bp, Artificial Sequence
  Description of Artificial Sequence: Synthetic oligonucleotide
  Target: ATXN1; (+) strand; PAM type: NRG; PAM sequence: GGG
ctggaaggccggtaggtgtc

SEQ ID NO: 154989 - DNA, 20 bp, Artificial Sequence
  Description of Artificial Sequence: Synthetic oligonucleotide
  Target: ATXN1; (+) strand; PAM type: NRG; PAM sequence: CAG
gggcgacatttgaccttctt

SEQ ID NO: 154990 - DNA, 20 bp, Artificial Sequence
  Description of Artificial Sequence: Synthetic oligonucleotide
  Target: ATXN1; (+) strand; PAM type: NRG; PAM sequence: AGG
ggcgacatttgaccttcttc

SEQ ID NO: 154991 - DNA, 20 bp, Artificial Sequence
  Description of Artificial Sequence: Synthetic oligonucleotide
  Target: ATXN1; (+) strand; PAM type: NRG; PAM sequence: TAG
tttgaccttcttcaggtgct

SEQ ID NO: 154992 - DNA, 20 bp, Artificial Sequence
  Description of Artificial Sequence: Synthetic oligonucleotide
  Target: ATXN1; (+) strand; PAM type: NRG; PAM sequence: AAG
ttcttcaggtgcttagaact

SEQ ID NO: 154993 - DNA, 20 bp, Artificial Sequence
  Description of Artificial Sequence: Synthetic oligonucleotide
  Target: ATXN1; (+) strand; PAM type: NRG; PAM sequence: TGG
ggtgcttagaactaagtgtc

SEQ ID NO: 154994 - DNA, 20 bp, Artificial Sequence
  Description of Artificial Sequence: Synthetic oligonucleotide
  Target: ATXN1; (+) strand; PAM type: NRG; PAM sequence: AAG
gaaacatgatcctttcgcgt

SEQ ID NO: 154995 - DNA, 20 bp, Artificial Sequence
  Description of Artificial Sequence: Synthetic oligonucleotide
  Target: ATXN1; (+) strand; PAM type: NRG; PAM sequence: AAG
tcgcgtaagtttctttctga

SEQ ID NO: 154996 - DNA, 20 bp, Artificial Sequence
  Description of Artificial Sequence: Synthetic oligonucleotide
  Target: ATXN1; (+) strand; PAM type: NRG; PAM sequence: AAG
aagccaccaatcttgactgt

SEQ ID NO: 154997 - DNA, 20 bp, Artificial Sequence
  Description of Artificial Sequence: Synthetic oligonucleotide
  Target: ATXN1; (+) strand; PAM type: NRG; PAM sequence: GAG
cttgactgtaagctgtattt

SEQ ID NO: 154998 - DNA, 20 bp, Artificial Sequence
  Description of Artificial Sequence: Synthetic oligonucleotide
  Target: ATXN1; (+) strand; PAM type: NRG; PAM sequence: GAG
tgactgtaagctgtatttga

SEQ ID NO: 154999 - DNA, 20 bp, Artificial Sequence
  Description of Artificial Sequence: Synthetic oligonucleotide
  Target: ATXN1; (+) strand; PAM type: NRG; PAM sequence: TGG
gctgtatttgagagatcttt

SEQ ID NO: 155000 - DNA, 20 bp, Artificial Sequence
  Description of Artificial Sequence: Synthetic oligonucleotide
  Target: ATXN1; (+) strand; PAM type: NRG; PAM sequence: GAG
atttgagagatcttttggct

SEQ ID NO: 155001 - DNA, 20 bp, Artificial Sequence
  Description of Artificial Sequence: Synthetic oligonucleotide
  Target: ATXN1; (+) strand; PAM type: NRG; PAM sequence: CGG
tgagtttacttatgacctaa

SEQ ID NO: 155002 - DNA, 20 bp, Artificial Sequence
  Description of Artificial Sequence: Synthetic oligonucleotide
  Target: ATXN1; (+) strand; PAM type: NRG; PAM sequence: TAG
tttacttatgacctaacggt

SEQ ID NO: 155003 - DNA, 20 bp, Artificial Sequence
  Description of Artificial Sequence: Synthetic oligonucleotide
  Target: ATXN1; (+) strand; PAM type: NRG; PAM sequence: GAG
ctaacggttagtcaccaact

SEQ ID NO: 155004 - DNA, 20 bp, Artificial Sequence
  Description of Artificial Sequence: Synthetic oligonucleotide
  Target: ATXN1; (+) strand; PAM type: NRG; PAM sequence: AGG
taacggttagtcaccaactg

SEQ ID NO: 155005 - DNA, 20 bp, Artificial Sequence
  Description of Artificial Sequence: Synthetic oligonucleotide
  Target: ATXN1; (+) strand; PAM type: NRG; PAM sequence: CAG
cggttagtcaccaactgagg

SEQ ID NO: 155006 - DNA, 20 bp, Artificial Sequence
  Description of Artificial Sequence: Synthetic oligonucleotide
  Target: ATXN1; (+) strand; PAM type: NRG; PAM sequence: AGG
ggttagtcaccaactgaggc

SEQ ID NO: 155007 - DNA, 20 bp, Artificial Sequence
  Description of Artificial Sequence: Synthetic oligonucleotide
  Target: ATXN1; (+) strand; PAM type: NRG; PAM sequence: GGG
gttagtcaccaactgaggca

SEQ ID NO: 155008 - DNA, 20 bp, Artificial Sequence
  Description of Artificial Sequence: Synthetic oligonucleotide
  Target: ATXN1; (+) strand; PAM type: NRG; PAM sequence: CAG
tcaccaactgaggcagggca

SEQ ID NO: 155009 - DNA, 20 bp, Artificial Sequence
  Description of Artificial Sequence: Synthetic oligonucleotide
  Target: ATXN1; (+) strand; PAM type: NRG; PAM sequence: AGG
caccaactgaggcagggcac

SEQ ID NO: 155010 - DNA, 20 bp, Artificial Sequence
  Description of Artificial Sequence: Synthetic oligonucleotide
  Target: ATXN1; (+) strand; PAM type: NRG; PAM sequence: AAG
gcacaggatgaccaaaaaaa

SEQ ID NO: 155011 - DNA, 20 bp, Artificial Sequence
  Description of Artificial Sequence: Synthetic oligonucleotide
  Target: ATXN1; (+) strand; PAM type: NRG; PAM sequence: CAG
gatgaccaaaaaaaaagtgt

SEQ ID NO: 155012 - DNA, 20 bp, Artificial Sequence
  Description of Artificial Sequence: Synthetic oligonucleotide
  Target: ATXN1; (+) strand; PAM type: NRG; PAM sequence: TGG
tgtcagtttttacacaactc

SEQ ID NO: 155013 - DNA, 20 bp, Artificial Sequence
  Description of Artificial Sequence: Synthetic oligonucleotide
  Target: ATXN1; (+) strand; PAM type: NRG; PAM sequence: AAG
tttacacaactctggcctgc

SEQ ID NO: 155014 - DNA, 20 bp, Artificial Sequence
  Description of Artificial Sequence: Synthetic oligonucleotide
  Target: ATXN1; (+) strand; PAM type: NRG; PAM sequence: GAG
tacacaactctggcctgcaa

SEQ ID NO: 155015 - DNA, 20 bp, Artificial Sequence
  Description of Artificial Sequence: Synthetic oligonucleotide
  Target: ATXN1; (+) strand; PAM type: NRG; PAM sequence: GAG
ataaataaaaataaacatac

SEQ ID NO: 155016 - DNA, 20 bp, Artificial Sequence
  Description of Artificial Sequence: Synthetic oligonucleotide
  Target: ATXN1; (+) strand; PAM type: NRG; PAM sequence: GAG
ataaaaataaacatacgagc

SEQ ID NO: 155017 - DNA, 20 bp, Artificial Sequence
  Description of Artificial Sequence: Synthetic oligonucleotide
  Target: ATXN1; (+) strand; PAM type: NRG; PAM sequence: AGG
taaaaataaacatacgagcg

SEQ ID NO: 155018 - DNA, 20 bp, Artificial Sequence
  Description of Artificial Sequence: Synthetic oligonucleotide
  Target: ATXN1; (+) strand; PAM type: NRG; PAM sequence: AAG
aaataaacatacgagcgagg

SEQ ID NO: 155019 - DNA, 20 bp, Artificial Sequence
  Description of Artificial Sequence: Synthetic oligonucleotide
  Target: ATXN1; (+) strand; PAM type: NRG; PAM sequence: AGG
aataaacatacgagcgagga

SEQ ID NO: 155020 - DNA, 20 bp, Artificial Sequence
  Description of Artificial Sequence: Synthetic oligonucleotide
  Target: ATXN1; (+) strand; PAM type: NRG; PAM sequence: CAG
acatacgagcgaggaaggtg

SEQ ID NO: 155021 - DNA, 20 bp, Artificial Sequence
  Description of Artificial Sequence: Synthetic oligonucleotide
  Target: ATXN1; (+) strand; PAM type: NRG; PAM sequence: GAG
atacgagcgaggaaggtgca

SEQ ID NO: 155022 - DNA, 20 bp, Artificial Sequence
  Description of Artificial Sequence: Synthetic oligonucleotide
  Target: ATXN1; (+) strand; PAM type: NRG; PAM sequence: CGG
gcgaggaaggtgcagagccc

SEQ ID NO: 155023 - DNA, 20 bp, Artificial Sequence
  Description of Artificial Sequence: Synthetic oligonucleotide
  Target: ATXN1; (+) strand; PAM type: NRG; PAM sequence: TGG
aaataccatgcacatatatg

SEQ ID NO: 155024 - DNA, 20 bp, Artificial Sequence
  Description of Artificial Sequence: Synthetic oligonucleotide
  Target: ATXN1; (+) strand; PAM type: NRG; PAM sequence: AAG
gcacatatatgtggctattt

SEQ ID NO: 155025 - DNA, 20 bp, Artificial Sequence
  Description of Artificial Sequence: Synthetic oligonucleotide
  Target: ATXN1; (+) strand; PAM type: NRG; PAM sequence: TAG
ggctatttaagtataactac

SEQ ID NO: 155026 - DNA, 20 bp, Artificial Sequence
  Description of Artificial Sequence: Synthetic oligonucleotide
  Target: ATXN1; (+) strand; PAM type: NRG; PAM sequence: CGG
ttaaaaatcgattattgtta

SEQ ID NO: 155027 - DNA, 20 bp, Artificial Sequence
  Description of Artificial Sequence: Synthetic oligonucleotide
  Target: ATXN1; (+) strand; PAM type: NRG; PAM sequence: CGG
tattgttacggtttaaacct

SEQ ID NO: 155028 - DNA, 20 bp, Artificial Sequence
  Description of Artificial Sequence: Synthetic oligonucleotide
  Target: ATXN1; (+) strand; PAM type: NRG; PAM sequence: GGG
attgttacggtttaaacctc

SEQ ID NO: 155029 - DNA, 20 bp, Artificial Sequence
  Description of Artificial Sequence: Synthetic oligonucleotide
  Target: ATXN1; (+) strand; PAM type: NRG; PAM sequence: TGG
ttacggtttaaacctcgggt

SEQ ID NO: 155030 - DNA, 20 bp, Artificial Sequence
  Description of Artificial Sequence: Synthetic oligonucleotide
  Target: ATXN1; (+) strand; PAM type: NRG; PAM sequence: AAG
ttaaacctcgggttggtcta

SEQ ID NO: 155031 - DNA, 20 bp, Artificial Sequence
  Description of Artificial Sequence: Synthetic oligonucleotide
  Target: ATXN1; (+) strand; PAM type: NRG; PAM sequence: TGG
ttggtctaaagtgacattgt

SEQ ID NO: 155032 - DNA, 20 bp, Artificial Sequence
  Description of Artificial Sequence: Synthetic oligonucleotide
  Target: ATXN1; (+) strand; PAM type: NRG; PAM sequence: CAG
tgacattgttggtctcatta

SEQ ID NO: 155033 - DNA, 20 bp, Artificial Sequence
  Description of Artificial Sequence: Synthetic oligonucleotide
  Target: ATXN1; (+) strand; PAM type: NRG; PAM sequence: TAG
gttggtctcattacagcctc

SEQ ID NO: 155034 - DNA, 20 bp, Artificial Sequence
  Description of Artificial Sequence: Synthetic oligonucleotide
  Target: ATXN1; (+) strand; PAM type: NRG; PAM sequence: TGG
ggtctcattacagcctctag

SEQ ID NO: 155035 - DNA, 20 bp, Artificial Sequence
  Description of Artificial Sequence: Synthetic oligonucleotide
  Target: ATXN1; (+) strand; PAM type: NRG; PAM sequence: CAG
tcattacagcctctagtgga

SEQ ID NO: 155036 - DNA, 20 bp, Artificial Sequence
  Description of Artificial Sequence: Synthetic oligonucleotide
  Target: ATXN1; (+) strand; PAM type: NRG; PAM sequence: CAG
ctctagtggacagttaacat

SEQ ID NO: 155037 - DNA, 20 bp, Artificial Sequence
  Description of Artificial Sequence: Synthetic oligonucleotide
  Target: ATXN1; (+) strand; PAM type: NRG; PAM sequence: AAG
gttaacatcagtttcctgaa

SEQ ID NO: 155038 - DNA, 20 bp, Artificial Sequence
  Description of Artificial Sequence: Synthetic oligonucleotide
  Target: ATXN1; (+) strand; PAM type: NRG; PAM sequence: AGG
ttaacatcagtttcctgaaa

SEQ ID NO: 155039 - DNA, 20 bp, Artificial Sequence
  Description of Artificial Sequence: Synthetic oligonucleotide
  Target: ATXN1; (+) strand; PAM type: NRG; PAM sequence: TGG
tttcctgaaaaggctctgac

SEQ ID NO: 155040 - DNA, 20 bp, Artificial Sequence
  Description of Artificial Sequence: Synthetic oligonucleotide
  Target: ATXN1; (+) strand; PAM type: NRG; PAM sequence: AAG
ctggttttgttttcgttgac

SEQ ID NO: 155041 - DNA, 20 bp, Artificial Sequence
  Description of Artificial Sequence: Synthetic oligonucleotide
  Target: ATXN1; (+) strand; PAM type: NRG; PAM sequence: AAG
tttcgttgacaagctttgtc

SEQ ID NO: 155042 - DNA, 20 bp, Artificial Sequence
  Description of Artificial Sequence: Synthetic oligonucleotide
  Target: ATXN1; (+) strand; PAM type: NRG; PAM sequence: AGG
ttcgttgacaagctttgtca

SEQ ID NO: 155043 - DNA, 20 bp, Artificial Sequence
  Description of Artificial Sequence: Synthetic oligonucleotide
  Target: ATXN1; (+) strand; PAM type: NRG; PAM sequence: AAG
tgacaagctttgtcaaggtg

SEQ ID NO: 155044 - DNA, 20 bp, Artificial Sequence
  Description of Artificial Sequence: Synthetic oligonucleotide
  Target: ATXN1; (+) strand; PAM type: NRG; PAM sequence: AGG
gacaagctttgtcaaggtga

SEQ ID NO: 155045 - DNA, 20 bp, Artificial Sequence
  Description of Artificial Sequence: Synthetic oligonucleotide
  Target: ATXN1; (+) strand; PAM type: NRG; PAM sequence: TAG
agctttgtcaaggtgaaggt

SEQ ID NO: 155046 - DNA, 20 bp, Artificial Sequence
  Description of Artificial Sequence: Synthetic oligonucleotide
  Target: ATXN1; (+) strand; PAM type: NRG; PAM sequence: AAG
caaggtgaaggttagtacgt

SEQ ID NO: 155047 - DNA, 20 bp, Artificial Sequence
  Description of Artificial Sequence: Synthetic oligonucleotide
  Target: ATXN1; (+) strand; PAM type: NRG; PAM sequence: GAG
aggtgaaggttagtacgtaa

SEQ ID NO: 155048 - DNA, 20 bp, Artificial Sequence
  Description of Artificial Sequence: Synthetic oligonucleotide
  Target: ATXN1; (+) strand; PAM type: NRG; PAM sequence: CGG
ttagtacgtaagagcataac

SEQ ID NO: 155049 - DNA, 20 bp, Artificial Sequence
  Description of Artificial Sequence: Synthetic oligonucleotide
  Target: ATXN1; (+) strand; PAM type: NRG; PAM sequence: GGG
tagtacgtaagagcataacc

SEQ ID NO: 155050 - DNA, 20 bp, Artificial Sequence
  Description of Artificial Sequence: Synthetic oligonucleotide
  Target: ATXN1; (+) strand; PAM type: NRG; PAM sequence: TGG
cccgcccccaacaccctgct

SEQ ID NO: 155051 - DNA, 20 bp, Artificial Sequence
  Description of Artificial Sequence: Synthetic oligonucleotide
  Target: ATXN1; (+) strand; PAM type: NRG; PAM sequence: AAG
ccccaacaccctgcttggca

SEQ ID NO: 155052 - DNA, 20 bp, Artificial Sequence
  Description of Artificial Sequence: Synthetic oligonucleotide
  Target: ATXN1; (+) strand; PAM type: NRG; PAM sequence: CAG
ctgcttggcaaagacgactt

SEQ ID NO: 155053 - DNA, 20 bp, Artificial Sequence
  Description of Artificial Sequence: Synthetic oligonucleotide
  Target: ATXN1; (+) strand; PAM type: NRG; PAM sequence: AAG
ttggcaaagacgacttcaga

SEQ ID NO: 155054 - DNA, 20 bp, Artificial Sequence
  Description of Artificial Sequence: Synthetic oligonucleotide
  Target: ATXN1; (+) strand; PAM type: NRG; PAM sequence: AGG
tggcaaagacgacttcagaa

SEQ ID NO: 155055 - DNA, 20 bp, Artificial Sequence
  Description of Artificial Sequence: Synthetic oligonucleotide
  Target: ATXN1; (+) strand; PAM type: NRG; PAM sequence: GAG
gcaaagacgacttcagaaag

SEQ ID NO: 155056 - DNA, 20 bp, Artificial Sequence
  Description of Artificial Sequence: Synthetic oligonucleotide
  Target: ATXN1; (+) strand; PAM type: NRG; PAM sequence: CAG
aagacgacttcagaaaggag

SEQ ID NO: 155057 - DNA, 20 bp, Artificial Sequence
  Description of Artificial Sequence: Synthetic oligonucleotide
  Target: ATXN1; (+) strand; PAM type: NRG; PAM sequence: AAG
acgacttcagaaaggagcag

SEQ ID NO: 155058 - DNA, 20 bp, Artificial Sequence
  Description of Artificial Sequence: Synthetic oligonucleotide
  Target: ATXN1; (+) strand; PAM type: NRG; PAM sequence: TGG
agaaaggagcagaagcttgt

SEQ ID NO: 155059 - DNA, 20 bp, Artificial Sequence
  Description of Artificial Sequence: Synthetic oligonucleotide
  Target: ATXN1; (+) strand; PAM type: NRG; PAM sequence: TAG
agaagcttgttggctttata

SEQ ID NO: 155060 - DNA, 20 bp, Artificial Sequence
  Description of Artificial Sequence: Synthetic oligonucleotide
  Target: ATXN1; (+) strand; PAM type: NRG; PAM sequence: AAG
cttgttggctttatatagaa

SEQ ID NO: 155061 - DNA, 20 bp, Artificial Sequence
  Description of Artificial Sequence: Synthetic oligonucleotide
  Target: ATXN1; (+) strand; PAM type: NRG; PAM sequence: CAG
aagacgtatgctttgtgctg

SEQ ID NO: 155062 - DNA, 20 bp, Artificial Sequence
  Description of Artificial Sequence: Synthetic oligonucleotide
  Target: ATXN1; (+) strand; PAM type: NRG; PAM sequence: AGG
agacgtatgctttgtgctgc

SEQ ID NO: 155063 - DNA, 20 bp, Artificial Sequence
  Description of Artificial Sequence: Synthetic oligonucleotide
  Target: ATXN1; (+) strand; PAM type: NRG; PAM sequence: TGG
gctgcaggtattattattac

SEQ ID NO: 155064 - DNA, 20 bp, Artificial Sequence
  Description of Artificial Sequence: Synthetic oligonucleotide
  Target: ATXN1; (+) strand; PAM type: NRG; PAM sequence: CAG
attactggactgtgaataaa

SEQ ID NO: 155065 - DNA, 20 bp, Artificial Sequence
  Description of Artificial Sequence: Synthetic oligonucleotide
  Target: ATXN1; (+) strand; PAM type: NRG; PAM sequence: AAG
ctggactgtgaataaacaga

SEQ ID NO: 155066 - DNA, 20 bp, Artificial Sequence
  Description of Artificial Sequence: Synthetic oligonucleotide
  Target: ATXN1; (+) strand; PAM type: NRG; PAM sequence: CAG
aaagcttctgctattcattt

SEQ ID NO: 155067 - DNA, 20 bp, Artificial Sequence
  Description of Artificial Sequence: Synthetic oligonucleotide
  Target: ATXN1; (+) strand; PAM type: NRG; PAM sequence: CAG
tctgctattcatttcagttt

SEQ ID NO: 155068 - DNA, 20 bp, Artificial Sequence
  Description of Artificial Sequence: Synthetic oligonucleotide
  Target: ATXN1; (+) strand; PAM type: NRG; PAM sequence: CAG
ctattcatttcagtttcaga

SEQ ID NO: 155069 - DNA, 20 bp, Artificial Sequence
  Description of Artificial Sequence: Synthetic oligonucleotide
  Target: ATXN1; (+) strand; PAM type: NRG; PAM sequence: CAG
catctcaaatatttttataa

SEQ ID NO: 155070 - DNA, 20 bp, Artificial Sequence
  Description of Artificial Sequence: Synthetic oligonucleotide
  Target: ATXN1; (+) strand; PAM type: NRG; PAM sequence: TGG
atttttataacagaaaatat

SEQ ID NO: 155071 - DNA, 20 bp, Artificial Sequence
  Description of Artificial Sequence: Synthetic oligonucleotide
  Target: ATXN1; (+) strand; PAM type: NRG; PAM sequence: TGG
aatattggttgccatgtttt

SEQ ID NO: 155072 - DNA, 20 bp, Artificial Sequence
  Description of Artificial Sequence: Synthetic oligonucleotide
  Target: ATXN1; (+) strand; PAM type: NRG; PAM sequence: TAG
atccacctccactctatttt

SEQ ID NO: 155073 - DNA, 20 bp, Artificial Sequence
  Description of Artificial Sequence: Synthetic oligonucleotide
  Target: ATXN1; (+) strand; PAM type: NRG; PAM sequence: TAG
atttttagacatcttacatt

SEQ ID NO: 155074 - DNA, 20 bp, Artificial Sequence
  Description of Artificial Sequence: Synthetic oligonucleotide
  Target: ATXN1; (+) strand; PAM type: NRG; PAM sequence: CAG
tcttacatttagataatttt

SEQ ID NO: 155075 - DNA, 20 bp, Artificial Sequence
  Description of Artificial Sequence: Synthetic oligonucleotide
  Target: ATXN1; (+) strand; PAM type: NRG; PAM sequence: AAG
gataattttcagttaaaaaa

SEQ ID NO: 155076 - DNA, 20 bp, Artificial Sequence
  Description of Artificial Sequence: Synthetic oligonucleotide
  Target: ATXN1; (+) strand; PAM type: NRG; PAM sequence: TGG
ctaatattgtaattttacgt

SEQ ID NO: 155077 - DNA, 20 bp, Artificial Sequence
  Description of Artificial Sequence: Synthetic oligonucleotide
  Target: ATXN1; (+) strand; PAM type: NRG; PAM sequence: AAG
ttgtaattttacgttggcac

SEQ ID NO: 155078 - DNA, 20 bp, Artificial Sequence
  Description of Artificial Sequence: Synthetic oligonucleotide
  Target: ATXN1; (+) strand; PAM type: NRG; PAM sequence: CAG
taattttacgttggcacaag

SEQ ID NO: 155079 - DNA, 20 bp, Artificial Sequence
  Description of Artificial Sequence: Synthetic oligonucleotide
  Target: ATXN1; (+) strand; PAM type: NRG; PAM sequence: CAG
ttaaattaaaacacataatt

SEQ ID NO: 155080 - DNA, 20 bp, Artificial Sequence
  Description of Artificial Sequence: Synthetic oligonucleotide
  Target: ATXN1; (+) strand; PAM type: NRG; PAM sequence: CAG
aaaacacataattcagatta

SEQ ID NO: 155081 - DNA, 20 bp, Artificial Sequence
  Description of Artificial Sequence: Synthetic oligonucleotide
  Target: ATXN1; (+) strand; PAM type: NRG; PAM sequence: TAG
cacataattcagattacagt

SEQ ID NO: 155082 - DNA, 20 bp, Artificial Sequence
  Description of Artificial Sequence: Synthetic oligonucleotide
  Target: ATXN1; (+) strand; PAM type: NRG; PAM sequence: AAG
attaatttaaatgttctctc

SEQ ID NO: 155083 - DNA, 20 bp, Artificial Sequence
  Description of Artificial Sequence: Synthetic oligonucleotide
  Target: ATXN1; (+) strand; PAM type: NRG; PAM sequence: AGG
ttaatttaaatgttctctca

SEQ ID NO: 155084 - DNA, 20 bp, Artificial Sequence
  Description of Artificial Sequence: Synthetic oligonucleotide
  Target: ATXN1; (+) strand; PAM type: NRG; PAM sequence: AAG
atttaaatgttctctcaagg

SEQ ID NO: 155085 - DNA, 20 bp, Artificial Sequence
  Description of Artificial Sequence: Synthetic oligonucleotide
  Target: ATXN1; (+) strand; PAM type: NRG; PAM sequence: TGG
aaatatgtatattacccaaa

SEQ ID NO: 155086 - DNA, 20 bp, Artificial Sequence
  Description of Artificial Sequence: Synthetic oligonucleotide
  Target: ATXN1; (+) strand; PAM type: NRG; PAM sequence: AAG
aaatggtaaaaacaattaat

SEQ ID NO: 155087 - DNA, 20 bp, Artificial Sequence
  Description of Artificial Sequence: Synthetic oligonucleotide
  Target: ATXN1; (+) strand; PAM type: NRG; PAM sequence: TAG
aaatgtgtcatttactttct

SEQ ID NO: 155088 - DNA, 20 bp, Artificial Sequence
  Description of Artificial Sequence: Synthetic oligonucleotide
  Target: ATXN1; (+) strand; PAM type: NRG; PAM sequence: AAG
catttactttcttagccatt

SEQ ID NO: 155089 - DNA, 20 bp, Artificial Sequence
  Description of Artificial Sequence: Synthetic oligonucleotide
  Target: ATXN1; (+) strand; PAM type: NRG; PAM sequence: AAG
tttcttagccattaagttta

SEQ ID NO: 155090 - DNA, 20 bp, Artificial Sequence
  Description of Artificial Sequence: Synthetic oligonucleotide
  Target: ATXN1; (+) strand; PAM type: NRG; PAM sequence: AAG
ctgtaactatttcttcctgc

SEQ ID NO: 155091 - DNA, 20 bp, Artificial Sequence
  Description of Artificial Sequence: Synthetic oligonucleotide
  Target: ATXN1; (+) strand; PAM type: NRG; PAM sequence: TAG
tgaaactgtctcattacctt

SEQ ID NO: 155092 - DNA, 20 bp, Artificial Sequence
  Description of Artificial Sequence: Synthetic oligonucleotide
  Target: ATXN1; (+) strand; PAM type: NRG; PAM sequence: CAG
gtactgaaatattttgtttt

SEQ ID NO: 155093 - DNA, 20 bp, Artificial Sequence
  Description of Artificial Sequence: Synthetic oligonucleotide
  Target: ATXN1; (+) strand; PAM type: NRG; PAM sequence: TGG
tgaaatattttgttttcaga

SEQ ID NO: 155094 - DNA, 20 bp, Artificial Sequence
  Description of Artificial Sequence: Synthetic oligonucleotide
  Target: ATXN1; (+) strand; PAM type: NRG; PAM sequence: AAG
ttttcagatggcaaaatatt

SEQ ID NO: 155095 - DNA, 20 bp, Artificial Sequence
  Description of Artificial Sequence: Synthetic oligonucleotide
  Target: ATXN1; (+) strand; PAM type: NRG; PAM sequence: CAG
aagtgtacaatcacaaataa

SEQ ID NO: 155096 - DNA, 20 bp, Artificial Sequence
  Description of Artificial Sequence: Synthetic oligonucleotide
  Target: ATXN1; (+) strand; PAM type: NRG; PAM sequence: AGG
agtgtacaatcacaaataac

SEQ ID NO: 155097 - DNA, 20 bp, Artificial Sequence
  Description of Artificial Sequence: Synthetic oligonucleotide
  Target: ATXN1; (+) strand; PAM type: NRG; PAM sequence: TAG
aataacaggcactgattctt

SEQ ID NO: 155098 - DNA, 20 bp, Artificial Sequence
  Description of Artificial Sequence: Synthetic oligonucleotide
  Target: ATXN1; (+) strand; PAM type: NRG; PAM sequence: AAG
ggcactgattctttagaaac

SEQ ID NO: 155099 - DNA, 20 bp, Artificial Sequence
  Description of Artificial Sequence: Synthetic oligonucleotide
  Target: ATXN1; (+) strand; PAM type: NRG; PAM sequence: AAG
caaataaaaactcaatgaaa

SEQ ID NO: 155100 - DNA, 20 bp, Artificial Sequence
  Description of Artificial Sequence: Synthetic oligonucleotide
  Target: ATXN1; (+) strand; PAM type: NRG; PAM sequence: AGG
aaataaaaactcaatgaaaa

SEQ ID NO: 155101 - DNA, 20 bp, Artificial Sequence
  Description of Artificial Sequence: Synthetic oligonucleotide
  Target: ATXN1; (+) strand; PAM type: NRG; PAM sequence: GGG
aataaaaactcaatgaaaaa

SEQ ID NO: 155102 - DNA, 20 bp, Artificial Sequence
  Description of Artificial Sequence: Synthetic oligonucleotide
  Target: ATXN1; (+) strand; PAM type: NRG; PAM sequence: CAG
aaaaactcaatgaaaaaggg

SEQ ID NO: 155103 - DNA, 20 bp, Artificial Sequence
  Description of Artificial Sequence: Synthetic oligonucleotide
  Target: ATXN1; (+) strand; PAM type: NRG; PAM sequence: GAG
aaactcaatgaaaaagggca

SEQ ID NO: 155104 - DNA, 20 bp, Artificial Sequence
  Description of Artificial Sequence: Synthetic oligonucleotide
  Target: ATXN1; (+) strand; PAM type: NRG; PAM sequence: AAG
tgaaaaagggcagagcttcc

SEQ ID NO: 155105 - DNA, 20 bp, Artificial Sequence
  Description of Artificial Sequence: Synthetic oligonucleotide
  Target: ATXN1; (+) strand; PAM type: NRG; PAM sequence: AAG
aaaagggcagagcttccaag

SEQ ID NO: 155106 - DNA, 20 bp, Artificial Sequence
  Description of Artificial Sequence: Synthetic oligonucleotide
  Target: ATXN1; (+) strand; PAM type: NRG; PAM sequence: TAG
gggcagagcttccaagaagc

SEQ ID NO: 155107 - DNA, 20 bp, Artificial Sequence
  Description of Artificial Sequence: Synthetic oligonucleotide
  Target: ATXN1; (+) strand; PAM type: NRG; PAM sequence: TAG
cagagcttccaagaagctag

SEQ ID NO: 155108 - DNA, 20 bp, Artificial Sequence
  Description of Artificial Sequence: Synthetic oligonucleotide
  Target: ATXN1; (+) strand; PAM type: NRG; PAM sequence: TAG
gaagctagtagacaaatata

SEQ ID NO: 155109 - DNA, 20 bp, Artificial Sequence
  Description of Artificial Sequence: Synthetic oligonucleotide
  Target: ATXN1; (+) strand; PAM type: NRG; PAM sequence: TAG
tagacaaatatatagtacta

SEQ ID NO: 155110 - DNA, 20 bp, Artificial Sequence
  Description of Artificial Sequence: Synthetic oligonucleotide
  Target: ATXN1; (+) strand; PAM type: NRG; PAM sequence: AAG
agtactatagtcctactcat

SEQ ID NO: 155111 - DNA, 20 bp, Artificial Sequence
  Description of Artificial Sequence: Synthetic oligonucleotide
  Target: ATXN1; (+) strand; PAM type: NRG; PAM sequence: AGG
gtactatagtcctactcata

SEQ ID NO: 155112 - DNA, 20 bp, Artificial Sequence
  Description of Artificial Sequence: Synthetic oligonucleotide
  Target: ATXN1; (+) strand; PAM type: NRG; PAM sequence: TGG
tatagtcctactcataaggc

SEQ ID NO: 155113 - DNA, 20 bp, Artificial Sequence
  Description of Artificial Sequence: Synthetic oligonucleotide
  Target: ATXN1; (+) strand; PAM type: NRG; PAM sequence: AAG
ggctggtgttatgtttgtaa

SEQ ID NO: 155114 - DNA, 20 bp, Artificial Sequence
  Description of Artificial Sequence: Synthetic oligonucleotide
  Target: ATXN1; (+) strand; PAM type: NRG; PAM sequence: AAG
tgttatgtttgtaaaagcat

SEQ ID NO: 155115 - DNA, 20 bp, Artificial Sequence
  Description of Artificial Sequence: Synthetic oligonucleotide
  Target: ATXN1; (+) strand; PAM type: NRG; PAM sequence: CAG
taagtcaacctttgaaatta

SEQ ID NO: 155116 - DNA, 20 bp, Artificial Sequence
  Description of Artificial Sequence: Synthetic oligonucleotide
  Target: ATXN1; (+) strand; PAM type: NRG; PAM sequence: AGG
aagtcaacctttgaaattac

SEQ ID NO: 155117 - DNA, 20 bp, Artificial Sequence
  Description of Artificial Sequence: Synthetic oligonucleotide
  Target: ATXN1; (+) strand; PAM type: NRG; PAM sequence: AAG
attacaggaaatcgataaat

SEQ ID NO: 155118 - DNA, 20 bp, Artificial Sequence
  Description of Artificial Sequence: Synthetic oligonucleotide
  Target: ATXN1; (+) strand; PAM type: NRG; PAM sequence: AGG
ttacaggaaatcgataaata

SEQ ID NO: 155119 - DNA, 20 bp, Artificial Sequence
  Description of Artificial Sequence: Synthetic oligonucleotide
  Target: ATXN1; (+) strand; PAM type: NRG; PAM sequence: GAG
atcgataaataaggcctgat

SEQ ID NO: 155120 - DNA, 20 bp, Artificial Sequence
  Description of Artificial Sequence: Synthetic oligonucleotide
  Target: ATXN1; (+) strand; PAM type: NRG; PAM sequence: TAG
ttgactcgtatcctgtgtca

SEQ ID NO: 155121 - DNA, 20 bp, Artificial Sequence
  Description of Artificial Sequence: Synthetic oligonucleotide
  Target: ATXN1; (+) strand; PAM type: NRG; PAM sequence: TGG
acatatctattttactgttt

SEQ ID NO: 155122 - DNA, 20 bp, Artificial Sequence
  Description of Artificial Sequence: Synthetic oligonucleotide
  Target: ATXN1; (+) strand; PAM type: NRG; PAM sequence: TGG
tatctattttactgttttgg

SEQ ID NO: 155123 - DNA, 20 bp, Artificial Sequence
  Description of Artificial Sequence: Synthetic oligonucleotide
  Target: ATXN1; (+) strand; PAM type: NRG; PAM sequence: AAG
tttggtggtatctactcttg

SEQ ID NO: 155124 - DNA, 20 bp, Artificial Sequence
  Description of Artificial Sequence: Synthetic oligonucleotide
  Target: ATXN1; (+) strand; PAM type: NRG; PAM sequence: AGG
ttggtggtatctactcttga

SEQ ID NO: 155125 - DNA, 20 bp, Artificial Sequence
  Description of Artificial Sequence: Synthetic oligonucleotide
  Target: ATXN1; (+) strand; PAM type: NRG; PAM sequence: TGG
ctactcttgaaggtgttaaa

SEQ ID NO: 155126 - DNA, 20 bp, Artificial Sequence
  Description of Artificial Sequence: Synthetic oligonucleotide
  Target: ATXN1; (+) strand; PAM type: NRG; PAM sequence: GGG
tactcttgaaggtgttaaat

SEQ ID NO: 155127 - DNA, 20 bp, Artificial Sequence
  Description of Artificial Sequence: Synthetic oligonucleotide
  Target: ATXN1; (+) strand; PAM type: NRG; PAM sequence: CAG
cttgaaggtgttaaatgggc

SEQ ID NO: 155128 - DNA, 20 bp, Artificial Sequence
  Description of Artificial Sequence: Synthetic oligonucleotide
  Target: ATXN1; (+) strand; PAM type: NRG; PAM sequence: AAG
aaggtgttaaatgggccagc

SEQ ID NO: 155129 - DNA, 20 bp, Artificial Sequence
  Description of Artificial Sequence: Synthetic oligonucleotide
  Target: ATXN1; (+) strand; PAM type: NRG; PAM sequence: AAG
acatattacacccttactta

SEQ ID NO: 155130 - DNA, 20 bp, Artificial Sequence
  Description of Artificial Sequence: Synthetic oligonucleotide
  Target: ATXN1; (+) strand; PAM type: NRG; PAM sequence: TAG
ttacacccttacttaaagtg

SEQ ID NO: 155131 - DNA, 20 bp, Artificial Sequence
  Description of Artificial Sequence: Synthetic oligonucleotide
  Target: ATXN1; (+) strand; PAM type: NRG; PAM sequence: AAG
tacttaaagtgtagttttca

SEQ ID NO: 155132 - DNA, 20 bp, Artificial Sequence
  Description of Artificial Sequence: Synthetic oligonucleotide
  Target: ATXN1; (+) strand; PAM type: NRG; PAM sequence: CAG
tgtagttttcaaagtcgcca

SEQ ID NO: 155133 - DNA, 20 bp, Artificial Sequence
  Description of Artificial Sequence: Synthetic oligonucleotide
  Target: ATXN1; (+) strand; PAM type: NRG; PAM sequence: CAG
agttttcaaagtcgccacag

SEQ ID NO: 155134 - DNA, 20 bp, Artificial Sequence
  Description of Artificial Sequence: Synthetic oligonucleotide
  Target: ATXN1; (+) strand; PAM type: NRG; PAM sequence: TGG
aaagtcgccacagcagcact

SEQ ID NO: 155135 - DNA, 20 bp, Artificial Sequence
  Description of Artificial Sequence: Synthetic oligonucleotide
  Target: ATXN1; (+) strand; PAM type: NRG; PAM sequence: GGG
aagtcgccacagcagcactt

SEQ ID NO: 155136 - DNA, 20 bp, Artificial Sequence
  Description of Artificial Sequence: Synthetic oligonucleotide
  Target: ATXN1; (+) strand; PAM type: NRG; PAM sequence: GAG
gtcgccacagcagcacttgg

SEQ ID NO: 155137 - DNA, 20 bp, Artificial Sequence
  Description of Artificial Sequence: Synthetic oligonucleotide
  Target: ATXN1; (+) strand; PAM type: NRG; PAM sequence: TAG
agcagcacttgggagctttt

SEQ ID NO: 155138 - DNA, 20 bp, Artificial Sequence
  Description of Artificial Sequence: Synthetic oligonucleotide
  Target: ATXN1; (+) strand; PAM type: NRG; PAM sequence: CAG
ttgggagctttttagacatt

SEQ ID NO: 155139 - DNA, 20 bp, Artificial Sequence
  Description of Artificial Sequence: Synthetic oligonucleotide
  Target: ATXN1; (+) strand; PAM type: NRG; PAM sequence: GAG
gggagctttttagacattca

SEQ ID NO: 155140 - DNA, 20 bp, Artificial Sequence
  Description of Artificial Sequence: Synthetic oligonucleotide
  Target: ATXN1; (+) strand; PAM type: NRG; PAM sequence: AAG
ctttttagacattcagagtc

SEQ ID NO: 155141 - DNA, 20 bp, Artificial Sequence
  Description of Artificial Sequence: Synthetic oligonucleotide
  Target: ATXN1; (+) strand; PAM type: NRG; PAM sequence: AGG
tttttagacattcagagtca

SEQ ID NO: 155142 - DNA, 20 bp, Artificial Sequence
  Description of Artificial Sequence: Synthetic oligonucleotide
  Target: ATXN1; (+) strand; PAM type: NRG; PAM sequence: GGG
ttttagacattcagagtcaa

SEQ ID NO: 155143 - DNA, 20 bp, Artificial Sequence
  Description of Artificial Sequence: Synthetic oligonucleotide
  Target: ATXN1; (+) strand; PAM type: NRG; PAM sequence: CAG
cagagtcaagggttctaccc

SEQ ID NO: 155144 - DNA, 20 bp, Artificial Sequence
  Description of Artificial Sequence: Synthetic oligonucleotide
  Target: ATXN1; (+) strand; PAM type: NRG; PAM sequence: CAG
ctaccccagacataccaaat

SEQ ID NO: 155145 - DNA, 20 bp, Artificial Sequence
  Description of Artificial Sequence: Synthetic oligonucleotide
  Target: ATXN1; (+) strand; PAM type: NRG; PAM sequence: CAG
atcagaatctgcctttgaac

SEQ ID NO: 155146 - DNA, 20 bp, Artificial Sequence
  Description of Artificial Sequence: Synthetic oligonucleotide
  Target: ATXN1; (+) strand; PAM type: NRG; PAM sequence: AGG
tcagaatctgcctttgaacc

SEQ ID NO: 155147 - DNA, 20 bp, Artificial Sequence
  Description of Artificial Sequence: Synthetic oligonucleotide
  Target: ATXN1; (+) strand; PAM type: NRG; PAM sequence: TGG
ctgcctttgaaccaggcccc

SEQ ID NO: 155148 - DNA, 20 bp, Artificial Sequence
  Description of Artificial Sequence: Synthetic oligonucleotide
  Target: ATXN1; (+) strand; PAM type: NRG; PAM sequence: GGG
tgcctttgaaccaggcccct

SEQ ID NO: 155149 - DNA, 20 bp, Artificial Sequence
  Description of Artificial Sequence: Synthetic oligonucleotide
  Target: ATXN1; (+) strand; PAM type: NRG; PAM sequence: AAG
tctaaacacattatcatgtg

SEQ ID NO: 155150 - DNA, 20 bp, Artificial Sequence
  Description of Artificial Sequence: Synthetic oligonucleotide
  Target: ATXN1; (+) strand; PAM type: NRG; PAM sequence: TGG
cattatcatgtgaagaacac

SEQ ID NO: 155151 - DNA, 20 bp, Artificial Sequence
  Description of Artificial Sequence: Synthetic oligonucleotide
  Target: ATXN1; (+) strand; PAM type: NRG; PAM sequence: CAG
aagaacactggtctatacca

SEQ ID NO: 155152 - DNA, 20 bp, Artificial Sequence
  Description of Artificial Sequence: Synthetic oligonucleotide
  Target: ATXN1; (+) strand; PAM type: NRG; PAM sequence: AGG
agaacactggtctataccac

SEQ ID NO: 155153 - DNA, 20 bp, Artificial Sequence
  Description of Artificial Sequence: Synthetic oligonucleotide
  Target: ATXN1; (+) strand; PAM type: NRG; PAM sequence: GGG
gaacactggtctataccaca

SEQ ID NO: 155154 - DNA, 20 bp, Artificial Sequence
  Description of Artificial Sequence: Synthetic oligonucleotide
  Target: ATXN1; (+) strand; PAM type: NRG; PAM sequence: TGG
gggatcaacctaaataaatt

SEQ ID NO: 155155 - DNA, 20 bp, Artificial Sequence
  Description of Artificial Sequence: Synthetic oligonucleotide
  Target: ATXN1; (+) strand; PAM type: NRG; PAM sequence: GGG
ggatcaacctaaataaattt

SEQ ID NO: 155156 - DNA, 20 bp, Artificial Sequence
  Description of Artificial Sequence: Synthetic oligonucleotide
  Target: ATXN1; (+) strand; PAM type: NRG; PAM sequence: AAG
acctaaataaatttgggcac

SEQ ID NO: 155157 - DNA, 20 bp, Artificial Sequence
  Description of Artificial Sequence: Synthetic oligonucleotide
  Target: ATXN1; (+) strand; PAM type: NRG; PAM sequence: CAG
aataaatttgggcacaagtg

SEQ ID NO: 155158 - DNA, 20 bp, Artificial Sequence
  Description of Artificial Sequence: Synthetic oligonucleotide
  Target: ATXN1; (+) strand; PAM type: NRG; PAM sequence: AAG
aaatttgggcacaagtgcag

SEQ ID NO: 155159 - DNA, 20 bp, Artificial Sequence
  Description of Artificial Sequence: Synthetic oligonucleotide
  Target: ATXN1; (+) strand; PAM type: NRG; PAM sequence: TAG
atttcttttttgctcctttt

SEQ ID NO: 155160 - DNA, 20 bp, Artificial Sequence
  Description of Artificial Sequence: Synthetic oligonucleotide
  Target: ATXN1; (+) strand; PAM type: NRG; PAM sequence: AAG
cttttttgctcctttttagt

SEQ ID NO: 155161 - DNA, 20 bp, Artificial Sequence
  Description of Artificial Sequence: Synthetic oligonucleotide
  Target: ATXN1; (+) strand; PAM type: NRG; PAM sequence: CAG
ttgctcctttttagtaagta

SEQ ID NO: 155162 - DNA, 20 bp, Artificial Sequence
  Description of Artificial Sequence: Synthetic oligonucleotide
  Target: ATXN1; (+) strand; PAM type: NRG; PAM sequence: TGG
aattattatgttatatgctt

SEQ ID NO: 155163 - DNA, 20 bp, Artificial Sequence
  Description of Artificial Sequence: Synthetic oligonucleotide
  Target: ATXN1; (+) strand; PAM type: NRG; PAM sequence: AAG
gataaatactactgcactgt

SEQ ID NO: 155164 - DNA, 20 bp, Artificial Sequence
  Description of Artificial Sequence: Synthetic oligonucleotide
  Target: ATXN1; (+) strand; PAM type: NRG; PAM sequence: AAG
ctgcatcattattgccaaaa

SEQ ID NO: 155165 - DNA, 20 bp, Artificial Sequence
  Description of Artificial Sequence: Synthetic oligonucleotide
  Target: ATXN1; (+) strand; PAM type: NRG; PAM sequence: GAG
ccaaaaaagaatgctctgct

SEQ ID NO: 155166 - DNA, 20 bp, Artificial Sequence
  Description of Artificial Sequence: Synthetic oligonucleotide
  Target: ATXN1; (+) strand; PAM type: NRG; PAM sequence: AGG
caaaaaagaatgctctgctg

SEQ ID NO: 155167 - DNA, 20 bp, Artificial Sequence
  Description of Artificial Sequence: Synthetic oligonucleotide
  Target: ATXN1; (+) strand; PAM type: NRG; PAM sequence: TGG
tgctctgctgaggaatgtac

SEQ ID NO: 155168 - DNA, 20 bp, Artificial Sequence
  Description of Artificial Sequence: Synthetic oligonucleotide
  Target: ATXN1; (+) strand; PAM type: NRG; PAM sequence: GGG
gctctgctgaggaatgtact

SEQ ID NO: 155169 - DNA, 20 bp, Artificial Sequence
  Description of Artificial Sequence: Synthetic oligonucleotide
  Target: ATXN1; (+) strand; PAM type: NRG; PAM sequence: GGG
ctctgctgaggaatgtactg

SEQ ID NO: 155170 - DNA, 20 bp, Artificial Sequence
  Description of Artificial Sequence: Synthetic oligonucleotide
  Target: ATXN1; (+) strand; PAM type: NRG; PAM sequence: TGG
gaacatgaacattttcttca

SEQ ID NO: 155171 - DNA, 20 bp, Artificial Sequence
  Description of Artificial Sequence: Synthetic oligonucleotide
  Target: ATXN1; (+) strand; PAM type: NRG; PAM sequence: CAG
catgaacattttcttcatgg

SEQ ID NO: 155172 - DNA, 20 bp, Artificial Sequence
  Description of Artificial Sequence: Synthetic oligonucleotide
  Target: ATXN1; (+) strand; PAM type: NRG; PAM sequence: CAG
gaacattttcttcatggcag

SEQ ID NO: 155173 - DNA, 20 bp, Artificial Sequence
  Description of Artificial Sequence: Synthetic oligonucleotide
  Target: ATXN1; (+) strand; PAM type: NRG; PAM sequence: GAG
acattttcttcatggcagca

SEQ ID NO: 155174 - DNA, 20 bp, Artificial Sequence
  Description of Artificial Sequence: Synthetic oligonucleotide
  Target: ATXN1; (+) strand; PAM type: NRG; PAM sequence: AGG
cattttcttcatggcagcag

SEQ ID NO: 155175 - DNA, 20 bp, Artificial Sequence
  Description of Artificial Sequence: Synthetic oligonucleotide
  Target: ATXN1; (+) strand; PAM type: NRG; PAM sequence: GGG
attttcttcatggcagcaga

SEQ ID NO: 155176 - DNA, 20 bp, Artificial Sequence
  Description of Artificial Sequence: Synthetic oligonucleotide
  Target: ATXN1; (+) strand; PAM type: NRG; PAM sequence: GAG
tttcttcatggcagcagagg

SEQ ID NO: 155177 - DNA, 20 bp, Artificial Sequence
  Description of Artificial Sequence: Synthetic oligonucleotide
  Target: ATXN1; (+) strand; PAM type: NRG; PAM sequence: AAG
catggcagcagagggagcac

SEQ ID NO: 155178 - DNA, 20 bp, Artificial Sequence
  Description of Artificial Sequence: Synthetic oligonucleotide
  Target: ATXN1; (+) strand; PAM type: NRG; PAM sequence: GAG
tggcagcagagggagcacaa

SEQ ID NO: 155179 - DNA, 20 bp, Artificial Sequence
  Description of Artificial Sequence: Synthetic oligonucleotide
  Target: ATXN1; (+) strand; PAM type: NRG; PAM sequence: CAG
acaagagtgcttaataaaac

SEQ ID NO: 155180 - DNA, 20 bp, Artificial Sequence
  Description of Artificial Sequence: Synthetic oligonucleotide
  Target: ATXN1; (+) strand; PAM type: NRG; PAM sequence: CAG
tgcttaataaaaccagtgca

SEQ ID NO: 155181 - DNA, 20 bp, Artificial Sequence
  Description of Artificial Sequence: Synthetic oligonucleotide
  Target: ATXN1; (+) strand; PAM type: NRG; PAM sequence: AGG
gcttaataaaaccagtgcac

SEQ ID NO: 155182 - DNA, 20 bp, Artificial Sequence
  Description of Artificial Sequence: Synthetic oligonucleotide
  Target: ATXN1; (+) strand; PAM type: NRG; PAM sequence: CAG
caggtctctccaaatcatga

SEQ ID NO: 155183 - DNA, 20 bp, Artificial Sequence
  Description of Artificial Sequence: Synthetic oligonucleotide
  Target: ATXN1; (+) strand; PAM type: NRG; PAM sequence: TAG
tcatgacagattttacattg

SEQ ID NO: 155184 - DNA, 20 bp, Artificial Sequence
  Description of Artificial Sequence: Synthetic oligonucleotide
  Target: ATXN1; (+) strand; PAM type: NRG; PAM sequence: TGG
attgtagtatatgttttcat

SEQ ID NO: 155185 - DNA, 20 bp, Artificial Sequence
  Description of Artificial Sequence: Synthetic oligonucleotide
  Target: ATXN1; (+) strand; PAM type: NRG; PAM sequence: AAG
gtagtatatgttttcattgg

SEQ ID NO: 155186 - DNA, 20 bp, Artificial Sequence
  Description of Artificial Sequence: Synthetic oligonucleotide
  Target: ATXN1; (+) strand; PAM type: NRG; PAM sequence: TAG
gtatatgttttcattggaag

SEQ ID NO: 155187 - DNA, 20 bp, Artificial Sequence
  Description of Artificial Sequence: Synthetic oligonucleotide
  Target: ATXN1; (+) strand; PAM type: NRG; PAM sequence: TAG
attggaagtagcctgttatg

SEQ ID NO: 155188 - DNA, 20 bp, Artificial Sequence
  Description of Artificial Sequence: Synthetic oligonucleotide
  Target: ATXN1; (+) strand; PAM type: NRG; PAM sequence: AAG
ctgttatgtagttcaaaatg

SEQ ID NO: 155189 - DNA, 20 bp, Artificial Sequence
  Description of Artificial Sequence: Synthetic oligonucleotide
  Target: ATXN1; (+) strand; PAM type: NRG; PAM sequence: GAG
caaaatgaagcaaatcaact

SEQ ID NO: 155190 - DNA, 20 bp, Artificial Sequence
  Description of Artificial Sequence: Synthetic oligonucleotide
  Target: ATXN1; (+) strand; PAM type: NRG; PAM sequence: CAG
gcaaatcaactgagcaaaca

SEQ ID NO: 155191 - DNA, 20 bp, Artificial Sequence
  Description of Artificial Sequence: Synthetic oligonucleotide
  Target: ATXN1; (+) strand; PAM type: NRG; PAM sequence: TAG
atcaactgagcaaacacaga

SEQ ID NO: 155192 - DNA, 20 bp, Artificial Sequence
  Description of Artificial Sequence: Synthetic oligonucleotide
  Target: ATXN1; (+) strand; PAM type: NRG; PAM sequence: AGG
tcaactgagcaaacacagat

SEQ ID NO: 155193 - DNA, 20 bp, Artificial Sequence
  Description of Artificial Sequence: Synthetic oligonucleotide
  Target: ATXN1; (+) strand; PAM type: NRG; PAM sequence: CAG
gcaaacacagataggcttac

SEQ ID NO: 155194 - DNA, 20 bp, Artificial Sequence
  Description of Artificial Sequence: Synthetic oligonucleotide
  Target: ATXN1; (+) strand; PAM type: NRG; PAM sequence: AGG
caaacacagataggcttacc

SEQ ID NO: 155195 - DNA, 20 bp, Artificial Sequence
  Description of Artificial Sequence: Synthetic oligonucleotide
  Target: ATXN1; (+) strand; PAM type: NRG; PAM sequence: CAG
ataacaactatgtaactgaa

SEQ ID NO: 155196 - DNA, 20 bp, Artificial Sequence
  Description of Artificial Sequence: Synthetic oligonucleotide
  Target: ATXN1; (+) strand; PAM type: NRG; PAM sequence: AAG
tatgtaactgaacagattga

SEQ ID NO: 155197 - DNA, 20 bp, Artificial Sequence
  Description of Artificial Sequence: Synthetic oligonucleotide
  Target: ATXN1; (+) strand; PAM type: NRG; PAM sequence: AAG
attgaaagttgaataaaata

SEQ ID NO: 155198 - DNA, 20 bp, Artificial Sequence
  Description of Artificial Sequence: Synthetic oligonucleotide
  Target: ATXN1; (+) strand; PAM type: NRG; PAM sequence: TAG
aaaataaagataaacttctt

SEQ ID NO: 155199 - DNA, 20 bp, Artificial Sequence
  Description of Artificial Sequence: Synthetic oligonucleotide
  Target: ATXN1; (+) strand; PAM type: NRG; PAM sequence: GAG
aataaagataaacttcttta

SEQ ID NO: 155200 - DNA, 20 bp, Artificial Sequence
  Description of Artificial Sequence: Synthetic oligonucleotide
  Target: ATXN1; (+) strand; PAM type: NRG; PAM sequence: TAG
gataaacttctttagagttt

SEQ ID NO: 155201 - DNA, 20 bp, Artificial Sequence
  Description of Artificial Sequence: Synthetic oligonucleotide
  Target: ATXN1; (+) strand; PAM type: NRG; PAM sequence: AGG
ataaacttctttagagtttt

SEQ ID NO: 155202 - DNA, 20 bp, Artificial Sequence
  Description of Artificial Sequence: Synthetic oligonucleotide
  Target: ATXN1; (+) strand; PAM type: NRG; PAM sequence: AAG
ttttaggcttgaattcttaa

SEQ ID NO: 155203 - DNA, 20 bp, Artificial Sequence
  Description of Artificial Sequence: Synthetic oligonucleotide
  Target: ATXN1; (+) strand; PAM type: NRG; PAM sequence: AAG
aggcttgaattcttaaaaga

SEQ ID NO: 155204 - DNA, 20 bp, Artificial Sequence
  Description of Artificial Sequence: Synthetic oligonucleotide
  Target: ATXN1; (+) strand; PAM type: NRG; PAM sequence: TGG
cttgaattcttaaaagaaag

SEQ ID NO: 155205 - DNA, 20 bp, Artificial Sequence
  Description of Artificial Sequence: Synthetic oligonucleotide
  Target: ATXN1; (+) strand; PAM type: NRG; PAM sequence: AAG
taaaagaaagtggacctcaa

SEQ ID NO: 155206 - DNA, 20 bp, Artificial Sequence
  Description of Artificial Sequence: Synthetic oligonucleotide
  Target: ATXN1; (+) strand; PAM type: NRG; PAM sequence: AAG
agtggacctcaaaagtgaaa

SEQ ID NO: 155207 - DNA, 20 bp, Artificial Sequence
  Description of Artificial Sequence: Synthetic oligonucleotide
  Target: ATXN1; (+) strand; PAM type: NRG; PAM sequence: TAG
caaaagtgaaaaagatgcct

SEQ ID NO: 155208 - DNA, 20 bp, Artificial Sequence
  Description of Artificial Sequence: Synthetic oligonucleotide
  Target: ATXN1; (+) strand; PAM type: NRG; PAM sequence: AAG
cttagctttgctcaaaaaca

SEQ ID NO: 155209 - DNA, 20 bp, Artificial Sequence
  Description of Artificial Sequence: Synthetic oligonucleotide
  Target: ATXN1; (+) strand; PAM type: NRG; PAM sequence: CAG
aaaacaaagataacacaaca

SEQ ID NO: 155210 - DNA, 20 bp, Artificial Sequence
  Description of Artificial Sequence: Synthetic oligonucleotide
  Target: ATXN1; (+) strand; PAM type: NRG; PAM sequence: CAG
aagataacacaacacagaat

SEQ ID NO: 155211 - DNA, 20 bp, Artificial Sequence
  Description of Artificial Sequence: Synthetic oligonucleotide
  Target: ATXN1; (+) strand; PAM type: NRG; PAM sequence: AGG
agataacacaacacagaatc

SEQ ID NO: 155212 - DNA, 20 bp, Artificial Sequence
  Description of Artificial Sequence: Synthetic oligonucleotide
  Target: ATXN1; (+) strand; PAM type: NRG; PAM sequence: AAG
acacagaatcaggcaaccct

SEQ ID NO: 155213 - DNA, 20 bp, Artificial Sequence
  Description of Artificial Sequence: Synthetic oligonucleotide
  Target: ATXN1; (+) strand; PAM type: NRG; PAM sequence: TAG
caggcaaccctaagatgcct

SEQ ID NO: 155214 - DNA, 20 bp, Artificial Sequence
  Description of Artificial Sequence: Synthetic oligonucleotide
  Target: ATXN1; (+) strand; PAM type: NRG; PAM sequence: AAG
cttagctttactcaaaaaca

SEQ ID NO: 155215 - DNA, 20 bp, Artificial Sequence
  Description of Artificial Sequence: Synthetic oligonucleotide
  Target: ATXN1; (+) strand; PAM type: NRG; PAM sequence: CAG
actcaaaaacaaagataaca

SEQ ID NO: 155216 - DNA, 20 bp, Artificial Sequence
  Description of Artificial Sequence: Synthetic oligonucleotide
  Target: ATXN1; (+) strand; PAM type: NRG; PAM sequence: CAG
aaacaaagataacacagaat

SEQ ID NO: 155217 - DNA, 20 bp, Artificial Sequence
  Description of Artificial Sequence: Synthetic oligonucleotide
  Target: ATXN1; (+) strand; PAM type: NRG; PAM sequence: AGG
aacaaagataacacagaatc

SEQ ID NO: 155218 - DNA, 20 bp, Artificial Sequence
  Description of Artificial Sequence: Synthetic oligonucleotide
  Target: ATXN1; (+) strand; PAM type: NRG; PAM sequence: TAG
acagaatcaggcaaccctaa

SEQ ID NO: 155219 - DNA, 20 bp, Artificial Sequence
  Description of Artificial Sequence: Synthetic oligonucleotide
  Target: ATXN1; (+) strand; PAM type: NRG; PAM sequence: TAG
gaatcaggcaaccctaatag

SEQ ID NO: 155220 - DNA, 20 bp, Artificial Sequence
  Description of Artificial Sequence: Synthetic oligonucleotide
  Target: ATXN1; (+) strand; PAM type: NRG; PAM sequence: CAG
agctcctgtttatctaaaaa

SEQ ID NO: 155221 - DNA, 20 bp, Artificial Sequence
  Description of Artificial Sequence: Synthetic oligonucleotide
  Target: ATXN1; (+) strand; PAM type: NRG; PAM sequence: GAG
ctcctgtttatctaaaaaca

SEQ ID NO: 155222 - DNA, 20 bp, Artificial Sequence
  Description of Artificial Sequence: Synthetic oligonucleotide
  Target: ATXN1; (+) strand; PAM type: NRG; PAM sequence: CAG
tgtttatctaaaaacagagt

SEQ ID NO: 155223 - DNA, 20 bp, Artificial Sequence
  Description of Artificial Sequence: Synthetic oligonucleotide
  Target: ATXN1; (+) strand; PAM type: NRG; PAM sequence: TGG
taaaaacagagtcagttcac

SEQ ID NO: 155224 - DNA, 20 bp, Artificial Sequence
  Description of Artificial Sequence: Synthetic oligonucleotide
  Target: ATXN1; (+) strand; PAM type: NRG; PAM sequence: CAG
cagttcactggaccctacat

SEQ ID NO: 155225 - DNA, 20 bp, Artificial Sequence
  Description of Artificial Sequence: Synthetic oligonucleotide
  Target: ATXN1; (+) strand; PAM type: NRG; PAM sequence: AGG
agttcactggaccctacatc

SEQ ID NO: 155226 - DNA, 20 bp, Artificial Sequence
  Description of Artificial Sequence: Synthetic oligonucleotide
  Target: ATXN1; (+) strand; PAM type: NRG; PAM sequence: TGG
tcaggtaacttaatttcatt

SEQ ID NO: 155227 - DNA, 20 bp, Artificial Sequence
  Description of Artificial Sequence: Synthetic oligonucleotide
  Target: ATXN1; (+) strand; PAM type: NRG; PAM sequence: TGG
tcatttggtgtcatacatgt

SEQ ID NO: 155228 - DNA, 20 bp, Artificial Sequence
  Description of Artificial Sequence: Synthetic oligonucleotide
  Target: ATXN1; (+) strand; PAM type: NRG; PAM sequence: AAG
tggtgtcatacatgttggtt

SEQ ID NO: 155229 - DNA, 20 bp, Artificial Sequence
  Description of Artificial Sequence: Synthetic oligonucleotide
  Target: ATXN1; (+) strand; PAM type: NRG; PAM sequence: AGG
ggtgtcatacatgttggtta

SEQ ID NO: 155230 - DNA, 20 bp, Artificial Sequence
  Description of Artificial Sequence: Synthetic oligonucleotide
  Target: ATXN1; (+) strand; PAM type: NRG; PAM sequence: CAG
ccttttgctgtgtttacact

SEQ ID NO: 155231 - DNA, 20 bp, Artificial Sequence
  Description of Artificial Sequence: Synthetic oligonucleotide
  Target: ATXN1; (+) strand; PAM type: NRG; PAM sequence: TAG
gtttacactcagaataattt

SEQ ID NO: 155232 - DNA, 20 bp, Artificial Sequence
  Description of Artificial Sequence: Synthetic oligonucleotide
  Target: ATXN1; (+) strand; PAM type: NRG; PAM sequence: AGG
tttacactcagaataatttt

SEQ ID NO: 155233 - DNA, 20 bp, Artificial Sequence
  Description of Artificial Sequence: Synthetic oligonucleotide
  Target: ATXN1; (+) strand; PAM type: NRG; PAM sequence: GGG
ttacactcagaataatttta

SEQ ID NO: 155234 - DNA, 20 bp, Artificial Sequence
  Description of Artificial Sequence: Synthetic oligonucleotide
  Target: ATXN1; (+) strand; PAM type: NRG; PAM sequence: GGG
tacactcagaataattttag

SEQ ID NO: 155235 - DNA, 20 bp, Artificial Sequence
  Description of Artificial Sequence: Synthetic oligonucleotide
  Target: ATXN1; (+) strand; PAM type: NRG; PAM sequence: CAG
gggtttctccttaatgcttg

SEQ ID NO: 155236 - DNA, 20 bp, Artificial Sequence
  Description of Artificial Sequence: Synthetic oligonucleotide
  Target: ATXN1; (+) strand; PAM type: NRG; PAM sequence: TGG
tttctccttaatgcttgcag

SEQ ID NO: 155237 - DNA, 20 bp, Artificial Sequence
  Description of Artificial Sequence: Synthetic oligonucleotide
  Target: ATXN1; (+) strand; PAM type: NRG; PAM sequence: GAG
tccttaatgcttgcagtggt

SEQ ID NO: 155238 - DNA, 20 bp, Artificial Sequence
  Description of Artificial Sequence: Synthetic oligonucleotide
  Target: ATXN1; (+) strand; PAM type: NRG; PAM sequence: AGG
ccttaatgcttgcagtggtg

SEQ ID NO: 155239 - DNA, 20 bp, Artificial Sequence
  Description of Artificial Sequence: Synthetic oligonucleotide
  Target: ATXN1; (+) strand; PAM type: NRG; PAM sequence: TAG
tgcttgcagtggtgaggatt

SEQ ID NO: 155240 - DNA, 20 bp, Artificial Sequence
  Description of Artificial Sequence: Synthetic oligonucleotide
  Target: ATXN1; (+) strand; PAM type: NRG; PAM sequence: AGG
gcttgcagtggtgaggattt

SEQ ID NO: 155241 - DNA, 20 bp, Artificial Sequence
  Description of Artificial Sequence: Synthetic oligonucleotide
  Target: ATXN1; (+) strand; PAM type: NRG; PAM sequence: CAG
agtggtgaggatttaggttt

SEQ ID NO: 155242 - DNA, 20 bp, Artificial Sequence
  Description of Artificial Sequence: Synthetic oligonucleotide
  Target: ATXN1; (+) strand; PAM type: NRG; PAM sequence: TAG
aggtttcagttatacctacg

SEQ ID NO: 155243 - DNA, 20 bp, Artificial Sequence
  Description of Artificial Sequence: Synthetic oligonucleotide
  Target: ATXN1; (+) strand; PAM type: NRG; PAM sequence: AAG
catcctcaaaaactcccttg

SEQ ID NO: 155244 - DNA, 20 bp, Artificial Sequence
  Description of Artificial Sequence: Synthetic oligonucleotide
  Target: ATXN1; (+) strand; PAM type: NRG; PAM sequence: CAG
cctcaaaaactcccttgaag

SEQ ID NO: 155245 - DNA, 20 bp, Artificial Sequence
  Description of Artificial Sequence: Synthetic oligonucleotide
  Target: ATXN1; (+) strand; PAM type: NRG; PAM sequence: TGG
cttgaagcagataacatact

SEQ ID NO: 155246 - DNA, 20 bp, Artificial Sequence
  Description of Artificial Sequence: Synthetic oligonucleotide
  Target: ATXN1; (+) strand; PAM type: NRG; PAM sequence: AAG
gcagataacatacttggtaa

SEQ ID NO: 155247 - DNA, 20 bp, Artificial Sequence
  Description of Artificial Sequence: Synthetic oligonucleotide
  Target: ATXN1; (+) strand; PAM type: NRG; PAM sequence: AAG
taacatacttggtaaaagcc

SEQ ID NO: 155248 - DNA, 20 bp, Artificial Sequence
  Description of Artificial Sequence: Synthetic oligonucleotide
  Target: ATXN1; (+) strand; PAM type: NRG; PAM sequence: AAG
gtaaaagccaagtatccaaa

SEQ ID NO: 155249 - DNA, 20 bp, Artificial Sequence
  Description of Artificial Sequence: Synthetic oligonucleotide
  Target: ATXN1; (+) strand; PAM type: NRG; PAM sequence: TGG
gccaagtatccaaaaagtta

SEQ ID NO: 155250 - DNA, 20 bp, Artificial Sequence
  Description of Artificial Sequence: Synthetic oligonucleotide
  Target: ATXN1; (+) strand; PAM type: NRG; PAM sequence: GAG
catcgtgctttcataacatt

SEQ ID NO: 155251 - DNA, 20 bp, Artificial Sequence
  Description of Artificial Sequence: Synthetic oligonucleotide
  Target: ATXN1; (+) strand; PAM type: NRG; PAM sequence: CAG
attgagtcatttaattgttt

SEQ ID NO: 155252 - DNA, 20 bp, Artificial Sequence
  Description of Artificial Sequence: Synthetic oligonucleotide
  Target: ATXN1; (+) strand; PAM type: NRG; PAM sequence: TAG
gagtcatttaattgtttcag

SEQ ID NO: 155253 - DNA, 20 bp, Artificial Sequence
  Description of Artificial Sequence: Synthetic oligonucleotide
  Target: ATXN1; (+) strand; PAM type: NRG; PAM sequence: GAG
aattgtttcagtagtgcttt

SEQ ID NO: 155254 - DNA, 20 bp, Artificial Sequence
  Description of Artificial Sequence: Synthetic oligonucleotide
  Target: ATXN1; (+) strand; PAM type: NRG; PAM sequence: AGG
attgtttcagtagtgctttg

SEQ ID NO: 155255 - DNA, 20 bp, Artificial Sequence
  Description of Artificial Sequence: Synthetic oligonucleotide
  Target: ATXN1; (+) strand; PAM type: NRG; PAM sequence: GAG
gctttgaggtattcataaat

SEQ ID NO: 155256 - DNA, 20 bp, Artificial Sequence
  Description of Artificial Sequence: Synthetic oligonucleotide
  Target: ATXN1; (+) strand; PAM type: NRG; PAM sequence: AGG
ctttgaggtattcataaatg

SEQ ID NO: 155257 - DNA, 20 bp, Artificial Sequence
  Description of Artificial Sequence: Synthetic oligonucleotide
  Target: ATXN1; (+) strand; PAM type: NRG; PAM sequence: GGG
tttgaggtattcataaatga

SEQ ID NO: 155258 - DNA, 20 bp, Artificial Sequence
  Description of Artificial Sequence: Synthetic oligonucleotide
  Target: ATXN1; (+) strand; PAM type: NRG; PAM sequence: CAG
cataaatgagggaaattata

SEQ ID NO: 155259 - DNA, 20 bp, Artificial Sequence
  Description of Artificial Sequence: Synthetic oligonucleotide
  Target: ATXN1; (+) strand; PAM type: NRG; PAM sequence: AAG
gagggaaattatacagacta

SEQ ID NO: 155260 - DNA, 20 bp, Artificial Sequence
  Description of Artificial Sequence: Synthetic oligonucleotide
  Target: ATXN1; (+) strand; PAM type: NRG; PAM sequence: CAG
aattatacagactaaagatc

SEQ ID NO: 155261 - DNA, 20 bp, Artificial Sequence
  Description of Artificial Sequence: Synthetic oligonucleotide
  Target: ATXN1; (+) strand; PAM type: NRG; PAM sequence: GAG
ttatacagactaaagatcca

SEQ ID NO: 155262 - DNA, 20 bp, Artificial Sequence
  Description of Artificial Sequence: Synthetic oligonucleotide
  Target: ATXN1; (+) strand; PAM type: NRG; PAM sequence: CAG
aagatccagagcatttttta

SEQ ID NO: 155263 - DNA, 20 bp, Artificial Sequence
  Description of Artificial Sequence: Synthetic oligonucleotide
  Target: ATXN1; (+) strand; PAM type: NRG; PAM sequence: AAG
gagcattttttacagtttta

SEQ ID NO: 155264 - DNA, 20 bp, Artificial Sequence
  Description of Artificial Sequence: Synthetic oligonucleotide
  Target: ATXN1; (+) strand; PAM type: NRG; PAM sequence: AGG
agcattttttacagttttaa

SEQ ID NO: 155265 - DNA, 20 bp, Artificial Sequence
  Description of Artificial Sequence: Synthetic oligonucleotide
  Target: ATXN1; (+) strand; PAM type: NRG; PAM sequence: AAG
acagttttaaaggtttttca

SEQ ID NO: 155266 - DNA, 20 bp, Artificial Sequence
  Description of Artificial Sequence: Synthetic oligonucleotide
  Target: ATXN1; (+) strand; PAM type: NRG; PAM sequence: TAG
aggtttttcaaagttattct

SEQ ID NO: 155267 - DNA, 20 bp, Artificial Sequence
  Description of Artificial Sequence: Synthetic oligonucleotide
  Target: ATXN1; (+) strand; PAM type: NRG; PAM sequence: AAG
tatatttattatttatttac

SEQ ID NO: 155268 - DNA, 20 bp, Artificial Sequence
  Description of Artificial Sequence: Synthetic oligonucleotide
  Target: ATXN1; (+) strand; PAM type: NRG; PAM sequence: CAG
atttattatttatttacaag

SEQ ID NO: 155269 - DNA, 20 bp, Artificial Sequence
  Description of Artificial Sequence: Synthetic oligonucleotide
  Target: ATXN1; (+) strand; PAM type: NRG; PAM sequence: AAG
actctgcatctacaataact

SEQ ID NO: 155270 - DNA, 20 bp, Artificial Sequence
  Description of Artificial Sequence: Synthetic oligonucleotide
  Target: ATXN1; (+) strand; PAM type: NRG; PAM sequence: GAG
atctacaataactaagactt

SEQ ID NO: 155271 - DNA, 20 bp, Artificial Sequence
  Description of Artificial Sequence: Synthetic oligonucleotide
  Target: ATXN1; (+) strand; PAM type: NRG; PAM sequence: GAG
agacttgagaatataaaatt

SEQ ID NO: 155272 - DNA, 20 bp, Artificial Sequence
  Description of Artificial Sequence: Synthetic oligonucleotide
  Target: ATXN1; (+) strand; PAM type: NRG; PAM sequence: AAG
ttgagaatataaaattgagt

SEQ ID NO: 155273 - DNA, 20 bp, Artificial Sequence
  Description of Artificial Sequence: Synthetic oligonucleotide
  Target: ATXN1; (+) strand; PAM type: NRG; PAM sequence: TAG
taaaattgagtaagacatct

SEQ ID NO: 155274 - DNA, 20 bp, Artificial Sequence
  Description of Artificial Sequence: Synthetic oligonucleotide
  Target: ATXN1; (+) strand; PAM type: NRG; PAM sequence: AAG
agtaagacatcttagtgtgc

SEQ ID NO: 155275 - DNA, 20 bp, Artificial Sequence
  Description of Artificial Sequence: Synthetic oligonucleotide
  Target: ATXN1; (+) strand; PAM type: NRG; PAM sequence: AGG
gtaagacatcttagtgtgca

SEQ ID NO: 155276 - DNA, 20 bp, Artificial Sequence
  Description of Artificial Sequence: Synthetic oligonucleotide
  Target: ATXN1; (+) strand; PAM type: NRG; PAM sequence: GAG
aagacatcttagtgtgcaag

SEQ ID NO: 155277 - DNA, 20 bp, Artificial Sequence
  Description of Artificial Sequence: Synthetic oligonucleotide
  Target: ATXN1; (+) strand; PAM type: NRG; PAM sequence: CAG
atcttagtgtgcaaggagat

SEQ ID NO: 155278 - DNA, 20 bp, Artificial Sequence
  Description of Artificial Sequence: Synthetic oligonucleotide
  Target: ATXN1; (+) strand; PAM type: NRG; PAM sequence: GAG
cttagtgtgcaaggagatca

SEQ ID NO: 155279 - DNA, 20 bp, Artificial Sequence
  Description of Artificial Sequence: Synthetic oligonucleotide
  Target: ATXN1; (+) strand; PAM type: NRG; PAM sequence: CAG
agtgtgcaaggagatcagag

SEQ ID NO: 155280 - DNA, 20 bp, Artificial Sequence
  Description of Artificial Sequence: Synthetic oligonucleotide
  Target: ATXN1; (+) strand; PAM type: NRG; PAM sequence: CAG
gcaaggagatcagagcagaa

SEQ ID NO: 155281 - DNA, 20 bp, Artificial Sequence
  Description of Artificial Sequence: Synthetic oligonucleotide
  Target: ATXN1; (+) strand; PAM type: NRG; PAM sequence: TGG
agcagaacagatcttacctt

SEQ ID NO: 155282 - DNA, 20 bp, Artificial Sequence
  Description of Artificial Sequence: Synthetic oligonucleotide
  Target: ATXN1; (+) strand; PAM type: NRG; PAM sequence: AAG
ttttaccacgttgaaacaca

SEQ ID NO: 155283 - DNA, 20 bp, Artificial Sequence
  Description of Artificial Sequence: Synthetic oligonucleotide
  Target: ATXN1; (+) strand; PAM type: NRG; PAM sequence: TAG
cgttgaaacacaaagattca

SEQ ID NO: 155284 - DNA, 20 bp, Artificial Sequence
  Description of Artificial Sequence: Synthetic oligonucleotide
  Target: ATXN1; (+) strand; PAM type: NRG; PAM sequence: CAG
gattcatagttgatgcgatc

SEQ ID NO: 155285 - DNA, 20 bp, Artificial Sequence
  Description of Artificial Sequence: Synthetic oligonucleotide
  Target: ATXN1; (+) strand; PAM type: NRG; PAM sequence: CAG
tgatgcgatccagcacctgc

SEQ ID NO: 155286 - DNA, 20 bp, Artificial Sequence
  Description of Artificial Sequence: Synthetic oligonucleotide
  Target: ATXN1; (+) strand; PAM type: NRG; PAM sequence: TAG
tccagcacctgccagaatca

SEQ ID NO: 155287 - DNA, 20 bp, Artificial Sequence
  Description of Artificial Sequence: Synthetic oligonucleotide
  Target: ATXN1; (+) strand; PAM type: NRG; PAM sequence: CAG
cctgccagaatcatagcaat

SEQ ID NO: 155288 - DNA, 20 bp, Artificial Sequence
  Description of Artificial Sequence: Synthetic oligonucleotide
  Target: ATXN1; (+) strand; PAM type: NRG; PAM sequence: GAG
gcaatcagacttccaaatat

SEQ ID NO: 155289 - DNA, 20 bp, Artificial Sequence
  Description of Artificial Sequence: Synthetic oligonucleotide
  Target: ATXN1; (+) strand; PAM type: NRG; PAM sequence: TAG
caaatatgagaatcaaacat

SEQ ID NO: 155290 - DNA, 20 bp, Artificial Sequence
  Description of Artificial Sequence: Synthetic oligonucleotide
  Target: ATXN1; (+) strand; PAM type: NRG; PAM sequence: GAG
attagaatcattaaaaattt

SEQ ID NO: 155291 - DNA, 20 bp, Artificial Sequence
  Description of Artificial Sequence: Synthetic oligonucleotide
  Target: ATXN1; (+) strand; PAM type: NRG; PAM sequence: GAG
tagaatcattaaaaatttga

SEQ ID NO: 155292 - DNA, 20 bp, Artificial Sequence
  Description of Artificial Sequence: Synthetic oligonucleotide
  Target: ATXN1; (+) strand; PAM type: NRG; PAM sequence: AGG
agaatcattaaaaatttgag

SEQ ID NO: 155293 - DNA, 20 bp, Artificial Sequence
  Description of Artificial Sequence: Synthetic oligonucleotide
  Target: ATXN1; (+) strand; PAM type: NRG; PAM sequence: CGG
atcattaaaaatttgagagg

SEQ ID NO: 155294 - DNA, 20 bp, Artificial Sequence
  Description of Artificial Sequence: Synthetic oligonucleotide
  Target: ATXN1; (+) strand; PAM type: NRG; PAM sequence: GGG
tcattaaaaatttgagaggc

SEQ ID NO: 155295 - DNA, 20 bp, Artificial Sequence
  Description of Artificial Sequence: Synthetic oligonucleotide
  Target: ATXN1; (+) strand; PAM type: NRG; PAM sequence: GGG
cattaaaaatttgagaggcg

SEQ ID NO: 155296 - DNA, 20 bp, Artificial Sequence
  Description of Artificial Sequence: Synthetic oligonucleotide
  Target: ATXN1; (+) strand; PAM type: NRG; PAM sequence: GGG
attaaaaatttgagaggcgg

SEQ ID NO: 155297 - DNA, 20 bp, Artificial Sequence
  Description of Artificial Sequence: Synthetic oligonucleotide
  Target: ATXN1; (+) strand; PAM type: NRG; PAM sequence: GGG
ttaaaaatttgagaggcggg

SEQ ID NO: 155298 - DNA, 20 bp, Artificial Sequence
  Description of Artificial Sequence: Synthetic oligonucleotide
  Target: ATXN1; (+) strand; PAM type: NRG; PAM sequence: GGG
taaaaatttgagaggcgggg

SEQ ID NO: 155299 - DNA, 20 bp, Artificial Sequence
  Description of Artificial Sequence: Synthetic oligonucleotide
  Target: ATXN1; (+) strand; PAM type: NRG; PAM sequence: CAG
aatttgagaggcggggggga

SEQ ID NO: 155300 - DNA, 20 bp, Artificial Sequence
  Description of Artificial Sequence: Synthetic oligonucleotide
  Target: ATXN1; (+) strand; PAM type: NRG; PAM sequence: GAG
gggacagttgtacaactctt

SEQ ID NO: 155301 - DNA, 20 bp, Artificial Sequence
  Description of Artificial Sequence: Synthetic oligonucleotide
  Target: ATXN1; (+) strand; PAM type: NRG; PAM sequence: AAG
gttgtacaactcttgagcaa

SEQ ID NO: 155302 - DNA, 20 bp, Artificial Sequence
  Description of Artificial Sequence: Synthetic oligonucleotide
  Target: ATXN1; (+) strand; PAM type: NRG; PAM sequence: AAG
ttgagcaaaagttgacttat

SEQ ID NO: 155303 - DNA, 20 bp, Artificial Sequence
  Description of Artificial Sequence: Synthetic oligonucleotide
  Target: ATXN1; (+) strand; PAM type: NRG; PAM sequence: AAG
ttgtacgacaaacaaatgtg

SEQ ID NO: 155304 - DNA, 20 bp, Artificial Sequence
  Description of Artificial Sequence: Synthetic oligonucleotide
  Target: ATXN1; (+) strand; PAM type: NRG; PAM sequence: GAG
tccctatcacaaaatcacat

SEQ ID NO: 155305 - DNA, 20 bp, Artificial Sequence
  Description of Artificial Sequence: Synthetic oligonucleotide
  Target: ATXN1; (+) strand; PAM type: NRG; PAM sequence: AAG
tatcacaaaatcacatgagt

SEQ ID NO: 155306 - DNA, 20 bp, Artificial Sequence
  Description of Artificial Sequence: Synthetic oligonucleotide
  Target: ATXN1; (+) strand; PAM type: NRG; PAM sequence: GAG
caaaatcacatgagtaagtt

SEQ ID NO: 155307 - DNA, 20 bp, Artificial Sequence
  Description of Artificial Sequence: Synthetic oligonucleotide
  Target: ATXN1; (+) strand; PAM type: NRG; PAM sequence: TGG
atcacatgagtaagttgagt

SEQ ID NO: 155308 - DNA, 20 bp, Artificial Sequence
  Description of Artificial Sequence: Synthetic oligonucleotide
  Target: ATXN1; (+) strand; PAM type: NRG; PAM sequence: AAG
atcttttctaaaatgctgaa

SEQ ID NO: 155309 - DNA, 20 bp, Artificial Sequence
  Description of Artificial Sequence: Synthetic oligonucleotide
  Target: ATXN1; (+) strand; PAM type: NRG; PAM sequence: AAG
agaatttttctcccacacta

SEQ ID NO: 155310 - DNA, 20 bp, Artificial Sequence
  Description of Artificial Sequence: Synthetic oligonucleotide
  Target: ATXN1; (+) strand; PAM type: NRG; PAM sequence: GAG
aatttttctcccacactaaa

SEQ ID NO: 155311 - DNA, 20 bp, Artificial Sequence
  Description of Artificial Sequence: Synthetic oligonucleotide
  Target: ATXN1; (+) strand; PAM type: NRG; PAM sequence: AGG
atttttctcccacactaaag

SEQ ID NO: 155312 - DNA, 20 bp, Artificial Sequence
  Description of Artificial Sequence: Synthetic oligonucleotide
  Target: ATXN1; (+) strand; PAM type: NRG; PAM sequence: GGG
tttttctcccacactaaaga

SEQ ID NO: 155313 - DNA, 20 bp, Artificial Sequence
  Description of Artificial Sequence: Synthetic oligonucleotide
  Target: ATXN1; (+) strand; PAM type: NRG; PAM sequence: AAG
cacactaaagagggtttgcc

SEQ ID NO: 155314 - DNA, 20 bp, Artificial Sequence
  Description of Artificial Sequence: Synthetic oligonucleotide
  Target: ATXN1; (+) strand; PAM type: NRG; PAM sequence: TGG
gggtttgccaagtttctgcc

SEQ ID NO: 155315 - DNA, 20 bp, Artificial Sequence
  Description of Artificial Sequence: Synthetic oligonucleotide
  Target: ATXN1; (+) strand; PAM type: NRG; PAM sequence: GAG
gtttgccaagtttctgcctg

SEQ ID NO: 155316 - DNA, 20 bp, Artificial Sequence
  Description of Artificial Sequence: Synthetic oligonucleotide
  Target: ATXN1; (+) strand; PAM type: NRG; PAM sequence: TGG
ctgcctggagcaatttgtta

SEQ ID NO: 155317 - DNA, 20 bp, Artificial Sequence
  Description of Artificial Sequence: Synthetic oligonucleotide
  Target: ATXN1; (+) strand; PAM type: NRG; PAM sequence: CAG
tatggctgtgtaataaatcc

SEQ ID NO: 155318 - DNA, 20 bp, Artificial Sequence
  Description of Artificial Sequence: Synthetic oligonucleotide
  Target: ATXN1; (+) strand; PAM type: NRG; PAM sequence: AAG
gctgtgtaataaatcccaga

SEQ ID NO: 155319 - DNA, 20 bp, Artificial Sequence
  Description of Artificial Sequence: Synthetic oligonucleotide
  Target: ATXN1; (+) strand; PAM type: NRG; PAM sequence: TGG
cagaaagtttgaatttttaa

SEQ ID NO: 155320 - DNA, 20 bp, Artificial Sequence
  Description of Artificial Sequence: Synthetic oligonucleotide
  Target: ATXN1; (+) strand; PAM type: NRG; PAM sequence: CAG
atttttaatggaaacactga

SEQ ID NO: 155321 - DNA, 20 bp, Artificial Sequence
  Description of Artificial Sequence: Synthetic oligonucleotide
  Target: ATXN1; (+) strand; PAM type: NRG; PAM sequence: AAG
atggaaacactgacagaata

SEQ ID NO: 155322 - DNA, 20 bp, Artificial Sequence
  Description of Artificial Sequence: Synthetic oligonucleotide
  Target: ATXN1; (+) strand; PAM type: NRG; PAM sequence: GAG
ggaaacactgacagaataaa

SEQ ID NO: 155323 - DNA, 20 bp, Artificial Sequence
  Description of Artificial Sequence: Synthetic oligonucleotide
  Target: ATXN1; (+) strand; PAM type: NRG; PAM sequence: AGG
gaaacactgacagaataaag

SEQ ID NO: 155324 - DNA, 20 bp, Artificial Sequence
  Description of Artificial Sequence: Synthetic oligonucleotide
  Target: ATXN1; (+) strand; PAM type: NRG; PAM sequence: GGG
aaacactgacagaataaaga

SEQ ID NO: 155325 - DNA, 20 bp, Artificial Sequence
  Description of Artificial Sequence: Synthetic oligonucleotide
  Target: ATXN1; (+) strand; PAM type: NRG; PAM sequence: GAG
catatgtcatttaaaaatct

SEQ ID NO: 155326 - DNA, 20 bp, Artificial Sequence
  Description of Artificial Sequence: Synthetic oligonucleotide
  Target: ATXN1; (+) strand; PAM type: NRG; PAM sequence: TAG
ttaaaaatctgagcaaacca

SEQ ID NO: 155327 - DNA, 20 bp, Artificial Sequence
  Description of Artificial Sequence: Synthetic oligonucleotide
  Target: ATXN1; (+) strand; PAM type: NRG; PAM sequence: TAG
caaaacaaatatactttcct

SEQ ID NO: 155328 - DNA, 20 bp, Artificial Sequence
  Description of Artificial Sequence: Synthetic oligonucleotide
  Target: ATXN1; (+) strand; PAM type: NRG; PAM sequence: AAG
cttagattgcactcacaaat

SEQ ID NO: 155329 - DNA, 20 bp, Artificial Sequence
  Description of Artificial Sequence: Synthetic oligonucleotide
  Target: ATXN1; (+) strand; PAM type: NRG; PAM sequence: AGG
ttagattgcactcacaaata

SEQ ID NO: 155330 - DNA, 20 bp, Artificial Sequence
  Description of Artificial Sequence: Synthetic oligonucleotide
  Target: ATXN1; (+) strand; PAM type: NRG; PAM sequence: TGG
attgcactcacaaataaggc

SEQ ID NO: 155331 - DNA, 20 bp, Artificial Sequence
  Description of Artificial Sequence: Synthetic oligonucleotide
  Target: ATXN1; (+) strand; PAM type: NRG; PAM sequence: GGG
ttgcactcacaaataaggct

SEQ ID NO: 155332 - DNA, 20 bp, Artificial Sequence
  Description of Artificial Sequence: Synthetic oligonucleotide
  Target: ATXN1; (+) strand; PAM type: NRG; PAM sequence: GGG
tgcactcacaaataaggctg

SEQ ID NO: 155333 - DNA, 20 bp, Artificial Sequence
  Description of Artificial Sequence: Synthetic oligonucleotide
  Target: ATXN1; (+) strand; PAM type: NRG; PAM sequence: GAG
cactcacaaataaggctggg

SEQ ID NO: 155334 - DNA, 20 bp, Artificial Sequence
  Description of Artificial Sequence: Synthetic oligonucleotide
  Target: ATXN1; (+) strand; PAM type: NRG; PAM sequence: AAG
taaggctggggagaccacaa

SEQ ID NO: 155335 - DNA, 20 bp, Artificial Sequence
  Description of Artificial Sequence: Synthetic oligonucleotide
  Target: ATXN1; (+) strand; PAM type: NRG; PAM sequence: AAG
caaaagtaaaacaaactcaa

SEQ ID NO: 155336 - DNA, 20 bp, Artificial Sequence
  Description of Artificial Sequence: Synthetic oligonucleotide
  Target: ATXN1; (+) strand; PAM type: NRG; PAM sequence: TAG
agtgaaaaacactcacacaa

SEQ ID NO: 155337 - DNA, 20 bp, Artificial Sequence
  Description of Artificial Sequence: Synthetic oligonucleotide
  Target: ATXN1; (+) strand; PAM type: NRG; PAM sequence: GAG
acactcacacaatagactct

SEQ ID NO: 155338 - DNA, 20 bp, Artificial Sequence
  Description of Artificial Sequence: Synthetic oligonucleotide
  Target: ATXN1; (+) strand; PAM type: NRG; PAM sequence: AGG
cactcacacaatagactctg

SEQ ID NO: 155339 - DNA, 20 bp, Artificial Sequence
  Description of Artificial Sequence: Synthetic oligonucleotide
  Target: ATXN1; (+) strand; PAM type: NRG; PAM sequence: CAG
cacacaatagactctgaggt

SEQ ID NO: 155340 - DNA, 20 bp, Artificial Sequence
  Description of Artificial Sequence: Synthetic oligonucleotide
  Target: ATXN1; (+) strand; PAM type: NRG; PAM sequence: CAG
tgaggtcagctcaccacacc

SEQ ID NO: 155341 - DNA, 20 bp, Artificial Sequence
  Description of Artificial Sequence: Synthetic oligonucleotide
  Target: ATXN1; (+) strand; PAM type: NRG; PAM sequence: AAG
agctcaccacacccagacta

SEQ ID NO: 155342 - DNA, 20 bp, Artificial Sequence
  Description of Artificial Sequence: Synthetic oligonucleotide
  Target: ATXN1; (+) strand; PAM type: NRG; PAM sequence: TGG
cacacccagactaaagtcac

SEQ ID NO: 155343 - DNA, 20 bp, Artificial Sequence
  Description of Artificial Sequence: Synthetic oligonucleotide
  Target: ATXN1; (+) strand; PAM type: NRG; PAM sequence: GGG
acacccagactaaagtcact

SEQ ID NO: 155344 - DNA, 20 bp, Artificial Sequence
  Description of Artificial Sequence: Synthetic oligonucleotide
  Target: ATXN1; (+) strand; PAM type: NRG; PAM sequence: AAG
tgggctctgtgcgtgtcacc

SEQ ID NO: 155345 - DNA, 20 bp, Artificial Sequence
  Description of Artificial Sequence: Synthetic oligonucleotide
  Target: ATXN1; (+) strand; PAM type: NRG; PAM sequence: AAG
cgtgtcaccaagactcttaa

SEQ ID NO: 155346 - DNA, 20 bp, Artificial Sequence
  Description of Artificial Sequence: Synthetic oligonucleotide
  Target: ATXN1; (+) strand; PAM type: NRG; PAM sequence: TAG
cttgaccctccaccaaactg

SEQ ID NO: 155347 - DNA, 20 bp, Artificial Sequence
  Description of Artificial Sequence: Synthetic oligonucleotide
  Target: ATXN1; (+) strand; PAM type: NRG; PAM sequence: AAG
accctccaccaaactgtagc

SEQ ID NO: 155348 - DNA, 20 bp, Artificial Sequence
  Description of Artificial Sequence: Synthetic oligonucleotide
  Target: ATXN1; (+) strand; PAM type: NRG; PAM sequence: CAG
tccaccaaactgtagcaaga

SEQ ID NO: 155349 - DNA, 20 bp, Artificial Sequence
  Description of Artificial Sequence: Synthetic oligonucleotide
  Target: ATXN1; (+) strand; PAM type: NRG; PAM sequence: AGG
ccaccaaactgtagcaagac

SEQ ID NO: 155350 - DNA, 20 bp, Artificial Sequence
  Description of Artificial Sequence: Synthetic oligonucleotide
  Target: ATXN1; (+) strand; PAM type: NRG; PAM sequence: TGG
ctgtagcaagacaggcttcc

SEQ ID NO: 155351 - DNA, 20 bp, Artificial Sequence
  Description of Artificial Sequence: Synthetic oligonucleotide
  Target: ATXN1; (+) strand; PAM type: NRG; PAM sequence: GGG
tgtagcaagacaggcttcct

SEQ ID NO: 155352 - DNA, 20 bp, Artificial Sequence
  Description of Artificial Sequence: Synthetic oligonucleotide
  Target: ATXN1; (+) strand; PAM type: NRG; PAM sequence: TAG
cctgggaatgaaaatgacat

SEQ ID NO: 155353 - DNA, 20 bp, Artificial Sequence
  Description of Artificial Sequence: Synthetic oligonucleotide
  Target: ATXN1; (+) strand; PAM type: NRG; PAM sequence: TAG
aatgaaaatgacattagcat

SEQ ID NO: 155354 - DNA, 20 bp, Artificial Sequence
  Description of Artificial Sequence: Synthetic oligonucleotide
  Target: ATXN1; (+) strand; PAM type: NRG; PAM sequence: AAG
aaatgacattagcattagtc

SEQ ID NO: 155355 - DNA, 20 bp, Artificial Sequence
  Description of Artificial Sequence: Synthetic oligonucleotide
  Target: ATXN1; (+) strand; PAM type: NRG; PAM sequence: GAG
atgacattagcattagtcaa

SEQ ID NO: 155356 - DNA, 20 bp, Artificial Sequence
  Description of Artificial Sequence: Synthetic oligonucleotide
  Target: ATXN1; (-) strand; PAM type: YTN; PAM sequence: CTA
tggcatgaacactaagcaac

SEQ ID NO: 155357 - DNA, 20 bp, Artificial Sequence
  Description of Artificial Sequence: Synthetic oligonucleotide
  Target: ATXN1; (-) strand; PAM type: YTN; PAM sequence: CTG
gcctatggcatgaacactaa

SEQ ID NO: 155358 - DNA, 20 bp, Artificial Sequence
  Description of Artificial Sequence: Synthetic oligonucleotide
  Target: ATXN1; (-) strand; PAM type: YTN; PAM sequence: CTC
aagtctggcctatggcatga

SEQ ID NO: 155359 - DNA, 20 bp, Artificial Sequence
  Description of Artificial Sequence: Synthetic oligonucleotide
  Target: ATXN1; (-) strand; PAM type: YTN; PAM sequence: TTA
gaaactcaagtctggcctat

SEQ ID NO: 155360 - DNA, 20 bp, Artificial Sequence
  Description of Artificial Sequence: Synthetic oligonucleotide
  Target: ATXN1; (-) strand; PAM type: YTN; PAM sequence: TTT
agaaactcaagtctggccta

SEQ ID NO: 155361 - DNA, 20 bp, Artificial Sequence
  Description of Artificial Sequence: Synthetic oligonucleotide
  Target: ATXN1; (-) strand; PAM type: YTN; PAM sequence: TTC
agaggagtatttagaaactc

SEQ ID NO: 155362 - DNA, 20 bp, Artificial Sequence
  Description of Artificial Sequence: Synthetic oligonucleotide
  Target: ATXN1; (-) strand; PAM type: YTN; PAM sequence: TTT
cagaggagtatttagaaact

SEQ ID NO: 155363 - DNA, 20 bp, Artificial Sequence
  Description of Artificial Sequence: Synthetic oligonucleotide
  Target: ATXN1; (-) strand; PAM type: YTN; PAM sequence: TTT
tcagaggagtatttagaaac

SEQ ID NO: 155364 - DNA, 20 bp, Artificial Sequence
  Description of Artificial Sequence: Synthetic oligonucleotide
  Target: ATXN1; (-) strand; PAM type: YTN; PAM sequence: TTC
acattttcagaggagtattt

SEQ ID NO: 155365 - DNA, 20 bp, Artificial Sequence
  Description of Artificial Sequence: Synthetic oligonucleotide
  Target: ATXN1; (-) strand; PAM type: YTN; PAM sequence: TTG
gatagcaacgttcacatttt

SEQ ID NO: 155366 - DNA, 20 bp, Artificial Sequence
  Description of Artificial Sequence: Synthetic oligonucleotide
  Target: ATXN1; (-) strand; PAM type: YTN; PAM sequence: TTT
ggatagcaacgttcacattt

SEQ ID NO: 155367 - DNA, 20 bp, Artificial Sequence
  Description of Artificial Sequence: Synthetic oligonucleotide
  Target: ATXN1; (-) strand; PAM type: YTN; PAM sequence: CTT
tggatagcaacgttcacatt

SEQ ID NO: 155368 - DNA, 20 bp, Artificial Sequence
  Description of Artificial Sequence: Synthetic oligonucleotide
  Target: ATXN1; (-) strand; PAM type: YTN; PAM sequence: TTC
caggctttggatagcaacgt

SEQ ID NO: 155369 - DNA, 20 bp, Artificial Sequence
  Description of Artificial Sequence: Synthetic oligonucleotide
  Target: ATXN1; (-) strand; PAM type: YTN; PAM sequence: CTT
ccaggctttggatagcaacg

SEQ ID NO: 155370 - DNA, 20 bp, Artificial Sequence
  Description of Artificial Sequence: Synthetic oligonucleotide
  Target: ATXN1; (-) strand; PAM type: YTN; PAM sequence: TTA
gcaccagaggcttccaggct

SEQ ID NO: 155371 - DNA, 20 bp, Artificial Sequence
  Description of Artificial Sequence: Synthetic oligonucleotide
  Target: ATXN1; (-) strand; PAM type: YTN; PAM sequence: CTT
agcaccagaggcttccaggc

SEQ ID NO: 155372 - DNA, 20 bp, Artificial Sequence
  Description of Artificial Sequence: Synthetic oligonucleotide
  Target: ATXN1; (-) strand; PAM type: YTN; PAM sequence: CTG
tcttagcaccagaggcttcc

SEQ ID NO: 155373 - DNA, 20 bp, Artificial Sequence
  Description of Artificial Sequence: Synthetic oligonucleotide
  Target: ATXN1; (-) strand; PAM type: YTN; PAM sequence: CTG
cacatgtgtgggtccaagca

SEQ ID NO: 155374 - DNA, 20 bp, Artificial Sequence
  Description of Artificial Sequence: Synthetic oligonucleotide
  Target: ATXN1; (-) strand; PAM type: YTN; PAM sequence: CTA
tcaccctgcacatgtgtggg

SEQ ID NO: 155375 - DNA, 20 bp, Artificial Sequence
  Description of Artificial Sequence: Synthetic oligonucleotide
  Target: ATXN1; (-) strand; PAM type: YTN; PAM sequence: CTA
cacctatcaccctgcacatg

SEQ ID NO: 155376 - DNA, 20 bp, Artificial Sequence
  Description of Artificial Sequence: Synthetic oligonucleotide
  Target: ATXN1; (-) strand; PAM type: YTN; PAM sequence: TTA
caggtcactacacctatcac

SEQ ID NO: 155377 - DNA, 20 bp, Artificial Sequence
  Description of Artificial Sequence: Synthetic oligonucleotide
  Target: ATXN1; (-) strand; PAM type: YTN; PAM sequence: CTT
acaggtcactacacctatca

SEQ ID NO: 155378 - DNA, 20 bp, Artificial Sequence
  Description of Artificial Sequence: Synthetic oligonucleotide
  Target: ATXN1; (-) strand; PAM type: YTN; PAM sequence: CTC
ttacaggtcactacacctat

SEQ ID NO: 155379 - DNA, 20 bp, Artificial Sequence
  Description of Artificial Sequence: Synthetic oligonucleotide
  Target: ATXN1; (-) strand; PAM type: YTN; PAM sequence: TTC
tcttacaggtcactacacct

SEQ ID NO: 155380 - DNA, 20 bp, Artificial Sequence
  Description of Artificial Sequence: Synthetic oligonucleotide
  Target: ATXN1; (-) strand; PAM type: YTN; PAM sequence: CTG
ttctcttacaggtcactaca

SEQ ID NO: 155381 - DNA, 20 bp, Artificial Sequence
  Description of Artificial Sequence: Synthetic oligonucleotide
  Target: ATXN1; (-) strand; PAM type: YTN; PAM sequence: CTC
cctgttctcttacaggtcac

SEQ ID NO: 155382 - DNA, 20 bp, Artificial Sequence
  Description of Artificial Sequence: Synthetic oligonucleotide
  Target: ATXN1; (-) strand; PAM type: YTN; PAM sequence: TTC
gactccctgttctcttacag

SEQ ID NO: 155383 - DNA, 20 bp, Artificial Sequence
  Description of Artificial Sequence: Synthetic oligonucleotide
  Target: ATXN1; (-) strand; PAM type: YTN; PAM sequence: CTG
gccacccccagttcgactcc

SEQ ID NO: 155384 - DNA, 20 bp, Artificial Sequence
  Description of Artificial Sequence: Synthetic oligonucleotide
  Target: ATXN1; (-) strand; PAM type: YTN; PAM sequence: CTG
ggtacactggccacccccag

SEQ ID NO: 155385 - DNA, 20 bp, Artificial Sequence
  Description of Artificial Sequence: Synthetic oligonucleotide
  Target: ATXN1; (-) strand; PAM type: YTN; PAM sequence: TTG
ctgggtacactggccacccc

SEQ ID NO: 155386 - DNA, 20 bp, Artificial Sequence
  Description of Artificial Sequence: Synthetic oligonucleotide
  Target: ATXN1; (-) strand; PAM type: YTN; PAM sequence: TTT
gctgggtacactggccaccc

SEQ ID NO: 155387 - DNA, 20 bp, Artificial Sequence
  Description of Artificial Sequence: Synthetic oligonucleotide
  Target: ATXN1; (-) strand; PAM type: YTN; PAM sequence: CTT
tgctgggtacactggccacc

SEQ ID NO: 155388 - DNA, 20 bp, Artificial Sequence
  Description of Artificial Sequence: Synthetic oligonucleotide
  Target: ATXN1; (-) strand; PAM type: YTN; PAM sequence: CTG
ctttgctgggtacactggcc

SEQ ID NO: 155389 - DNA, 20 bp, Artificial Sequence
  Description of Artificial Sequence: Synthetic oligonucleotide
  Target: ATXN1; (-) strand; PAM type: YTN; PAM sequence: TTC
tgctttgctgggtacactgg

SEQ ID NO: 155390 - DNA, 20 bp, Artificial Sequence
  Description of Artificial Sequence: Synthetic oligonucleotide
  Target: ATXN1; (-) strand; PAM type: YTN; PAM sequence: TTT
ctgctttgctgggtacactg

SEQ ID NO: 155391 - DNA, 20 bp, Artificial Sequence
  Description of Artificial Sequence: Synthetic oligonucleotide
  Target: ATXN1; (-) strand; PAM type: YTN; PAM sequence: CTT
tctgctttgctgggtacact

SEQ ID NO: 155392 - DNA, 20 bp, Artificial Sequence
  Description of Artificial Sequence: Synthetic oligonucleotide
  Target: ATXN1; (-) strand; PAM type: YTN; PAM sequence: CTG
tctttctgctttgctgggta

SEQ ID NO: 155393 - DNA, 20 bp, Artificial Sequence
  Description of Artificial Sequence: Synthetic oligonucleotide
  Target: ATXN1; (-) strand; PAM type: YTN; PAM sequence: CTG
cctgtctttctgctttgctg

SEQ ID NO: 155394 - DNA, 20 bp, Artificial Sequence
  Description of Artificial Sequence: Synthetic oligonucleotide
  Target: ATXN1; (-) strand; PAM type: YTN; PAM sequence: TTG
atagcctgcctgtctttctg

SEQ ID NO: 155395 - DNA, 20 bp, Artificial Sequence
  Description of Artificial Sequence: Synthetic oligonucleotide
  Target: ATXN1; (-) strand; PAM type: YTN; PAM sequence: TTT
gatagcctgcctgtctttct

SEQ ID NO: 155396 - DNA, 20 bp, Artificial Sequence
  Description of Artificial Sequence: Synthetic oligonucleotide
  Target: ATXN1; (-) strand; PAM type: YTN; PAM sequence: TTT
tgatagcctgcctgtctttc

SEQ ID NO: 155397 - DNA, 20 bp, Artificial Sequence
  Description of Artificial Sequence: Synthetic oligonucleotide
  Target: ATXN1; (-) strand; PAM type: YTN; PAM sequence: CTG
ttttgatagcctgcctgtct

SEQ ID NO: 155398 - DNA, 20 bp, Artificial Sequence
  Description of Artificial Sequence: Synthetic oligonucleotide
  Target: ATXN1; (-) strand; PAM type: YTN; PAM sequence: CTC
tgttttgatagcctgcctgt

SEQ ID NO: 155399 - DNA, 20 bp, Artificial Sequence
  Description of Artificial Sequence: Synthetic oligonucleotide
  Target: ATXN1; (-) strand; PAM type: YTN; PAM sequence: TTG
aagtggctctgttttgatag

SEQ ID NO: 155400 - DNA, 20 bp, Artificial Sequence
  Description of Artificial Sequence: Synthetic oligonucleotide
  Target: ATXN1; (-) strand; PAM type: YTN; PAM sequence: TTC
attgaagtggctctgttttg

SEQ ID NO: 155401 - DNA, 20 bp, Artificial Sequence
  Description of Artificial Sequence: Synthetic oligonucleotide
  Target: ATXN1; (-) strand; PAM type: YTN; PAM sequence: TTT
cattgaagtggctctgtttt

SEQ ID NO: 155402 - DNA, 20 bp, Artificial Sequence
  Description of Artificial Sequence: Synthetic oligonucleotide
  Target: ATXN1; (-) strand; PAM type: YTN; PAM sequence: TTA
cgtggaaatcaccagcaagg

SEQ ID NO: 155403 - DNA, 20 bp, Artificial Sequence
  Description of Artificial Sequence: Synthetic oligonucleotide
  Target: ATXN1; (-) strand; PAM type: YTN; PAM sequence: CTT
acgtggaaatcaccagcaag

SEQ ID NO: 155404 - DNA, 20 bp, Artificial Sequence
  Description of Artificial Sequence: Synthetic oligonucleotide
  Target: ATXN1; (-) strand; PAM type: YTN; PAM sequence: CTA
ccagcttacgtggaaatcac

SEQ ID NO: 155405 - DNA, 20 bp, Artificial Sequence
  Description of Artificial Sequence: Synthetic oligonucleotide
  Target: ATXN1; (-) strand; PAM type: YTN; PAM sequence: TTC
aagggggacgaccaggacga

SEQ ID NO: 155406 - DNA, 20 bp, Artificial Sequence
  Description of Artificial Sequence: Synthetic oligonucleotide
  Target: ATXN1; (-) strand; PAM type: YTN; PAM sequence: CTT
caagggggacgaccaggacg

SEQ ID NO: 155407 - DNA, 20 bp, Artificial Sequence
  Description of Artificial Sequence: Synthetic oligonucleotide
  Target: ATXN1; (-) strand; PAM type: YTN; PAM sequence: CTA
agatcagaaatcaagtgtct

SEQ ID NO: 155408 - DNA, 20 bp, Artificial Sequence
  Description of Artificial Sequence: Synthetic oligonucleotide
  Target: ATXN1; (-) strand; PAM type: YTN; PAM sequence: CTG
gtctaagatcagaaatcaag

SEQ ID NO: 155409 - DNA, 20 bp, Artificial Sequence
  Description of Artificial Sequence: Synthetic oligonucleotide
  Target: ATXN1; (-) strand; PAM type: YTN; PAM sequence: CTG
tctggtctaagatcagaaat

SEQ ID NO: 155410 - DNA, 20 bp, Artificial Sequence
  Description of Artificial Sequence: Synthetic oligonucleotide
  Target: ATXN1; (-) strand; PAM type: YTN; PAM sequence: CTC
ccgcctgtctggtctaagat

SEQ ID NO: 155411 - DNA, 20 bp, Artificial Sequence
  Description of Artificial Sequence: Synthetic oligonucleotide
  Target: ATXN1; (-) strand; PAM type: YTN; PAM sequence: TTC
acctcccgcctgtctggtct

SEQ ID NO: 155412 - DNA, 20 bp, Artificial Sequence
  Description of Artificial Sequence: Synthetic oligonucleotide
  Target: ATXN1; (-) strand; PAM type: YTN; PAM sequence: CTT
cacctcccgcctgtctggtc

SEQ ID NO: 155413 - DNA, 20 bp, Artificial Sequence
  Description of Artificial Sequence: Synthetic oligonucleotide
  Target: ATXN1; (-) strand; PAM type: YTN; PAM sequence: CTA
cgtcaacaacaggaaaagtc

SEQ ID NO: 155414 - DNA, 20 bp, Artificial Sequence
  Description of Artificial Sequence: Synthetic oligonucleotide
  Target: ATXN1; (-) strand; PAM type: YTN; PAM sequence: CTC
ctacgtcaacaacaggaaaa

SEQ ID NO: 155415 - DNA, 20 bp, Artificial Sequence
  Description of Artificial Sequence: Synthetic oligonucleotide
  Target: ATXN1; (-) strand; PAM type: YTN; PAM sequence: CTG
tcctcctacgtcaacaacag

SEQ ID NO: 155416 - DNA, 20 bp, Artificial Sequence
  Description of Artificial Sequence: Synthetic oligonucleotide
  Target: ATXN1; (-) strand; PAM type: YTN; PAM sequence: CTC
ctgtcctcctacgtcaacaa

SEQ ID NO: 155417 - DNA, 20 bp, Artificial Sequence
  Description of Artificial Sequence: Synthetic oligonucleotide
  Target: ATXN1; (-) strand; PAM type: YTN; PAM sequence: CTG
gaaacagcctcctgtcctcc

SEQ ID NO: 155418 - DNA, 20 bp, Artificial Sequence
  Description of Artificial Sequence: Synthetic oligonucleotide
  Target: ATXN1; (-) strand; PAM type: YTN; PAM sequence: TTC
ccccctggaaacagcctcct

SEQ ID NO: 155419 - DNA, 20 bp, Artificial Sequence
  Description of Artificial Sequence: Synthetic oligonucleotide
  Target: ATXN1; (-) strand; PAM type: YTN; PAM sequence: CTG
gccgattcccccctggaaac

SEQ ID NO: 155420 - DNA, 20 bp, Artificial Sequence
  Description of Artificial Sequence: Synthetic oligonucleotide
  Target: ATXN1; (-) strand; PAM type: YTN; PAM sequence: TTC
ccaacaaccaggagcccaaa

SEQ ID NO: 155421 - DNA, 20 bp, Artificial Sequence
  Description of Artificial Sequence: Synthetic oligonucleotide
  Target: ATXN1; (-) strand; PAM type: YTN; PAM sequence: CTT
cccaacaaccaggagcccaa

SEQ ID NO: 155422 - DNA, 20 bp, Artificial Sequence
  Description of Artificial Sequence: Synthetic oligonucleotide
  Target: ATXN1; (-) strand; PAM type: YTN; PAM sequence: CTC
aacatgcacaccaacttccc

SEQ ID NO: 155423 - DNA, 20 bp, Artificial Sequence
  Description of Artificial Sequence: Synthetic oligonucleotide
  Target: ATXN1; (-) strand; PAM type: YTN; PAM sequence: CTA
cctcaacatgcacaccaact

SEQ ID NO: 155424 - DNA, 20 bp, Artificial Sequence
  Description of Artificial Sequence: Synthetic oligonucleotide
  Target: ATXN1; (-) strand; PAM type: YTN; PAM sequence: TTC
tacctcaacatgcacaccaa

SEQ ID NO: 155425 - DNA, 20 bp, Artificial Sequence
  Description of Artificial Sequence: Synthetic oligonucleotide
  Target: ATXN1; (-) strand; PAM type: YTN; PAM sequence: CTA
ttctacctcaacatgcacac

SEQ ID NO: 155426 - DNA, 20 bp, Artificial Sequence
  Description of Artificial Sequence: Synthetic oligonucleotide
  Target: ATXN1; (-) strand; PAM type: YTN; PAM sequence: TTC
tattctacctcaacatgcac

SEQ ID NO: 155427 - DNA, 20 bp, Artificial Sequence
  Description of Artificial Sequence: Synthetic oligonucleotide
  Target: ATXN1; (-) strand; PAM type: YTN; PAM sequence: TTT
ctattctacctcaacatgca

SEQ ID NO: 155428 - DNA, 20 bp, Artificial Sequence
  Description of Artificial Sequence: Synthetic oligonucleotide
  Target: ATXN1; (-) strand; PAM type: YTN; PAM sequence: CTT
tctattctacctcaacatgc

SEQ ID NO: 155429 - DNA, 20 bp, Artificial Sequence
  Description of Artificial Sequence: Synthetic oligonucleotide
  Target: ATXN1; (-) strand; PAM type: YTN; PAM sequence: TTA
cctttctattctacctcaac

SEQ ID NO: 155430 - DNA, 20 bp, Artificial Sequence
  Description of Artificial Sequence: Synthetic oligonucleotide
  Target: ATXN1; (-) strand; PAM type: YTN; PAM sequence: TTT
acctttctattctacctcaa

SEQ ID NO: 155431 - DNA, 20 bp, Artificial Sequence
  Description of Artificial Sequence: Synthetic oligonucleotide
  Target: ATXN1; (-) strand; PAM type: YTN; PAM sequence: CTT
tacctttctattctacctca

SEQ ID NO: 155432 - DNA, 20 bp, Artificial Sequence
  Description of Artificial Sequence: Synthetic oligonucleotide
  Target: ATXN1; (-) strand; PAM type: YTN; PAM sequence: CTA
acagaaaccacctttacctt

SEQ ID NO: 155433 - DNA, 20 bp, Artificial Sequence
  Description of Artificial Sequence: Synthetic oligonucleotide
  Target: ATXN1; (-) strand; PAM type: YTN; PAM sequence: CTG
ctaacagaaaccacctttac

SEQ ID NO: 155434 - DNA, 20 bp, Artificial Sequence
  Description of Artificial Sequence: Synthetic oligonucleotide
  Target: ATXN1; (-) strand; PAM type: YTN; PAM sequence: CTG
ctgctaacagaaaccacctt

SEQ ID NO: 155435 - DNA, 20 bp, Artificial Sequence
  Description of Artificial Sequence: Synthetic oligonucleotide
  Target: ATXN1; (-) strand; PAM type: YTN; PAM sequence: CTC
tgctgctaacagaaaccacc

SEQ ID NO: 155436 - DNA, 20 bp, Artificial Sequence
  Description of Artificial Sequence: Synthetic oligonucleotide
  Target: ATXN1; (-) strand; PAM type: YTN; PAM sequence: CTC
ccctctgctgctaacagaaa

SEQ ID NO: 155437 - DNA, 20 bp, Artificial Sequence
  Description of Artificial Sequence: Synthetic oligonucleotide
  Target: ATXN1; (-) strand; PAM type: YTN; PAM sequence: CTC
cagcaacgtgctcccctctg

SEQ ID NO: 155438 - DNA, 20 bp, Artificial Sequence
  Description of Artificial Sequence: Synthetic oligonucleotide
  Target: ATXN1; (-) strand; PAM type: YTN; PAM sequence: CTC
tccagcaacgtgctcccctc

SEQ ID NO: 155439 - DNA, 20 bp, Artificial Sequence
  Description of Artificial Sequence: Synthetic oligonucleotide
  Target: ATXN1; (-) strand; PAM type: YTN; PAM sequence: TTC
tctccagcaacgtgctcccc

SEQ ID NO: 155440 - DNA, 20 bp, Artificial Sequence
  Description of Artificial Sequence: Synthetic oligonucleotide
  Target: ATXN1; (-) strand; PAM type: YTN; PAM sequence: TTG
gtgccattctctccagcaac

SEQ ID NO: 155441 - DNA, 20 bp, Artificial Sequence
  Description of Artificial Sequence: Synthetic oligonucleotide
  Target: ATXN1; (-) strand; PAM type: YTN; PAM sequence: CTT
ggtgccattctctccagcaa

SEQ ID NO: 155442 - DNA, 20 bp, Artificial Sequence
  Description of Artificial Sequence: Synthetic oligonucleotide
  Target: ATXN1; (-) strand; PAM type: YTN; PAM sequence: CTG
cttggtgccattctctccag

SEQ ID NO: 155443 - DNA, 20 bp, Artificial Sequence
  Description of Artificial Sequence: Synthetic oligonucleotide
  Target: ATXN1; (-) strand; PAM type: YTN; PAM sequence: TTG
aaggagtcagggacccataa

SEQ ID NO: 155444 - DNA, 20 bp, Artificial Sequence
  Description of Artificial Sequence: Synthetic oligonucleotide
  Target: ATXN1; (-) strand; PAM type: YTN; PAM sequence: CTT
gaaggagtcagggacccata

SEQ ID NO: 155445 - DNA, 20 bp, Artificial Sequence
  Description of Artificial Sequence: Synthetic oligonucleotide
  Target: ATXN1; (-) strand; PAM type: YTN; PAM sequence: CTG
gtgagcagcgcttgaaggag

SEQ ID NO: 155446 - DNA, 20 bp, Artificial Sequence
  Description of Artificial Sequence: Synthetic oligonucleotide
  Target: ATXN1; (-) strand; PAM type: YTN; PAM sequence: TTG
cggagaggaaagtcctggtg

SEQ ID NO: 155447 - DNA, 20 bp, Artificial Sequence
  Description of Artificial Sequence: Synthetic oligonucleotide
  Target: ATXN1; (-) strand; PAM type: YTN; PAM sequence: CTG
catgttgcggagaggaaagt

SEQ ID NO: 155448 - DNA, 20 bp, Artificial Sequence
  Description of Artificial Sequence: Synthetic oligonucleotide
  Target: ATXN1; (-) strand; PAM type: YTN; PAM sequence: CTG
ccctgcatgttgcggagagg

SEQ ID NO: 155449 - DNA, 20 bp, Artificial Sequence
  Description of Artificial Sequence: Synthetic oligonucleotide
  Target: ATXN1; (-) strand; PAM type: YTN; PAM sequence: CTG
gctgccctgcatgttgcgga

SEQ ID NO: 155450 - DNA, 20 bp, Artificial Sequence
  Description of Artificial Sequence: Synthetic oligonucleotide
  Target: ATXN1; (-) strand; PAM type: YTN; PAM sequence: TTG
ctggctgccctgcatgttgc

SEQ ID NO: 155451 - DNA, 20 bp, Artificial Sequence
  Description of Artificial Sequence: Synthetic oligonucleotide
  Target: ATXN1; (-) strand; PAM type: YTN; PAM sequence: CTC
attgctggctgccctgcatg

SEQ ID NO: 155452 - DNA, 20 bp, Artificial Sequence
  Description of Artificial Sequence: Synthetic oligonucleotide
  Target: ATXN1; (-) strand; PAM type: YTN; PAM sequence: CTC
ccgcccaaagggcacgggct

SEQ ID NO: 155453 - DNA, 20 bp, Artificial Sequence
  Description of Artificial Sequence: Synthetic oligonucleotide
  Target: ATXN1; (-) strand; PAM type: YTN; PAM sequence: TTC
ctcccgcccaaagggcacgg

SEQ ID NO: 155454 - DNA, 20 bp, Artificial Sequence
  Description of Artificial Sequence: Synthetic oligonucleotide
  Target: ATXN1; (-) strand; PAM type: YTN; PAM sequence: CTC
agatgaacacattcctcccg

SEQ ID NO: 155455 - DNA, 20 bp, Artificial Sequence
  Description of Artificial Sequence: Synthetic oligonucleotide
  Target: ATXN1; (-) strand; PAM type: YTN; PAM sequence: CTA
ccaagtgccaagatgatcac

SEQ ID NO: 155456 - DNA, 20 bp, Artificial Sequence
  Description of Artificial Sequence: Synthetic oligonucleotide
  Target: ATXN1; (-) strand; PAM type: YTN; PAM sequence: TTC
taccaagtgccaagatgatc

SEQ ID NO: 155457 - DNA, 20 bp, Artificial Sequence
  Description of Artificial Sequence: Synthetic oligonucleotide
  Target: ATXN1; (-) strand; PAM type: YTN; PAM sequence: TTT
ctaccaagtgccaagatgat

SEQ ID NO: 155458 - DNA, 20 bp, Artificial Sequence
  Description of Artificial Sequence: Synthetic oligonucleotide
  Target: ATXN1; (-) strand; PAM type: YTN; PAM sequence: CTG
accccatccccacatttcta

SEQ ID NO: 155459 - DNA, 20 bp, Artificial Sequence
  Description of Artificial Sequence: Synthetic oligonucleotide
  Target: ATXN1; (-) strand; PAM type: YTN; PAM sequence: CTC
tgaccccatccccacatttc

SEQ ID NO: 155460 - DNA, 20 bp, Artificial Sequence
  Description of Artificial Sequence: Synthetic oligonucleotide
  Target: ATXN1; (-) strand; PAM type: YTN; PAM sequence: CTC
agaaaaccagaccccaccct

SEQ ID NO: 155461 - DNA, 20 bp, Artificial Sequence
  Description of Artificial Sequence: Synthetic oligonucleotide
  Target: ATXN1; (-) strand; PAM type: YTN; PAM sequence: CTG
tagcccccaaggcactcaga

SEQ ID NO: 155462 - DNA, 20 bp, Artificial Sequence
  Description of Artificial Sequence: Synthetic oligonucleotide
  Target: ATXN1; (-) strand; PAM type: YTN; PAM sequence: TTC
tgtagcccccaaggcactca

SEQ ID NO: 155463 - DNA, 20 bp, Artificial Sequence
  Description of Artificial Sequence: Synthetic oligonucleotide
  Target: ATXN1; (-) strand; PAM type: YTN; PAM sequence: TTT
ctgtagcccccaaggcactc

SEQ ID NO: 155464 - DNA, 20 bp, Artificial Sequence
  Description of Artificial Sequence: Synthetic oligonucleotide
  Target: ATXN1; (-) strand; PAM type: YTN; PAM sequence: CTT
tctgtagcccccaaggcact

SEQ ID NO: 155465 - DNA, 20 bp, Artificial Sequence
  Description of Artificial Sequence: Synthetic oligonucleotide
  Target: ATXN1; (-) strand; PAM type: YTN; PAM sequence: CTC
cagcactttctgtagccccc

SEQ ID NO: 155466 - DNA, 20 bp, Artificial Sequence
  Description of Artificial Sequence: Synthetic oligonucleotide
  Target: ATXN1; (-) strand; PAM type: YTN; PAM sequence: CTC
ccagctccagcactttctgt

SEQ ID NO: 155467 - DNA, 20 bp, Artificial Sequence
  Description of Artificial Sequence: Synthetic oligonucleotide
  Target: ATXN1; (-) strand; PAM type: YTN; PAM sequence: TTA
ctcccagctccagcactttc

SEQ ID NO: 155468 - DNA, 20 bp, Artificial Sequence
  Description of Artificial Sequence: Synthetic oligonucleotide
  Target: ATXN1; (-) strand; PAM type: YTN; PAM sequence: TTA
gaattactcccagctccagc

SEQ ID NO: 155469 - DNA, 20 bp, Artificial Sequence
  Description of Artificial Sequence: Synthetic oligonucleotide
  Target: ATXN1; (-) strand; PAM type: YTN; PAM sequence: TTA
agagcccaattagaattact

SEQ ID NO: 155470 - DNA, 20 bp, Artificial Sequence
  Description of Artificial Sequence: Synthetic oligonucleotide
  Target: ATXN1; (-) strand; PAM type: YTN; PAM sequence: CTT
aagagcccaattagaattac

SEQ ID NO: 155471 - DNA, 20 bp, Artificial Sequence
  Description of Artificial Sequence: Synthetic oligonucleotide
  Target: ATXN1; (-) strand; PAM type: YTN; PAM sequence: TTC
ccgccccaccttaagagccc

SEQ ID NO: 155472 - DNA, 20 bp, Artificial Sequence
  Description of Artificial Sequence: Synthetic oligonucleotide
  Target: ATXN1; (-) strand; PAM type: YTN; PAM sequence: TTT
cccgccccaccttaagagcc

SEQ ID NO: 155473 - DNA, 20 bp, Artificial Sequence
  Description of Artificial Sequence: Synthetic oligonucleotide
  Target: ATXN1; (-) strand; PAM type: YTN; PAM sequence: CTA
gtttcccgccccaccttaag

SEQ ID NO: 155474 - DNA, 20 bp, Artificial Sequence
  Description of Artificial Sequence: Synthetic oligonucleotide
  Target: ATXN1; (-) strand; PAM type: YTN; PAM sequence: TTA
tctagtttcccgccccacct

SEQ ID NO: 155475 - DNA, 20 bp, Artificial Sequence
  Description of Artificial Sequence: Synthetic oligonucleotide
  Target: ATXN1; (-) strand; PAM type: YTN; PAM sequence: TTT
atctagtttcccgccccacc

SEQ ID NO: 155476 - DNA, 20 bp, Artificial Sequence
  Description of Artificial Sequence: Synthetic oligonucleotide
  Target: ATXN1; (-) strand; PAM type: YTN; PAM sequence: TTT
tatctagtttcccgccccac

SEQ ID NO: 155477 - DNA, 20 bp, Artificial Sequence
  Description of Artificial Sequence: Synthetic oligonucleotide
  Target: ATXN1; (-) strand; PAM type: YTN; PAM sequence: TTT
ttatctagtttcccgcccca

SEQ ID NO: 155478 - DNA, 20 bp, Artificial Sequence
  Description of Artificial Sequence: Synthetic oligonucleotide
  Target: ATXN1; (-) strand; PAM type: YTN; PAM sequence: CTT
tttatctagtttcccgcccc

SEQ ID NO: 155479 - DNA, 20 bp, Artificial Sequence
  Description of Artificial Sequence: Synthetic oligonucleotide
  Target: ATXN1; (-) strand; PAM type: YTN; PAM sequence: TTC
tttttatctagtttcccgcc

SEQ ID NO: 155480 - DNA, 20 bp, Artificial Sequence
  Description of Artificial Sequence: Synthetic oligonucleotide
  Target: ATXN1; (-) strand; PAM type: YTN; PAM sequence: TTT
ctttttatctagtttcccgc

SEQ ID NO: 155481 - DNA, 20 bp, Artificial Sequence
  Description of Artificial Sequence: Synthetic oligonucleotide
  Target: ATXN1; (-) strand; PAM type: YTN; PAM sequence: TTT
tctttttatctagtttcccg

SEQ ID NO: 155482 - DNA, 20 bp, Artificial Sequence
  Description of Artificial Sequence: Synthetic oligonucleotide
  Target: ATXN1; (-) strand; PAM type: YTN; PAM sequence: CTG
gaagacgatagaagttttct

SEQ ID NO: 155483 - DNA, 20 bp, Artificial Sequence
  Description of Artificial Sequence: Synthetic oligonucleotide
  Target: ATXN1; (-) strand; PAM type: YTN; PAM sequence: CTC
tggaagacgatagaagtttt

SEQ ID NO: 155484 - DNA, 20 bp, Artificial Sequence
  Description of Artificial Sequence: Synthetic oligonucleotide
  Target: ATXN1; (-) strand; PAM type: YTN; PAM sequence: CTC
agaggctctggaagacgata

SEQ ID NO: 155485 - DNA, 20 bp, Artificial Sequence
  Description of Artificial Sequence: Synthetic oligonucleotide
  Target: ATXN1; (-) strand; PAM type: YTN; PAM sequence: TTA
ccctcagaggctctggaaga

SEQ ID NO: 155486 - DNA, 20 bp, Artificial Sequence
  Description of Artificial Sequence: Synthetic oligonucleotide
  Target: ATXN1; (-) strand; PAM type: YTN; PAM sequence: CTT
accctcagaggctctggaag

SEQ ID NO: 155487 - DNA, 20 bp, Artificial Sequence
  Description of Artificial Sequence: Synthetic oligonucleotide
  Target: ATXN1; (-) strand; PAM type: YTN; PAM sequence: TTC
cacagtcttaccctcagagg

SEQ ID NO: 155488 - DNA, 20 bp, Artificial Sequence
  Description of Artificial Sequence: Synthetic oligonucleotide
  Target: ATXN1; (-) strand; PAM type: YTN; PAM sequence: CTT
ccacagtcttaccctcagag

SEQ ID NO: 155489 - DNA, 20 bp, Artificial Sequence
  Description of Artificial Sequence: Synthetic oligonucleotide
  Target: ATXN1; (-) strand; PAM type: YTN; PAM sequence: TTG
taaggaacttccacagtctt

SEQ ID NO: 155490 - DNA, 20 bp, Artificial Sequence
  Description of Artificial Sequence: Synthetic oligonucleotide
  Target: ATXN1; (-) strand; PAM type: YTN; PAM sequence: TTT
gtaaggaacttccacagtct

SEQ ID NO: 155491 - DNA, 20 bp, Artificial Sequence
  Description of Artificial Sequence: Synthetic oligonucleotide
  Target: ATXN1; (-) strand; PAM type: YTN; PAM sequence: CTT
tgtaaggaacttccacagtc

SEQ ID NO: 155492 - DNA, 20 bp, Artificial Sequence
  Description of Artificial Sequence: Synthetic oligonucleotide
  Target: ATXN1; (-) strand; PAM type: YTN; PAM sequence: CTC
ctttgtaaggaacttccaca

SEQ ID NO: 155493 - DNA, 20 bp, Artificial Sequence
  Description of Artificial Sequence: Synthetic oligonucleotide
  Target: ATXN1; (-) strand; PAM type: YTN; PAM sequence: TTC
cacatctcctttgtaaggaa

SEQ ID NO: 155494 - DNA, 20 bp, Artificial Sequence
  Description of Artificial Sequence: Synthetic oligonucleotide
  Target: ATXN1; (-) strand; PAM type: YTN; PAM sequence: TTT
ccacatctcctttgtaagga

SEQ ID NO: 155495 - DNA, 20 bp, Artificial Sequence
  Description of Artificial Sequence: Synthetic oligonucleotide
  Target: ATXN1; (-) strand; PAM type: YTN; PAM sequence: TTT
tccacatctcctttgtaagg

SEQ ID NO: 155496 - DNA, 20 bp, Artificial Sequence
  Description of Artificial Sequence: Synthetic oligonucleotide
  Target: ATXN1; (-) strand; PAM type: YTN; PAM sequence: CTC
agtcccccgagaatatccag

SEQ ID NO: 155497 - DNA, 20 bp, Artificial Sequence
  Description of Artificial Sequence: Synthetic oligonucleotide
  Target: ATXN1; (-) strand; PAM type: YTN; PAM sequence: TTG
gcggcccccacgtaggtgca

SEQ ID NO: 155498 - DNA, 20 bp, Artificial Sequence
  Description of Artificial Sequence: Synthetic oligonucleotide
  Target: ATXN1; (-) strand; PAM type: YTN; PAM sequence: TTT
ggcggcccccacgtaggtgc

SEQ ID NO: 155499 - DNA, 20 bp, Artificial Sequence
  Description of Artificial Sequence: Synthetic oligonucleotide
  Target: ATXN1; (-) strand; PAM type: YTN; PAM sequence: TTG
agtttggcggcccccacgta

SEQ ID NO: 155500 - DNA, 20 bp, Artificial Sequence
  Description of Artificial Sequence: Synthetic oligonucleotide
  Target: ATXN1; (-) strand; PAM type: YTN; PAM sequence: CTT
gagtttggcggcccccacgt

SEQ ID NO: 155501 - DNA, 20 bp, Artificial Sequence
  Description of Artificial Sequence: Synthetic oligonucleotide
  Target: ATXN1; (-) strand; PAM type: YTN; PAM sequence: CTC
cttgagtttggcggccccca

SEQ ID NO: 155502 - DNA, 20 bp, Artificial Sequence
  Description of Artificial Sequence: Synthetic oligonucleotide
  Target: ATXN1; (-) strand; PAM type: YTN; PAM sequence: CTG
agctccttgagtttggcggc

SEQ ID NO: 155503 - DNA, 20 bp, Artificial Sequence
  Description of Artificial Sequence: Synthetic oligonucleotide
  Target: ATXN1; (-) strand; PAM type: YTN; PAM sequence: CTG
ctgagctccttgagtttggc

SEQ ID NO: 155504 - DNA, 20 bp, Artificial Sequence
  Description of Artificial Sequence: Synthetic oligonucleotide
  Target: ATXN1; (-) strand; PAM type: YTN; PAM sequence: CTC
ctgctgagctccttgagttt

SEQ ID NO: 155505 - DNA, 20 bp, Artificial Sequence
  Description of Artificial Sequence: Synthetic oligonucleotide
  Target: ATXN1; (-) strand; PAM type: YTN; PAM sequence: TTG
ccctcctgctgagctccttg

SEQ ID NO: 155506 - DNA, 20 bp, Artificial Sequence
  Description of Artificial Sequence: Synthetic oligonucleotide
  Target: ATXN1; (-) strand; PAM type: YTN; PAM sequence: CTG
ggtcacccggatgaatgttg

SEQ ID NO: 155507 - DNA, 20 bp, Artificial Sequence
  Description of Artificial Sequence: Synthetic oligonucleotide
  Target: ATXN1; (-) strand; PAM type: YTN; PAM sequence: CTG
ctgggtcacccggatgaatg

SEQ ID NO: 155508 - DNA, 20 bp, Artificial Sequence
  Description of Artificial Sequence: Synthetic oligonucleotide
  Target: ATXN1; (-) strand; PAM type: YTN; PAM sequence: TTG
tgctgctgggtcacccggat

SEQ ID NO: 155509 - DNA, 20 bp, Artificial Sequence
  Description of Artificial Sequence: Synthetic oligonucleotide
  Target: ATXN1; (-) strand; PAM type: YTN; PAM sequence: CTG
aacacggtgttgtgctgctg

SEQ ID NO: 155510 - DNA, 20 bp, Artificial Sequence
  Description of Artificial Sequence: Synthetic oligonucleotide
  Target: ATXN1; (-) strand; PAM type: YTN; PAM sequence: TTA
gctgaacacggtgttgtgct

SEQ ID NO: 155511 - DNA, 20 bp, Artificial Sequence
  Description of Artificial Sequence: Synthetic oligonucleotide
  Target: ATXN1; (-) strand; PAM type: YTN; PAM sequence: TTG
tccccagggttagctgaaca

SEQ ID NO: 155512 - DNA, 20 bp, Artificial Sequence
  Description of Artificial Sequence: Synthetic oligonucleotide
  Target: ATXN1; (-) strand; PAM type: YTN; PAM sequence: TTT
gtccccagggttagctgaac

SEQ ID NO: 155513 - DNA, 20 bp, Artificial Sequence
  Description of Artificial Sequence: Synthetic oligonucleotide
  Target: ATXN1; (-) strand; PAM type: YTN; PAM sequence: CTT
tgtccccagggttagctgaa

SEQ ID NO: 155514 - DNA, 20 bp, Artificial Sequence
  Description of Artificial Sequence: Synthetic oligonucleotide
  Target: ATXN1; (-) strand; PAM type: YTN; PAM sequence: CTG
ctttgtccccagggttagct

SEQ ID NO: 155515 - DNA, 20 bp, Artificial Sequence
  Description of Artificial Sequence: Synthetic oligonucleotide
  Target: ATXN1; (-) strand; PAM type: YTN; PAM sequence: CTC
gagccagacgctgctttgtc

SEQ ID NO: 155516 - DNA, 20 bp, Artificial Sequence
  Description of Artificial Sequence: Synthetic oligonucleotide
  Target: ATXN1; (-) strand; PAM type: YTN; PAM sequence: TTC
cactcgagccagacgctgct

SEQ ID NO: 155517 - DNA, 20 bp, Artificial Sequence
  Description of Artificial Sequence: Synthetic oligonucleotide
  Target: ATXN1; (-) strand; PAM type: YTN; PAM sequence: CTT
ccactcgagccagacgctgc

SEQ ID NO: 155518 - DNA, 20 bp, Artificial Sequence
  Description of Artificial Sequence: Synthetic oligonucleotide
  Target: ATXN1; (-) strand; PAM type: YTN; PAM sequence: TTG
gacgcttccactcgagccag

SEQ ID NO: 155519 - DNA, 20 bp, Artificial Sequence
  Description of Artificial Sequence: Synthetic oligonucleotide
  Target: ATXN1; (-) strand; PAM type: YTN; PAM sequence: TTT
ggacgcttccactcgagcca

SEQ ID NO: 155520 - DNA, 20 bp, Artificial Sequence
  Description of Artificial Sequence: Synthetic oligonucleotide
  Target: ATXN1; (-) strand; PAM type: YTN; PAM sequence: TTG
gggggagatgggaaaagcag

SEQ ID NO: 155521 - DNA, 20 bp, Artificial Sequence
  Description of Artificial Sequence: Synthetic oligonucleotide
  Target: ATXN1; (-) strand; PAM type: YTN; PAM sequence: CTT
ggggggagatgggaaaagca

SEQ ID NO: 155522 - DNA, 20 bp, Artificial Sequence
  Description of Artificial Sequence: Synthetic oligonucleotide
  Target: ATXN1; (-) strand; PAM type: YTN; PAM sequence: CTG
acggaacagacttgggggga

SEQ ID NO: 155523 - DNA, 20 bp, Artificial Sequence
  Description of Artificial Sequence: Synthetic oligonucleotide
  Target: ATXN1; (-) strand; PAM type: YTN; PAM sequence: CTC
tgacggaacagacttggggg

SEQ ID NO: 155524 - DNA, 20 bp, Artificial Sequence
  Description of Artificial Sequence: Synthetic oligonucleotide
  Target: ATXN1; (-) strand; PAM type: YTN; PAM sequence: TTC
aggagcagccagaagctctg

SEQ ID NO: 155525 - DNA, 20 bp, Artificial Sequence
  Description of Artificial Sequence: Synthetic oligonucleotide
  Target: ATXN1; (-) strand; PAM type: YTN; PAM sequence: TTC
caccattcaggagcagccag

SEQ ID NO: 155526 - DNA, 20 bp, Artificial Sequence
  Description of Artificial Sequence: Synthetic oligonucleotide
  Target: ATXN1; (-) strand; PAM type: YTN; PAM sequence: CTC
caggcagcaggagacagaag

SEQ ID NO: 155527 - DNA, 20 bp, Artificial Sequence
  Description of Artificial Sequence: Synthetic oligonucleotide
  Target: ATXN1; (-) strand; PAM type: YTN; PAM sequence: CTG
ggccccgagaaggcaggcgg

SEQ ID NO: 155528 - DNA, 20 bp, Artificial Sequence
  Description of Artificial Sequence: Synthetic oligonucleotide
  Target: ATXN1; (-) strand; PAM type: YTN; PAM sequence: TTG
cgtctgggccccgagaaggc

SEQ ID NO: 155529 - DNA, 20 bp, Artificial Sequence
  Description of Artificial Sequence: Synthetic oligonucleotide
  Target: ATXN1; (-) strand; PAM type: YTN; PAM sequence: CTT
gcgtctgggccccgagaagg

SEQ ID NO: 155530 - DNA, 20 bp, Artificial Sequence
  Description of Artificial Sequence: Synthetic oligonucleotide
  Target: ATXN1; (-) strand; PAM type: YTN; PAM sequence: TTG
gcccaatcggtgccttgcgt

SEQ ID NO: 155531 - DNA, 20 bp, Artificial Sequence
  Description of Artificial Sequence: Synthetic oligonucleotide
  Target: ATXN1; (-) strand; PAM type: YTN; PAM sequence: CTG
atgttggcccaatcggtgcc

SEQ ID NO: 155532 - DNA, 20 bp, Artificial Sequence
  Description of Artificial Sequence: Synthetic oligonucleotide
  Target: ATXN1; (-) strand; PAM type: YTN; PAM sequence: CTC
tgatgttggcccaatcggtg

SEQ ID NO: 155533 - DNA, 20 bp, Artificial Sequence
  Description of Artificial Sequence: Synthetic oligonucleotide
  Target: ATXN1; (-) strand; PAM type: YTN; PAM sequence: CTG
ggcagcagggctctgatgtt

SEQ ID NO: 155534 - DNA, 20 bp, Artificial Sequence
  Description of Artificial Sequence: Synthetic oligonucleotide
  Target: ATXN1; (-) strand; PAM type: YTN; PAM sequence: TTC
tgggcagcagggctctgatg

SEQ ID NO: 155535 - DNA, 20 bp, Artificial Sequence
  Description of Artificial Sequence: Synthetic oligonucleotide
  Target: ATXN1; (-) strand; PAM type: YTN; PAM sequence: TTA
tgagttctgggcagcagggc

SEQ ID NO: 155536 - DNA, 20 bp, Artificial Sequence
  Description of Artificial Sequence: Synthetic oligonucleotide
  Target: ATXN1; (-) strand; PAM type: YTN; PAM sequence: TTG
aacaatgaggttatgagttc

SEQ ID NO: 155537 - DNA, 20 bp, Artificial Sequence
  Description of Artificial Sequence: Synthetic oligonucleotide
  Target: ATXN1; (-) strand; PAM type: YTN; PAM sequence: TTT
gaacaatgaggttatgagtt

SEQ ID NO: 155538 - DNA, 20 bp, Artificial Sequence
  Description of Artificial Sequence: Synthetic oligonucleotide
  Target: ATXN1; (-) strand; PAM type: YTN; PAM sequence: TTG
gtttgaacaatgaggttatg

SEQ ID NO: 155539 - DNA, 20 bp, Artificial Sequence
  Description of Artificial Sequence: Synthetic oligonucleotide
  Target: ATXN1; (-) strand; PAM type: YTN; PAM sequence: TTA
aaaaagaaagaaaaacaaag

SEQ ID NO: 155540 - DNA, 20 bp, Artificial Sequence
  Description of Artificial Sequence: Synthetic oligonucleotide
  Target: ATXN1; (-) strand; PAM type: YTN; PAM sequence: TTT
aaaaaagaaagaaaaacaaa

SEQ ID NO: 155541 - DNA, 20 bp, Artificial Sequence
  Description of Artificial Sequence: Synthetic oligonucleotide
  Target: ATXN1; (-) strand; PAM type: YTN; PAM sequence: TTT
taaaaaagaaagaaaaacaa

SEQ ID NO: 155542 - DNA, 20 bp, Artificial Sequence
  Description of Artificial Sequence: Synthetic oligonucleotide
  Target: ATXN1; (-) strand; PAM type: YTN; PAM sequence: CTT
ttaaaaaagaaagaaaaaca

SEQ ID NO: 155543 - DNA, 20 bp, Artificial Sequence
  Description of Artificial Sequence: Synthetic oligonucleotide
  Target: ATXN1; (-) strand; PAM type: YTN; PAM sequence: TTC
ttttaaaaaagaaagaaaaa

SEQ ID NO: 155544 - DNA, 20 bp, Artificial Sequence
  Description of Artificial Sequence: Synthetic oligonucleotide
  Target: ATXN1; (-) strand; PAM type: YTN; PAM sequence: CTT
cttttaaaaaagaaagaaaa

SEQ ID NO: 155545 - DNA, 20 bp, Artificial Sequence
  Description of Artificial Sequence: Synthetic oligonucleotide
  Target: ATXN1; (-) strand; PAM type: YTN; PAM sequence: TTA
aagtgaaaccatcttctttt

SEQ ID NO: 155546 - DNA, 20 bp, Artificial Sequence
  Description of Artificial Sequence: Synthetic oligonucleotide
  Target: ATXN1; (-) strand; PAM type: YTN; PAM sequence: TTA
tattaaagtgaaaccatctt

SEQ ID NO: 155547 - DNA, 20 bp, Artificial Sequence
  Description of Artificial Sequence: Synthetic oligonucleotide
  Target: ATXN1; (-) strand; PAM type: YTN; PAM sequence: TTA
agataatagcattatattaa

SEQ ID NO: 155548 - DNA, 20 bp, Artificial Sequence
  Description of Artificial Sequence: Synthetic oligonucleotide
  Target: ATXN1; (-) strand; PAM type: YTN; PAM sequence: CTT
aagataatagcattatatta

SEQ ID NO: 155549 - DNA, 20 bp, Artificial Sequence
  Description of Artificial Sequence: Synthetic oligonucleotide
  Target: ATXN1; (-) strand; PAM type: YTN; PAM sequence: TTA
agtcttaagataatagcatt

SEQ ID NO: 155550 - DNA, 20 bp, Artificial Sequence
  Description of Artificial Sequence: Synthetic oligonucleotide
  Target: ATXN1; (-) strand; PAM type: YTN; PAM sequence: CTC
cattaagtcttaagataata

SEQ ID NO: 155551 - DNA, 20 bp, Artificial Sequence
  Description of Artificial Sequence: Synthetic oligonucleotide
  Target: ATXN1; (-) strand; PAM type: YTN; PAM sequence: CTC
cagcaactccattaagtctt

SEQ ID NO: 155552 - DNA, 20 bp, Artificial Sequence
  Description of Artificial Sequence: Synthetic oligonucleotide
  Target: ATXN1; (-) strand; PAM type: YTN; PAM sequence: CTG
gaaatacaaactccagcaac

SEQ ID NO: 155553 - DNA, 20 bp, Artificial Sequence
  Description of Artificial Sequence: Synthetic oligonucleotide
  Target: ATXN1; (-) strand; PAM type: YTN; PAM sequence: CTC
ctggaaatacaaactccagc

SEQ ID NO: 155554 - DNA, 20 bp, Artificial Sequence
  Description of Artificial Sequence: Synthetic oligonucleotide
  Target: ATXN1; (-) strand; PAM type: YTN; PAM sequence: TTG
actcctggaaatacaaactc

SEQ ID NO: 155555 - DNA, 20 bp, Artificial Sequence
  Description of Artificial Sequence: Synthetic oligonucleotide
  Target: ATXN1; (-) strand; PAM type: YTN; PAM sequence: CTT
gactcctggaaatacaaact

SEQ ID NO: 155556 - DNA, 20 bp, Artificial Sequence
  Description of Artificial Sequence: Synthetic oligonucleotide
  Target: ATXN1; (-) strand; PAM type: YTN; PAM sequence: TTC
aacttgactcctggaaatac

SEQ ID NO: 155557 - DNA, 20 bp, Artificial Sequence
  Description of Artificial Sequence: Synthetic oligonucleotide
  Target: ATXN1; (-) strand; PAM type: YTN; PAM sequence: CTA
ggaaggtagcaaaacaaatc

SEQ ID NO: 155558 - DNA, 20 bp, Artificial Sequence
  Description of Artificial Sequence: Synthetic oligonucleotide
  Target: ATXN1; (-) strand; PAM type: YTN; PAM sequence: CTG
tctaggaaggtagcaaaaca

SEQ ID NO: 155559 - DNA, 20 bp, Artificial Sequence
  Description of Artificial Sequence: Synthetic oligonucleotide
  Target: ATXN1; (-) strand; PAM type: YTN; PAM sequence: TTG
ccatcagcctgtctaggaag

SEQ ID NO: 155560 - DNA, 20 bp, Artificial Sequence
  Description of Artificial Sequence: Synthetic oligonucleotide
  Target: ATXN1; (-) strand; PAM type: YTN; PAM sequence: CTT
gccatcagcctgtctaggaa

SEQ ID NO: 155561 - DNA, 20 bp, Artificial Sequence
  Description of Artificial Sequence: Synthetic oligonucleotide
  Target: ATXN1; (-) strand; PAM type: YTN; PAM sequence: CTA
atcgccgggagaggcttgcc

SEQ ID NO: 155562 - DNA, 20 bp, Artificial Sequence
  Description of Artificial Sequence: Synthetic oligonucleotide
  Target: ATXN1; (-) strand; PAM type: YTN; PAM sequence: CTG
ctaatcgccgggagaggctt

SEQ ID NO: 155563 - DNA, 20 bp, Artificial Sequence
  Description of Artificial Sequence: Synthetic oligonucleotide
  Target: ATXN1; (-) strand; PAM type: YTN; PAM sequence: TTG
tctgctaatcgccgggagag

SEQ ID NO: 155564 - DNA, 20 bp, Artificial Sequence
  Description of Artificial Sequence: Synthetic oligonucleotide
  Target: ATXN1; (-) strand; PAM type: YTN; PAM sequence: CTT
gtctgctaatcgccgggaga

SEQ ID NO: 155565 - DNA, 20 bp, Artificial Sequence
  Description of Artificial Sequence: Synthetic oligonucleotide
  Target: ATXN1; (-) strand; PAM type: YTN; PAM sequence: CTA
aggtgacttgtctgctaatc

SEQ ID NO: 155566 - DNA, 20 bp, Artificial Sequence
  Description of Artificial Sequence: Synthetic oligonucleotide
  Target: ATXN1; (-) strand; PAM type: YTN; PAM sequence: CTC
ctaaggtgacttgtctgcta

SEQ ID NO: 155567 - DNA, 20 bp, Artificial Sequence
  Description of Artificial Sequence: Synthetic oligonucleotide
  Target: ATXN1; (-) strand; PAM type: YTN; PAM sequence: TTG
cccctcctaaggtgacttgt

SEQ ID NO: 155568 - DNA, 20 bp, Artificial Sequence
  Description of Artificial Sequence: Synthetic oligonucleotide
  Target: ATXN1; (-) strand; PAM type: YTN; PAM sequence: CTT
gcccctcctaaggtgacttg

SEQ ID NO: 155569 - DNA, 20 bp, Artificial Sequence
  Description of Artificial Sequence: Synthetic oligonucleotide
  Target: ATXN1; (-) strand; PAM type: YTN; PAM sequence: CTC
cttgcccctcctaaggtgac

SEQ ID NO: 155570 - DNA, 20 bp, Artificial Sequence
  Description of Artificial Sequence: Synthetic oligonucleotide
  Target: ATXN1; (-) strand; PAM type: YTN; PAM sequence: CTC
tccttgcccctcctaaggtg

SEQ ID NO: 155571 - DNA, 20 bp, Artificial Sequence
  Description of Artificial Sequence: Synthetic oligonucleotide
  Target: ATXN1; (-) strand; PAM type: YTN; PAM sequence: CTC
ctctccttgcccctcctaag

SEQ ID NO: 155572 - DNA, 20 bp, Artificial Sequence
  Description of Artificial Sequence: Synthetic oligonucleotide
  Target: ATXN1; (-) strand; PAM type: YTN; PAM sequence: CTG
tcctcctctccttgcccctc

SEQ ID NO: 155573 - DNA, 20 bp, Artificial Sequence
  Description of Artificial Sequence: Synthetic oligonucleotide
  Target: ATXN1; (-) strand; PAM type: YTN; PAM sequence: TTG
gcccccgcactgtcctcctc

SEQ ID NO: 155574 - DNA, 20 bp, Artificial Sequence
  Description of Artificial Sequence: Synthetic oligonucleotide
  Target: ATXN1; (-) strand; PAM type: YTN; PAM sequence: CTT
ggcccccgcactgtcctcct

SEQ ID NO: 155575 - DNA, 20 bp, Artificial Sequence
  Description of Artificial Sequence: Synthetic oligonucleotide
  Target: ATXN1; (-) strand; PAM type: YTN; PAM sequence: CTG
tccacccttggcccccgcac

SEQ ID NO: 155576 - DNA, 20 bp, Artificial Sequence
  Description of Artificial Sequence: Synthetic oligonucleotide
  Target: ATXN1; (-) strand; PAM type: YTN; PAM sequence: CTC
cggcctgtccacccttggcc

SEQ ID NO: 155577 - DNA, 20 bp, Artificial Sequence
  Description of Artificial Sequence: Synthetic oligonucleotide
  Target: ATXN1; (-) strand; PAM type: YTN; PAM sequence: TTG
actccggcctgtccaccctt

SEQ ID NO: 155578 - DNA, 20 bp, Artificial Sequence
  Description of Artificial Sequence: Synthetic oligonucleotide
  Target: ATXN1; (-) strand; PAM type: YTN; PAM sequence: TTT
gactccggcctgtccaccct

SEQ ID NO: 155579 - DNA, 20 bp, Artificial Sequence
  Description of Artificial Sequence: Synthetic oligonucleotide
  Target: ATXN1; (-) strand; PAM type: YTN; PAM sequence: CTT
tgactccggcctgtccaccc

SEQ ID NO: 155580 - DNA, 20 bp, Artificial Sequence
  Description of Artificial Sequence: Synthetic oligonucleotide
  Target: ATXN1; (-) strand; PAM type: YTN; PAM sequence: TTA
ctttgactccggcctgtcca

SEQ ID NO: 155581 - DNA, 20 bp, Artificial Sequence
  Description of Artificial Sequence: Synthetic oligonucleotide
  Target: ATXN1; (-) strand; PAM type: YTN; PAM sequence: CTA
gaggtgagggatgccagtta

SEQ ID NO: 155582 - DNA, 20 bp, Artificial Sequence
  Description of Artificial Sequence: Synthetic oligonucleotide
  Target: ATXN1; (-) strand; PAM type: YTN; PAM sequence: TTG
cagcaaccaaaagctagagg

SEQ ID NO: 155583 - DNA, 20 bp, Artificial Sequence
  Description of Artificial Sequence: Synthetic oligonucleotide
  Target: ATXN1; (-) strand; PAM type: YTN; PAM sequence: TTT
gcagcaaccaaaagctagag

SEQ ID NO: 155584 - DNA, 20 bp, Artificial Sequence
  Description of Artificial Sequence: Synthetic oligonucleotide
  Target: ATXN1; (-) strand; PAM type: YTN; PAM sequence: TTT
tgcagcaaccaaaagctaga

SEQ ID NO: 155585 - DNA, 20 bp, Artificial Sequence
  Description of Artificial Sequence: Synthetic oligonucleotide
  Target: ATXN1; (-) strand; PAM type: YTN; PAM sequence: CTT
ttgcagcaaccaaaagctag

SEQ ID NO: 155586 - DNA, 20 bp, Artificial Sequence
  Description of Artificial Sequence: Synthetic oligonucleotide
  Target: ATXN1; (-) strand; PAM type: YTN; PAM sequence: TTC
ttttgcagcaaccaaaagct

SEQ ID NO: 155587 - DNA, 20 bp, Artificial Sequence
  Description of Artificial Sequence: Synthetic oligonucleotide
  Target: ATXN1; (-) strand; PAM type: YTN; PAM sequence: TTG
ttcttttgcagcaaccaaaa

SEQ ID NO: 155588 - DNA, 20 bp, Artificial Sequence
  Description of Artificial Sequence: Synthetic oligonucleotide
  Target: ATXN1; (-) strand; PAM type: YTN; PAM sequence: TTT
gttcttttgcagcaaccaaa

SEQ ID NO: 155589 - DNA, 20 bp, Artificial Sequence
  Description of Artificial Sequence: Synthetic oligonucleotide
  Target: ATXN1; (-) strand; PAM type: YTN; PAM sequence: TTT
tgttcttttgcagcaaccaa

SEQ ID NO: 155590 - DNA, 20 bp, Artificial Sequence
  Description of Artificial Sequence: Synthetic oligonucleotide
  Target: ATXN1; (-) strand; PAM type: YTN; PAM sequence: CTT
ttgttcttttgcagcaacca

SEQ ID NO: 155591 - DNA, 20 bp, Artificial Sequence
  Description of Artificial Sequence: Synthetic oligonucleotide
  Target: ATXN1; (-) strand; PAM type: YTN; PAM sequence: TTG
cttttgttcttttgcagcaa

SEQ ID NO: 155592 - DNA, 20 bp, Artificial Sequence
  Description of Artificial Sequence: Synthetic oligonucleotide
  Target: ATXN1; (-) strand; PAM type: YTN; PAM sequence: TTA
attgcttttgttcttttgca

SEQ ID NO: 155593 - DNA, 20 bp, Artificial Sequence
  Description of Artificial Sequence: Synthetic oligonucleotide
  Target: ATXN1; (-) strand; PAM type: YTN; PAM sequence: CTG
tccagttaattgcttttgtt

SEQ ID NO: 155594 - DNA, 20 bp, Artificial Sequence
  Description of Artificial Sequence: Synthetic oligonucleotide
  Target: ATXN1; (-) strand; PAM type: YTN; PAM sequence: TTC
atctgtccagttaattgctt

SEQ ID NO: 155595 - DNA, 20 bp, Artificial Sequence
  Description of Artificial Sequence: Synthetic oligonucleotide
  Target: ATXN1; (-) strand; PAM type: YTN; PAM sequence: TTC
atgttcatctgtccagttaa

SEQ ID NO: 155596 - DNA, 20 bp, Artificial Sequence
  Description of Artificial Sequence: Synthetic oligonucleotide
  Target: ATXN1; (-) strand; PAM type: YTN; PAM sequence: CTG
ggaaaacaattcatgttcat

SEQ ID NO: 155597 - DNA, 20 bp, Artificial Sequence
  Description of Artificial Sequence: Synthetic oligonucleotide
  Target: ATXN1; (-) strand; PAM type: YTN; PAM sequence: TTG
tgagtatcagctgggaaaac

SEQ ID NO: 155598 - DNA, 20 bp, Artificial Sequence
  Description of Artificial Sequence: Synthetic oligonucleotide
  Target: ATXN1; (-) strand; PAM type: YTN; PAM sequence: TTT
gtgagtatcagctgggaaaa

SEQ ID NO: 155599 - DNA, 20 bp, Artificial Sequence
  Description of Artificial Sequence: Synthetic oligonucleotide
  Target: ATXN1; (-) strand; PAM type: YTN; PAM sequence: CTT
tgtgagtatcagctgggaaa

SEQ ID NO: 155600 - DNA, 20 bp, Artificial Sequence
  Description of Artificial Sequence: Synthetic oligonucleotide
  Target: ATXN1; (-) strand; PAM type: YTN; PAM sequence: CTC
aactttgtgagtatcagctg

SEQ ID NO: 155601 - DNA, 20 bp, Artificial Sequence
  Description of Artificial Sequence: Synthetic oligonucleotide
  Target: ATXN1; (-) strand; PAM type: YTN; PAM sequence: TTG
gctcaactttgtgagtatca

SEQ ID NO: 155602 - DNA, 20 bp, Artificial Sequence
  Description of Artificial Sequence: Synthetic oligonucleotide
  Target: ATXN1; (-) strand; PAM type: YTN; PAM sequence: CTC
ggggaaaacacattggctca

SEQ ID NO: 155603 - DNA, 20 bp, Artificial Sequence
  Description of Artificial Sequence: Synthetic oligonucleotide
  Target: ATXN1; (-) strand; PAM type: YTN; PAM sequence: CTG
aaaagcacatgtaatgaaac

SEQ ID NO: 155604 - DNA, 20 bp, Artificial Sequence
  Description of Artificial Sequence: Synthetic oligonucleotide
  Target: ATXN1; (-) strand; PAM type: YTN; PAM sequence: TTG
tccctgaaaagcacatgtaa

SEQ ID NO: 155605 - DNA, 20 bp, Artificial Sequence
  Description of Artificial Sequence: Synthetic oligonucleotide
  Target: ATXN1; (-) strand; PAM type: YTN; PAM sequence: CTT
gtccctgaaaagcacatgta

SEQ ID NO: 155606 - DNA, 20 bp, Artificial Sequence
  Description of Artificial Sequence: Synthetic oligonucleotide
  Target: ATXN1; (-) strand; PAM type: YTN; PAM sequence: CTG
gtagcgacagatgacttgtc

SEQ ID NO: 155607 - DNA, 20 bp, Artificial Sequence
  Description of Artificial Sequence: Synthetic oligonucleotide
  Target: ATXN1; (-) strand; PAM type: YTN; PAM sequence: CTA
gaggcaacagcaaactggta

SEQ ID NO: 155608 - DNA, 20 bp, Artificial Sequence
  Description of Artificial Sequence: Synthetic oligonucleotide
  Target: ATXN1; (-) strand; PAM type: YTN; PAM sequence: TTC
ctagaggcaacagcaaactg

SEQ ID NO: 155609 - DNA, 20 bp, Artificial Sequence
  Description of Artificial Sequence: Synthetic oligonucleotide
  Target: ATXN1; (-) strand; PAM type: YTN; PAM sequence: CTT
cctagaggcaacagcaaact

SEQ ID NO: 155610 - DNA, 20 bp, Artificial Sequence
  Description of Artificial Sequence: Synthetic oligonucleotide
  Target: ATXN1; (-) strand; PAM type: YTN; PAM sequence: CTG
agaagggggaaaaaaaagat

SEQ ID NO: 155611 - DNA, 20 bp, Artificial Sequence
  Description of Artificial Sequence: Synthetic oligonucleotide
  Target: ATXN1; (-) strand; PAM type: YTN; PAM sequence: TTG
ggactgagaagggggaaaaa

SEQ ID NO: 155612 - DNA, 20 bp, Artificial Sequence
  Description of Artificial Sequence: Synthetic oligonucleotide
  Target: ATXN1; (-) strand; PAM type: YTN; PAM sequence: TTA
agacaagttgggactgagaa

SEQ ID NO: 155613 - DNA, 20 bp, Artificial Sequence
  Description of Artificial Sequence: Synthetic oligonucleotide
  Target: ATXN1; (-) strand; PAM type: YTN; PAM sequence: TTC
aaattaagacaagttgggac

SEQ ID NO: 155614 - DNA, 20 bp, Artificial Sequence
  Description of Artificial Sequence: Synthetic oligonucleotide
  Target: ATXN1; (-) strand; PAM type: YTN; PAM sequence: TTT
caaattaagacaagttggga

SEQ ID NO: 155615 - DNA, 20 bp, Artificial Sequence
  Description of Artificial Sequence: Synthetic oligonucleotide
  Target: ATXN1; (-) strand; PAM type: YTN; PAM sequence: CTG
tggaatttcaaattaagaca

SEQ ID NO: 155616 - DNA, 20 bp, Artificial Sequence
  Description of Artificial Sequence: Synthetic oligonucleotide
  Target: ATXN1; (-) strand; PAM type: YTN; PAM sequence: TTC
ccataaaacatcctgtggaa

SEQ ID NO: 155617 - DNA, 20 bp, Artificial Sequence
  Description of Artificial Sequence: Synthetic oligonucleotide
  Target: ATXN1; (-) strand; PAM type: YTN; PAM sequence: CTT
cccataaaacatcctgtgga

SEQ ID NO: 155618 - DNA, 20 bp, Artificial Sequence
  Description of Artificial Sequence: Synthetic oligonucleotide
  Target: ATXN1; (-) strand; PAM type: YTN; PAM sequence: TTG
ggagacaaccttcccataaa

SEQ ID NO: 155619 - DNA, 20 bp, Artificial Sequence
  Description of Artificial Sequence: Synthetic oligonucleotide
  Target: ATXN1; (-) strand; PAM type: YTN; PAM sequence: CTT
gggagacaaccttcccataa

SEQ ID NO: 155620 - DNA, 20 bp, Artificial Sequence
  Description of Artificial Sequence: Synthetic oligonucleotide
  Target: ATXN1; (-) strand; PAM type: YTN; PAM sequence: TTC
ttgggagacaaccttcccat

SEQ ID NO: 155621 - DNA, 20 bp, Artificial Sequence
  Description of Artificial Sequence: Synthetic oligonucleotide
  Target: ATXN1; (-) strand; PAM type: YTN; PAM sequence: TTT
cttgggagacaaccttccca

SEQ ID NO: 155622 - DNA, 20 bp, Artificial Sequence
  Description of Artificial Sequence: Synthetic oligonucleotide
  Target: ATXN1; (-) strand; PAM type: YTN; PAM sequence: CTA
atttcttgggagacaacctt

SEQ ID NO: 155623 - DNA, 20 bp, Artificial Sequence
  Description of Artificial Sequence: Synthetic oligonucleotide
  Target: ATXN1; (-) strand; PAM type: YTN; PAM sequence: CTG
ctaatttcttgggagacaac

SEQ ID NO: 155624 - DNA, 20 bp, Artificial Sequence
  Description of Artificial Sequence: Synthetic oligonucleotide
  Target: ATXN1; (-) strand; PAM type: YTN; PAM sequence: CTC
cacctgctaatttcttggga

SEQ ID NO: 155625 - DNA, 20 bp, Artificial Sequence
  Description of Artificial Sequence: Synthetic oligonucleotide
  Target: ATXN1; (-) strand; PAM type: YTN; PAM sequence: TTC
agtgtgactccacctgctaa

SEQ ID NO: 155626 - DNA, 20 bp, Artificial Sequence
  Description of Artificial Sequence: Synthetic oligonucleotide
  Target: ATXN1; (-) strand; PAM type: YTN; PAM sequence: TTT
cagtgtgactccacctgcta

SEQ ID NO: 155627 - DNA, 20 bp, Artificial Sequence
  Description of Artificial Sequence: Synthetic oligonucleotide
  Target: ATXN1; (-) strand; PAM type: YTN; PAM sequence: TTT
tcagtgtgactccacctgct

SEQ ID NO: 155628 - DNA, 20 bp, Artificial Sequence
  Description of Artificial Sequence: Synthetic oligonucleotide
  Target: ATXN1; (-) strand; PAM type: YTN; PAM sequence: TTT
ttcagtgtgactccacctgc

SEQ ID NO: 155629 - DNA, 20 bp, Artificial Sequence
  Description of Artificial Sequence: Synthetic oligonucleotide
  Target: ATXN1; (-) strand; PAM type: YTN; PAM sequence: CTT
tttcagtgtgactccacctg

SEQ ID NO: 155630 - DNA, 20 bp, Artificial Sequence
  Description of Artificial Sequence: Synthetic oligonucleotide
  Target: ATXN1; (-) strand; PAM type: YTN; PAM sequence: CTC
tttttcagtgtgactccacc

SEQ ID NO: 155631 - DNA, 20 bp, Artificial Sequence
  Description of Artificial Sequence: Synthetic oligonucleotide
  Target: ATXN1; (-) strand; PAM type: YTN; PAM sequence: TTG
gctctttttcagtgtgactc

SEQ ID NO: 155632 - DNA, 20 bp, Artificial Sequence
  Description of Artificial Sequence: Synthetic oligonucleotide
  Target: ATXN1; (-) strand; PAM type: YTN; PAM sequence: TTT
ggctctttttcagtgtgact

SEQ ID NO: 155633 - DNA, 20 bp, Artificial Sequence
  Description of Artificial Sequence: Synthetic oligonucleotide
  Target: ATXN1; (-) strand; PAM type: YTN; PAM sequence: CTT
tggctctttttcagtgtgac

SEQ ID NO: 155634 - DNA, 20 bp, Artificial Sequence
  Description of Artificial Sequence: Synthetic oligonucleotide
  Target: ATXN1; (-) strand; PAM type: YTN; PAM sequence: CTG
atcaaagctttggctctttt

SEQ ID NO: 155635 - DNA, 20 bp, Artificial Sequence
  Description of Artificial Sequence: Synthetic oligonucleotide
  Target: ATXN1; (-) strand; PAM type: YTN; PAM sequence: TTA
ggatgccactgatcaaagct

SEQ ID NO: 155636 - DNA, 20 bp, Artificial Sequence
  Description of Artificial Sequence: Synthetic oligonucleotide
  Target: ATXN1; (-) strand; PAM type: YTN; PAM sequence: TTT
aggatgccactgatcaaagc

SEQ ID NO: 155637 - DNA, 20 bp, Artificial Sequence
  Description of Artificial Sequence: Synthetic oligonucleotide
  Target: ATXN1; (-) strand; PAM type: YTN; PAM sequence: TTT
taggatgccactgatcaaag

SEQ ID NO: 155638 - DNA, 20 bp, Artificial Sequence
  Description of Artificial Sequence: Synthetic oligonucleotide
  Target: ATXN1; (-) strand; PAM type: YTN; PAM sequence: CTT
ttaggatgccactgatcaaa

SEQ ID NO: 155639 - DNA, 20 bp, Artificial Sequence
  Description of Artificial Sequence: Synthetic oligonucleotide
  Target: ATXN1; (-) strand; PAM type: YTN; PAM sequence: CTC
aaaccaatgccttttaggat

SEQ ID NO: 155640 - DNA, 20 bp, Artificial Sequence
  Description of Artificial Sequence: Synthetic oligonucleotide
  Target: ATXN1; (-) strand; PAM type: YTN; PAM sequence: CTC
atgtctcaaaccaatgcctt

SEQ ID NO: 155641 - DNA, 20 bp, Artificial Sequence
  Description of Artificial Sequence: Synthetic oligonucleotide
  Target: ATXN1; (-) strand; PAM type: YTN; PAM sequence: CTA
actcatgtctcaaaccaatg

SEQ ID NO: 155642 - DNA, 20 bp, Artificial Sequence
  Description of Artificial Sequence: Synthetic oligonucleotide
  Target: ATXN1; (-) strand; PAM type: YTN; PAM sequence: CTC
taactcatgtctcaaaccaa

SEQ ID NO: 155643 - DNA, 20 bp, Artificial Sequence
  Description of Artificial Sequence: Synthetic oligonucleotide
  Target: ATXN1; (-) strand; PAM type: YTN; PAM sequence: CTG
agggaatggctctaactcat

SEQ ID NO: 155644 - DNA, 20 bp, Artificial Sequence
  Description of Artificial Sequence: Synthetic oligonucleotide
  Target: ATXN1; (-) strand; PAM type: YTN; PAM sequence: CTG
gcacactgagggaatggctc

SEQ ID NO: 155645 - DNA, 20 bp, Artificial Sequence
  Description of Artificial Sequence: Synthetic oligonucleotide
  Target: ATXN1; (-) strand; PAM type: YTN; PAM sequence: TTC
actggcacactgagggaatg

SEQ ID NO: 155646 - DNA, 20 bp, Artificial Sequence
  Description of Artificial Sequence: Synthetic oligonucleotide
  Target: ATXN1; (-) strand; PAM type: YTN; PAM sequence: TTC
cgagaaaggattcactggca

SEQ ID NO: 155647 - DNA, 20 bp, Artificial Sequence
  Description of Artificial Sequence: Synthetic oligonucleotide
  Target: ATXN1; (-) strand; PAM type: YTN; PAM sequence: CTT
ccgagaaaggattcactggc

SEQ ID NO: 155648 - DNA, 20 bp, Artificial Sequence
  Description of Artificial Sequence: Synthetic oligonucleotide
  Target: ATXN1; (-) strand; PAM type: YTN; PAM sequence: TTA
tacagtagtgccatgtggtc

SEQ ID NO: 155649 - DNA, 20 bp, Artificial Sequence
  Description of Artificial Sequence: Synthetic oligonucleotide
  Target: ATXN1; (-) strand; PAM type: YTN; PAM sequence: CTT
atacagtagtgccatgtggt

SEQ ID NO: 155650 - DNA, 20 bp, Artificial Sequence
  Description of Artificial Sequence: Synthetic oligonucleotide
  Target: ATXN1; (-) strand; PAM type: YTN; PAM sequence: CTG
acccttatacagtagtgcca

SEQ ID NO: 155651 - DNA, 20 bp, Artificial Sequence
  Description of Artificial Sequence: Synthetic oligonucleotide
  Target: ATXN1; (-) strand; PAM type: YTN; PAM sequence: TTA
actgacccttatacagtagt

SEQ ID NO: 155652 - DNA, 20 bp, Artificial Sequence
  Description of Artificial Sequence: Synthetic oligonucleotide
  Target: ATXN1; (-) strand; PAM type: YTN; PAM sequence: TTC
ccaacccgttaactgaccct

SEQ ID NO: 155653 - DNA, 20 bp, Artificial Sequence
  Description of Artificial Sequence: Synthetic oligonucleotide
  Target: ATXN1; (-) strand; PAM type: YTN; PAM sequence: TTG
ttcccaacccgttaactgac

SEQ ID NO: 155654 - DNA, 20 bp, Artificial Sequence
  Description of Artificial Sequence: Synthetic oligonucleotide
  Target: ATXN1; (-) strand; PAM type: YTN; PAM sequence: CTC
caagacaatgtcattgttcc

SEQ ID NO: 155655 - DNA, 20 bp, Artificial Sequence
  Description of Artificial Sequence: Synthetic oligonucleotide
  Target: ATXN1; (-) strand; PAM type: YTN; PAM sequence: TTC
tccaagacaatgtcattgtt

SEQ ID NO: 155656 - DNA, 20 bp, Artificial Sequence
  Description of Artificial Sequence: Synthetic oligonucleotide
  Target: ATXN1; (-) strand; PAM type: YTN; PAM sequence: CTG
cagaggccaattctccaaga

SEQ ID NO: 155657 - DNA, 20 bp, Artificial Sequence
  Description of Artificial Sequence: Synthetic oligonucleotide
  Target: ATXN1; (-) strand; PAM type: YTN; PAM sequence: CTG
caggtcagctgcagaggcca

SEQ ID NO: 155658 - DNA, 20 bp, Artificial Sequence
  Description of Artificial Sequence: Synthetic oligonucleotide
  Target: ATXN1; (-) strand; PAM type: YTN; PAM sequence: CTG
ctgcaggtcagctgcagagg

SEQ ID NO: 155659 - DNA, 20 bp, Artificial Sequence
  Description of Artificial Sequence: Synthetic oligonucleotide
  Target: ATXN1; (-) strand; PAM type: YTN; PAM sequence: CTG
gtggactgctgcaggtcagc

SEQ ID NO: 155660 - DNA, 20 bp, Artificial Sequence
  Description of Artificial Sequence: Synthetic oligonucleotide
  Target: ATXN1; (-) strand; PAM type: YTN; PAM sequence: TTA
aacaagcatcctggtggact

SEQ ID NO: 155661 - DNA, 20 bp, Artificial Sequence
  Description of Artificial Sequence: Synthetic oligonucleotide
  Target: ATXN1; (-) strand; PAM type: YTN; PAM sequence: TTT
aaacaagcatcctggtggac

SEQ ID NO: 155662 - DNA, 20 bp, Artificial Sequence
  Description of Artificial Sequence: Synthetic oligonucleotide
  Target: ATXN1; (-) strand; PAM type: YTN; PAM sequence: CTG
tttaaacaagcatcctggtg

SEQ ID NO: 155663 - DNA, 20 bp, Artificial Sequence
  Description of Artificial Sequence: Synthetic oligonucleotide
  Target: ATXN1; (-) strand; PAM type: YTN; PAM sequence: TTC
actgtttaaacaagcatcct

SEQ ID NO: 155664 - DNA, 20 bp, Artificial Sequence
  Description of Artificial Sequence: Synthetic oligonucleotide
  Target: ATXN1; (-) strand; PAM type: YTN; PAM sequence: CTG
cgttcactgtttaaacaagc

SEQ ID NO: 155665 - DNA, 20 bp, Artificial Sequence
  Description of Artificial Sequence: Synthetic oligonucleotide
  Target: ATXN1; (-) strand; PAM type: YTN; PAM sequence: TTC
tgcgttcactgtttaaacaa

SEQ ID NO: 155666 - DNA, 20 bp, Artificial Sequence
  Description of Artificial Sequence: Synthetic oligonucleotide
  Target: ATXN1; (-) strand; PAM type: YTN; PAM sequence: CTT
ctgcgttcactgtttaaaca

SEQ ID NO: 155667 - DNA, 20 bp, Artificial Sequence
  Description of Artificial Sequence: Synthetic oligonucleotide
  Target: ATXN1; (-) strand; PAM type: YTN; PAM sequence: TTC
ttctgcgttcactgtttaaa

SEQ ID NO: 155668 - DNA, 20 bp, Artificial Sequence
  Description of Artificial Sequence: Synthetic oligonucleotide
  Target: ATXN1; (-) strand; PAM type: YTN; PAM sequence: CTT
cttctgcgttcactgtttaa

SEQ ID NO: 155669 - DNA, 20 bp, Artificial Sequence
  Description of Artificial Sequence: Synthetic oligonucleotide
  Target: ATXN1; (-) strand; PAM type: YTN; PAM sequence: TTA
gcggccggtcatcacttctt

SEQ ID NO: 155670 - DNA, 20 bp, Artificial Sequence
  Description of Artificial Sequence: Synthetic oligonucleotide
  Target: ATXN1; (-) strand; PAM type: YTN; PAM sequence: TTT
agcggccggtcatcacttct

SEQ ID NO: 155671 - DNA, 20 bp, Artificial Sequence
  Description of Artificial Sequence: Synthetic oligonucleotide
  Target: ATXN1; (-) strand; PAM type: YTN; PAM sequence: TTC
aaagtttagcggccggtcat

SEQ ID NO: 155672 - DNA, 20 bp, Artificial Sequence
  Description of Artificial Sequence: Synthetic oligonucleotide
  Target: ATXN1; (-) strand; PAM type: YTN; PAM sequence: CTT
caaagtttagcggccggtca

SEQ ID NO: 155673 - DNA, 20 bp, Artificial Sequence
  Description of Artificial Sequence: Synthetic oligonucleotide
  Target: ATXN1; (-) strand; PAM type: YTN; PAM sequence: CTC
aatacttcaaagtttagcgg

SEQ ID NO: 155674 - DNA, 20 bp, Artificial Sequence
  Description of Artificial Sequence: Synthetic oligonucleotide
  Target: ATXN1; (-) strand; PAM type: YTN; PAM sequence: CTG
gaactcaatacttcaaagtt

SEQ ID NO: 155675 - DNA, 20 bp, Artificial Sequence
  Description of Artificial Sequence: Synthetic oligonucleotide
  Target: ATXN1; (-) strand; PAM type: YTN; PAM sequence: TTC
caggcctggaactcaatact

SEQ ID NO: 155676 - DNA, 20 bp, Artificial Sequence
  Description of Artificial Sequence: Synthetic oligonucleotide
  Target: ATXN1; (-) strand; PAM type: YTN; PAM sequence: TTT
ccaggcctggaactcaatac

SEQ ID NO: 155677 - DNA, 20 bp, Artificial Sequence
  Description of Artificial Sequence: Synthetic oligonucleotide
  Target: ATXN1; (-) strand; PAM type: YTN; PAM sequence: CTT
tccaggcctggaactcaata

SEQ ID NO: 155678 - DNA, 20 bp, Artificial Sequence
  Description of Artificial Sequence: Synthetic oligonucleotide
  Target: ATXN1; (-) strand; PAM type: YTN; PAM sequence: CTG
catacgctttccaggcctgg

SEQ ID NO: 155679 - DNA, 20 bp, Artificial Sequence
  Description of Artificial Sequence: Synthetic oligonucleotide
  Target: ATXN1; (-) strand; PAM type: YTN; PAM sequence: CTG
atctgcatacgctttccagg

SEQ ID NO: 155680 - DNA, 20 bp, Artificial Sequence
  Description of Artificial Sequence: Synthetic oligonucleotide
  Target: ATXN1; (-) strand; PAM type: YTN; PAM sequence: TTA
aaaagcaaagtaaaacaacc

SEQ ID NO: 155681 - DNA, 20 bp, Artificial Sequence
  Description of Artificial Sequence: Synthetic oligonucleotide
  Target: ATXN1; (-) strand; PAM type: YTN; PAM sequence: TTA
ttaaaaagcaaagtaaaaca

SEQ ID NO: 155682 - DNA, 20 bp, Artificial Sequence
  Description of Artificial Sequence: Synthetic oligonucleotide
  Target: ATXN1; (-) strand; PAM type: YTN; PAM sequence: CTT
attaaaaagcaaagtaaaac

SEQ ID NO: 155683 - DNA, 20 bp, Artificial Sequence
  Description of Artificial Sequence: Synthetic oligonucleotide
  Target: ATXN1; (-) strand; PAM type: YTN; PAM sequence: TTC
agccttattaaaaagcaaag

SEQ ID NO: 155684 - DNA, 20 bp, Artificial Sequence
  Description of Artificial Sequence: Synthetic oligonucleotide
  Target: ATXN1; (-) strand; PAM type: YTN; PAM sequence: CTT
cagccttattaaaaagcaaa

SEQ ID NO: 155685 - DNA, 20 bp, Artificial Sequence
  Description of Artificial Sequence: Synthetic oligonucleotide
  Target: ATXN1; (-) strand; PAM type: YTN; PAM sequence: CTC
ttcagccttattaaaaagca

SEQ ID NO: 155686 - DNA, 20 bp, Artificial Sequence
  Description of Artificial Sequence: Synthetic oligonucleotide
  Target: ATXN1; (-) strand; PAM type: YTN; PAM sequence: CTG
ctcttcagccttattaaaaa

SEQ ID NO: 155687 - DNA, 20 bp, Artificial Sequence
  Description of Artificial Sequence: Synthetic oligonucleotide
  Target: ATXN1; (-) strand; PAM type: YTN; PAM sequence: TTG
tgtatctgctcttcagcctt

SEQ ID NO: 155688 - DNA, 20 bp, Artificial Sequence
  Description of Artificial Sequence: Synthetic oligonucleotide
  Target: ATXN1; (-) strand; PAM type: YTN; PAM sequence: CTT
gtgtatctgctcttcagcct

SEQ ID NO: 155689 - DNA, 20 bp, Artificial Sequence
  Description of Artificial Sequence: Synthetic oligonucleotide
  Target: ATXN1; (-) strand; PAM type: YTN; PAM sequence: CTG
acttgtgtatctgctcttca

SEQ ID NO: 155690 - DNA, 20 bp, Artificial Sequence
  Description of Artificial Sequence: Synthetic oligonucleotide
  Target: ATXN1; (-) strand; PAM type: YTN; PAM sequence: TTC
caaagaaaactgacttgtgt

SEQ ID NO: 155691 - DNA, 20 bp, Artificial Sequence
  Description of Artificial Sequence: Synthetic oligonucleotide
  Target: ATXN1; (-) strand; PAM type: YTN; PAM sequence: TTT
ccaaagaaaactgacttgtg

SEQ ID NO: 155692 - DNA, 20 bp, Artificial Sequence
  Description of Artificial Sequence: Synthetic oligonucleotide
  Target: ATXN1; (-) strand; PAM type: YTN; PAM sequence: CTT
tccaaagaaaactgacttgt

SEQ ID NO: 155693 - DNA, 20 bp, Artificial Sequence
  Description of Artificial Sequence: Synthetic oligonucleotide
  Target: ATXN1; (-) strand; PAM type: YTN; PAM sequence: TTG
cctttccaaagaaaactgac

SEQ ID NO: 155694 - DNA, 20 bp, Artificial Sequence
  Description of Artificial Sequence: Synthetic oligonucleotide
  Target: ATXN1; (-) strand; PAM type: YTN; PAM sequence: CTT
gcctttccaaagaaaactga

SEQ ID NO: 155695 - DNA, 20 bp, Artificial Sequence
  Description of Artificial Sequence: Synthetic oligonucleotide
  Target: ATXN1; (-) strand; PAM type: YTN; PAM sequence: TTG
cttgcctttccaaagaaaac

SEQ ID NO: 155696 - DNA, 20 bp, Artificial Sequence
  Description of Artificial Sequence: Synthetic oligonucleotide
  Target: ATXN1; (-) strand; PAM type: YTN; PAM sequence: CTC
cagggtcattgcttgccttt

SEQ ID NO: 155697 - DNA, 20 bp, Artificial Sequence
  Description of Artificial Sequence: Synthetic oligonucleotide
  Target: ATXN1; (-) strand; PAM type: YTN; PAM sequence: CTA
ctccagggtcattgcttgcc

SEQ ID NO: 155698 - DNA, 20 bp, Artificial Sequence
  Description of Artificial Sequence: Synthetic oligonucleotide
  Target: ATXN1; (-) strand; PAM type: YTN; PAM sequence: CTC
tactccagggtcattgcttg

SEQ ID NO: 155699 - DNA, 20 bp, Artificial Sequence
  Description of Artificial Sequence: Synthetic oligonucleotide
  Target: ATXN1; (-) strand; PAM type: YTN; PAM sequence: TTC
tctactccagggtcattgct

SEQ ID NO: 155700 - DNA, 20 bp, Artificial Sequence
  Description of Artificial Sequence: Synthetic oligonucleotide
  Target: ATXN1; (-) strand; PAM type: YTN; PAM sequence: CTT
ctctactccagggtcattgc

SEQ ID NO: 155701 - DNA, 20 bp, Artificial Sequence
  Description of Artificial Sequence: Synthetic oligonucleotide
  Target: ATXN1; (-) strand; PAM type: YTN; PAM sequence: CTG
tggatcttctctactccagg

SEQ ID NO: 155702 - DNA, 20 bp, Artificial Sequence
  Description of Artificial Sequence: Synthetic oligonucleotide
  Target: ATXN1; (-) strand; PAM type: YTN; PAM sequence: CTG
gcacagcagcaccctgtgga

SEQ ID NO: 155703 - DNA, 20 bp, Artificial Sequence
  Description of Artificial Sequence: Synthetic oligonucleotide
  Target: ATXN1; (-) strand; PAM type: YTN; PAM sequence: TTC
accctggcacagcagcaccc

SEQ ID NO: 155704 - DNA, 20 bp, Artificial Sequence
  Description of Artificial Sequence: Synthetic oligonucleotide
  Target: ATXN1; (-) strand; PAM type: YTN; PAM sequence: TTC
attcaccctggcacagcagc

SEQ ID NO: 155705 - DNA, 20 bp, Artificial Sequence
  Description of Artificial Sequence: Synthetic oligonucleotide
  Target: ATXN1; (-) strand; PAM type: YTN; PAM sequence: CTG
tggacaatcaggccattcat

SEQ ID NO: 155706 - DNA, 20 bp, Artificial Sequence
  Description of Artificial Sequence: Synthetic oligonucleotide
  Target: ATXN1; (-) strand; PAM type: YTN; PAM sequence: CTC
atgccatcggtcactgtgga

SEQ ID NO: 155707 - DNA, 20 bp, Artificial Sequence
  Description of Artificial Sequence: Synthetic oligonucleotide
  Target: ATXN1; (-) strand; PAM type: YTN; PAM sequence: TTC
tcatgccatcggtcactgtg

SEQ ID NO: 155708 - DNA, 20 bp, Artificial Sequence
  Description of Artificial Sequence: Synthetic oligonucleotide
  Target: ATXN1; (-) strand; PAM type: YTN; PAM sequence: CTT
ctcatgccatcggtcactgt

SEQ ID NO: 155709 - DNA, 20 bp, Artificial Sequence
  Description of Artificial Sequence: Synthetic oligonucleotide
  Target: ATXN1; (-) strand; PAM type: YTN; PAM sequence: TTG
gacccttctcatgccatcgg

SEQ ID NO: 155710 - DNA, 20 bp, Artificial Sequence
  Description of Artificial Sequence: Synthetic oligonucleotide
  Target: ATXN1; (-) strand; PAM type: YTN; PAM sequence: CTG
gttggacccttctcatgcca

SEQ ID NO: 155711 - DNA, 20 bp, Artificial Sequence
  Description of Artificial Sequence: Synthetic oligonucleotide
  Target: ATXN1; (-) strand; PAM type: YTN; PAM sequence: CTC
tggttggacccttctcatgc

SEQ ID NO: 155712 - DNA, 20 bp, Artificial Sequence
  Description of Artificial Sequence: Synthetic oligonucleotide
  Target: ATXN1; (-) strand; PAM type: YTN; PAM sequence: TTA
tcccagagtgtgacagctct

SEQ ID NO: 155713 - DNA, 20 bp, Artificial Sequence
  Description of Artificial Sequence: Synthetic oligonucleotide
  Target: ATXN1; (-) strand; PAM type: YTN; PAM sequence: CTG
tattatcccagagtgtgaca

SEQ ID NO: 155714 - DNA, 20 bp, Artificial Sequence
  Description of Artificial Sequence: Synthetic oligonucleotide
  Target: ATXN1; (-) strand; PAM type: YTN; PAM sequence: TTA
aaggaccaacagtgggcctg

SEQ ID NO: 155715 - DNA, 20 bp, Artificial Sequence
  Description of Artificial Sequence: Synthetic oligonucleotide
  Target: ATXN1; (-) strand; PAM type: YTN; PAM sequence: CTT
aaaggaccaacagtgggcct

SEQ ID NO: 155716 - DNA, 20 bp, Artificial Sequence
  Description of Artificial Sequence: Synthetic oligonucleotide
  Target: ATXN1; (-) strand; PAM type: YTN; PAM sequence: CTA
aacataatcttaaaggacca

SEQ ID NO: 155717 - DNA, 20 bp, Artificial Sequence
  Description of Artificial Sequence: Synthetic oligonucleotide
  Target: ATXN1; (-) strand; PAM type: YTN; PAM sequence: CTC
taaacataatcttaaaggac

SEQ ID NO: 155718 - DNA, 20 bp, Artificial Sequence
  Description of Artificial Sequence: Synthetic oligonucleotide
  Target: ATXN1; (-) strand; PAM type: YTN; PAM sequence: CTG
gatctctaaacataatctta

SEQ ID NO: 155719 - DNA, 20 bp, Artificial Sequence
  Description of Artificial Sequence: Synthetic oligonucleotide
  Target: ATXN1; (-) strand; PAM type: YTN; PAM sequence: CTG
gctggatctctaaacataat

SEQ ID NO: 155720 - DNA, 20 bp, Artificial Sequence
  Description of Artificial Sequence: Synthetic oligonucleotide
  Target: ATXN1; (-) strand; PAM type: YTN; PAM sequence: CTG
ctggctggatctctaaacat

SEQ ID NO: 155721 - DNA, 20 bp, Artificial Sequence
  Description of Artificial Sequence: Synthetic oligonucleotide
  Target: ATXN1; (-) strand; PAM type: YTN; PAM sequence: TTA
caatggagacaatgctgctg

SEQ ID NO: 155722 - DNA, 20 bp, Artificial Sequence
  Description of Artificial Sequence: Synthetic oligonucleotide
  Target: ATXN1; (-) strand; PAM type: YTN; PAM sequence: TTA
gtaggggaaagtattacaat

SEQ ID NO: 155723 - DNA, 20 bp, Artificial Sequence
  Description of Artificial Sequence: Synthetic oligonucleotide
  Target: ATXN1; (-) strand; PAM type: YTN; PAM sequence: TTT
agtaggggaaagtattacaa

SEQ ID NO: 155724 - DNA, 20 bp, Artificial Sequence
  Description of Artificial Sequence: Synthetic oligonucleotide
  Target: ATXN1; (-) strand; PAM type: YTN; PAM sequence: TTA
atggatttagtaggggaaag

SEQ ID NO: 155725 - DNA, 20 bp, Artificial Sequence
  Description of Artificial Sequence: Synthetic oligonucleotide
  Target: ATXN1; (-) strand; PAM type: YTN; PAM sequence: CTT
aatggatttagtaggggaaa

SEQ ID NO: 155726 - DNA, 20 bp, Artificial Sequence
  Description of Artificial Sequence: Synthetic oligonucleotide
  Target: ATXN1; (-) strand; PAM type: YTN; PAM sequence: CTC
ttaatggatttagtagggga

SEQ ID NO: 155727 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaaaaaaaaaaaaaa

SEQ ID NO: 155728 - DNA, 20 bp, Artificial Sequence
  Description of Artificial Sequence: Synthetic oligonucleotide
  Target: ATXN1; (-) strand; PAM type: YTN; PAM sequence: CTC
aaattaaaaaaaaaaaaaaa

SEQ ID NO: 155729 - DNA, 20 bp, Artificial Sequence
  Description of Artificial Sequence: Synthetic oligonucleotide
  Target: ATXN1; (-) strand; PAM type: YTN; PAM sequence: CTG
tctcaaattaaaaaaaaaaa

SEQ ID NO: 155730 - DNA, 20 bp, Artificial Sequence
  Description of Artificial Sequence: Synthetic oligonucleotide
  Target: ATXN1; (-) strand; PAM type: YTN; PAM sequence: CTG
ggcaacagagaccctgtctc

SEQ ID NO: 155731 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcaacagagacc

SEQ ID NO: 155732 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggcaacag

SEQ ID NO: 155733 - DNA, 20 bp, Artificial Sequence
  Description of Artificial Sequence: Synthetic oligonucleotide
  Target: ATXN1; (-) strand; PAM type: YTN; PAM sequence: CTG
ccactgcactccagcctggg

SEQ ID NO: 155734 - DNA, 20 bp, Artificial Sequence
  Description of Artificial Sequence: Synthetic oligonucleotide
  Target: ATXN1; (-) strand; PAM type: YTN; PAM sequence: CTG
tgatcctgccactgcactcc

SEQ ID NO: 155735 - DNA, 20 bp, Artificial Sequence
  Description of Artificial Sequence: Synthetic oligonucleotide
  Target: ATXN1; (-) strand; PAM type: YTN; PAM sequence: CTG
tggtgagctgtgatcctgcc

SEQ ID NO: 155736 - DNA, 20 bp, Artificial Sequence
  Description of Artificial Sequence: Synthetic oligonucleotide
  Target: ATXN1; (-) strand; PAM type: YTN; PAM sequence: CTG
agcccgggaggtcaaggctg

SEQ ID NO: 155737 - DNA, 20 bp, Artificial Sequence
  Description of Artificial Sequence: Synthetic oligonucleotide
  Target: ATXN1; (-) strand; PAM type: YTN; PAM sequence: CTG
aggtcagaggatcacctgag

SEQ ID NO: 155738 - DNA, 20 bp, Artificial Sequence
  Description of Artificial Sequence: Synthetic oligonucleotide
  Target: ATXN1; (-) strand; PAM type: YTN; PAM sequence: TTG
ggagactgaggtcagaggat

SEQ ID NO: 155739 - DNA, 20 bp, Artificial Sequence
  Description of Artificial Sequence: Synthetic oligonucleotide
  Target: ATXN1; (-) strand; PAM type: YTN; PAM sequence: CTT
gggagactgaggtcagagga

SEQ ID NO: 155740 - DNA, 20 bp, Artificial Sequence
  Description of Artificial Sequence: Synthetic oligonucleotide
  Target: ATXN1; (-) strand; PAM type: YTN; PAM sequence: CTA
cttgggagactgaggtcaga

SEQ ID NO: 155741 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctacttgggag

SEQ ID NO: 155742 - DNA, 20 bp, Artificial Sequence
  Description of Artificial Sequence: Synthetic oligonucleotide
  Target: ATXN1; (-) strand; PAM type: YTN; PAM sequence: CTG
ggcgtggtagcaggtgtctg

SEQ ID NO: 155743 - DNA, 20 bp, Artificial Sequence
  Description of Artificial Sequence: Synthetic oligonucleotide
  Target: ATXN1; (-) strand; PAM type: YTN; PAM sequence: TTA
gctgggcgtggtagcaggtg

SEQ ID NO: 155744 - DNA, 20 bp, Artificial Sequence
  Description of Artificial Sequence: Synthetic oligonucleotide
  Target: ATXN1; (-) strand; PAM type: YTN; PAM sequence: CTA
taaaaaatacaaaaattagc

SEQ ID NO: 155745 - DNA, 20 bp, Artificial Sequence
  Description of Artificial Sequence: Synthetic oligonucleotide
  Target: ATXN1; (-) strand; PAM type: YTN; PAM sequence: CTC
tataaaaaatacaaaaatta

SEQ ID NO: 155746 - DNA, 20 bp, Artificial Sequence
  Description of Artificial Sequence: Synthetic oligonucleotide
  Target: ATXN1; (-) strand; PAM type: YTN; PAM sequence: CTG
tctctataaaaaatacaaaa

SEQ ID NO: 155747 - DNA, 20 bp, Artificial Sequence
  Description of Artificial Sequence: Synthetic oligonucleotide
  Target: ATXN1; (-) strand; PAM type: YTN; PAM sequence: CTG
ggcaacatggtgagaccctg

SEQ ID NO: 155748 - DNA, 20 bp, Artificial Sequence
  Description of Artificial Sequence: Synthetic oligonucleotide
  Target: ATXN1; (-) strand; PAM type: YTN; PAM sequence: TTG
agaccagtctgggcaacatg

SEQ ID NO: 155749 - DNA, 20 bp, Artificial Sequence
  Description of Artificial Sequence: Synthetic oligonucleotide
  Target: ATXN1; (-) strand; PAM type: YTN; PAM sequence: TTT
gagaccagtctgggcaacat

SEQ ID NO: 155750 - DNA, 20 bp, Artificial Sequence
  Description of Artificial Sequence: Synthetic oligonucleotide
  Target: ATXN1; (-) strand; PAM type: YTN; PAM sequence: CTG
gagtttgagaccagtctggg

SEQ ID NO: 155751 - DNA, 20 bp, Artificial Sequence
  Description of Artificial Sequence: Synthetic oligonucleotide
  Target: ATXN1; (-) strand; PAM type: YTN; PAM sequence: TTG
agccctggagtttgagacca

SEQ ID NO: 155752 - DNA, 20 bp, Artificial Sequence
  Description of Artificial Sequence: Synthetic oligonucleotide
  Target: ATXN1; (-) strand; PAM type: YTN; PAM sequence: CTT
gagccctggagtttgagacc

SEQ ID NO: 155753 - DNA, 20 bp, Artificial Sequence
  Description of Artificial Sequence: Synthetic oligonucleotide
  Target: ATXN1; (-) strand; PAM type: YTN; PAM sequence: TTG
acgcaggtggatggcttgag

SEQ ID NO: 155754 - DNA, 20 bp, Artificial Sequence
  Description of Artificial Sequence: Synthetic oligonucleotide
  Target: ATXN1; (-) strand; PAM type: YTN; PAM sequence: TTG
gggaggttgacgcaggtgga

SEQ ID NO: 155755 - DNA, 20 bp, Artificial Sequence
  Description of Artificial Sequence: Synthetic oligonucleotide
  Target: ATXN1; (-) strand; PAM type: YTN; PAM sequence: TTT
ggggaggttgacgcaggtgg

SEQ ID NO: 155756 - DNA, 20 bp, Artificial Sequence
  Description of Artificial Sequence: Synthetic oligonucleotide
  Target: ATXN1; (-) strand; PAM type: YTN; PAM sequence: CTT
tggggaggttgacgcaggtg

SEQ ID NO: 155757 - DNA, 20 bp, Artificial Sequence
  Description of Artificial Sequence: Synthetic oligonucleotide
  Target: ATXN1; (-) strand; PAM type: YTN; PAM sequence: CTA
gcactttggggaggttgacg

SEQ ID NO: 155758 - DNA, 20 bp, Artificial Sequence
  Description of Artificial Sequence: Synthetic oligonucleotide
  Target: ATXN1; (-) strand; PAM type: YTN; PAM sequence: CTG
taatcctagcactttgggga

SEQ ID NO: 155759 - DNA, 20 bp, Artificial Sequence
  Description of Artificial Sequence: Synthetic oligonucleotide
  Target: ATXN1; (-) strand; PAM type: YTN; PAM sequence: CTC
acacctgtaatcctagcact

SEQ ID NO: 155760 - DNA, 20 bp, Artificial Sequence
  Description of Artificial Sequence: Synthetic oligonucleotide
  Target: ATXN1; (-) strand; PAM type: YTN; PAM sequence: TTA
atgggccgggcacagtggct

SEQ ID NO: 155761 - DNA, 20 bp, Artificial Sequence
  Description of Artificial Sequence: Synthetic oligonucleotide
  Target: ATXN1; (-) strand; PAM type: YTN; PAM sequence: CTT
aatgggccgggcacagtggc

SEQ ID NO: 155762 - DNA, 20 bp, Artificial Sequence
  Description of Artificial Sequence: Synthetic oligonucleotide
  Target: ATXN1; (-) strand; PAM type: YTN; PAM sequence: TTC
ttaatgggccgggcacagtg

SEQ ID NO: 155763 - DNA, 20 bp, Artificial Sequence
  Description of Artificial Sequence: Synthetic oligonucleotide
  Target: ATXN1; (-) strand; PAM type: YTN; PAM sequence: TTA
ttcttaatgggccgggcaca

SEQ ID NO: 155764 - DNA, 20 bp, Artificial Sequence
  Description of Artificial Sequence: Synthetic oligonucleotide
  Target: ATXN1; (-) strand; PAM type: YTN; PAM sequence: CTA
caggtgcaagagttattctt

SEQ ID NO: 155765 - DNA, 20 bp, Artificial Sequence
  Description of Artificial Sequence: Synthetic oligonucleotide
  Target: ATXN1; (-) strand; PAM type: YTN; PAM sequence: TTC
tacaggtgcaagagttattc

SEQ ID NO: 155766 - DNA, 20 bp, Artificial Sequence
  Description of Artificial Sequence: Synthetic oligonucleotide
  Target: ATXN1; (-) strand; PAM type: YTN; PAM sequence: TTT
ctacaggtgcaagagttatt

SEQ ID NO: 155767 - DNA, 20 bp, Artificial Sequence
  Description of Artificial Sequence: Synthetic oligonucleotide
  Target: ATXN1; (-) strand; PAM type: YTN; PAM sequence: TTG
tgtttctacaggtgcaagag

SEQ ID NO: 155768 - DNA, 20 bp, Artificial Sequence
  Description of Artificial Sequence: Synthetic oligonucleotide
  Target: ATXN1; (-) strand; PAM type: YTN; PAM sequence: CTT
gtgtttctacaggtgcaaga

SEQ ID NO: 155769 - DNA, 20 bp, Artificial Sequence
  Description of Artificial Sequence: Synthetic oligonucleotide
  Target: ATXN1; (-) strand; PAM type: YTN; PAM sequence: CTC
caaagtgcagcccttgtgtt

SEQ ID NO: 155770 - DNA, 20 bp, Artificial Sequence
  Description of Artificial Sequence: Synthetic oligonucleotide
  Target: ATXN1; (-) strand; PAM type: YTN; PAM sequence: CTC
ccgtctccaaagtgcagccc

SEQ ID NO: 155771 - DNA, 20 bp, Artificial Sequence
  Description of Artificial Sequence: Synthetic oligonucleotide
  Target: ATXN1; (-) strand; PAM type: YTN; PAM sequence: TTG
gccctcccgtctccaaagtg

SEQ ID NO: 155772 - DNA, 20 bp, Artificial Sequence
  Description of Artificial Sequence: Synthetic oligonucleotide
  Target: ATXN1; (-) strand; PAM type: YTN; PAM sequence: CTT
ggccctcccgtctccaaagt

SEQ ID NO: 155773 - DNA, 20 bp, Artificial Sequence
  Description of Artificial Sequence: Synthetic oligonucleotide
  Target: ATXN1; (-) strand; PAM type: YTN; PAM sequence: CTC
ttggccctcccgtctccaaa

SEQ ID NO: 155774 - DNA, 20 bp, Artificial Sequence
  Description of Artificial Sequence: Synthetic oligonucleotide
  Target: ATXN1; (-) strand; PAM type: YTN; PAM sequence: TTA
aatcgcctcttggccctccc

SEQ ID NO: 155775 - DNA, 20 bp, Artificial Sequence
  Description of Artificial Sequence: Synthetic oligonucleotide
  Target: ATXN1; (-) strand; PAM type: YTN; PAM sequence: CTC
cacgttaaatcgcctcttgg

SEQ ID NO: 155776 - DNA, 20 bp, Artificial Sequence
  Description of Artificial Sequence: Synthetic oligonucleotide
  Target: ATXN1; (-) strand; PAM type: YTN; PAM sequence: TTG
ctccacgttaaatcgcctct

SEQ ID NO: 155777 - DNA, 20 bp, Artificial Sequence
  Description of Artificial Sequence: Synthetic oligonucleotide
  Target: ATXN1; (-) strand; PAM type: YTN; PAM sequence: CTT
gctccacgttaaatcgcctc

SEQ ID NO: 155778 - DNA, 20 bp, Artificial Sequence
  Description of Artificial Sequence: Synthetic oligonucleotide
  Target: ATXN1; (-) strand; PAM type: YTN; PAM sequence: CTG
cagccaagccccatgtcttg

SEQ ID NO: 155779 - DNA, 20 bp, Artificial Sequence
  Description of Artificial Sequence: Synthetic oligonucleotide
  Target: ATXN1; (-) strand; PAM type: YTN; PAM sequence: CTG
gaagaccacagagagcaagg

SEQ ID NO: 155780 - DNA, 20 bp, Artificial Sequence
  Description of Artificial Sequence: Synthetic oligonucleotide
  Target: ATXN1; (-) strand; PAM type: YTN; PAM sequence: TTA
caagcagctggaagaccaca

SEQ ID NO: 155781 - DNA, 20 bp, Artificial Sequence
  Description of Artificial Sequence: Synthetic oligonucleotide
  Target: ATXN1; (-) strand; PAM type: YTN; PAM sequence: CTC
agttacaagcagctggaaga

SEQ ID NO: 155782 - DNA, 20 bp, Artificial Sequence
  Description of Artificial Sequence: Synthetic oligonucleotide
  Target: ATXN1; (-) strand; PAM type: YTN; PAM sequence: CTA
ctcagttacaagcagctgga

SEQ ID NO: 155783 - DNA, 20 bp, Artificial Sequence
  Description of Artificial Sequence: Synthetic oligonucleotide
  Target: ATXN1; (-) strand; PAM type: YTN; PAM sequence: TTG
taactactcagttacaagca

SEQ ID NO: 155784 - DNA, 20 bp, Artificial Sequence
  Description of Artificial Sequence: Synthetic oligonucleotide
  Target: ATXN1; (-) strand; PAM type: YTN; PAM sequence: TTT
gtaactactcagttacaagc

SEQ ID NO: 155785 - DNA, 20 bp, Artificial Sequence
  Description of Artificial Sequence: Synthetic oligonucleotide
  Target: ATXN1; (-) strand; PAM type: YTN; PAM sequence: TTT
tgtaactactcagttacaag

SEQ ID NO: 155786 - DNA, 20 bp, Artificial Sequence
  Description of Artificial Sequence: Synthetic oligonucleotide
  Target: ATXN1; (-) strand; PAM type: YTN; PAM sequence: TTG
attttgtaactactcagtta

SEQ ID NO: 155787 - DNA, 20 bp, Artificial Sequence
  Description of Artificial Sequence: Synthetic oligonucleotide
  Target: ATXN1; (-) strand; PAM type: YTN; PAM sequence: TTT
gattttgtaactactcagtt

SEQ ID NO: 155788 - DNA, 20 bp, Artificial Sequence
  Description of Artificial Sequence: Synthetic oligonucleotide
  Target: ATXN1; (-) strand; PAM type: YTN; PAM sequence: TTT
tgattttgtaactactcagt

SEQ ID NO: 155789 - DNA, 20 bp, Artificial Sequence
  Description of Artificial Sequence: Synthetic oligonucleotide
  Target: ATXN1; (-) strand; PAM type: YTN; PAM sequence: TTT
ttgattttgtaactactcag

SEQ ID NO: 155790 - DNA, 20 bp, Artificial Sequence
  Description of Artificial Sequence: Synthetic oligonucleotide
  Target: ATXN1; (-) strand; PAM type: YTN; PAM sequence: CTA
acgagtttttgattttgtaa

SEQ ID NO: 155791 - DNA, 20 bp, Artificial Sequence
  Description of Artificial Sequence: Synthetic oligonucleotide
  Target: ATXN1; (-) strand; PAM type: YTN; PAM sequence: TTC
aaaatggtcctaacgagttt

SEQ ID NO: 155792 - DNA, 20 bp, Artificial Sequence
  Description of Artificial Sequence: Synthetic oligonucleotide
  Target: ATXN1; (-) strand; PAM type: YTN; PAM sequence: CTT
caaaatggtcctaacgagtt

SEQ ID NO: 155793 - DNA, 20 bp, Artificial Sequence
  Description of Artificial Sequence: Synthetic oligonucleotide
  Target: ATXN1; (-) strand; PAM type: YTN; PAM sequence: CTG
cttcaaaatggtcctaacga

SEQ ID NO: 155794 - DNA, 20 bp, Artificial Sequence
  Description of Artificial Sequence: Synthetic oligonucleotide
  Target: ATXN1; (-) strand; PAM type: YTN; PAM sequence: CTC
tgcttcaaaatggtcctaac

SEQ ID NO: 155795 - DNA, 20 bp, Artificial Sequence
  Description of Artificial Sequence: Synthetic oligonucleotide
  Target: ATXN1; (-) strand; PAM type: YTN; PAM sequence: CTG
aaggctctgcttcaaaatgg

SEQ ID NO: 155796 - DNA, 20 bp, Artificial Sequence
  Description of Artificial Sequence: Synthetic oligonucleotide
  Target: ATXN1; (-) strand; PAM type: YTN; PAM sequence: TTC
tgaaggctctgcttcaaaat

SEQ ID NO: 155797 - DNA, 20 bp, Artificial Sequence
  Description of Artificial Sequence: Synthetic oligonucleotide
  Target: ATXN1; (-) strand; PAM type: YTN; PAM sequence: TTT
ctgaaggctctgcttcaaaa

SEQ ID NO: 155798 - DNA, 20 bp, Artificial Sequence
  Description of Artificial Sequence: Synthetic oligonucleotide
  Target: ATXN1; (-) strand; PAM type: YTN; PAM sequence: CTT
tctgaaggctctgcttcaaa

SEQ ID NO: 155799 - DNA, 20 bp, Artificial Sequence
  Description of Artificial Sequence: Synthetic oligonucleotide
  Target: ATXN1; (-) strand; PAM type: YTN; PAM sequence: CTC
tttctgaaggctctgcttca

SEQ ID NO: 155800 - DNA, 20 bp, Artificial Sequence
  Description of Artificial Sequence: Synthetic oligonucleotide
  Target: ATXN1; (-) strand; PAM type: YTN; PAM sequence: TTC
tctttctgaaggctctgctt

SEQ ID NO: 155801 - DNA, 20 bp, Artificial Sequence
  Description of Artificial Sequence: Synthetic oligonucleotide
  Target: ATXN1; (-) strand; PAM type: YTN; PAM sequence: CTC
aggaaaaaaaaaaaaaaaaa

SEQ ID NO: 155802 - DNA, 20 bp, Artificial Sequence
  Description of Artificial Sequence: Synthetic oligonucleotide
  Target: ATXN1; (-) strand; PAM type: YTN; PAM sequence: TTG
gtctcaggaaaaaaaaaaaa

SEQ ID NO: 155803 - DNA, 20 bp, Artificial Sequence
  Description of Artificial Sequence: Synthetic oligonucleotide
  Target: ATXN1; (-) strand; PAM type: YTN; PAM sequence: CTT
ggtctcaggaaaaaaaaaaa

SEQ ID NO: 155804 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagcaagacttgg

SEQ ID NO: 155805 - DNA, 20 bp, Artificial Sequence
  Description of Artificial Sequence: Synthetic oligonucleotide
  Target: ATXN1; (-) strand; PAM type: YTN; PAM sequence: CTG
cctgggtgacagagcaagac

SEQ ID NO: 155806 - DNA, 20 bp, Artificial Sequence
  Description of Artificial Sequence: Synthetic oligonucleotide
  Target: ATXN1; (-) strand; PAM type: YTN; PAM sequence: CTC
tgcctgggtgacagagcaag

SEQ ID NO: 155807 - DNA, 20 bp, Artificial Sequence
  Description of Artificial Sequence: Synthetic oligonucleotide
  Target: ATXN1; (-) strand; PAM type: YTN; PAM sequence: CTG
cactctgcctgggtgacaga

SEQ ID NO: 155808 - DNA, 20 bp, Artificial Sequence
  Description of Artificial Sequence: Synthetic oligonucleotide
  Target: ATXN1; (-) strand; PAM type: YTN; PAM sequence: TTG
tgccactgcactctgcctgg

SEQ ID NO: 155809 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagattgtgcc

SEQ ID NO: 155810 - DNA, 20 bp, Artificial Sequence
  Description of Artificial Sequence: Synthetic oligonucleotide
  Target: ATXN1; (-) strand; PAM type: YTN; PAM sequence: CTG
ggaggcggaggttgcagtga

SEQ ID NO: 155811 - DNA, 20 bp, Artificial Sequence
  Description of Artificial Sequence: Synthetic oligonucleotide
  Target: ATXN1; (-) strand; PAM type: YTN; PAM sequence: TTG
aacctgggaggcggaggttg

SEQ ID NO: 155812 - DNA, 20 bp, Artificial Sequence
  Description of Artificial Sequence: Synthetic oligonucleotide
  Target: ATXN1; (-) strand; PAM type: YTN; PAM sequence: CTT
gaacctgggaggcggaggtt

SEQ ID NO: 155813 - DNA, 20 bp, Artificial Sequence
  Description of Artificial Sequence: Synthetic oligonucleotide
  Target: ATXN1; (-) strand; PAM type: YTN; PAM sequence: CTG
aggcacgagaatcacttgaa

SEQ ID NO: 155814 - DNA, 20 bp, Artificial Sequence
  Description of Artificial Sequence: Synthetic oligonucleotide
  Target: ATXN1; (-) strand; PAM type: YTN; PAM sequence: CTG
aaggctgaggcacgagaatc

SEQ ID NO: 155815 - DNA, 20 bp, Artificial Sequence
  Description of Artificial Sequence: Synthetic oligonucleotide
  Target: ATXN1; (-) strand; PAM type: YTN; PAM sequence: CTC
tgaaggctgaggcacgagaa

SEQ ID NO: 155816 - DNA, 20 bp, Artificial Sequence
  Description of Artificial Sequence: Synthetic oligonucleotide
  Target: ATXN1; (-) strand; PAM type: YTN; PAM sequence: CTA
ctctgaaggctgaggcacga

SEQ ID NO: 155817 - DNA, 20 bp, Artificial Sequence
  Description of Artificial Sequence: Synthetic oligonucleotide
  Target: ATXN1; (-) strand; PAM type: YTN; PAM sequence: CTG
taatcccggctactctgaag

SEQ ID NO: 155818 - DNA, 20 bp, Artificial Sequence
  Description of Artificial Sequence: Synthetic oligonucleotide
  Target: ATXN1; (-) strand; PAM type: YTN; PAM sequence: TTA
gccagacgtggcgggcacct

SEQ ID NO: 155819 - DNA, 20 bp, Artificial Sequence
  Description of Artificial Sequence: Synthetic oligonucleotide
  Target: ATXN1; (-) strand; PAM type: YTN; PAM sequence: CTA
aaaacataaacattagccag

SEQ ID NO: 155820 - DNA, 20 bp, Artificial Sequence
  Description of Artificial Sequence: Synthetic oligonucleotide
  Target: ATXN1; (-) strand; PAM type: YTN; PAM sequence: CTA
ctaaaaacataaacattagc

SEQ ID NO: 155821 - DNA, 20 bp, Artificial Sequence
  Description of Artificial Sequence: Synthetic oligonucleotide
  Target: ATXN1; (-) strand; PAM type: YTN; PAM sequence: CTC
tactaaaaacataaacatta

SEQ ID NO: 155822 - DNA, 20 bp, Artificial Sequence
  Description of Artificial Sequence: Synthetic oligonucleotide
  Target: ATXN1; (-) strand; PAM type: YTN; PAM sequence: CTG
ggtaacatggcaaaaaccca

SEQ ID NO: 155823 - DNA, 20 bp, Artificial Sequence
  Description of Artificial Sequence: Synthetic oligonucleotide
  Target: ATXN1; (-) strand; PAM type: YTN; PAM sequence: TTG
agaccagcctgggtaacatg

SEQ ID NO: 155824 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctgggtaacat

SEQ ID NO: 155825 - DNA, 20 bp, Artificial Sequence
  Description of Artificial Sequence: Synthetic oligonucleotide
  Target: ATXN1; (-) strand; PAM type: YTN; PAM sequence: CTG
aggtgggtggatcacccgag

SEQ ID NO: 155826 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggtgggtggat

SEQ ID NO: 155827 - DNA, 20 bp, Artificial Sequence
  Description of Artificial Sequence: Synthetic oligonucleotide
  Target: ATXN1; (-) strand; PAM type: YTN; PAM sequence: TTT
gggaggctgaggtgggtgga

SEQ ID NO: 155828 - DNA, 20 bp, Artificial Sequence
  Description of Artificial Sequence: Synthetic oligonucleotide
  Target: ATXN1; (-) strand; PAM type: YTN; PAM sequence: CTT
tgggaggctgaggtgggtgg

SEQ ID NO: 155829 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 155830 - DNA, 20 bp, Artificial Sequence
  Description of Artificial Sequence: Synthetic oligonucleotide
  Target: ATXN1; (-) strand; PAM type: YTN; PAM sequence: CTC
acacctgtaatcccagcact

SEQ ID NO: 155831 - DNA, 20 bp, Artificial Sequence
  Description of Artificial Sequence: Synthetic oligonucleotide
  Target: ATXN1; (-) strand; PAM type: YTN; PAM sequence: TTA
tgggccaggcgcggtggctc

SEQ ID NO: 155832 - DNA, 20 bp, Artificial Sequence
  Description of Artificial Sequence: Synthetic oligonucleotide
  Target: ATXN1; (-) strand; PAM type: YTN; PAM sequence: TTT
atgggccaggcgcggtggct

SEQ ID NO: 155833 - DNA, 20 bp, Artificial Sequence
  Description of Artificial Sequence: Synthetic oligonucleotide
  Target: ATXN1; (-) strand; PAM type: YTN; PAM sequence: CTT
tatgggccaggcgcggtggc

SEQ ID NO: 155834 - DNA, 20 bp, Artificial Sequence
  Description of Artificial Sequence: Synthetic oligonucleotide
  Target: ATXN1; (-) strand; PAM type: YTN; PAM sequence: CTC
tttatgggccaggcgcggtg

SEQ ID NO: 155835 - DNA, 20 bp, Artificial Sequence
  Description of Artificial Sequence: Synthetic oligonucleotide
  Target: ATXN1; (-) strand; PAM type: YTN; PAM sequence: TTC
tctttatgggccaggcgcgg

SEQ ID NO: 155836 - DNA, 20 bp, Artificial Sequence
  Description of Artificial Sequence: Synthetic oligonucleotide
  Target: ATXN1; (-) strand; PAM type: YTN; PAM sequence: TTA
caagttctctttatgggcca

SEQ ID NO: 155837 - DNA, 20 bp, Artificial Sequence
  Description of Artificial Sequence: Synthetic oligonucleotide
  Target: ATXN1; (-) strand; PAM type: YTN; PAM sequence: CTT
acaagttctctttatgggcc

SEQ ID NO: 155838 - DNA, 20 bp, Artificial Sequence
  Description of Artificial Sequence: Synthetic oligonucleotide
  Target: ATXN1; (-) strand; PAM type: YTN; PAM sequence: CTA
aggcaaacggtgacggagcc

SEQ ID NO: 155839 - DNA, 20 bp, Artificial Sequence
  Description of Artificial Sequence: Synthetic oligonucleotide
  Target: ATXN1; (-) strand; PAM type: YTN; PAM sequence: CTG
ctaaggcaaacggtgacgga

SEQ ID NO: 155840 - DNA, 20 bp, Artificial Sequence
  Description of Artificial Sequence: Synthetic oligonucleotide
  Target: ATXN1; (-) strand; PAM type: YTN; PAM sequence: CTA
tcagaggcagagatgaacct

SEQ ID NO: 155841 - DNA, 20 bp, Artificial Sequence
  Description of Artificial Sequence: Synthetic oligonucleotide
  Target: ATXN1; (-) strand; PAM type: YTN; PAM sequence: CTC
ctatcagaggcagagatgaa

SEQ ID NO: 155842 - DNA, 20 bp, Artificial Sequence
  Description of Artificial Sequence: Synthetic oligonucleotide
  Target: ATXN1; (-) strand; PAM type: YTN; PAM sequence: CTC
ccccagccccactcctatca

SEQ ID NO: 155843 - DNA, 20 bp, Artificial Sequence
  Description of Artificial Sequence: Synthetic oligonucleotide
  Target: ATXN1; (-) strand; PAM type: YTN; PAM sequence: CTG
gtgtgggctcccccagcccc

SEQ ID NO: 155844 - DNA, 20 bp, Artificial Sequence
  Description of Artificial Sequence: Synthetic oligonucleotide
  Target: ATXN1; (-) strand; PAM type: YTN; PAM sequence: CTC
tggtgtgggctcccccagcc

SEQ ID NO: 155845 - DNA, 20 bp, Artificial Sequence
  Description of Artificial Sequence: Synthetic oligonucleotide
  Target: ATXN1; (-) strand; PAM type: YTN; PAM sequence: CTG
tgggacacccggtccaaggg

SEQ ID NO: 155846 - DNA, 20 bp, Artificial Sequence
  Description of Artificial Sequence: Synthetic oligonucleotide
  Target: ATXN1; (-) strand; PAM type: YTN; PAM sequence: CTC
caggtcctgtgggacacccg

SEQ ID NO: 155847 - DNA, 20 bp, Artificial Sequence
  Description of Artificial Sequence: Synthetic oligonucleotide
  Target: ATXN1; (-) strand; PAM type: YTN; PAM sequence: TTC
atctccaggtcctgtgggac

SEQ ID NO: 155848 - DNA, 20 bp, Artificial Sequence
  Description of Artificial Sequence: Synthetic oligonucleotide
  Target: ATXN1; (-) strand; PAM type: YTN; PAM sequence: CTT
catctccaggtcctgtggga

SEQ ID NO: 155849 - DNA, 20 bp, Artificial Sequence
  Description of Artificial Sequence: Synthetic oligonucleotide
  Target: ATXN1; (-) strand; PAM type: YTN; PAM sequence: CTG
catgcttcatctccaggtcc

SEQ ID NO: 155850 - DNA, 20 bp, Artificial Sequence
  Description of Artificial Sequence: Synthetic oligonucleotide
  Target: ATXN1; (-) strand; PAM type: YTN; PAM sequence: CTG
gcacaggaagcccagtgggt

SEQ ID NO: 155851 - DNA, 20 bp, Artificial Sequence
  Description of Artificial Sequence: Synthetic oligonucleotide
  Target: ATXN1; (-) strand; PAM type: YTN; PAM sequence: CTC
tggcacaggaagcccagtgg

SEQ ID NO: 155852 - DNA, 20 bp, Artificial Sequence
  Description of Artificial Sequence: Synthetic oligonucleotide
  Target: ATXN1; (-) strand; PAM type: YTN; PAM sequence: CTC
ccccagctctggcacaggaa

SEQ ID NO: 155853 - DNA, 20 bp, Artificial Sequence
  Description of Artificial Sequence: Synthetic oligonucleotide
  Target: ATXN1; (-) strand; PAM type: YTN; PAM sequence: CTC
ctcccccagctctggcacag

SEQ ID NO: 155854 - DNA, 20 bp, Artificial Sequence
  Description of Artificial Sequence: Synthetic oligonucleotide
  Target: ATXN1; (-) strand; PAM type: YTN; PAM sequence: CTC
ctcctcccccagctctggca

SEQ ID NO: 155855 - DNA, 20 bp, Artificial Sequence
  Description of Artificial Sequence: Synthetic oligonucleotide
  Target: ATXN1; (-) strand; PAM type: YTN; PAM sequence: CTG
tcctcctcctcccccagctc

SEQ ID NO: 155856 - DNA, 20 bp, Artificial Sequence
  Description of Artificial Sequence: Synthetic oligonucleotide
  Target: ATXN1; (-) strand; PAM type: YTN; PAM sequence: CTG
gctgtcctcctcctccccca

SEQ ID NO: 155857 - DNA, 20 bp, Artificial Sequence
  Description of Artificial Sequence: Synthetic oligonucleotide
  Target: ATXN1; (-) strand; PAM type: YTN; PAM sequence: TTC
actggctgtcctcctcctcc

SEQ ID NO: 155858 - DNA, 20 bp, Artificial Sequence
  Description of Artificial Sequence: Synthetic oligonucleotide
  Target: ATXN1; (-) strand; PAM type: YTN; PAM sequence: CTC
agatggaacggccagagtgg

SEQ ID NO: 155859 - DNA, 20 bp, Artificial Sequence
  Description of Artificial Sequence: Synthetic oligonucleotide
  Target: ATXN1; (-) strand; PAM type: YTN; PAM sequence: CTG
ccagagccctcagatggaac

SEQ ID NO: 155860 - DNA, 20 bp, Artificial Sequence
  Description of Artificial Sequence: Synthetic oligonucleotide
  Target: ATXN1; (-) strand; PAM type: YTN; PAM sequence: TTG
aaaccatcaaaagcactgcc

SEQ ID NO: 155861 - DNA, 20 bp, Artificial Sequence
  Description of Artificial Sequence: Synthetic oligonucleotide
  Target: ATXN1; (-) strand; PAM type: YTN; PAM sequence: CTT
gaaaccatcaaaagcactgc

SEQ ID NO: 155862 - DNA, 20 bp, Artificial Sequence
  Description of Artificial Sequence: Synthetic oligonucleotide
  Target: ATXN1; (-) strand; PAM type: YTN; PAM sequence: CTG
cagcggggcaggacttgaaa

SEQ ID NO: 155863 - DNA, 20 bp, Artificial Sequence
  Description of Artificial Sequence: Synthetic oligonucleotide
  Target: ATXN1; (-) strand; PAM type: YTN; PAM sequence: TTC
aggtgctgcagcggggcagg

SEQ ID NO: 155864 - DNA, 20 bp, Artificial Sequence
  Description of Artificial Sequence: Synthetic oligonucleotide
  Target: ATXN1; (-) strand; PAM type: YTN; PAM sequence: CTT
caggtgctgcagcggggcag

SEQ ID NO: 155865 - DNA, 20 bp, Artificial Sequence
  Description of Artificial Sequence: Synthetic oligonucleotide
  Target: ATXN1; (-) strand; PAM type: YTN; PAM sequence: TTA
gggggaaccataccttcagg

SEQ ID NO: 155866 - DNA, 20 bp, Artificial Sequence
  Description of Artificial Sequence: Synthetic oligonucleotide
  Target: ATXN1; (-) strand; PAM type: YTN; PAM sequence: CTG
gtgaaatcaattagggggaa

SEQ ID NO: 155867 - DNA, 20 bp, Artificial Sequence
  Description of Artificial Sequence: Synthetic oligonucleotide
  Target: ATXN1; (-) strand; PAM type: YTN; PAM sequence: CTC
agctggtgaaatcaattagg

SEQ ID NO: 155868 - DNA, 20 bp, Artificial Sequence
  Description of Artificial Sequence: Synthetic oligonucleotide
  Target: ATXN1; (-) strand; PAM type: YTN; PAM sequence: TTA
cctcagctggtgaaatcaat

SEQ ID NO: 155869 - DNA, 20 bp, Artificial Sequence
  Description of Artificial Sequence: Synthetic oligonucleotide
  Target: ATXN1; (-) strand; PAM type: YTN; PAM sequence: CTT
acctcagctggtgaaatcaa

SEQ ID NO: 155870 - DNA, 20 bp, Artificial Sequence
  Description of Artificial Sequence: Synthetic oligonucleotide
  Target: ATXN1; (-) strand; PAM type: YTN; PAM sequence: TTA
cttacctcagctggtgaaat

SEQ ID NO: 155871 - DNA, 20 bp, Artificial Sequence
  Description of Artificial Sequence: Synthetic oligonucleotide
  Target: ATXN1; (-) strand; PAM type: YTN; PAM sequence: CTG
tgttacttacctcagctggt

SEQ ID NO: 155872 - DNA, 20 bp, Artificial Sequence
  Description of Artificial Sequence: Synthetic oligonucleotide
  Target: ATXN1; (-) strand; PAM type: YTN; PAM sequence: TTG
gggtccagtggctgtgttac

SEQ ID NO: 155873 - DNA, 20 bp, Artificial Sequence
  Description of Artificial Sequence: Synthetic oligonucleotide
  Target: ATXN1; (-) strand; PAM type: YTN; PAM sequence: TTT
ggggtccagtggctgtgtta

SEQ ID NO: 155874 - DNA, 20 bp, Artificial Sequence
  Description of Artificial Sequence: Synthetic oligonucleotide
  Target: ATXN1; (-) strand; PAM type: YTN; PAM sequence: CTG
acaagtttggggtccagtgg

SEQ ID NO: 155875 - DNA, 20 bp, Artificial Sequence
  Description of Artificial Sequence: Synthetic oligonucleotide
  Target: ATXN1; (-) strand; PAM type: YTN; PAM sequence: TTC
tgacaagtttggggtccagt

SEQ ID NO: 155876 - DNA, 20 bp, Artificial Sequence
  Description of Artificial Sequence: Synthetic oligonucleotide
  Target: ATXN1; (-) strand; PAM type: YTN; PAM sequence: TTG
ttctgacaagtttggggtcc

SEQ ID NO: 155877 - DNA, 20 bp, Artificial Sequence
  Description of Artificial Sequence: Synthetic oligonucleotide
  Target: ATXN1; (-) strand; PAM type: YTN; PAM sequence: CTG
attgttctgacaagtttggg

SEQ ID NO: 155878 - DNA, 20 bp, Artificial Sequence
  Description of Artificial Sequence: Synthetic oligonucleotide
  Target: ATXN1; (-) strand; PAM type: YTN; PAM sequence: TTG
tgtgagatactgattgttct

SEQ ID NO: 155879 - DNA, 20 bp, Artificial Sequence
  Description of Artificial Sequence: Synthetic oligonucleotide
  Target: ATXN1; (-) strand; PAM type: YTN; PAM sequence: TTT
gtgtgagatactgattgttc

SEQ ID NO: 155880 - DNA, 20 bp, Artificial Sequence
  Description of Artificial Sequence: Synthetic oligonucleotide
  Target: ATXN1; (-) strand; PAM type: YTN; PAM sequence: TTG
tttgtgtgagatactgattg

SEQ ID NO: 155881 - DNA, 20 bp, Artificial Sequence
  Description of Artificial Sequence: Synthetic oligonucleotide
  Target: ATXN1; (-) strand; PAM type: YTN; PAM sequence: TTT
gtttgtgtgagatactgatt

SEQ ID NO: 155882 - DNA, 20 bp, Artificial Sequence
  Description of Artificial Sequence: Synthetic oligonucleotide
  Target: ATXN1; (-) strand; PAM type: YTN; PAM sequence: TTT
tgtttgtgtgagatactgat

SEQ ID NO: 155883 - DNA, 20 bp, Artificial Sequence
  Description of Artificial Sequence: Synthetic oligonucleotide
  Target: ATXN1; (-) strand; PAM type: YTN; PAM sequence: TTT
ttgtttgtgtgagatactga

SEQ ID NO: 155884 - DNA, 20 bp, Artificial Sequence
  Description of Artificial Sequence: Synthetic oligonucleotide
  Target: ATXN1; (-) strand; PAM type: YTN; PAM sequence: CTT
tttgtttgtgtgagatactg

SEQ ID NO: 155885 - DNA, 20 bp, Artificial Sequence
  Description of Artificial Sequence: Synthetic oligonucleotide
  Target: ATXN1; (-) strand; PAM type: YTN; PAM sequence: TTC
cctttttgtttgtgtgagat

SEQ ID NO: 155886 - DNA, 20 bp, Artificial Sequence
  Description of Artificial Sequence: Synthetic oligonucleotide
  Target: ATXN1; (-) strand; PAM type: YTN; PAM sequence: CTT
ccctttttgtttgtgtgaga

SEQ ID NO: 155887 - DNA, 20 bp, Artificial Sequence
  Description of Artificial Sequence: Synthetic oligonucleotide
  Target: ATXN1; (-) strand; PAM type: YTN; PAM sequence: CTG
ccttccctttttgtttgtgt

SEQ ID NO: 155888 - DNA, 20 bp, Artificial Sequence
  Description of Artificial Sequence: Synthetic oligonucleotide
  Target: ATXN1; (-) strand; PAM type: YTN; PAM sequence: CTC
tgccttccctttttgtttgt

SEQ ID NO: 155889 - DNA, 20 bp, Artificial Sequence
  Description of Artificial Sequence: Synthetic oligonucleotide
  Target: ATXN1; (-) strand; PAM type: YTN; PAM sequence: CTG
catctctgccttcccttttt

SEQ ID NO: 155890 - DNA, 20 bp, Artificial Sequence
  Description of Artificial Sequence: Synthetic oligonucleotide
  Target: ATXN1; (-) strand; PAM type: YTN; PAM sequence: CTC
ggcaaagcagtctgcatctc

SEQ ID NO: 155891 - DNA, 20 bp, Artificial Sequence
  Description of Artificial Sequence: Synthetic oligonucleotide
  Target: ATXN1; (-) strand; PAM type: YTN; PAM sequence: CTG
tgggcaaactcggcaaagca

SEQ ID NO: 155892 - DNA, 20 bp, Artificial Sequence
  Description of Artificial Sequence: Synthetic oligonucleotide
  Target: ATXN1; (-) strand; PAM type: YTN; PAM sequence: CTG
tgtgctgtgggcaaactcgg

SEQ ID NO: 155893 - DNA, 20 bp, Artificial Sequence
  Description of Artificial Sequence: Synthetic oligonucleotide
  Target: ATXN1; (-) strand; PAM type: YTN; PAM sequence: CTG
tggagtagcccgggcaaatg

SEQ ID NO: 155894 - DNA, 20 bp, Artificial Sequence
  Description of Artificial Sequence: Synthetic oligonucleotide
  Target: ATXN1; (-) strand; PAM type: YTN; PAM sequence: CTG
ccccaggtcctgtggagtag

SEQ ID NO: 155895 - DNA, 20 bp, Artificial Sequence
  Description of Artificial Sequence: Synthetic oligonucleotide
  Target: ATXN1; (-) strand; PAM type: YTN; PAM sequence: CTA
caagggctgccccaggtcct

SEQ ID NO: 155896 - DNA, 20 bp, Artificial Sequence
  Description of Artificial Sequence: Synthetic oligonucleotide
  Target: ATXN1; (-) strand; PAM type: YTN; PAM sequence: CTC
aggctacaagggctgcccca

SEQ ID NO: 155897 - DNA, 20 bp, Artificial Sequence
  Description of Artificial Sequence: Synthetic oligonucleotide
  Target: ATXN1; (-) strand; PAM type: YTN; PAM sequence: CTG
tgtaggtgcaactcaggcta

SEQ ID NO: 155898 - DNA, 20 bp, Artificial Sequence
  Description of Artificial Sequence: Synthetic oligonucleotide
  Target: ATXN1; (-) strand; PAM type: YTN; PAM sequence: TTA
tataataaatatgtgaaagg

SEQ ID NO: 155899 - DNA, 20 bp, Artificial Sequence
  Description of Artificial Sequence: Synthetic oligonucleotide
  Target: ATXN1; (-) strand; PAM type: YTN; PAM sequence: CTG
acacattatataataaatat

SEQ ID NO: 155900 - DNA, 20 bp, Artificial Sequence
  Description of Artificial Sequence: Synthetic oligonucleotide
  Target: ATXN1; (-) strand; PAM type: YTN; PAM sequence: TTG
aggtcctgacacattatata

SEQ ID NO: 155901 - DNA, 20 bp, Artificial Sequence
  Description of Artificial Sequence: Synthetic oligonucleotide
  Target: ATXN1; (-) strand; PAM type: YTN; PAM sequence: TTA
gttgaggtcctgacacatta

SEQ ID NO: 155902 - DNA, 20 bp, Artificial Sequence
  Description of Artificial Sequence: Synthetic oligonucleotide
  Target: ATXN1; (-) strand; PAM type: YTN; PAM sequence: TTT
agttgaggtcctgacacatt

SEQ ID NO: 155903 - DNA, 20 bp, Artificial Sequence
  Description of Artificial Sequence: Synthetic oligonucleotide
  Target: ATXN1; (-) strand; PAM type: YTN; PAM sequence: TTA
tttagttgaggtcctgacac

SEQ ID NO: 155904 - DNA, 20 bp, Artificial Sequence
  Description of Artificial Sequence: Synthetic oligonucleotide
  Target: ATXN1; (-) strand; PAM type: YTN; PAM sequence: CTG
attatttagttgaggtcctg

SEQ ID NO: 155905 - DNA, 20 bp, Artificial Sequence
  Description of Artificial Sequence: Synthetic oligonucleotide
  Target: ATXN1; (-) strand; PAM type: YTN; PAM sequence: CTC
tgattatttagttgaggtcc

SEQ ID NO: 155906 - DNA, 20 bp, Artificial Sequence
  Description of Artificial Sequence: Synthetic oligonucleotide
  Target: ATXN1; (-) strand; PAM type: YTN; PAM sequence: CTC
ctctgattatttagttgagg

SEQ ID NO: 155907 - DNA, 20 bp, Artificial Sequence
  Description of Artificial Sequence: Synthetic oligonucleotide
  Target: ATXN1; (-) strand; PAM type: YTN; PAM sequence: CTC
tcctctgattatttagttga

SEQ ID NO: 155908 - DNA, 20 bp, Artificial Sequence
  Description of Artificial Sequence: Synthetic oligonucleotide
  Target: ATXN1; (-) strand; PAM type: YTN; PAM sequence: TTG
gactctcctctgattattta

SEQ ID NO: 155909 - DNA, 20 bp, Artificial Sequence
  Description of Artificial Sequence: Synthetic oligonucleotide
  Target: ATXN1; (-) strand; PAM type: YTN; PAM sequence: TTT
ggactctcctctgattattt

SEQ ID NO: 155910 - DNA, 20 bp, Artificial Sequence
  Description of Artificial Sequence: Synthetic oligonucleotide
  Target: ATXN1; (-) strand; PAM type: YTN; PAM sequence: TTT
tggactctcctctgattatt

SEQ ID NO: 155911 - DNA, 20 bp, Artificial Sequence
  Description of Artificial Sequence: Synthetic oligonucleotide
  Target: ATXN1; (-) strand; PAM type: YTN; PAM sequence: TTG
ggaaggtgttttggactctc

SEQ ID NO: 155912 - DNA, 20 bp, Artificial Sequence
  Description of Artificial Sequence: Synthetic oligonucleotide
  Target: ATXN1; (-) strand; PAM type: YTN; PAM sequence: CTT
gggaaggtgttttggactct

SEQ ID NO: 155913 - DNA, 20 bp, Artificial Sequence
  Description of Artificial Sequence: Synthetic oligonucleotide
  Target: ATXN1; (-) strand; PAM type: YTN; PAM sequence: TTC
ttgggaaggtgttttggact

SEQ ID NO: 155914 - DNA, 20 bp, Artificial Sequence
  Description of Artificial Sequence: Synthetic oligonucleotide
  Target: ATXN1; (-) strand; PAM type: YTN; PAM sequence: CTT
cttgggaaggtgttttggac

SEQ ID NO: 155915 - DNA, 20 bp, Artificial Sequence
  Description of Artificial Sequence: Synthetic oligonucleotide
  Target: ATXN1; (-) strand; PAM type: YTN; PAM sequence: CTA
tcttcttgggaaggtgtttt

SEQ ID NO: 155916 - DNA, 20 bp, Artificial Sequence
  Description of Artificial Sequence: Synthetic oligonucleotide
  Target: ATXN1; (-) strand; PAM type: YTN; PAM sequence: TTA
gccaaggaggaactatcttc

SEQ ID NO: 155917 - DNA, 20 bp, Artificial Sequence
  Description of Artificial Sequence: Synthetic oligonucleotide
  Target: ATXN1; (-) strand; PAM type: YTN; PAM sequence: CTT
agccaaggaggaactatctt

SEQ ID NO: 155918 - DNA, 20 bp, Artificial Sequence
  Description of Artificial Sequence: Synthetic oligonucleotide
  Target: ATXN1; (-) strand; PAM type: YTN; PAM sequence: TTC
acttagccaaggaggaacta

SEQ ID NO: 155919 - DNA, 20 bp, Artificial Sequence
  Description of Artificial Sequence: Synthetic oligonucleotide
  Target: ATXN1; (-) strand; PAM type: YTN; PAM sequence: TTT
cacttagccaaggaggaact

SEQ ID NO: 155920 - DNA, 20 bp, Artificial Sequence
  Description of Artificial Sequence: Synthetic oligonucleotide
  Target: ATXN1; (-) strand; PAM type: YTN; PAM sequence: TTT
tcacttagccaaggaggaac

SEQ ID NO: 155921 - DNA, 20 bp, Artificial Sequence
  Description of Artificial Sequence: Synthetic oligonucleotide
  Target: ATXN1; (-) strand; PAM type: YTN; PAM sequence: TTC
attttcacttagccaaggag

SEQ ID NO: 155922 - DNA, 20 bp, Artificial Sequence
  Description of Artificial Sequence: Synthetic oligonucleotide
  Target: ATXN1; (-) strand; PAM type: YTN; PAM sequence: TTA
aattcattttcacttagcca

SEQ ID NO: 155923 - DNA, 20 bp, Artificial Sequence
  Description of Artificial Sequence: Synthetic oligonucleotide
  Target: ATXN1; (-) strand; PAM type: YTN; PAM sequence: TTG
gggttaaattcattttcact

SEQ ID NO: 155924 - DNA, 20 bp, Artificial Sequence
  Description of Artificial Sequence: Synthetic oligonucleotide
  Target: ATXN1; (-) strand; PAM type: YTN; PAM sequence: CTT
ggggttaaattcattttcac

SEQ ID NO: 155925 - DNA, 20 bp, Artificial Sequence
  Description of Artificial Sequence: Synthetic oligonucleotide
  Target: ATXN1; (-) strand; PAM type: YTN; PAM sequence: TTA
cacagaggtgggagaacgct

SEQ ID NO: 155926 - DNA, 20 bp, Artificial Sequence
  Description of Artificial Sequence: Synthetic oligonucleotide
  Target: ATXN1; (-) strand; PAM type: YTN; PAM sequence: CTC
aaggttacacagaggtggga

SEQ ID NO: 155927 - DNA, 20 bp, Artificial Sequence
  Description of Artificial Sequence: Synthetic oligonucleotide
  Target: ATXN1; (-) strand; PAM type: YTN; PAM sequence: TTC
cagcctcaaggttacacaga

SEQ ID NO: 155928 - DNA, 20 bp, Artificial Sequence
  Description of Artificial Sequence: Synthetic oligonucleotide
  Target: ATXN1; (-) strand; PAM type: YTN; PAM sequence: CTT
ccagcctcaaggttacacag

SEQ ID NO: 155929 - DNA, 20 bp, Artificial Sequence
  Description of Artificial Sequence: Synthetic oligonucleotide
  Target: ATXN1; (-) strand; PAM type: YTN; PAM sequence: CTC
aagaccttccagcctcaagg

SEQ ID NO: 155930 - DNA, 20 bp, Artificial Sequence
  Description of Artificial Sequence: Synthetic oligonucleotide
  Target: ATXN1; (-) strand; PAM type: YTN; PAM sequence: CTC
aacccacctcaagaccttcc

SEQ ID NO: 155931 - DNA, 20 bp, Artificial Sequence
  Description of Artificial Sequence: Synthetic oligonucleotide
  Target: ATXN1; (-) strand; PAM type: YTN; PAM sequence: CTC
aacccacctcaacccacctc

SEQ ID NO: 155932 - DNA, 20 bp, Artificial Sequence
  Description of Artificial Sequence: Synthetic oligonucleotide
  Target: ATXN1; (-) strand; PAM type: YTN; PAM sequence: CTG
cacccacctcaacccacctc

SEQ ID NO: 155933 - DNA, 20 bp, Artificial Sequence
  Description of Artificial Sequence: Synthetic oligonucleotide
  Target: ATXN1; (-) strand; PAM type: YTN; PAM sequence: TTC
caggtggaatcccctgcacc

SEQ ID NO: 155934 - DNA, 20 bp, Artificial Sequence
  Description of Artificial Sequence: Synthetic oligonucleotide
  Target: ATXN1; (-) strand; PAM type: YTN; PAM sequence: CTT
ccaggtggaatcccctgcac

SEQ ID NO: 155935 - DNA, 20 bp, Artificial Sequence
  Description of Artificial Sequence: Synthetic oligonucleotide
  Target: ATXN1; (-) strand; PAM type: YTN; PAM sequence: CTC
aagaacccatagcttccagg

SEQ ID NO: 155936 - DNA, 20 bp, Artificial Sequence
  Description of Artificial Sequence: Synthetic oligonucleotide
  Target: ATXN1; (-) strand; PAM type: YTN; PAM sequence: TTC
ctcaagaacccatagcttcc

SEQ ID NO: 155937 - DNA, 20 bp, Artificial Sequence
  Description of Artificial Sequence: Synthetic oligonucleotide
  Target: ATXN1; (-) strand; PAM type: YTN; PAM sequence: TTG
tgccagaaaaagtaattcct

SEQ ID NO: 155938 - DNA, 20 bp, Artificial Sequence
  Description of Artificial Sequence: Synthetic oligonucleotide
  Target: ATXN1; (-) strand; PAM type: YTN; PAM sequence: TTA
gcagttgtgccagaaaaagt

SEQ ID NO: 155939 - DNA, 20 bp, Artificial Sequence
  Description of Artificial Sequence: Synthetic oligonucleotide
  Target: ATXN1; (-) strand; PAM type: YTN; PAM sequence: CTT
agcagttgtgccagaaaaag

SEQ ID NO: 155940 - DNA, 20 bp, Artificial Sequence
  Description of Artificial Sequence: Synthetic oligonucleotide
  Target: ATXN1; (-) strand; PAM type: YTN; PAM sequence: TTG
gaaagatatggcttagcagt

SEQ ID NO: 155941 - DNA, 20 bp, Artificial Sequence
  Description of Artificial Sequence: Synthetic oligonucleotide
  Target: ATXN1; (-) strand; PAM type: YTN; PAM sequence: CTT
ggaaagatatggcttagcag

SEQ ID NO: 155942 - DNA, 20 bp, Artificial Sequence
  Description of Artificial Sequence: Synthetic oligonucleotide
  Target: ATXN1; (-) strand; PAM type: YTN; PAM sequence: CTG
ggcccagtcttggaaagata

SEQ ID NO: 155943 - DNA, 20 bp, Artificial Sequence
  Description of Artificial Sequence: Synthetic oligonucleotide
  Target: ATXN1; (-) strand; PAM type: YTN; PAM sequence: TTG
cactgggcccagtcttggaa

SEQ ID NO: 155944 - DNA, 20 bp, Artificial Sequence
  Description of Artificial Sequence: Synthetic oligonucleotide
  Target: ATXN1; (-) strand; PAM type: YTN; PAM sequence: TTT
gcactgggcccagtcttgga

SEQ ID NO: 155945 - DNA, 20 bp, Artificial Sequence
  Description of Artificial Sequence: Synthetic oligonucleotide
  Target: ATXN1; (-) strand; PAM type: YTN; PAM sequence: CTT
tgcactgggcccagtcttgg

SEQ ID NO: 155946 - DNA, 20 bp, Artificial Sequence
  Description of Artificial Sequence: Synthetic oligonucleotide
  Target: ATXN1; (-) strand; PAM type: YTN; PAM sequence: TTA
cagctttgcactgggcccag

SEQ ID NO: 155947 - DNA, 20 bp, Artificial Sequence
  Description of Artificial Sequence: Synthetic oligonucleotide
  Target: ATXN1; (-) strand; PAM type: YTN; PAM sequence: CTC
aagagtaccacattacagct

SEQ ID NO: 155948 - DNA, 20 bp, Artificial Sequence
  Description of Artificial Sequence: Synthetic oligonucleotide
  Target: ATXN1; (-) strand; PAM type: YTN; PAM sequence: TTA
cctcaagagtaccacattac

SEQ ID NO: 155949 - DNA, 20 bp, Artificial Sequence
  Description of Artificial Sequence: Synthetic oligonucleotide
  Target: ATXN1; (-) strand; PAM type: YTN; PAM sequence: TTT
acctcaagagtaccacatta

SEQ ID NO: 155950 - DNA, 20 bp, Artificial Sequence
  Description of Artificial Sequence: Synthetic oligonucleotide
  Target: ATXN1; (-) strand; PAM type: YTN; PAM sequence: CTC
cccgtttacctcaagagtac

SEQ ID NO: 155951 - DNA, 20 bp, Artificial Sequence
  Description of Artificial Sequence: Synthetic oligonucleotide
  Target: ATXN1; (-) strand; PAM type: YTN; PAM sequence: CTC
agcatgtggaggaactcccc

SEQ ID NO: 155952 - DNA, 20 bp, Artificial Sequence
  Description of Artificial Sequence: Synthetic oligonucleotide
  Target: ATXN1; (-) strand; PAM type: YTN; PAM sequence: CTC
tcagcatgtggaggaactcc

SEQ ID NO: 155953 - DNA, 20 bp, Artificial Sequence
  Description of Artificial Sequence: Synthetic oligonucleotide
  Target: ATXN1; (-) strand; PAM type: YTN; PAM sequence: CTC
gagcaggtctctcagcatgt

SEQ ID NO: 155954 - DNA, 20 bp, Artificial Sequence
  Description of Artificial Sequence: Synthetic oligonucleotide
  Target: ATXN1; (-) strand; PAM type: YTN; PAM sequence: CTC
ctcgagcaggtctctcagca

SEQ ID NO: 155955 - DNA, 20 bp, Artificial Sequence
  Description of Artificial Sequence: Synthetic oligonucleotide
  Target: ATXN1; (-) strand; PAM type: YTN; PAM sequence: CTC
aaaaacaaaaaaaaaaccca

SEQ ID NO: 155956 - DNA, 20 bp, Artificial Sequence
  Description of Artificial Sequence: Synthetic oligonucleotide
  Target: ATXN1; (-) strand; PAM type: YTN; PAM sequence: CTG
cctcaaaaacaaaaaaaaaa

SEQ ID NO: 155957 - DNA, 20 bp, Artificial Sequence
  Description of Artificial Sequence: Synthetic oligonucleotide
  Target: ATXN1; (-) strand; PAM type: YTN; PAM sequence: CTC
tgcctcaaaaacaaaaaaaa

SEQ ID NO: 155958 - DNA, 20 bp, Artificial Sequence
  Description of Artificial Sequence: Synthetic oligonucleotide
  Target: ATXN1; (-) strand; PAM type: YTN; PAM sequence: CTG
ggcgacagagcaaaactctg

SEQ ID NO: 155959 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcgacagagcaa

SEQ ID NO: 155960 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggcgacag

SEQ ID NO: 155961 - DNA, 20 bp, Artificial Sequence
  Description of Artificial Sequence: Synthetic oligonucleotide
  Target: ATXN1; (-) strand; PAM type: YTN; PAM sequence: CTG
cagtgagccataatcatacc

SEQ ID NO: 155962 - DNA, 20 bp, Artificial Sequence
  Description of Artificial Sequence: Synthetic oligonucleotide
  Target: ATXN1; (-) strand; PAM type: YTN; PAM sequence: CTG
gggccaggaggtcgaggctg

SEQ ID NO: 155963 - DNA, 20 bp, Artificial Sequence
  Description of Artificial Sequence: Synthetic oligonucleotide
  Target: ATXN1; (-) strand; PAM type: YTN; PAM sequence: CTG
aggtgggaggatcgcctggg

SEQ ID NO: 155964 - DNA, 20 bp, Artificial Sequence
  Description of Artificial Sequence: Synthetic oligonucleotide
  Target: ATXN1; (-) strand; PAM type: YTN; PAM sequence: TTA
ggggactgaggtgggaggat

SEQ ID NO: 155965 - DNA, 20 bp, Artificial Sequence
  Description of Artificial Sequence: Synthetic oligonucleotide
  Target: ATXN1; (-) strand; PAM type: YTN; PAM sequence: CTT
aggggactgaggtgggagga

SEQ ID NO: 155966 - DNA, 20 bp, Artificial Sequence
  Description of Artificial Sequence: Synthetic oligonucleotide
  Target: ATXN1; (-) strand; PAM type: YTN; PAM sequence: CTA
cttaggggactgaggtggga

SEQ ID NO: 155967 - DNA, 20 bp, Artificial Sequence
  Description of Artificial Sequence: Synthetic oligonucleotide
  Target: ATXN1; (-) strand; PAM type: YTN; PAM sequence: CTA
tggtcccagctacttagggg

SEQ ID NO: 155968 - DNA, 20 bp, Artificial Sequence
  Description of Artificial Sequence: Synthetic oligonucleotide
  Target: ATXN1; (-) strand; PAM type: YTN; PAM sequence: TTA
gccgggtgtggtggcacata

SEQ ID NO: 155969 - DNA, 20 bp, Artificial Sequence
  Description of Artificial Sequence: Synthetic oligonucleotide
  Target: ATXN1; (-) strand; PAM type: YTN; PAM sequence: CTA
caaaaaatgaaattagccgg

SEQ ID NO: 155970 - DNA, 20 bp, Artificial Sequence
  Description of Artificial Sequence: Synthetic oligonucleotide
  Target: ATXN1; (-) strand; PAM type: YTN; PAM sequence: CTC
tacaaaaaatgaaattagcc

SEQ ID NO: 155971 - DNA, 20 bp, Artificial Sequence
  Description of Artificial Sequence: Synthetic oligonucleotide
  Target: ATXN1; (-) strand; PAM type: YTN; PAM sequence: CTC
atctctacaaaaaatgaaat

SEQ ID NO: 155972 - DNA, 20 bp, Artificial Sequence
  Description of Artificial Sequence: Synthetic oligonucleotide
  Target: ATXN1; (-) strand; PAM type: YTN; PAM sequence: CTA
gtcaacatagtaagacctca

SEQ ID NO: 155973 - DNA, 20 bp, Artificial Sequence
  Description of Artificial Sequence: Synthetic oligonucleotide
  Target: ATXN1; (-) strand; PAM type: YTN; PAM sequence: TTC
gagaccagcctagtcaacat

SEQ ID NO: 155974 - DNA, 20 bp, Artificial Sequence
  Description of Artificial Sequence: Synthetic oligonucleotide
  Target: ATXN1; (-) strand; PAM type: YTN; PAM sequence: TTG
agcccaggagttcgagacca

SEQ ID NO: 155975 - DNA, 20 bp, Artificial Sequence
  Description of Artificial Sequence: Synthetic oligonucleotide
  Target: ATXN1; (-) strand; PAM type: YTN; PAM sequence: CTT
gagcccaggagttcgagacc

SEQ ID NO: 155976 - DNA, 20 bp, Artificial Sequence
  Description of Artificial Sequence: Synthetic oligonucleotide
  Target: ATXN1; (-) strand; PAM type: YTN; PAM sequence: CTG
cttgagcccaggagttcgag

SEQ ID NO: 155977 - DNA, 20 bp, Artificial Sequence
  Description of Artificial Sequence: Synthetic oligonucleotide
  Target: ATXN1; (-) strand; PAM type: YTN; PAM sequence: TTG
gggaggccgaggcacaaggc

SEQ ID NO: 155978 - DNA, 20 bp, Artificial Sequence
  Description of Artificial Sequence: Synthetic oligonucleotide
  Target: ATXN1; (-) strand; PAM type: YTN; PAM sequence: CTC
acgcccataatcccaacagt

SEQ ID NO: 155979 - DNA, 20 bp, Artificial Sequence
  Description of Artificial Sequence: Synthetic oligonucleotide
  Target: ATXN1; (-) strand; PAM type: YTN; PAM sequence: TTC
agcgagcagaccgggcacag

SEQ ID NO: 155980 - DNA, 20 bp, Artificial Sequence
  Description of Artificial Sequence: Synthetic oligonucleotide
  Target: ATXN1; (-) strand; PAM type: YTN; PAM sequence: TTA
gaaattcagcgagcagaccg

SEQ ID NO: 155981 - DNA, 20 bp, Artificial Sequence
  Description of Artificial Sequence: Synthetic oligonucleotide
  Target: ATXN1; (-) strand; PAM type: YTN; PAM sequence: CTC
attagaaattcagcgagcag

SEQ ID NO: 155982 - DNA, 20 bp, Artificial Sequence
  Description of Artificial Sequence: Synthetic oligonucleotide
  Target: ATXN1; (-) strand; PAM type: YTN; PAM sequence: TTC
aagctcattagaaattcagc

SEQ ID NO: 155983 - DNA, 20 bp, Artificial Sequence
  Description of Artificial Sequence: Synthetic oligonucleotide
  Target: ATXN1; (-) strand; PAM type: YTN; PAM sequence: CTG
taattcaagctcattagaaa

SEQ ID NO: 155984 - DNA, 20 bp, Artificial Sequence
  Description of Artificial Sequence: Synthetic oligonucleotide
  Target: ATXN1; (-) strand; PAM type: YTN; PAM sequence: TTC
ctgtaattcaagctcattag

SEQ ID NO: 155985 - DNA, 20 bp, Artificial Sequence
  Description of Artificial Sequence: Synthetic oligonucleotide
  Target: ATXN1; (-) strand; PAM type: YTN; PAM sequence: CTT
cctgtaattcaagctcatta

SEQ ID NO: 155986 - DNA, 20 bp, Artificial Sequence
  Description of Artificial Sequence: Synthetic oligonucleotide
  Target: ATXN1; (-) strand; PAM type: YTN; PAM sequence: TTA
cttcctgtaattcaagctca

SEQ ID NO: 155987 - DNA, 20 bp, Artificial Sequence
  Description of Artificial Sequence: Synthetic oligonucleotide
  Target: ATXN1; (-) strand; PAM type: YTN; PAM sequence: TTT
acttcctgtaattcaagctc

SEQ ID NO: 155988 - DNA, 20 bp, Artificial Sequence
  Description of Artificial Sequence: Synthetic oligonucleotide
  Target: ATXN1; (-) strand; PAM type: YTN; PAM sequence: TTT
tacttcctgtaattcaagct

SEQ ID NO: 155989 - DNA, 20 bp, Artificial Sequence
  Description of Artificial Sequence: Synthetic oligonucleotide
  Target: ATXN1; (-) strand; PAM type: YTN; PAM sequence: TTT
ttacttcctgtaattcaagc

SEQ ID NO: 155990 - DNA, 20 bp, Artificial Sequence
  Description of Artificial Sequence: Synthetic oligonucleotide
  Target: ATXN1; (-) strand; PAM type: YTN; PAM sequence: TTA
tttttacttcctgtaattca

SEQ ID NO: 155991 - DNA, 20 bp, Artificial Sequence
  Description of Artificial Sequence: Synthetic oligonucleotide
  Target: ATXN1; (-) strand; PAM type: YTN; PAM sequence: TTT
atttttacttcctgtaattc

SEQ ID NO: 155992 - DNA, 20 bp, Artificial Sequence
  Description of Artificial Sequence: Synthetic oligonucleotide
  Target: ATXN1; (-) strand; PAM type: YTN; PAM sequence: CTG
taagtggaaaatttattttt

SEQ ID NO: 155993 - DNA, 20 bp, Artificial Sequence
  Description of Artificial Sequence: Synthetic oligonucleotide
  Target: ATXN1; (-) strand; PAM type: YTN; PAM sequence: TTA
gtggtctgtaagtggaaaat

SEQ ID NO: 155994 - DNA, 20 bp, Artificial Sequence
  Description of Artificial Sequence: Synthetic oligonucleotide
  Target: ATXN1; (-) strand; PAM type: YTN; PAM sequence: CTG
gttagtggtctgtaagtgga

SEQ ID NO: 155995 - DNA, 20 bp, Artificial Sequence
  Description of Artificial Sequence: Synthetic oligonucleotide
  Target: ATXN1; (-) strand; PAM type: YTN; PAM sequence: CTA
aactggttagtggtctgtaa

SEQ ID NO: 155996 - DNA, 20 bp, Artificial Sequence
  Description of Artificial Sequence: Synthetic oligonucleotide
  Target: ATXN1; (-) strand; PAM type: YTN; PAM sequence: CTC
taaactggttagtggtctgt

SEQ ID NO: 155997 - DNA, 20 bp, Artificial Sequence
  Description of Artificial Sequence: Synthetic oligonucleotide
  Target: ATXN1; (-) strand; PAM type: YTN; PAM sequence: TTG
ctctaaactggttagtggtc

SEQ ID NO: 155998 - DNA, 20 bp, Artificial Sequence
  Description of Artificial Sequence: Synthetic oligonucleotide
  Target: ATXN1; (-) strand; PAM type: YTN; PAM sequence: TTT
gctctaaactggttagtggt

SEQ ID NO: 155999 - DNA, 20 bp, Artificial Sequence
  Description of Artificial Sequence: Synthetic oligonucleotide
  Target: ATXN1; (-) strand; PAM type: YTN; PAM sequence: TTA
cagatttgctctaaactggt

SEQ ID NO: 156000 - DNA, 20 bp, Artificial Sequence
  Description of Artificial Sequence: Synthetic oligonucleotide
  Target: ATXN1; (-) strand; PAM type: YTN; PAM sequence: CTT
acagatttgctctaaactgg

SEQ ID NO: 156001 - DNA, 20 bp, Artificial Sequence
  Description of Artificial Sequence: Synthetic oligonucleotide
  Target: ATXN1; (-) strand; PAM type: YTN; PAM sequence: CTC
cttacagatttgctctaaac

SEQ ID NO: 156002 - DNA, 20 bp, Artificial Sequence
  Description of Artificial Sequence: Synthetic oligonucleotide
  Target: ATXN1; (-) strand; PAM type: YTN; PAM sequence: CTA
tacactccttacagatttgc

SEQ ID NO: 156003 - DNA, 20 bp, Artificial Sequence
  Description of Artificial Sequence: Synthetic oligonucleotide
  Target: ATXN1; (-) strand; PAM type: YTN; PAM sequence: CTC
gtgtggcataatctatacac

SEQ ID NO: 156004 - DNA, 20 bp, Artificial Sequence
  Description of Artificial Sequence: Synthetic oligonucleotide
  Target: ATXN1; (-) strand; PAM type: YTN; PAM sequence: TTC
atgcgctcgtgtggcataat

SEQ ID NO: 156005 - DNA, 20 bp, Artificial Sequence
  Description of Artificial Sequence: Synthetic oligonucleotide
  Target: ATXN1; (-) strand; PAM type: YTN; PAM sequence: CTT
catgcgctcgtgtggcataa

SEQ ID NO: 156006 - DNA, 20 bp, Artificial Sequence
  Description of Artificial Sequence: Synthetic oligonucleotide
  Target: ATXN1; (-) strand; PAM type: YTN; PAM sequence: TTA
aacatgtggtagcttcatgc

SEQ ID NO: 156007 - DNA, 20 bp, Artificial Sequence
  Description of Artificial Sequence: Synthetic oligonucleotide
  Target: ATXN1; (-) strand; PAM type: YTN; PAM sequence: TTT
aaacatgtggtagcttcatg

SEQ ID NO: 156008 - DNA, 20 bp, Artificial Sequence
  Description of Artificial Sequence: Synthetic oligonucleotide
  Target: ATXN1; (-) strand; PAM type: YTN; PAM sequence: CTT
taaacatgtggtagcttcat

SEQ ID NO: 156009 - DNA, 20 bp, Artificial Sequence
  Description of Artificial Sequence: Synthetic oligonucleotide
  Target: ATXN1; (-) strand; PAM type: YTN; PAM sequence: TTG
tctttaaacatgtggtagct

SEQ ID NO: 156010 - DNA, 20 bp, Artificial Sequence
  Description of Artificial Sequence: Synthetic oligonucleotide
  Target: ATXN1; (-) strand; PAM type: YTN; PAM sequence: CTT
gtctttaaacatgtggtagc

SEQ ID NO: 156011 - DNA, 20 bp, Artificial Sequence
  Description of Artificial Sequence: Synthetic oligonucleotide
  Target: ATXN1; (-) strand; PAM type: YTN; PAM sequence: TTC
acaagaggtatacttgtctt

SEQ ID NO: 156012 - DNA, 20 bp, Artificial Sequence
  Description of Artificial Sequence: Synthetic oligonucleotide
  Target: ATXN1; (-) strand; PAM type: YTN; PAM sequence: CTG
ttcacaagaggtatacttgt

SEQ ID NO: 156013 - DNA, 20 bp, Artificial Sequence
  Description of Artificial Sequence: Synthetic oligonucleotide
  Target: ATXN1; (-) strand; PAM type: YTN; PAM sequence: CTG
ctgttcacaagaggtatact

SEQ ID NO: 156014 - DNA, 20 bp, Artificial Sequence
  Description of Artificial Sequence: Synthetic oligonucleotide
  Target: ATXN1; (-) strand; PAM type: YTN; PAM sequence: CTG
aacactgctgttcacaagag

SEQ ID NO: 156015 - DNA, 20 bp, Artificial Sequence
  Description of Artificial Sequence: Synthetic oligonucleotide
  Target: ATXN1; (-) strand; PAM type: YTN; PAM sequence: CTA
gctgaacactgctgttcaca

SEQ ID NO: 156016 - DNA, 20 bp, Artificial Sequence
  Description of Artificial Sequence: Synthetic oligonucleotide
  Target: ATXN1; (-) strand; PAM type: YTN; PAM sequence: CTC
ctagctgaacactgctgttc

SEQ ID NO: 156017 - DNA, 20 bp, Artificial Sequence
  Description of Artificial Sequence: Synthetic oligonucleotide
  Target: ATXN1; (-) strand; PAM type: YTN; PAM sequence: TTA
tgcctcctagctgaacactg

SEQ ID NO: 156018 - DNA, 20 bp, Artificial Sequence
  Description of Artificial Sequence: Synthetic oligonucleotide
  Target: ATXN1; (-) strand; PAM type: YTN; PAM sequence: TTT
atgcctcctagctgaacact

SEQ ID NO: 156019 - DNA, 20 bp, Artificial Sequence
  Description of Artificial Sequence: Synthetic oligonucleotide
  Target: ATXN1; (-) strand; PAM type: YTN; PAM sequence: TTC
atgtttatgcctcctagctg

SEQ ID NO: 156020 - DNA, 20 bp, Artificial Sequence
  Description of Artificial Sequence: Synthetic oligonucleotide
  Target: ATXN1; (-) strand; PAM type: YTN; PAM sequence: TTC
agttcatgtttatgcctcct

SEQ ID NO: 156021 - DNA, 20 bp, Artificial Sequence
  Description of Artificial Sequence: Synthetic oligonucleotide
  Target: ATXN1; (-) strand; PAM type: YTN; PAM sequence: CTT
cagttcatgtttatgcctcc

SEQ ID NO: 156022 - DNA, 20 bp, Artificial Sequence
  Description of Artificial Sequence: Synthetic oligonucleotide
  Target: ATXN1; (-) strand; PAM type: YTN; PAM sequence: TTC
ttcagttcatgtttatgcct

SEQ ID NO: 156023 - DNA, 20 bp, Artificial Sequence
  Description of Artificial Sequence: Synthetic oligonucleotide
  Target: ATXN1; (-) strand; PAM type: YTN; PAM sequence: TTT
cttcagttcatgtttatgcc

SEQ ID NO: 156024 - DNA, 20 bp, Artificial Sequence
  Description of Artificial Sequence: Synthetic oligonucleotide
  Target: ATXN1; (-) strand; PAM type: YTN; PAM sequence: TTG
gtttcttcagttcatgttta

SEQ ID NO: 156025 - DNA, 20 bp, Artificial Sequence
  Description of Artificial Sequence: Synthetic oligonucleotide
  Target: ATXN1; (-) strand; PAM type: YTN; PAM sequence: CTT
ggtttcttcagttcatgttt

SEQ ID NO: 156026 - DNA, 20 bp, Artificial Sequence
  Description of Artificial Sequence: Synthetic oligonucleotide
  Target: ATXN1; (-) strand; PAM type: YTN; PAM sequence: CTG
atgtcttggtttcttcagtt

SEQ ID NO: 156027 - DNA, 20 bp, Artificial Sequence
  Description of Artificial Sequence: Synthetic oligonucleotide
  Target: ATXN1; (-) strand; PAM type: YTN; PAM sequence: CTA
agataaaaggcacacagcca

SEQ ID NO: 156028 - DNA, 20 bp, Artificial Sequence
  Description of Artificial Sequence: Synthetic oligonucleotide
  Target: ATXN1; (-) strand; PAM type: YTN; PAM sequence: TTC
taagataaaaggcacacagc

SEQ ID NO: 156029 - DNA, 20 bp, Artificial Sequence
  Description of Artificial Sequence: Synthetic oligonucleotide
  Target: ATXN1; (-) strand; PAM type: YTN; PAM sequence: TTG
gggggaagagtacgtgtgag

SEQ ID NO: 156030 - DNA, 20 bp, Artificial Sequence
  Description of Artificial Sequence: Synthetic oligonucleotide
  Target: ATXN1; (-) strand; PAM type: YTN; PAM sequence: TTT
ggggggaagagtacgtgtga

SEQ ID NO: 156031 - DNA, 20 bp, Artificial Sequence
  Description of Artificial Sequence: Synthetic oligonucleotide
  Target: ATXN1; (-) strand; PAM type: YTN; PAM sequence: TTT
tggggggaagagtacgtgtg

SEQ ID NO: 156032 - DNA, 20 bp, Artificial Sequence
  Description of Artificial Sequence: Synthetic oligonucleotide
  Target: ATXN1; (-) strand; PAM type: YTN; PAM sequence: CTA
atgttttggggggaagagta

SEQ ID NO: 156033 - DNA, 20 bp, Artificial Sequence
  Description of Artificial Sequence: Synthetic oligonucleotide
  Target: ATXN1; (-) strand; PAM type: YTN; PAM sequence: CTG
ctaatgttttggggggaaga

SEQ ID NO: 156034 - DNA, 20 bp, Artificial Sequence
  Description of Artificial Sequence: Synthetic oligonucleotide
  Target: ATXN1; (-) strand; PAM type: YTN; PAM sequence: TTC
gctgctaatgttttgggggg

SEQ ID NO: 156035 - DNA, 20 bp, Artificial Sequence
  Description of Artificial Sequence: Synthetic oligonucleotide
  Target: ATXN1; (-) strand; PAM type: YTN; PAM sequence: CTT
cgctgctaatgttttggggg

SEQ ID NO: 156036 - DNA, 20 bp, Artificial Sequence
  Description of Artificial Sequence: Synthetic oligonucleotide
  Target: ATXN1; (-) strand; PAM type: YTN; PAM sequence: TTG
ccttcgctgctaatgttttg

SEQ ID NO: 156037 - DNA, 20 bp, Artificial Sequence
  Description of Artificial Sequence: Synthetic oligonucleotide
  Target: ATXN1; (-) strand; PAM type: YTN; PAM sequence: CTG
ggtaggtcggaggtagggag

SEQ ID NO: 156038 - DNA, 20 bp, Artificial Sequence
  Description of Artificial Sequence: Synthetic oligonucleotide
  Target: ATXN1; (-) strand; PAM type: YTN; PAM sequence: CTC
cctgggtaggtcggaggtag

SEQ ID NO: 156039 - DNA, 20 bp, Artificial Sequence
  Description of Artificial Sequence: Synthetic oligonucleotide
  Target: ATXN1; (-) strand; PAM type: YTN; PAM sequence: TTC
tccctgggtaggtcggaggt

SEQ ID NO: 156040 - DNA, 20 bp, Artificial Sequence
  Description of Artificial Sequence: Synthetic oligonucleotide
  Target: ATXN1; (-) strand; PAM type: YTN; PAM sequence: CTC
acgagttctccctgggtagg

SEQ ID NO: 156041 - DNA, 20 bp, Artificial Sequence
  Description of Artificial Sequence: Synthetic oligonucleotide
  Target: ATXN1; (-) strand; PAM type: YTN; PAM sequence: TTG
acccccgctcacgagttctc

SEQ ID NO: 156042 - DNA, 20 bp, Artificial Sequence
  Description of Artificial Sequence: Synthetic oligonucleotide
  Target: ATXN1; (-) strand; PAM type: YTN; PAM sequence: TTA
ttgacccccgctcacgagtt

SEQ ID NO: 156043 - DNA, 20 bp, Artificial Sequence
  Description of Artificial Sequence: Synthetic oligonucleotide
  Target: ATXN1; (-) strand; PAM type: YTN; PAM sequence: CTT
attgacccccgctcacgagt

SEQ ID NO: 156044 - DNA, 20 bp, Artificial Sequence
  Description of Artificial Sequence: Synthetic oligonucleotide
  Target: ATXN1; (-) strand; PAM type: YTN; PAM sequence: CTC
cttattgacccccgctcacg

SEQ ID NO: 156045 - DNA, 20 bp, Artificial Sequence
  Description of Artificial Sequence: Synthetic oligonucleotide
  Target: ATXN1; (-) strand; PAM type: YTN; PAM sequence: CTC
ctccttattgacccccgctc

SEQ ID NO: 156046 - DNA, 20 bp, Artificial Sequence
  Description of Artificial Sequence: Synthetic oligonucleotide
  Target: ATXN1; (-) strand; PAM type: YTN; PAM sequence: TTC
ctcctccttattgacccccg

SEQ ID NO: 156047 - DNA, 20 bp, Artificial Sequence
  Description of Artificial Sequence: Synthetic oligonucleotide
  Target: ATXN1; (-) strand; PAM type: YTN; PAM sequence: CTA
attcctcctccttattgacc

SEQ ID NO: 156048 - DNA, 20 bp, Artificial Sequence
  Description of Artificial Sequence: Synthetic oligonucleotide
  Target: ATXN1; (-) strand; PAM type: YTN; PAM sequence: CTC
aaggaagaggccaggaaaag

SEQ ID NO: 156049 - DNA, 20 bp, Artificial Sequence
  Description of Artificial Sequence: Synthetic oligonucleotide
  Target: ATXN1; (-) strand; PAM type: YTN; PAM sequence: TTG
ggtcctcaaggaagaggcca

SEQ ID NO: 156050 - DNA, 20 bp, Artificial Sequence
  Description of Artificial Sequence: Synthetic oligonucleotide
  Target: ATXN1; (-) strand; PAM type: YTN; PAM sequence: CTG
ttgggtcctcaaggaagagg

SEQ ID NO: 156051 - DNA, 20 bp, Artificial Sequence
  Description of Artificial Sequence: Synthetic oligonucleotide
  Target: ATXN1; (-) strand; PAM type: YTN; PAM sequence: TTC
tgttgggtcctcaaggaaga

SEQ ID NO: 156052 - DNA, 20 bp, Artificial Sequence
  Description of Artificial Sequence: Synthetic oligonucleotide
  Target: ATXN1; (-) strand; PAM type: YTN; PAM sequence: CTT
ctgttgggtcctcaaggaag

SEQ ID NO: 156053 - DNA, 20 bp, Artificial Sequence
  Description of Artificial Sequence: Synthetic oligonucleotide
  Target: ATXN1; (-) strand; PAM type: YTN; PAM sequence: TTG
ccttctgttgggtcctcaag

SEQ ID NO: 156054 - DNA, 20 bp, Artificial Sequence
  Description of Artificial Sequence: Synthetic oligonucleotide
  Target: ATXN1; (-) strand; PAM type: YTN; PAM sequence: TTT
gccttctgttgggtcctcaa

SEQ ID NO: 156055 - DNA, 20 bp, Artificial Sequence
  Description of Artificial Sequence: Synthetic oligonucleotide
  Target: ATXN1; (-) strand; PAM type: YTN; PAM sequence: CTT
tgccttctgttgggtcctca

SEQ ID NO: 156056 - DNA, 20 bp, Artificial Sequence
  Description of Artificial Sequence: Synthetic oligonucleotide
  Target: ATXN1; (-) strand; PAM type: YTN; PAM sequence: TTG
cagatgtgtgtctttgcctt

SEQ ID NO: 156057 - DNA, 20 bp, Artificial Sequence
  Description of Artificial Sequence: Synthetic oligonucleotide
  Target: ATXN1; (-) strand; PAM type: YTN; PAM sequence: CTA
ataaaataacagtgccaatt

SEQ ID NO: 156058 - DNA, 20 bp, Artificial Sequence
  Description of Artificial Sequence: Synthetic oligonucleotide
  Target: ATXN1; (-) strand; PAM type: YTN; PAM sequence: CTC
gtactaataaaataacagtg

SEQ ID NO: 156059 - DNA, 20 bp, Artificial Sequence
  Description of Artificial Sequence: Synthetic oligonucleotide
  Target: ATXN1; (-) strand; PAM type: YTN; PAM sequence: TTC
agtatactcgtactaataaa

SEQ ID NO: 156060 - DNA, 20 bp, Artificial Sequence
  Description of Artificial Sequence: Synthetic oligonucleotide
  Target: ATXN1; (-) strand; PAM type: YTN; PAM sequence: TTT
cagtatactcgtactaataa

SEQ ID NO: 156061 - DNA, 20 bp, Artificial Sequence
  Description of Artificial Sequence: Synthetic oligonucleotide
  Target: ATXN1; (-) strand; PAM type: YTN; PAM sequence: TTG
tttcagtatactcgtactaa

SEQ ID NO: 156062 - DNA, 20 bp, Artificial Sequence
  Description of Artificial Sequence: Synthetic oligonucleotide
  Target: ATXN1; (-) strand; PAM type: YTN; PAM sequence: TTA
ttgtttcagtatactcgtac

SEQ ID NO: 156063 - DNA, 20 bp, Artificial Sequence
  Description of Artificial Sequence: Synthetic oligonucleotide
  Target: ATXN1; (-) strand; PAM type: YTN; PAM sequence: TTT
attgtttcagtatactcgta

SEQ ID NO: 156064 - DNA, 20 bp, Artificial Sequence
  Description of Artificial Sequence: Synthetic oligonucleotide
  Target: ATXN1; (-) strand; PAM type: YTN; PAM sequence: CTG
tataccagtacaagtttatt

SEQ ID NO: 156065 - DNA, 20 bp, Artificial Sequence
  Description of Artificial Sequence: Synthetic oligonucleotide
  Target: ATXN1; (-) strand; PAM type: YTN; PAM sequence: TTG
tctgtataccagtacaagtt

SEQ ID NO: 156066 - DNA, 20 bp, Artificial Sequence
  Description of Artificial Sequence: Synthetic oligonucleotide
  Target: ATXN1; (-) strand; PAM type: YTN; PAM sequence: TTA
aataaattgtctgtatacca

SEQ ID NO: 156067 - DNA, 20 bp, Artificial Sequence
  Description of Artificial Sequence: Synthetic oligonucleotide
  Target: ATXN1; (-) strand; PAM type: YTN; PAM sequence: TTT
aaataaattgtctgtatacc

SEQ ID NO: 156068 - DNA, 20 bp, Artificial Sequence
  Description of Artificial Sequence: Synthetic oligonucleotide
  Target: ATXN1; (-) strand; PAM type: YTN; PAM sequence: TTT
taaataaattgtctgtatac

SEQ ID NO: 156069 - DNA, 20 bp, Artificial Sequence
  Description of Artificial Sequence: Synthetic oligonucleotide
  Target: ATXN1; (-) strand; PAM type: YTN; PAM sequence: TTG
ttttaaataaattgtctgta

SEQ ID NO: 156070 - DNA, 20 bp, Artificial Sequence
  Description of Artificial Sequence: Synthetic oligonucleotide
  Target: ATXN1; (-) strand; PAM type: YTN; PAM sequence: TTG
aacaaaattgttttaaataa

SEQ ID NO: 156071 - DNA, 20 bp, Artificial Sequence
  Description of Artificial Sequence: Synthetic oligonucleotide
  Target: ATXN1; (-) strand; PAM type: YTN; PAM sequence: TTT
gaacaaaattgttttaaata

SEQ ID NO: 156072 - DNA, 20 bp, Artificial Sequence
  Description of Artificial Sequence: Synthetic oligonucleotide
  Target: ATXN1; (-) strand; PAM type: YTN; PAM sequence: TTC
aaaatttgaacaaaattgtt

SEQ ID NO: 156073 - DNA, 20 bp, Artificial Sequence
  Description of Artificial Sequence: Synthetic oligonucleotide
  Target: ATXN1; (-) strand; PAM type: YTN; PAM sequence: TTG
attcaaaatttgaacaaaat

SEQ ID NO: 156074 - DNA, 20 bp, Artificial Sequence
  Description of Artificial Sequence: Synthetic oligonucleotide
  Target: ATXN1; (-) strand; PAM type: YTN; PAM sequence: TTT
gattcaaaatttgaacaaaa

SEQ ID NO: 156075 - DNA, 20 bp, Artificial Sequence
  Description of Artificial Sequence: Synthetic oligonucleotide
  Target: ATXN1; (-) strand; PAM type: YTN; PAM sequence: TTA
taataaaacaatgtttgatt

SEQ ID NO: 156076 - DNA, 20 bp, Artificial Sequence
  Description of Artificial Sequence: Synthetic oligonucleotide
  Target: ATXN1; (-) strand; PAM type: YTN; PAM sequence: TTA
ttataataaaacaatgtttg

SEQ ID NO: 156077 - DNA, 20 bp, Artificial Sequence
  Description of Artificial Sequence: Synthetic oligonucleotide
  Target: ATXN1; (-) strand; PAM type: YTN; PAM sequence: TTC
attattataataaaacaatg

SEQ ID NO: 156078 - DNA, 20 bp, Artificial Sequence
  Description of Artificial Sequence: Synthetic oligonucleotide
  Target: ATXN1; (-) strand; PAM type: YTN; PAM sequence: TTT
cattattataataaaacaat

SEQ ID NO: 156079 - DNA, 20 bp, Artificial Sequence
  Description of Artificial Sequence: Synthetic oligonucleotide
  Target: ATXN1; (-) strand; PAM type: YTN; PAM sequence: TTA
tttcattattataataaaac

SEQ ID NO: 156080 - DNA, 20 bp, Artificial Sequence
  Description of Artificial Sequence: Synthetic oligonucleotide
  Target: ATXN1; (-) strand; PAM type: YTN; PAM sequence: CTA
ggtagaaattatttcattat

SEQ ID NO: 156081 - DNA, 20 bp, Artificial Sequence
  Description of Artificial Sequence: Synthetic oligonucleotide
  Target: ATXN1; (-) strand; PAM type: YTN; PAM sequence: TTC
taggtagaaattatttcatt

SEQ ID NO: 156082 - DNA, 20 bp, Artificial Sequence
  Description of Artificial Sequence: Synthetic oligonucleotide
  Target: ATXN1; (-) strand; PAM type: YTN; PAM sequence: TTT
ctaggtagaaattatttcat

SEQ ID NO: 156083 - DNA, 20 bp, Artificial Sequence
  Description of Artificial Sequence: Synthetic oligonucleotide
  Target: ATXN1; (-) strand; PAM type: YTN; PAM sequence: TTT
tctaggtagaaattatttca

SEQ ID NO: 156084 - DNA, 20 bp, Artificial Sequence
  Description of Artificial Sequence: Synthetic oligonucleotide
  Target: ATXN1; (-) strand; PAM type: YTN; PAM sequence: TTG
caggttttctaggtagaaat

SEQ ID NO: 156085 - DNA, 20 bp, Artificial Sequence
  Description of Artificial Sequence: Synthetic oligonucleotide
  Target: ATXN1; (-) strand; PAM type: YTN; PAM sequence: CTT
gcaggttttctaggtagaaa

SEQ ID NO: 156086 - DNA, 20 bp, Artificial Sequence
  Description of Artificial Sequence: Synthetic oligonucleotide
  Target: ATXN1; (-) strand; PAM type: YTN; PAM sequence: TTG
atggtgcttgcaggttttct

SEQ ID NO: 156087 - DNA, 20 bp, Artificial Sequence
  Description of Artificial Sequence: Synthetic oligonucleotide
  Target: ATXN1; (-) strand; PAM type: YTN; PAM sequence: TTT
gatggtgcttgcaggttttc

SEQ ID NO: 156088 - DNA, 20 bp, Artificial Sequence
  Description of Artificial Sequence: Synthetic oligonucleotide
  Target: ATXN1; (-) strand; PAM type: YTN; PAM sequence: CTT
tgatggtgcttgcaggtttt

SEQ ID NO: 156089 - DNA, 20 bp, Artificial Sequence
  Description of Artificial Sequence: Synthetic oligonucleotide
  Target: ATXN1; (-) strand; PAM type: YTN; PAM sequence: TTC
tttgatggtgcttgcaggtt

SEQ ID NO: 156090 - DNA, 20 bp, Artificial Sequence
  Description of Artificial Sequence: Synthetic oligonucleotide
  Target: ATXN1; (-) strand; PAM type: YTN; PAM sequence: TTT
ctttgatggtgcttgcaggt

SEQ ID NO: 156091 - DNA, 20 bp, Artificial Sequence
  Description of Artificial Sequence: Synthetic oligonucleotide
  Target: ATXN1; (-) strand; PAM type: YTN; PAM sequence: CTT
tctttgatggtgcttgcagg

SEQ ID NO: 156092 - DNA, 20 bp, Artificial Sequence
  Description of Artificial Sequence: Synthetic oligonucleotide
  Target: ATXN1; (-) strand; PAM type: YTN; PAM sequence: TTA
tggtccctttctttgatggt

SEQ ID NO: 156093 - DNA, 20 bp, Artificial Sequence
  Description of Artificial Sequence: Synthetic oligonucleotide
  Target: ATXN1; (-) strand; PAM type: YTN; PAM sequence: TTT
atggtccctttctttgatgg

SEQ ID NO: 156094 - DNA, 20 bp, Artificial Sequence
  Description of Artificial Sequence: Synthetic oligonucleotide
  Target: ATXN1; (-) strand; PAM type: YTN; PAM sequence: TTT
tatggtccctttctttgatg

SEQ ID NO: 156095 - DNA, 20 bp, Artificial Sequence
  Description of Artificial Sequence: Synthetic oligonucleotide
  Target: ATXN1; (-) strand; PAM type: YTN; PAM sequence: TTG
aattttatggtccctttctt

SEQ ID NO: 156096 - DNA, 20 bp, Artificial Sequence
  Description of Artificial Sequence: Synthetic oligonucleotide
  Target: ATXN1; (-) strand; PAM type: YTN; PAM sequence: TTA
ttgaattttatggtcccttt

SEQ ID NO: 156097 - DNA, 20 bp, Artificial Sequence
  Description of Artificial Sequence: Synthetic oligonucleotide
  Target: ATXN1; (-) strand; PAM type: YTN; PAM sequence: TTT
attgaattttatggtccctt

SEQ ID NO: 156098 - DNA, 20 bp, Artificial Sequence
  Description of Artificial Sequence: Synthetic oligonucleotide
  Target: ATXN1; (-) strand; PAM type: YTN; PAM sequence: CTG
tttattgaattttatggtcc

SEQ ID NO: 156099 - DNA, 20 bp, Artificial Sequence
  Description of Artificial Sequence: Synthetic oligonucleotide
  Target: ATXN1; (-) strand; PAM type: YTN; PAM sequence: CTC
gagtctgtttattgaatttt

SEQ ID NO: 156100 - DNA, 20 bp, Artificial Sequence
  Description of Artificial Sequence: Synthetic oligonucleotide
  Target: ATXN1; (-) strand; PAM type: YTN; PAM sequence: TTG
taggatacactcgagtctgt

SEQ ID NO: 156101 - DNA, 20 bp, Artificial Sequence
  Description of Artificial Sequence: Synthetic oligonucleotide
  Target: ATXN1; (-) strand; PAM type: YTN; PAM sequence: TTT
gtaggatacactcgagtctg

SEQ ID NO: 156102 - DNA, 20 bp, Artificial Sequence
  Description of Artificial Sequence: Synthetic oligonucleotide
  Target: ATXN1; (-) strand; PAM type: YTN; PAM sequence: CTA
tttgtaggatacactcgagt

SEQ ID NO: 156103 - DNA, 20 bp, Artificial Sequence
  Description of Artificial Sequence: Synthetic oligonucleotide
  Target: ATXN1; (-) strand; PAM type: YTN; PAM sequence: CTA
atcgtggtgtgtctatttgt

SEQ ID NO: 156104 - DNA, 20 bp, Artificial Sequence
  Description of Artificial Sequence: Synthetic oligonucleotide
  Target: ATXN1; (-) strand; PAM type: YTN; PAM sequence: TTC
taatcgtggtgtgtctattt

SEQ ID NO: 156105 - DNA, 20 bp, Artificial Sequence
  Description of Artificial Sequence: Synthetic oligonucleotide
  Target: ATXN1; (-) strand; PAM type: YTN; PAM sequence: TTT
ctaatcgtggtgtgtctatt

SEQ ID NO: 156106 - DNA, 20 bp, Artificial Sequence
  Description of Artificial Sequence: Synthetic oligonucleotide
  Target: ATXN1; (-) strand; PAM type: YTN; PAM sequence: TTT
tctaatcgtggtgtgtctat

SEQ ID NO: 156107 - DNA, 20 bp, Artificial Sequence
  Description of Artificial Sequence: Synthetic oligonucleotide
  Target: ATXN1; (-) strand; PAM type: YTN; PAM sequence: CTA
ttttctaatcgtggtgtgtc

SEQ ID NO: 156108 - DNA, 20 bp, Artificial Sequence
  Description of Artificial Sequence: Synthetic oligonucleotide
  Target: ATXN1; (-) strand; PAM type: YTN; PAM sequence: TTC
tattttctaatcgtggtgtg

SEQ ID NO: 156109 - DNA, 20 bp, Artificial Sequence
  Description of Artificial Sequence: Synthetic oligonucleotide
  Target: ATXN1; (-) strand; PAM type: YTN; PAM sequence: TTC
atattctattttctaatcgt

SEQ ID NO: 156110 - DNA, 20 bp, Artificial Sequence
  Description of Artificial Sequence: Synthetic oligonucleotide
  Target: ATXN1; (-) strand; PAM type: YTN; PAM sequence: TTA
aaaaatggaagaattcatat

SEQ ID NO: 156111 - DNA, 20 bp, Artificial Sequence
  Description of Artificial Sequence: Synthetic oligonucleotide
  Target: ATXN1; (-) strand; PAM type: YTN; PAM sequence: TTA
aacaaatattaaaaaatgga

SEQ ID NO: 156112 - DNA, 20 bp, Artificial Sequence
  Description of Artificial Sequence: Synthetic oligonucleotide
  Target: ATXN1; (-) strand; PAM type: YTN; PAM sequence: TTT
aaacaaatattaaaaaatgg

SEQ ID NO: 156113 - DNA, 20 bp, Artificial Sequence
  Description of Artificial Sequence: Synthetic oligonucleotide
  Target: ATXN1; (-) strand; PAM type: YTN; PAM sequence: TTT
taaacaaatattaaaaaatg

SEQ ID NO: 156114 - DNA, 20 bp, Artificial Sequence
  Description of Artificial Sequence: Synthetic oligonucleotide
  Target: ATXN1; (-) strand; PAM type: YTN; PAM sequence: TTT
ttaaacaaatattaaaaaat

SEQ ID NO: 156115 - DNA, 20 bp, Artificial Sequence
  Description of Artificial Sequence: Synthetic oligonucleotide
  Target: ATXN1; (-) strand; PAM type: YTN; PAM sequence: TTT
tttaaacaaatattaaaaaa

SEQ ID NO: 156116 - DNA, 20 bp, Artificial Sequence
  Description of Artificial Sequence: Synthetic oligonucleotide
  Target: ATXN1; (-) strand; PAM type: YTN; PAM sequence: CTT
ttttaaacaaatattaaaaa

SEQ ID NO: 156117 - DNA, 20 bp, Artificial Sequence
  Description of Artificial Sequence: Synthetic oligonucleotide
  Target: ATXN1; (-) strand; PAM type: YTN; PAM sequence: CTA
gcttttttaaacaaatatta

SEQ ID NO: 156118 - DNA, 20 bp, Artificial Sequence
  Description of Artificial Sequence: Synthetic oligonucleotide
  Target: ATXN1; (-) strand; PAM type: YTN; PAM sequence: TTG
cactagcttttttaaacaaa

SEQ ID NO: 156119 - DNA, 20 bp, Artificial Sequence
  Description of Artificial Sequence: Synthetic oligonucleotide
  Target: ATXN1; (-) strand; PAM type: YTN; PAM sequence: CTT
gcactagcttttttaaacaa

SEQ ID NO: 156120 - DNA, 20 bp, Artificial Sequence
  Description of Artificial Sequence: Synthetic oligonucleotide
  Target: ATXN1; (-) strand; PAM type: YTN; PAM sequence: TTG
tacttgcactagctttttta

SEQ ID NO: 156121 - DNA, 20 bp, Artificial Sequence
  Description of Artificial Sequence: Synthetic oligonucleotide
  Target: ATXN1; (-) strand; PAM type: YTN; PAM sequence: TTC
cagtgtaaaatattgtactt

SEQ ID NO: 156122 - DNA, 20 bp, Artificial Sequence
  Description of Artificial Sequence: Synthetic oligonucleotide
  Target: ATXN1; (-) strand; PAM type: YTN; PAM sequence: CTG
taattccagtgtaaaatatt

SEQ ID NO: 156123 - DNA, 20 bp, Artificial Sequence
  Description of Artificial Sequence: Synthetic oligonucleotide
  Target: ATXN1; (-) strand; PAM type: YTN; PAM sequence: CTC
tgtaattccagtgtaaaata

SEQ ID NO: 156124 - DNA, 20 bp, Artificial Sequence
  Description of Artificial Sequence: Synthetic oligonucleotide
  Target: ATXN1; (-) strand; PAM type: YTN; PAM sequence: CTC
tctgtaattccagtgtaaaa

SEQ ID NO: 156125 - DNA, 20 bp, Artificial Sequence
  Description of Artificial Sequence: Synthetic oligonucleotide
  Target: ATXN1; (-) strand; PAM type: YTN; PAM sequence: TTC
catatgcgtgcatactctct

SEQ ID NO: 156126 - DNA, 20 bp, Artificial Sequence
  Description of Artificial Sequence: Synthetic oligonucleotide
  Target: ATXN1; (-) strand; PAM type: YTN; PAM sequence: TTT
ccatatgcgtgcatactctc

SEQ ID NO: 156127 - DNA, 20 bp, Artificial Sequence
  Description of Artificial Sequence: Synthetic oligonucleotide
  Target: ATXN1; (-) strand; PAM type: YTN; PAM sequence: TTT
tccatatgcgtgcatactct

SEQ ID NO: 156128 - DNA, 20 bp, Artificial Sequence
  Description of Artificial Sequence: Synthetic oligonucleotide
  Target: ATXN1; (-) strand; PAM type: YTN; PAM sequence: TTT
ttccatatgcgtgcatactc

SEQ ID NO: 156129 - DNA, 20 bp, Artificial Sequence
  Description of Artificial Sequence: Synthetic oligonucleotide
  Target: ATXN1; (-) strand; PAM type: YTN; PAM sequence: TTT
tttccatatgcgtgcatact

SEQ ID NO: 156130 - DNA, 20 bp, Artificial Sequence
  Description of Artificial Sequence: Synthetic oligonucleotide
  Target: ATXN1; (-) strand; PAM type: YTN; PAM sequence: CTT
ttttccatatgcgtgcatac

SEQ ID NO: 156131 - DNA, 20 bp, Artificial Sequence
  Description of Artificial Sequence: Synthetic oligonucleotide
  Target: ATXN1; (-) strand; PAM type: YTN; PAM sequence: TTG
tgacaggagaacttttttcc

SEQ ID NO: 156132 - DNA, 20 bp, Artificial Sequence
  Description of Artificial Sequence: Synthetic oligonucleotide
  Target: ATXN1; (-) strand; PAM type: YTN; PAM sequence: TTA
ttgtgacaggagaacttttt

SEQ ID NO: 156133 - DNA, 20 bp, Artificial Sequence
  Description of Artificial Sequence: Synthetic oligonucleotide
  Target: ATXN1; (-) strand; PAM type: YTN; PAM sequence: TTT
attgtgacaggagaactttt

SEQ ID NO: 156134 - DNA, 20 bp, Artificial Sequence
  Description of Artificial Sequence: Synthetic oligonucleotide
  Target: ATXN1; (-) strand; PAM type: YTN; PAM sequence: TTT
tattgtgacaggagaacttt

SEQ ID NO: 156135 - DNA, 20 bp, Artificial Sequence
  Description of Artificial Sequence: Synthetic oligonucleotide
  Target: ATXN1; (-) strand; PAM type: YTN; PAM sequence: CTT
ttattgtgacaggagaactt

SEQ ID NO: 156136 - DNA, 20 bp, Artificial Sequence
  Description of Artificial Sequence: Synthetic oligonucleotide
  Target: ATXN1; (-) strand; PAM type: YTN; PAM sequence: TTA
agagcttttattgtgacagg

SEQ ID NO: 156137 - DNA, 20 bp, Artificial Sequence
  Description of Artificial Sequence: Synthetic oligonucleotide
  Target: ATXN1; (-) strand; PAM type: YTN; PAM sequence: TTA
agtgcatacataatagttaa

SEQ ID NO: 156138 - DNA, 20 bp, Artificial Sequence
  Description of Artificial Sequence: Synthetic oligonucleotide
  Target: ATXN1; (-) strand; PAM type: YTN; PAM sequence: TTT
aagtgcatacataatagtta

SEQ ID NO: 156139 - DNA, 20 bp, Artificial Sequence
  Description of Artificial Sequence: Synthetic oligonucleotide
  Target: ATXN1; (-) strand; PAM type: YTN; PAM sequence: TTT
taagtgcatacataatagtt

SEQ ID NO: 156140 - DNA, 20 bp, Artificial Sequence
  Description of Artificial Sequence: Synthetic oligonucleotide
  Target: ATXN1; (-) strand; PAM type: YTN; PAM sequence: TTG
aaaagaaaattttaagtgca

SEQ ID NO: 156141 - DNA, 20 bp, Artificial Sequence
  Description of Artificial Sequence: Synthetic oligonucleotide
  Target: ATXN1; (-) strand; PAM type: YTN; PAM sequence: TTA
ttgaaaagaaaattttaagt

SEQ ID NO: 156142 - DNA, 20 bp, Artificial Sequence
  Description of Artificial Sequence: Synthetic oligonucleotide
  Target: ATXN1; (-) strand; PAM type: YTN; PAM sequence: CTT
attgaaaagaaaattttaag

SEQ ID NO: 156143 - DNA, 20 bp, Artificial Sequence
  Description of Artificial Sequence: Synthetic oligonucleotide
  Target: ATXN1; (-) strand; PAM type: YTN; PAM sequence: TTG
caccttattgaaaagaaaat

SEQ ID NO: 156144 - DNA, 20 bp, Artificial Sequence
  Description of Artificial Sequence: Synthetic oligonucleotide
  Target: ATXN1; (-) strand; PAM type: YTN; PAM sequence: TTT
gcaccttattgaaaagaaaa

SEQ ID NO: 156145 - DNA, 20 bp, Artificial Sequence
  Description of Artificial Sequence: Synthetic oligonucleotide
  Target: ATXN1; (-) strand; PAM type: YTN; PAM sequence: TTT
tgcaccttattgaaaagaaa

SEQ ID NO: 156146 - DNA, 20 bp, Artificial Sequence
  Description of Artificial Sequence: Synthetic oligonucleotide
  Target: ATXN1; (-) strand; PAM type: YTN; PAM sequence: CTA
gggaaggaatgatgttttgc

SEQ ID NO: 156147 - DNA, 20 bp, Artificial Sequence
  Description of Artificial Sequence: Synthetic oligonucleotide
  Target: ATXN1; (-) strand; PAM type: YTN; PAM sequence: CTG
acatggccagtacagaggag

SEQ ID NO: 156148 - DNA, 20 bp, Artificial Sequence
  Description of Artificial Sequence: Synthetic oligonucleotide
  Target: ATXN1; (-) strand; PAM type: YTN; PAM sequence: CTA
ccagactgacatggccagta

SEQ ID NO: 156149 - DNA, 20 bp, Artificial Sequence
  Description of Artificial Sequence: Synthetic oligonucleotide
  Target: ATXN1; (-) strand; PAM type: YTN; PAM sequence: TTG
agggcactaccagactgaca

SEQ ID NO: 156150 - DNA, 20 bp, Artificial Sequence
  Description of Artificial Sequence: Synthetic oligonucleotide
  Target: ATXN1; (-) strand; PAM type: YTN; PAM sequence: TTG
ggttgagggcactaccagac

SEQ ID NO: 156151 - DNA, 20 bp, Artificial Sequence
  Description of Artificial Sequence: Synthetic oligonucleotide
  Target: ATXN1; (-) strand; PAM type: YTN; PAM sequence: CTT
gggttgagggcactaccaga

SEQ ID NO: 156152 - DNA, 20 bp, Artificial Sequence
  Description of Artificial Sequence: Synthetic oligonucleotide
  Target: ATXN1; (-) strand; PAM type: YTN; PAM sequence: CTC
ccacaggccaagggaaaaca

SEQ ID NO: 156153 - DNA, 20 bp, Artificial Sequence
  Description of Artificial Sequence: Synthetic oligonucleotide
  Target: ATXN1; (-) strand; PAM type: YTN; PAM sequence: TTA
cccaccatatgcctcccaca

SEQ ID NO: 156154 - DNA, 20 bp, Artificial Sequence
  Description of Artificial Sequence: Synthetic oligonucleotide
  Target: ATXN1; (-) strand; PAM type: YTN; PAM sequence: TTA
atatcagatcattacccacc

SEQ ID NO: 156155 - DNA, 20 bp, Artificial Sequence
  Description of Artificial Sequence: Synthetic oligonucleotide
  Target: ATXN1; (-) strand; PAM type: YTN; PAM sequence: TTT
aatatcagatcattacccac

SEQ ID NO: 156156 - DNA, 20 bp, Artificial Sequence
  Description of Artificial Sequence: Synthetic oligonucleotide
  Target: ATXN1; (-) strand; PAM type: YTN; PAM sequence: TTT
taatatcagatcattaccca

SEQ ID NO: 156157 - DNA, 20 bp, Artificial Sequence
  Description of Artificial Sequence: Synthetic oligonucleotide
  Target: ATXN1; (-) strand; PAM type: YTN; PAM sequence: CTG
gatgttttaatatcagatca

SEQ ID NO: 156158 - DNA, 20 bp, Artificial Sequence
  Description of Artificial Sequence: Synthetic oligonucleotide
  Target: ATXN1; (-) strand; PAM type: YTN; PAM sequence: CTA
ctggatgttttaatatcaga

SEQ ID NO: 156159 - DNA, 20 bp, Artificial Sequence
  Description of Artificial Sequence: Synthetic oligonucleotide
  Target: ATXN1; (-) strand; PAM type: YTN; PAM sequence: CTC
gtactactggatgttttaat

SEQ ID NO: 156160 - DNA, 20 bp, Artificial Sequence
  Description of Artificial Sequence: Synthetic oligonucleotide
  Target: ATXN1; (-) strand; PAM type: YTN; PAM sequence: CTG
agactcgtactactggatgt

SEQ ID NO: 156161 - DNA, 20 bp, Artificial Sequence
  Description of Artificial Sequence: Synthetic oligonucleotide
  Target: ATXN1; (-) strand; PAM type: YTN; PAM sequence: CTC
tgagactcgtactactggat

SEQ ID NO: 156162 - DNA, 20 bp, Artificial Sequence
  Description of Artificial Sequence: Synthetic oligonucleotide
  Target: ATXN1; (-) strand; PAM type: YTN; PAM sequence: CTC
cagagccatctctgagactc

SEQ ID NO: 156163 - DNA, 20 bp, Artificial Sequence
  Description of Artificial Sequence: Synthetic oligonucleotide
  Target: ATXN1; (-) strand; PAM type: YTN; PAM sequence: CTG
gctccagagccatctctgag

SEQ ID NO: 156164 - DNA, 20 bp, Artificial Sequence
  Description of Artificial Sequence: Synthetic oligonucleotide
  Target: ATXN1; (-) strand; PAM type: YTN; PAM sequence: TTC
cagccagtggagtcctggct

SEQ ID NO: 156165 - DNA, 20 bp, Artificial Sequence
  Description of Artificial Sequence: Synthetic oligonucleotide
  Target: ATXN1; (-) strand; PAM type: YTN; PAM sequence: TTT
ccagccagtggagtcctggc

SEQ ID NO: 156166 - DNA, 20 bp, Artificial Sequence
  Description of Artificial Sequence: Synthetic oligonucleotide
  Target: ATXN1; (-) strand; PAM type: YTN; PAM sequence: TTC
atttccagccagtggagtcc

SEQ ID NO: 156167 - DNA, 20 bp, Artificial Sequence
  Description of Artificial Sequence: Synthetic oligonucleotide
  Target: ATXN1; (-) strand; PAM type: YTN; PAM sequence: CTT
catttccagccagtggagtc

SEQ ID NO: 156168 - DNA, 20 bp, Artificial Sequence
  Description of Artificial Sequence: Synthetic oligonucleotide
  Target: ATXN1; (-) strand; PAM type: YTN; PAM sequence: TTA
gacagtcttcatttccagcc

SEQ ID NO: 156169 - DNA, 20 bp, Artificial Sequence
  Description of Artificial Sequence: Synthetic oligonucleotide
  Target: ATXN1; (-) strand; PAM type: YTN; PAM sequence: TTC
agattagacagtcttcattt

SEQ ID NO: 156170 - DNA, 20 bp, Artificial Sequence
  Description of Artificial Sequence: Synthetic oligonucleotide
  Target: ATXN1; (-) strand; PAM type: YTN; PAM sequence: CTT
cagattagacagtcttcatt

SEQ ID NO: 156171 - DNA, 20 bp, Artificial Sequence
  Description of Artificial Sequence: Synthetic oligonucleotide
  Target: ATXN1; (-) strand; PAM type: YTN; PAM sequence: TTG
tggtgaccttcagattagac

SEQ ID NO: 156172 - DNA, 20 bp, Artificial Sequence
  Description of Artificial Sequence: Synthetic oligonucleotide
  Target: ATXN1; (-) strand; PAM type: YTN; PAM sequence: TTT
gtggtgaccttcagattaga

SEQ ID NO: 156173 - DNA, 20 bp, Artificial Sequence
  Description of Artificial Sequence: Synthetic oligonucleotide
  Target: ATXN1; (-) strand; PAM type: YTN; PAM sequence: CTG
tcagtatttgtggtgacctt

SEQ ID NO: 156174 - DNA, 20 bp, Artificial Sequence
  Description of Artificial Sequence: Synthetic oligonucleotide
  Target: ATXN1; (-) strand; PAM type: YTN; PAM sequence: TTC
aagatagtcctgtcagtatt

SEQ ID NO: 156175 - DNA, 20 bp, Artificial Sequence
  Description of Artificial Sequence: Synthetic oligonucleotide
  Target: ATXN1; (-) strand; PAM type: YTN; PAM sequence: TTT
caagatagtcctgtcagtat

SEQ ID NO: 156176 - DNA, 20 bp, Artificial Sequence
  Description of Artificial Sequence: Synthetic oligonucleotide
  Target: ATXN1; (-) strand; PAM type: YTN; PAM sequence: TTA
gtgtcagccgaaaggaggtt

SEQ ID NO: 156177 - DNA, 20 bp, Artificial Sequence
  Description of Artificial Sequence: Synthetic oligonucleotide
  Target: ATXN1; (-) strand; PAM type: YTN; PAM sequence: CTA
aacccaaattagtgtcagcc

SEQ ID NO: 156178 - DNA, 20 bp, Artificial Sequence
  Description of Artificial Sequence: Synthetic oligonucleotide
  Target: ATXN1; (-) strand; PAM type: YTN; PAM sequence: CTC
taaacccaaattagtgtcag

SEQ ID NO: 156179 - DNA, 20 bp, Artificial Sequence
  Description of Artificial Sequence: Synthetic oligonucleotide
  Target: ATXN1; (-) strand; PAM type: YTN; PAM sequence: CTC
aactctaaacccaaattagt

SEQ ID NO: 156180 - DNA, 20 bp, Artificial Sequence
  Description of Artificial Sequence: Synthetic oligonucleotide
  Target: ATXN1; (-) strand; PAM type: YTN; PAM sequence: CTG
ctcaactctaaacccaaatt

SEQ ID NO: 156181 - DNA, 20 bp, Artificial Sequence
  Description of Artificial Sequence: Synthetic oligonucleotide
  Target: ATXN1; (-) strand; PAM type: YTN; PAM sequence: CTG
aactgctcaactctaaaccc

SEQ ID NO: 156182 - DNA, 20 bp, Artificial Sequence
  Description of Artificial Sequence: Synthetic oligonucleotide
  Target: ATXN1; (-) strand; PAM type: YTN; PAM sequence: CTC
cccagcctgaactgctcaac

SEQ ID NO: 156183 - DNA, 20 bp, Artificial Sequence
  Description of Artificial Sequence: Synthetic oligonucleotide
  Target: ATXN1; (-) strand; PAM type: YTN; PAM sequence: CTC
atctccccagcctgaactgc

SEQ ID NO: 156184 - DNA, 20 bp, Artificial Sequence
  Description of Artificial Sequence: Synthetic oligonucleotide
  Target: ATXN1; (-) strand; PAM type: YTN; PAM sequence: TTC
ctcatctccccagcctgaac

SEQ ID NO: 156185 - DNA, 20 bp, Artificial Sequence
  Description of Artificial Sequence: Synthetic oligonucleotide
  Target: ATXN1; (-) strand; PAM type: YTN; PAM sequence: TTT
cctcatctccccagcctgaa

SEQ ID NO: 156186 - DNA, 20 bp, Artificial Sequence
  Description of Artificial Sequence: Synthetic oligonucleotide
  Target: ATXN1; (-) strand; PAM type: YTN; PAM sequence: TTG
gcggggtttcctcatctccc

SEQ ID NO: 156187 - DNA, 20 bp, Artificial Sequence
  Description of Artificial Sequence: Synthetic oligonucleotide
  Target: ATXN1; (-) strand; PAM type: YTN; PAM sequence: TTT
ggcggggtttcctcatctcc

SEQ ID NO: 156188 - DNA, 20 bp, Artificial Sequence
  Description of Artificial Sequence: Synthetic oligonucleotide
  Target: ATXN1; (-) strand; PAM type: YTN; PAM sequence: TTT
tggcggggtttcctcatctc

SEQ ID NO: 156189 - DNA, 20 bp, Artificial Sequence
  Description of Artificial Sequence: Synthetic oligonucleotide
  Target: ATXN1; (-) strand; PAM type: YTN; PAM sequence: TTT
ttggcggggtttcctcatct

SEQ ID NO: 156190 - DNA, 20 bp, Artificial Sequence
  Description of Artificial Sequence: Synthetic oligonucleotide
  Target: ATXN1; (-) strand; PAM type: YTN; PAM sequence: CTT
tttggcggggtttcctcatc

SEQ ID NO: 156191 - DNA, 20 bp, Artificial Sequence
  Description of Artificial Sequence: Synthetic oligonucleotide
  Target: ATXN1; (-) strand; PAM type: YTN; PAM sequence: CTG
ccctttttggcggggtttcc

SEQ ID NO: 156192 - DNA, 20 bp, Artificial Sequence
  Description of Artificial Sequence: Synthetic oligonucleotide
  Target: ATXN1; (-) strand; PAM type: YTN; PAM sequence: CTG
tgaatactgccctttttggc

SEQ ID NO: 156193 - DNA, 20 bp, Artificial Sequence
  Description of Artificial Sequence: Synthetic oligonucleotide
  Target: ATXN1; (-) strand; PAM type: YTN; PAM sequence: TTC
tgtgaatactgccctttttg

SEQ ID NO: 156194 - DNA, 20 bp, Artificial Sequence
  Description of Artificial Sequence: Synthetic oligonucleotide
  Target: ATXN1; (-) strand; PAM type: YTN; PAM sequence: TTC
agttctgtgaatactgccct

SEQ ID NO: 156195 - DNA, 20 bp, Artificial Sequence
  Description of Artificial Sequence: Synthetic oligonucleotide
  Target: ATXN1; (-) strand; PAM type: YTN; PAM sequence: CTG
tgcattcagttctgtgaata

SEQ ID NO: 156196 - DNA, 20 bp, Artificial Sequence
  Description of Artificial Sequence: Synthetic oligonucleotide
  Target: ATXN1; (-) strand; PAM type: YTN; PAM sequence: TTG
atacctgtgcattcagttct

SEQ ID NO: 156197 - DNA, 20 bp, Artificial Sequence
  Description of Artificial Sequence: Synthetic oligonucleotide
  Target: ATXN1; (-) strand; PAM type: YTN; PAM sequence: CTT
gatacctgtgcattcagttc

SEQ ID NO: 156198 - DNA, 20 bp, Artificial Sequence
  Description of Artificial Sequence: Synthetic oligonucleotide
  Target: ATXN1; (-) strand; PAM type: YTN; PAM sequence: TTG
aacttgatacctgtgcattc

SEQ ID NO: 156199 - DNA, 20 bp, Artificial Sequence
  Description of Artificial Sequence: Synthetic oligonucleotide
  Target: ATXN1; (-) strand; PAM type: YTN; PAM sequence: TTT
gaacttgatacctgtgcatt

SEQ ID NO: 156200 - DNA, 20 bp, Artificial Sequence
  Description of Artificial Sequence: Synthetic oligonucleotide
  Target: ATXN1; (-) strand; PAM type: YTN; PAM sequence: TTA
gtgcatttgaacttgatacc

SEQ ID NO: 156201 - DNA, 20 bp, Artificial Sequence
  Description of Artificial Sequence: Synthetic oligonucleotide
  Target: ATXN1; (-) strand; PAM type: YTN; PAM sequence: TTA
gttagtgcatttgaacttga

SEQ ID NO: 156202 - DNA, 20 bp, Artificial Sequence
  Description of Artificial Sequence: Synthetic oligonucleotide
  Target: ATXN1; (-) strand; PAM type: YTN; PAM sequence: TTT
agttagtgcatttgaacttg

SEQ ID NO: 156203 - DNA, 20 bp, Artificial Sequence
  Description of Artificial Sequence: Synthetic oligonucleotide
  Target: ATXN1; (-) strand; PAM type: YTN; PAM sequence: CTT
tagttagtgcatttgaactt

SEQ ID NO: 156204 - DNA, 20 bp, Artificial Sequence
  Description of Artificial Sequence: Synthetic oligonucleotide
  Target: ATXN1; (-) strand; PAM type: YTN; PAM sequence: CTG
gcccaggagtggggtaaatc

SEQ ID NO: 156205 - DNA, 20 bp, Artificial Sequence
  Description of Artificial Sequence: Synthetic oligonucleotide
  Target: ATXN1; (-) strand; PAM type: YTN; PAM sequence: TTC
tggcccaggagtggggtaaa

SEQ ID NO: 156206 - DNA, 20 bp, Artificial Sequence
  Description of Artificial Sequence: Synthetic oligonucleotide
  Target: ATXN1; (-) strand; PAM type: YTN; PAM sequence: TTT
ctggcccaggagtggggtaa

SEQ ID NO: 156207 - DNA, 20 bp, Artificial Sequence
  Description of Artificial Sequence: Synthetic oligonucleotide
  Target: ATXN1; (-) strand; PAM type: YTN; PAM sequence: TTT
tctggcccaggagtggggta

SEQ ID NO: 156208 - DNA, 20 bp, Artificial Sequence
  Description of Artificial Sequence: Synthetic oligonucleotide
  Target: ATXN1; (-) strand; PAM type: YTN; PAM sequence: TTC
agttttctggcccaggagtg

SEQ ID NO: 156209 - DNA, 20 bp, Artificial Sequence
  Description of Artificial Sequence: Synthetic oligonucleotide
  Target: ATXN1; (-) strand; PAM type: YTN; PAM sequence: TTT
cagttttctggcccaggagt

SEQ ID NO: 156210 - DNA, 20 bp, Artificial Sequence
  Description of Artificial Sequence: Synthetic oligonucleotide
  Target: ATXN1; (-) strand; PAM type: YTN; PAM sequence: CTT
tcagttttctggcccaggag

SEQ ID NO: 156211 - DNA, 20 bp, Artificial Sequence
  Description of Artificial Sequence: Synthetic oligonucleotide
  Target: ATXN1; (-) strand; PAM type: YTN; PAM sequence: CTC
tttcagttttctggcccagg

SEQ ID NO: 156212 - DNA, 20 bp, Artificial Sequence
  Description of Artificial Sequence: Synthetic oligonucleotide
  Target: ATXN1; (-) strand; PAM type: YTN; PAM sequence: CTA
ctctttcagttttctggccc

SEQ ID NO: 156213 - DNA, 20 bp, Artificial Sequence
  Description of Artificial Sequence: Synthetic oligonucleotide
  Target: ATXN1; (-) strand; PAM type: YTN; PAM sequence: TTA
caggaaccacctactctttc

SEQ ID NO: 156214 - DNA, 20 bp, Artificial Sequence
  Description of Artificial Sequence: Synthetic oligonucleotide
  Target: ATXN1; (-) strand; PAM type: YTN; PAM sequence: CTT
acaggaaccacctactcttt

SEQ ID NO: 156215 - DNA, 20 bp, Artificial Sequence
  Description of Artificial Sequence: Synthetic oligonucleotide
  Target: ATXN1; (-) strand; PAM type: YTN; PAM sequence: TTC
ttacaggaaccacctactct

SEQ ID NO: 156216 - DNA, 20 bp, Artificial Sequence
  Description of Artificial Sequence: Synthetic oligonucleotide
  Target: ATXN1; (-) strand; PAM type: YTN; PAM sequence: CTG
gttcttacaggaaccaccta

SEQ ID NO: 156217 - DNA, 20 bp, Artificial Sequence
  Description of Artificial Sequence: Synthetic oligonucleotide
  Target: ATXN1; (-) strand; PAM type: YTN; PAM sequence: CTC
tggttcttacaggaaccacc

SEQ ID NO: 156218 - DNA, 20 bp, Artificial Sequence
  Description of Artificial Sequence: Synthetic oligonucleotide
  Target: ATXN1; (-) strand; PAM type: YTN; PAM sequence: TTC
tctggttcttacaggaacca

SEQ ID NO: 156219 - DNA, 20 bp, Artificial Sequence
  Description of Artificial Sequence: Synthetic oligonucleotide
  Target: ATXN1; (-) strand; PAM type: YTN; PAM sequence: TTT
ctctggttcttacaggaacc

SEQ ID NO: 156220 - DNA, 20 bp, Artificial Sequence
  Description of Artificial Sequence: Synthetic oligonucleotide
  Target: ATXN1; (-) strand; PAM type: YTN; PAM sequence: TTT
tctctggttcttacaggaac

SEQ ID NO: 156221 - DNA, 20 bp, Artificial Sequence
  Description of Artificial Sequence: Synthetic oligonucleotide
  Target: ATXN1; (-) strand; PAM type: YTN; PAM sequence: CTC
ggtgcacaggttttctctgg

SEQ ID NO: 156222 - DNA, 20 bp, Artificial Sequence
  Description of Artificial Sequence: Synthetic oligonucleotide
  Target: ATXN1; (-) strand; PAM type: YTN; PAM sequence: TTA
ccaagaagctcggtgcacag

SEQ ID NO: 156223 - DNA, 20 bp, Artificial Sequence
  Description of Artificial Sequence: Synthetic oligonucleotide
  Target: ATXN1; (-) strand; PAM type: YTN; PAM sequence: TTC
agagcagttaccaagaagct

SEQ ID NO: 156224 - DNA, 20 bp, Artificial Sequence
  Description of Artificial Sequence: Synthetic oligonucleotide
  Target: ATXN1; (-) strand; PAM type: YTN; PAM sequence: CTT
cagagcagttaccaagaagc

SEQ ID NO: 156225 - DNA, 20 bp, Artificial Sequence
  Description of Artificial Sequence: Synthetic oligonucleotide
  Target: ATXN1; (-) strand; PAM type: YTN; PAM sequence: TTG
tcttcagagcagttaccaag

SEQ ID NO: 156226 - DNA, 20 bp, Artificial Sequence
  Description of Artificial Sequence: Synthetic oligonucleotide
  Target: ATXN1; (-) strand; PAM type: YTN; PAM sequence: CTG
ttgtcttcagagcagttacc

SEQ ID NO: 156227 - DNA, 20 bp, Artificial Sequence
  Description of Artificial Sequence: Synthetic oligonucleotide
  Target: ATXN1; (-) strand; PAM type: YTN; PAM sequence: CTC
aagctgttgtcttcagagca

SEQ ID NO: 156228 - DNA, 20 bp, Artificial Sequence
  Description of Artificial Sequence: Synthetic oligonucleotide
  Target: ATXN1; (-) strand; PAM type: YTN; PAM sequence: CTA
gctcaagctgttgtcttcag

SEQ ID NO: 156229 - DNA, 20 bp, Artificial Sequence
  Description of Artificial Sequence: Synthetic oligonucleotide
  Target: ATXN1; (-) strand; PAM type: YTN; PAM sequence: TTA
ggtgacactagctcaagctg

SEQ ID NO: 156230 - DNA, 20 bp, Artificial Sequence
  Description of Artificial Sequence: Synthetic oligonucleotide
  Target: ATXN1; (-) strand; PAM type: YTN; PAM sequence: CTC
cagaataccaagtattaggt

SEQ ID NO: 156231 - DNA, 20 bp, Artificial Sequence
  Description of Artificial Sequence: Synthetic oligonucleotide
  Target: ATXN1; (-) strand; PAM type: YTN; PAM sequence: CTG
tcctccagaataccaagtat

SEQ ID NO: 156232 - DNA, 20 bp, Artificial Sequence
  Description of Artificial Sequence: Synthetic oligonucleotide
  Target: ATXN1; (-) strand; PAM type: YTN; PAM sequence: TTA
ccaagataacatactgtcct

SEQ ID NO: 156233 - DNA, 20 bp, Artificial Sequence
  Description of Artificial Sequence: Synthetic oligonucleotide
  Target: ATXN1; (-) strand; PAM type: YTN; PAM sequence: CTT
accaagataacatactgtcc

SEQ ID NO: 156234 - DNA, 20 bp, Artificial Sequence
  Description of Artificial Sequence: Synthetic oligonucleotide
  Target: ATXN1; (-) strand; PAM type: YTN; PAM sequence: TTA
cagtaatccttaccaagata

SEQ ID NO: 156235 - DNA, 20 bp, Artificial Sequence
  Description of Artificial Sequence: Synthetic oligonucleotide
  Target: ATXN1; (-) strand; PAM type: YTN; PAM sequence: TTT
acagtaatccttaccaagat

SEQ ID NO: 156236 - DNA, 20 bp, Artificial Sequence
  Description of Artificial Sequence: Synthetic oligonucleotide
  Target: ATXN1; (-) strand; PAM type: YTN; PAM sequence: TTG
tttacagtaatccttaccaa

SEQ ID NO: 156237 - DNA, 20 bp, Artificial Sequence
  Description of Artificial Sequence: Synthetic oligonucleotide
  Target: ATXN1; (-) strand; PAM type: YTN; PAM sequence: TTG
gaagtgttgtttacagtaat

SEQ ID NO: 156238 - DNA, 20 bp, Artificial Sequence
  Description of Artificial Sequence: Synthetic oligonucleotide
  Target: ATXN1; (-) strand; PAM type: YTN; PAM sequence: TTC
gttggaagtgttgtttacag

SEQ ID NO: 156239 - DNA, 20 bp, Artificial Sequence
  Description of Artificial Sequence: Synthetic oligonucleotide
  Target: ATXN1; (-) strand; PAM type: YTN; PAM sequence: CTT
cgttggaagtgttgtttaca

SEQ ID NO: 156240 - DNA, 20 bp, Artificial Sequence
  Description of Artificial Sequence: Synthetic oligonucleotide
  Target: ATXN1; (-) strand; PAM type: YTN; PAM sequence: CTG
aaggccttcgttggaagtgt

SEQ ID NO: 156241 - DNA, 20 bp, Artificial Sequence
  Description of Artificial Sequence: Synthetic oligonucleotide
  Target: ATXN1; (-) strand; PAM type: YTN; PAM sequence: CTG
tggccaatctgaaggccttc

SEQ ID NO: 156242 - DNA, 20 bp, Artificial Sequence
  Description of Artificial Sequence: Synthetic oligonucleotide
  Target: ATXN1; (-) strand; PAM type: YTN; PAM sequence: TTC
tgtggccaatctgaaggcct

SEQ ID NO: 156243 - DNA, 20 bp, Artificial Sequence
  Description of Artificial Sequence: Synthetic oligonucleotide
  Target: ATXN1; (-) strand; PAM type: YTN; PAM sequence: TTT
ctgtggccaatctgaaggcc

SEQ ID NO: 156244 - DNA, 20 bp, Artificial Sequence
  Description of Artificial Sequence: Synthetic oligonucleotide
  Target: ATXN1; (-) strand; PAM type: YTN; PAM sequence: TTT
tctgtggccaatctgaaggc

SEQ ID NO: 156245 - DNA, 20 bp, Artificial Sequence
  Description of Artificial Sequence: Synthetic oligonucleotide
  Target: ATXN1; (-) strand; PAM type: YTN; PAM sequence: CTT
ttctgtggccaatctgaagg

SEQ ID NO: 156246 - DNA, 20 bp, Artificial Sequence
  Description of Artificial Sequence: Synthetic oligonucleotide
  Target: ATXN1; (-) strand; PAM type: YTN; PAM sequence: CTC
cttttctgtggccaatctga

SEQ ID NO: 156247 - DNA, 20 bp, Artificial Sequence
  Description of Artificial Sequence: Synthetic oligonucleotide
  Target: ATXN1; (-) strand; PAM type: YTN; PAM sequence: CTG
tctccttttctgtggccaat

SEQ ID NO: 156248 - DNA, 20 bp, Artificial Sequence
  Description of Artificial Sequence: Synthetic oligonucleotide
  Target: ATXN1; (-) strand; PAM type: YTN; PAM sequence: CTG
gatggccaatgagcctgtct

SEQ ID NO: 156249 - DNA, 20 bp, Artificial Sequence
  Description of Artificial Sequence: Synthetic oligonucleotide
  Target: ATXN1; (-) strand; PAM type: YTN; PAM sequence: CTG
tctggatggccaatgagcct

SEQ ID NO: 156250 - DNA, 20 bp, Artificial Sequence
  Description of Artificial Sequence: Synthetic oligonucleotide
  Target: ATXN1; (-) strand; PAM type: YTN; PAM sequence: TTG
ctgtctggatggccaatgag

SEQ ID NO: 156251 - DNA, 20 bp, Artificial Sequence
  Description of Artificial Sequence: Synthetic oligonucleotide
  Target: ATXN1; (-) strand; PAM type: YTN; PAM sequence: TTT
gctgtctggatggccaatga

SEQ ID NO: 156252 - DNA, 20 bp, Artificial Sequence
  Description of Artificial Sequence: Synthetic oligonucleotide
  Target: ATXN1; (-) strand; PAM type: YTN; PAM sequence: TTG
tttgctgtctggatggccaa

SEQ ID NO: 156253 - DNA, 20 bp, Artificial Sequence
  Description of Artificial Sequence: Synthetic oligonucleotide
  Target: ATXN1; (-) strand; PAM type: YTN; PAM sequence: TTT
gtttgctgtctggatggcca

SEQ ID NO: 156254 - DNA, 20 bp, Artificial Sequence
  Description of Artificial Sequence: Synthetic oligonucleotide
  Target: ATXN1; (-) strand; PAM type: YTN; PAM sequence: TTA
gtttgtttgctgtctggatg

SEQ ID NO: 156255 - DNA, 20 bp, Artificial Sequence
  Description of Artificial Sequence: Synthetic oligonucleotide
  Target: ATXN1; (-) strand; PAM type: YTN; PAM sequence: TTT
agtttgtttgctgtctggat

SEQ ID NO: 156256 - DNA, 20 bp, Artificial Sequence
  Description of Artificial Sequence: Synthetic oligonucleotide
  Target: ATXN1; (-) strand; PAM type: YTN; PAM sequence: CTT
tagtttgtttgctgtctgga

SEQ ID NO: 156257 - DNA, 20 bp, Artificial Sequence
  Description of Artificial Sequence: Synthetic oligonucleotide
  Target: ATXN1; (-) strand; PAM type: YTN; PAM sequence: TTC
cctttagtttgtttgctgtc

SEQ ID NO: 156258 - DNA, 20 bp, Artificial Sequence
  Description of Artificial Sequence: Synthetic oligonucleotide
  Target: ATXN1; (-) strand; PAM type: YTN; PAM sequence: TTT
ccctttagtttgtttgctgt

SEQ ID NO: 156259 - DNA, 20 bp, Artificial Sequence
  Description of Artificial Sequence: Synthetic oligonucleotide
  Target: ATXN1; (-) strand; PAM type: YTN; PAM sequence: CTT
tccctttagtttgtttgctg

SEQ ID NO: 156260 - DNA, 20 bp, Artificial Sequence
  Description of Artificial Sequence: Synthetic oligonucleotide
  Target: ATXN1; (-) strand; PAM type: YTN; PAM sequence: TTC
tttccctttagtttgtttgc

SEQ ID NO: 156261 - DNA, 20 bp, Artificial Sequence
  Description of Artificial Sequence: Synthetic oligonucleotide
  Target: ATXN1; (-) strand; PAM type: YTN; PAM sequence: TTT
ctttccctttagtttgtttg

SEQ ID NO: 156262 - DNA, 20 bp, Artificial Sequence
  Description of Artificial Sequence: Synthetic oligonucleotide
  Target: ATXN1; (-) strand; PAM type: YTN; PAM sequence: TTT
tctttccctttagtttgttt

SEQ ID NO: 156263 - DNA, 20 bp, Artificial Sequence
  Description of Artificial Sequence: Synthetic oligonucleotide
  Target: ATXN1; (-) strand; PAM type: YTN; PAM sequence: TTC
acccacgttttctttccctt

SEQ ID NO: 156264 - DNA, 20 bp, Artificial Sequence
  Description of Artificial Sequence: Synthetic oligonucleotide
  Target: ATXN1; (-) strand; PAM type: YTN; PAM sequence: CTT
cacccacgttttctttccct

SEQ ID NO: 156265 - DNA, 20 bp, Artificial Sequence
  Description of Artificial Sequence: Synthetic oligonucleotide
  Target: ATXN1; (-) strand; PAM type: YTN; PAM sequence: TTG
gaggcttcacccacgttttc

SEQ ID NO: 156266 - DNA, 20 bp, Artificial Sequence
  Description of Artificial Sequence: Synthetic oligonucleotide
  Target: ATXN1; (-) strand; PAM type: YTN; PAM sequence: CTG
cagatacattggaggcttca

SEQ ID NO: 156267 - DNA, 20 bp, Artificial Sequence
  Description of Artificial Sequence: Synthetic oligonucleotide
  Target: ATXN1; (-) strand; PAM type: YTN; PAM sequence: TTC
cactgcagatacattggagg

SEQ ID NO: 156268 - DNA, 20 bp, Artificial Sequence
  Description of Artificial Sequence: Synthetic oligonucleotide
  Target: ATXN1; (-) strand; PAM type: YTN; PAM sequence: CTT
ccactgcagatacattggag

SEQ ID NO: 156269 - DNA, 20 bp, Artificial Sequence
  Description of Artificial Sequence: Synthetic oligonucleotide
  Target: ATXN1; (-) strand; PAM type: YTN; PAM sequence: CTC
aagtcttccactgcagatac

SEQ ID NO: 156270 - DNA, 20 bp, Artificial Sequence
  Description of Artificial Sequence: Synthetic oligonucleotide
  Target: ATXN1; (-) strand; PAM type: YTN; PAM sequence: CTG
aaaggactcaagtcttccac

SEQ ID NO: 156271 - DNA, 20 bp, Artificial Sequence
  Description of Artificial Sequence: Synthetic oligonucleotide
  Target: ATXN1; (-) strand; PAM type: YTN; PAM sequence: TTA
tctgaaaggactcaagtctt

SEQ ID NO: 156272 - DNA, 20 bp, Artificial Sequence
  Description of Artificial Sequence: Synthetic oligonucleotide
  Target: ATXN1; (-) strand; PAM type: YTN; PAM sequence: CTT
atctgaaaggactcaagtct

SEQ ID NO: 156273 - DNA, 20 bp, Artificial Sequence
  Description of Artificial Sequence: Synthetic oligonucleotide
  Target: ATXN1; (-) strand; PAM type: YTN; PAM sequence: TTC
ttatctgaaaggactcaagt

SEQ ID NO: 156274 - DNA, 20 bp, Artificial Sequence
  Description of Artificial Sequence: Synthetic oligonucleotide
  Target: ATXN1; (-) strand; PAM type: YTN; PAM sequence: TTT
cttatctgaaaggactcaag

SEQ ID NO: 156275 - DNA, 20 bp, Artificial Sequence
  Description of Artificial Sequence: Synthetic oligonucleotide
  Target: ATXN1; (-) strand; PAM type: YTN; PAM sequence: TTT
tcttatctgaaaggactcaa

SEQ ID NO: 156276 - DNA, 20 bp, Artificial Sequence
  Description of Artificial Sequence: Synthetic oligonucleotide
  Target: ATXN1; (-) strand; PAM type: YTN; PAM sequence: CTT
ttcttatctgaaaggactca

SEQ ID NO: 156277 - DNA, 20 bp, Artificial Sequence
  Description of Artificial Sequence: Synthetic oligonucleotide
  Target: ATXN1; (-) strand; PAM type: YTN; PAM sequence: TTC
cataacttttcttatctgaa

SEQ ID NO: 156278 - DNA, 20 bp, Artificial Sequence
  Description of Artificial Sequence: Synthetic oligonucleotide
  Target: ATXN1; (-) strand; PAM type: YTN; PAM sequence: TTT
ccataacttttcttatctga

SEQ ID NO: 156279 - DNA, 20 bp, Artificial Sequence
  Description of Artificial Sequence: Synthetic oligonucleotide
  Target: ATXN1; (-) strand; PAM type: YTN; PAM sequence: CTA
agaatttccataacttttct

SEQ ID NO: 156280 - DNA, 20 bp, Artificial Sequence
  Description of Artificial Sequence: Synthetic oligonucleotide
  Target: ATXN1; (-) strand; PAM type: YTN; PAM sequence: CTC
taagaatttccataactttt

SEQ ID NO: 156281 - DNA, 20 bp, Artificial Sequence
  Description of Artificial Sequence: Synthetic oligonucleotide
  Target: ATXN1; (-) strand; PAM type: YTN; PAM sequence: CTA
tacaataacaacaatctcta

SEQ ID NO: 156282 - DNA, 20 bp, Artificial Sequence
  Description of Artificial Sequence: Synthetic oligonucleotide
  Target: ATXN1; (-) strand; PAM type: YTN; PAM sequence: TTG
gccaataggtagtatctata

SEQ ID NO: 156283 - DNA, 20 bp, Artificial Sequence
  Description of Artificial Sequence: Synthetic oligonucleotide
  Target: ATXN1; (-) strand; PAM type: YTN; PAM sequence: TTT
ggccaataggtagtatctat

SEQ ID NO: 156284 - DNA, 20 bp, Artificial Sequence
  Description of Artificial Sequence: Synthetic oligonucleotide
  Target: ATXN1; (-) strand; PAM type: YTN; PAM sequence: TTA
agtgcatttggccaataggt

SEQ ID NO: 156285 - DNA, 20 bp, Artificial Sequence
  Description of Artificial Sequence: Synthetic oligonucleotide
  Target: ATXN1; (-) strand; PAM type: YTN; PAM sequence: TTA
aaattaagtgcatttggcca

SEQ ID NO: 156286 - DNA, 20 bp, Artificial Sequence
  Description of Artificial Sequence: Synthetic oligonucleotide
  Target: ATXN1; (-) strand; PAM type: YTN; PAM sequence: CTG
tattaaaattaagtgcattt

SEQ ID NO: 156287 - DNA, 20 bp, Artificial Sequence
  Description of Artificial Sequence: Synthetic oligonucleotide
  Target: ATXN1; (-) strand; PAM type: YTN; PAM sequence: TTC
aactgtattaaaattaagtg

SEQ ID NO: 156288 - DNA, 20 bp, Artificial Sequence
  Description of Artificial Sequence: Synthetic oligonucleotide
  Target: ATXN1; (-) strand; PAM type: YTN; PAM sequence: TTG
catacaaatggttcaactgt

SEQ ID NO: 156289 - DNA, 20 bp, Artificial Sequence
  Description of Artificial Sequence: Synthetic oligonucleotide
  Target: ATXN1; (-) strand; PAM type: YTN; PAM sequence: CTT
gcatacaaatggttcaactg

SEQ ID NO: 156290 - DNA, 20 bp, Artificial Sequence
  Description of Artificial Sequence: Synthetic oligonucleotide
  Target: ATXN1; (-) strand; PAM type: YTN; PAM sequence: TTC
atgtccccatgacttgcata

SEQ ID NO: 156291 - DNA, 20 bp, Artificial Sequence
  Description of Artificial Sequence: Synthetic oligonucleotide
  Target: ATXN1; (-) strand; PAM type: YTN; PAM sequence: TTT
catgtccccatgacttgcat

SEQ ID NO: 156292 - DNA, 20 bp, Artificial Sequence
  Description of Artificial Sequence: Synthetic oligonucleotide
  Target: ATXN1; (-) strand; PAM type: YTN; PAM sequence: TTT
tcatgtccccatgacttgca

SEQ ID NO: 156293 - DNA, 20 bp, Artificial Sequence
  Description of Artificial Sequence: Synthetic oligonucleotide
  Target: ATXN1; (-) strand; PAM type: YTN; PAM sequence: TTT
ttcatgtccccatgacttgc

SEQ ID NO: 156294 - DNA, 20 bp, Artificial Sequence
  Description of Artificial Sequence: Synthetic oligonucleotide
  Target: ATXN1; (-) strand; PAM type: YTN; PAM sequence: TTC
agtttttcatgtccccatga

SEQ ID NO: 156295 - DNA, 20 bp, Artificial Sequence
  Description of Artificial Sequence: Synthetic oligonucleotide
  Target: ATXN1; (-) strand; PAM type: YTN; PAM sequence: CTT
cagtttttcatgtccccatg

SEQ ID NO: 156296 - DNA, 20 bp, Artificial Sequence
  Description of Artificial Sequence: Synthetic oligonucleotide
  Target: ATXN1; (-) strand; PAM type: YTN; PAM sequence: CTG
tgtaatggcgggagggaaca

SEQ ID NO: 156297 - DNA, 20 bp, Artificial Sequence
  Description of Artificial Sequence: Synthetic oligonucleotide
  Target: ATXN1; (-) strand; PAM type: YTN; PAM sequence: CTC
ctgtgtaatggcgggaggga

SEQ ID NO: 156298 - DNA, 20 bp, Artificial Sequence
  Description of Artificial Sequence: Synthetic oligonucleotide
  Target: ATXN1; (-) strand; PAM type: YTN; PAM sequence: TTC
tcctgtgtaatggcgggagg

SEQ ID NO: 156299 - DNA, 20 bp, Artificial Sequence
  Description of Artificial Sequence: Synthetic oligonucleotide
  Target: ATXN1; (-) strand; PAM type: YTN; PAM sequence: TTT
ctcctgtgtaatggcgggag

SEQ ID NO: 156300 - DNA, 20 bp, Artificial Sequence
  Description of Artificial Sequence: Synthetic oligonucleotide
  Target: ATXN1; (-) strand; PAM type: YTN; PAM sequence: CTT
tctcctgtgtaatggcggga

SEQ ID NO: 156301 - DNA, 20 bp, Artificial Sequence
  Description of Artificial Sequence: Synthetic oligonucleotide
  Target: ATXN1; (-) strand; PAM type: YTN; PAM sequence: CTA
actttctcctgtgtaatggc

SEQ ID NO: 156302 - DNA, 20 bp, Artificial Sequence
  Description of Artificial Sequence: Synthetic oligonucleotide
  Target: ATXN1; (-) strand; PAM type: YTN; PAM sequence: CTG
gtagctaactttctcctgtg

SEQ ID NO: 156303 - DNA, 20 bp, Artificial Sequence
  Description of Artificial Sequence: Synthetic oligonucleotide
  Target: ATXN1; (-) strand; PAM type: YTN; PAM sequence: TTC
tggtagctaactttctcctg

SEQ ID NO: 156304 - DNA, 20 bp, Artificial Sequence
  Description of Artificial Sequence: Synthetic oligonucleotide
  Target: ATXN1; (-) strand; PAM type: YTN; PAM sequence: CTG
ttctggtagctaactttctc

SEQ ID NO: 156305 - DNA, 20 bp, Artificial Sequence
  Description of Artificial Sequence: Synthetic oligonucleotide
  Target: ATXN1; (-) strand; PAM type: YTN; PAM sequence: TTG
aaggcaactgttctggtagc

SEQ ID NO: 156306 - DNA, 20 bp, Artificial Sequence
  Description of Artificial Sequence: Synthetic oligonucleotide
  Target: ATXN1; (-) strand; PAM type: YTN; PAM sequence: CTC
gttgaaggcaactgttctgg

SEQ ID NO: 156307 - DNA, 20 bp, Artificial Sequence
  Description of Artificial Sequence: Synthetic oligonucleotide
  Target: ATXN1; (-) strand; PAM type: YTN; PAM sequence: TTC
tcgttgaaggcaactgttct

SEQ ID NO: 156308 - DNA, 20 bp, Artificial Sequence
  Description of Artificial Sequence: Synthetic oligonucleotide
  Target: ATXN1; (-) strand; PAM type: YTN; PAM sequence: CTT
ctcgttgaaggcaactgttc

SEQ ID NO: 156309 - DNA, 20 bp, Artificial Sequence
  Description of Artificial Sequence: Synthetic oligonucleotide
  Target: ATXN1; (-) strand; PAM type: YTN; PAM sequence: CTC
ccttctcgttgaaggcaact

SEQ ID NO: 156310 - DNA, 20 bp, Artificial Sequence
  Description of Artificial Sequence: Synthetic oligonucleotide
  Target: ATXN1; (-) strand; PAM type: YTN; PAM sequence: CTC
gtcccctcccttctcgttga

SEQ ID NO: 156311 - DNA, 20 bp, Artificial Sequence
  Description of Artificial Sequence: Synthetic oligonucleotide
  Target: ATXN1; (-) strand; PAM type: YTN; PAM sequence: TTC
agaatctcgtcccctccctt

SEQ ID NO: 156312 - DNA, 20 bp, Artificial Sequence
  Description of Artificial Sequence: Synthetic oligonucleotide
  Target: ATXN1; (-) strand; PAM type: YTN; PAM sequence: TTA
aattcagaatctcgtcccct

SEQ ID NO: 156313 - DNA, 20 bp, Artificial Sequence
  Description of Artificial Sequence: Synthetic oligonucleotide
  Target: ATXN1; (-) strand; PAM type: YTN; PAM sequence: CTT
aaattcagaatctcgtcccc

SEQ ID NO: 156314 - DNA, 20 bp, Artificial Sequence
  Description of Artificial Sequence: Synthetic oligonucleotide
  Target: ATXN1; (-) strand; PAM type: YTN; PAM sequence: TTC
ttaaattcagaatctcgtcc

SEQ ID NO: 156315 - DNA, 20 bp, Artificial Sequence
  Description of Artificial Sequence: Synthetic oligonucleotide
  Target: ATXN1; (-) strand; PAM type: YTN; PAM sequence: TTA
caattcttaaattcagaatc

SEQ ID NO: 156316 - DNA, 20 bp, Artificial Sequence
  Description of Artificial Sequence: Synthetic oligonucleotide
  Target: ATXN1; (-) strand; PAM type: YTN; PAM sequence: CTT
acaattcttaaattcagaat

SEQ ID NO: 156317 - DNA, 20 bp, Artificial Sequence
  Description of Artificial Sequence: Synthetic oligonucleotide
  Target: ATXN1; (-) strand; PAM type: YTN; PAM sequence: TTA
agcacccccacttacaattc

SEQ ID NO: 156318 - DNA, 20 bp, Artificial Sequence
  Description of Artificial Sequence: Synthetic oligonucleotide
  Target: ATXN1; (-) strand; PAM type: YTN; PAM sequence: CTG
tggggatattaagcaccccc

SEQ ID NO: 156319 - DNA, 20 bp, Artificial Sequence
  Description of Artificial Sequence: Synthetic oligonucleotide
  Target: ATXN1; (-) strand; PAM type: YTN; PAM sequence: CTG
gacagctgtggggatattaa

SEQ ID NO: 156320 - DNA, 20 bp, Artificial Sequence
  Description of Artificial Sequence: Synthetic oligonucleotide
  Target: ATXN1; (-) strand; PAM type: YTN; PAM sequence: CTG
tccaaaaatcaagccggaca

SEQ ID NO: 156321 - DNA, 20 bp, Artificial Sequence
  Description of Artificial Sequence: Synthetic oligonucleotide
  Target: ATXN1; (-) strand; PAM type: YTN; PAM sequence: TTC
ctgtccaaaaatcaagccgg

SEQ ID NO: 156322 - DNA, 20 bp, Artificial Sequence
  Description of Artificial Sequence: Synthetic oligonucleotide
  Target: ATXN1; (-) strand; PAM type: YTN; PAM sequence: CTC
agaatagtattcctgtccaa

SEQ ID NO: 156323 - DNA, 20 bp, Artificial Sequence
  Description of Artificial Sequence: Synthetic oligonucleotide
  Target: ATXN1; (-) strand; PAM type: YTN; PAM sequence: TTC
tcagaatagtattcctgtcc

SEQ ID NO: 156324 - DNA, 20 bp, Artificial Sequence
  Description of Artificial Sequence: Synthetic oligonucleotide
  Target: ATXN1; (-) strand; PAM type: YTN; PAM sequence: CTT
ctcagaatagtattcctgtc

SEQ ID NO: 156325 - DNA, 20 bp, Artificial Sequence
  Description of Artificial Sequence: Synthetic oligonucleotide
  Target: ATXN1; (-) strand; PAM type: YTN; PAM sequence: TTA
atataaagaggccagaataa

SEQ ID NO: 156326 - DNA, 20 bp, Artificial Sequence
  Description of Artificial Sequence: Synthetic oligonucleotide
  Target: ATXN1; (-) strand; PAM type: YTN; PAM sequence: TTT
aatataaagaggccagaata

SEQ ID NO: 156327 - DNA, 20 bp, Artificial Sequence
  Description of Artificial Sequence: Synthetic oligonucleotide
  Target: ATXN1; (-) strand; PAM type: YTN; PAM sequence: TTA
tttaatataaagaggccaga

SEQ ID NO: 156328 - DNA, 20 bp, Artificial Sequence
  Description of Artificial Sequence: Synthetic oligonucleotide
  Target: ATXN1; (-) strand; PAM type: YTN; PAM sequence: TTT
atttaatataaagaggccag

SEQ ID NO: 156329 - DNA, 20 bp, Artificial Sequence
  Description of Artificial Sequence: Synthetic oligonucleotide
  Target: ATXN1; (-) strand; PAM type: YTN; PAM sequence: TTT
tatttaatataaagaggcca

SEQ ID NO: 156330 - DNA, 20 bp, Artificial Sequence
  Description of Artificial Sequence: Synthetic oligonucleotide
  Target: ATXN1; (-) strand; PAM type: YTN; PAM sequence: TTT
ttatttaatataaagaggcc

SEQ ID NO: 156331 - DNA, 20 bp, Artificial Sequence
  Description of Artificial Sequence: Synthetic oligonucleotide
  Target: ATXN1; (-) strand; PAM type: YTN; PAM sequence: TTG
atttttatttaatataaaga

SEQ ID NO: 156332 - DNA, 20 bp, Artificial Sequence
  Description of Artificial Sequence: Synthetic oligonucleotide
  Target: ATXN1; (-) strand; PAM type: YTN; PAM sequence: TTT
gatttttatttaatataaag

SEQ ID NO: 156333 - DNA, 20 bp, Artificial Sequence
  Description of Artificial Sequence: Synthetic oligonucleotide
  Target: ATXN1; (-) strand; PAM type: YTN; PAM sequence: TTT
tgatttttatttaatataaa

SEQ ID NO: 156334 - DNA, 20 bp, Artificial Sequence
  Description of Artificial Sequence: Synthetic oligonucleotide
  Target: ATXN1; (-) strand; PAM type: YTN; PAM sequence: TTA
ttttgatttttatttaatat

SEQ ID NO: 156335 - DNA, 20 bp, Artificial Sequence
  Description of Artificial Sequence: Synthetic oligonucleotide
  Target: ATXN1; (-) strand; PAM type: YTN; PAM sequence: TTT
attttgatttttatttaata

SEQ ID NO: 156336 - DNA, 20 bp, Artificial Sequence
  Description of Artificial Sequence: Synthetic oligonucleotide
  Target: ATXN1; (-) strand; PAM type: YTN; PAM sequence: TTT
tattttgatttttatttaat

SEQ ID NO: 156337 - DNA, 20 bp, Artificial Sequence
  Description of Artificial Sequence: Synthetic oligonucleotide
  Target: ATXN1; (-) strand; PAM type: YTN; PAM sequence: TTA
gttttattttgatttttatt

SEQ ID NO: 156338 - DNA, 20 bp, Artificial Sequence
  Description of Artificial Sequence: Synthetic oligonucleotide
  Target: ATXN1; (-) strand; PAM type: YTN; PAM sequence: TTT
agttttattttgatttttat

SEQ ID NO: 156339 - DNA, 20 bp, Artificial Sequence
  Description of Artificial Sequence: Synthetic oligonucleotide
  Target: ATXN1; (-) strand; PAM type: YTN; PAM sequence: TTT
tagttttattttgattttta

SEQ ID NO: 156340 - DNA, 20 bp, Artificial Sequence
  Description of Artificial Sequence: Synthetic oligonucleotide
  Target: ATXN1; (-) strand; PAM type: YTN; PAM sequence: TTA
ttttagttttattttgattt

SEQ ID NO: 156341 - DNA, 20 bp, Artificial Sequence
  Description of Artificial Sequence: Synthetic oligonucleotide
  Target: ATXN1; (-) strand; PAM type: YTN; PAM sequence: TTT
attttagttttattttgatt

SEQ ID NO: 156342 - DNA, 20 bp, Artificial Sequence
  Description of Artificial Sequence: Synthetic oligonucleotide
  Target: ATXN1; (-) strand; PAM type: YTN; PAM sequence: TTT
tattttagttttattttgat

SEQ ID NO: 156343 - DNA, 20 bp, Artificial Sequence
  Description of Artificial Sequence: Synthetic oligonucleotide
  Target: ATXN1; (-) strand; PAM type: YTN; PAM sequence: CTC
attttattttagttttattt

SEQ ID NO: 156344 - DNA, 20 bp, Artificial Sequence
  Description of Artificial Sequence: Synthetic oligonucleotide
  Target: ATXN1; (-) strand; PAM type: YTN; PAM sequence: TTC
aatgtaaatgcctcatttta

SEQ ID NO: 156345 - DNA, 20 bp, Artificial Sequence
  Description of Artificial Sequence: Synthetic oligonucleotide
  Target: ATXN1; (-) strand; PAM type: YTN; PAM sequence: TTT
caatgtaaatgcctcatttt

SEQ ID NO: 156346 - DNA, 20 bp, Artificial Sequence
  Description of Artificial Sequence: Synthetic oligonucleotide
  Target: ATXN1; (-) strand; PAM type: YTN; PAM sequence: TTA
aatggggggagtaaaaacat

SEQ ID NO: 156347 - DNA, 20 bp, Artificial Sequence
  Description of Artificial Sequence: Synthetic oligonucleotide
  Target: ATXN1; (-) strand; PAM type: YTN; PAM sequence: TTT
aaatggggggagtaaaaaca

SEQ ID NO: 156348 - DNA, 20 bp, Artificial Sequence
  Description of Artificial Sequence: Synthetic oligonucleotide
  Target: ATXN1; (-) strand; PAM type: YTN; PAM sequence: CTC
atttaaatggggggagtaaa

SEQ ID NO: 156349 - DNA, 20 bp, Artificial Sequence
  Description of Artificial Sequence: Synthetic oligonucleotide
  Target: ATXN1; (-) strand; PAM type: YTN; PAM sequence: TTC
cccccacacctcatttaaat

SEQ ID NO: 156350 - DNA, 20 bp, Artificial Sequence
  Description of Artificial Sequence: Synthetic oligonucleotide
  Target: ATXN1; (-) strand; PAM type: YTN; PAM sequence: TTT
ccccccacacctcatttaaa

SEQ ID NO: 156351 - DNA, 20 bp, Artificial Sequence
  Description of Artificial Sequence: Synthetic oligonucleotide
  Target: ATXN1; (-) strand; PAM type: YTN; PAM sequence: CTT
tccccccacacctcatttaa

SEQ ID NO: 156352 - DNA, 20 bp, Artificial Sequence
  Description of Artificial Sequence: Synthetic oligonucleotide
  Target: ATXN1; (-) strand; PAM type: YTN; PAM sequence: TTC
tttccccccacacctcattt

SEQ ID NO: 156353 - DNA, 20 bp, Artificial Sequence
  Description of Artificial Sequence: Synthetic oligonucleotide
  Target: ATXN1; (-) strand; PAM type: YTN; PAM sequence: CTT
ctttccccccacacctcatt

SEQ ID NO: 156354 - DNA, 20 bp, Artificial Sequence
  Description of Artificial Sequence: Synthetic oligonucleotide
  Target: ATXN1; (-) strand; PAM type: YTN; PAM sequence: TTC
accttctttccccccacacc

SEQ ID NO: 156355 - DNA, 20 bp, Artificial Sequence
  Description of Artificial Sequence: Synthetic oligonucleotide
  Target: ATXN1; (-) strand; PAM type: YTN; PAM sequence: TTT
caccttctttccccccacac

SEQ ID NO: 156356 - DNA, 20 bp, Artificial Sequence
  Description of Artificial Sequence: Synthetic oligonucleotide
  Target: ATXN1; (-) strand; PAM type: YTN; PAM sequence: TTA
tttcaccttctttcccccca

SEQ ID NO: 156357 - DNA, 20 bp, Artificial Sequence
  Description of Artificial Sequence: Synthetic oligonucleotide
  Target: ATXN1; (-) strand; PAM type: YTN; PAM sequence: TTA
tggggacaaaaaaaaaaatt

SEQ ID NO: 156358 - DNA, 20 bp, Artificial Sequence
  Description of Artificial Sequence: Synthetic oligonucleotide
  Target: ATXN1; (-) strand; PAM type: YTN; PAM sequence: CTC
attatggggacaaaaaaaaa

SEQ ID NO: 156359 - DNA, 20 bp, Artificial Sequence
  Description of Artificial Sequence: Synthetic oligonucleotide
  Target: ATXN1; (-) strand; PAM type: YTN; PAM sequence: CTA
ccaatcaaacaggactcatt

SEQ ID NO: 156360 - DNA, 20 bp, Artificial Sequence
  Description of Artificial Sequence: Synthetic oligonucleotide
  Target: ATXN1; (-) strand; PAM type: YTN; PAM sequence: TTG
taacaagggatccaggctac

SEQ ID NO: 156361 - DNA, 20 bp, Artificial Sequence
  Description of Artificial Sequence: Synthetic oligonucleotide
  Target: ATXN1; (-) strand; PAM type: YTN; PAM sequence: TTT
gtaacaagggatccaggcta

SEQ ID NO: 156362 - DNA, 20 bp, Artificial Sequence
  Description of Artificial Sequence: Synthetic oligonucleotide
  Target: ATXN1; (-) strand; PAM type: YTN; PAM sequence: TTG
aacacgaagtgtttgtaaca

SEQ ID NO: 156363 - DNA, 20 bp, Artificial Sequence
  Description of Artificial Sequence: Synthetic oligonucleotide
  Target: ATXN1; (-) strand; PAM type: YTN; PAM sequence: CTT
gaacacgaagtgtttgtaac

SEQ ID NO: 156364 - DNA, 20 bp, Artificial Sequence
  Description of Artificial Sequence: Synthetic oligonucleotide
  Target: ATXN1; (-) strand; PAM type: YTN; PAM sequence: CTA
taaacccaaagaatataatc

SEQ ID NO: 156365 - DNA, 20 bp, Artificial Sequence
  Description of Artificial Sequence: Synthetic oligonucleotide
  Target: ATXN1; (-) strand; PAM type: YTN; PAM sequence: TTC
ctataaacccaaagaatata

SEQ ID NO: 156366 - DNA, 20 bp, Artificial Sequence
  Description of Artificial Sequence: Synthetic oligonucleotide
  Target: ATXN1; (-) strand; PAM type: YTN; PAM sequence: CTG
ttcctataaacccaaagaat

SEQ ID NO: 156367 - DNA, 20 bp, Artificial Sequence
  Description of Artificial Sequence: Synthetic oligonucleotide
  Target: ATXN1; (-) strand; PAM type: YTN; PAM sequence: TTC
ctgttcctataaacccaaag

SEQ ID NO: 156368 - DNA, 20 bp, Artificial Sequence
  Description of Artificial Sequence: Synthetic oligonucleotide
  Target: ATXN1; (-) strand; PAM type: YTN; PAM sequence: CTT
cctgttcctataaacccaaa

SEQ ID NO: 156369 - DNA, 20 bp, Artificial Sequence
  Description of Artificial Sequence: Synthetic oligonucleotide
  Target: ATXN1; (-) strand; PAM type: YTN; PAM sequence: TTC
agcacttcctgttcctataa

SEQ ID NO: 156370 - DNA, 20 bp, Artificial Sequence
  Description of Artificial Sequence: Synthetic oligonucleotide
  Target: ATXN1; (-) strand; PAM type: YTN; PAM sequence: TTT
cagcacttcctgttcctata

SEQ ID NO: 156371 - DNA, 20 bp, Artificial Sequence
  Description of Artificial Sequence: Synthetic oligonucleotide
  Target: ATXN1; (-) strand; PAM type: YTN; PAM sequence: TTT
tcagcacttcctgttcctat

SEQ ID NO: 156372 - DNA, 20 bp, Artificial Sequence
  Description of Artificial Sequence: Synthetic oligonucleotide
  Target: ATXN1; (-) strand; PAM type: YTN; PAM sequence: TTG
acattttcagcacttcctgt

SEQ ID NO: 156373 - DNA, 20 bp, Artificial Sequence
  Description of Artificial Sequence: Synthetic oligonucleotide
  Target: ATXN1; (-) strand; PAM type: YTN; PAM sequence: TTT
gacattttcagcacttcctg

SEQ ID NO: 156374 - DNA, 20 bp, Artificial Sequence
  Description of Artificial Sequence: Synthetic oligonucleotide
  Target: ATXN1; (-) strand; PAM type: YTN; PAM sequence: TTC
agagatgatgtttgacattt

SEQ ID NO: 156375 - DNA, 20 bp, Artificial Sequence
  Description of Artificial Sequence: Synthetic oligonucleotide
  Target: ATXN1; (-) strand; PAM type: YTN; PAM sequence: CTT
cagagatgatgtttgacatt

SEQ ID NO: 156376 - DNA, 20 bp, Artificial Sequence
  Description of Artificial Sequence: Synthetic oligonucleotide
  Target: ATXN1; (-) strand; PAM type: YTN; PAM sequence: TTC
ttcagagatgatgtttgaca

SEQ ID NO: 156377 - DNA, 20 bp, Artificial Sequence
  Description of Artificial Sequence: Synthetic oligonucleotide
  Target: ATXN1; (-) strand; PAM type: YTN; PAM sequence: TTT
cttcagagatgatgtttgac

SEQ ID NO: 156378 - DNA, 20 bp, Artificial Sequence
  Description of Artificial Sequence: Synthetic oligonucleotide
  Target: ATXN1; (-) strand; PAM type: YTN; PAM sequence: TTT
tcttcagagatgatgtttga

SEQ ID NO: 156379 - DNA, 20 bp, Artificial Sequence
  Description of Artificial Sequence: Synthetic oligonucleotide
  Target: ATXN1; (-) strand; PAM type: YTN; PAM sequence: TTT
ttcttcagagatgatgtttg

SEQ ID NO: 156380 - DNA, 20 bp, Artificial Sequence
  Description of Artificial Sequence: Synthetic oligonucleotide
  Target: ATXN1; (-) strand; PAM type: YTN; PAM sequence: CTT
tttcttcagagatgatgttt

SEQ ID NO: 156381 - DNA, 20 bp, Artificial Sequence
  Description of Artificial Sequence: Synthetic oligonucleotide
  Target: ATXN1; (-) strand; PAM type: YTN; PAM sequence: TTC
tttttcttcagagatgatgt

SEQ ID NO: 156382 - DNA, 20 bp, Artificial Sequence
  Description of Artificial Sequence: Synthetic oligonucleotide
  Target: ATXN1; (-) strand; PAM type: YTN; PAM sequence: CTT
ctttttcttcagagatgatg

SEQ ID NO: 156383 - DNA, 20 bp, Artificial Sequence
  Description of Artificial Sequence: Synthetic oligonucleotide
  Target: ATXN1; (-) strand; PAM type: YTN; PAM sequence: TTG
caacttctttttcttcagag

SEQ ID NO: 156384 - DNA, 20 bp, Artificial Sequence
  Description of Artificial Sequence: Synthetic oligonucleotide
  Target: ATXN1; (-) strand; PAM type: YTN; PAM sequence: TTA
agccattgcaacttcttttt

SEQ ID NO: 156385 - DNA, 20 bp, Artificial Sequence
  Description of Artificial Sequence: Synthetic oligonucleotide
  Target: ATXN1; (-) strand; PAM type: YTN; PAM sequence: CTT
aagccattgcaacttctttt

SEQ ID NO: 156386 - DNA, 20 bp, Artificial Sequence
  Description of Artificial Sequence: Synthetic oligonucleotide
  Target: ATXN1; (-) strand; PAM type: YTN; PAM sequence: CTC
ttaagccattgcaacttctt

SEQ ID NO: 156387 - DNA, 20 bp, Artificial Sequence
  Description of Artificial Sequence: Synthetic oligonucleotide
  Target: ATXN1; (-) strand; PAM type: YTN; PAM sequence: CTA
aactcttaagccattgcaac

SEQ ID NO: 156388 - DNA, 20 bp, Artificial Sequence
  Description of Artificial Sequence: Synthetic oligonucleotide
  Target: ATXN1; (-) strand; PAM type: YTN; PAM sequence: TTA
gtctaaactcttaagccatt

SEQ ID NO: 156389 - DNA, 20 bp, Artificial Sequence
  Description of Artificial Sequence: Synthetic oligonucleotide
  Target: ATXN1; (-) strand; PAM type: YTN; PAM sequence: CTT
agtctaaactcttaagccat

SEQ ID NO: 156390 - DNA, 20 bp, Artificial Sequence
  Description of Artificial Sequence: Synthetic oligonucleotide
  Target: ATXN1; (-) strand; PAM type: YTN; PAM sequence: TTC
ttagtctaaactcttaagcc

SEQ ID NO: 156391 - DNA, 20 bp, Artificial Sequence
  Description of Artificial Sequence: Synthetic oligonucleotide
  Target: ATXN1; (-) strand; PAM type: YTN; PAM sequence: CTT
cttagtctaaactcttaagc

SEQ ID NO: 156392 - DNA, 20 bp, Artificial Sequence
  Description of Artificial Sequence: Synthetic oligonucleotide
  Target: ATXN1; (-) strand; PAM type: YTN; PAM sequence: CTC
ccttcttagtctaaactctt

SEQ ID NO: 156393 - DNA, 20 bp, Artificial Sequence
  Description of Artificial Sequence: Synthetic oligonucleotide
  Target: ATXN1; (-) strand; PAM type: YTN; PAM sequence: CTG
agctcccttcttagtctaaa

SEQ ID NO: 156394 - DNA, 20 bp, Artificial Sequence
  Description of Artificial Sequence: Synthetic oligonucleotide
  Target: ATXN1; (-) strand; PAM type: YTN; PAM sequence: CTC
tgagctcccttcttagtcta

SEQ ID NO: 156395 - DNA, 20 bp, Artificial Sequence
  Description of Artificial Sequence: Synthetic oligonucleotide
  Target: ATXN1; (-) strand; PAM type: YTN; PAM sequence: TTC
tctgagctcccttcttagtc

SEQ ID NO: 156396 - DNA, 20 bp, Artificial Sequence
  Description of Artificial Sequence: Synthetic oligonucleotide
  Target: ATXN1; (-) strand; PAM type: YTN; PAM sequence: CTT
ctctgagctcccttcttagt

SEQ ID NO: 156397 - DNA, 20 bp, Artificial Sequence
  Description of Artificial Sequence: Synthetic oligonucleotide
  Target: ATXN1; (-) strand; PAM type: YTN; PAM sequence: CTG
aaagtacttctctgagctcc

SEQ ID NO: 156398 - DNA, 20 bp, Artificial Sequence
  Description of Artificial Sequence: Synthetic oligonucleotide
  Target: ATXN1; (-) strand; PAM type: YTN; PAM sequence: CTA
tgctgaaagtacttctctga

SEQ ID NO: 156399 - DNA, 20 bp, Artificial Sequence
  Description of Artificial Sequence: Synthetic oligonucleotide
  Target: ATXN1; (-) strand; PAM type: YTN; PAM sequence: TTC
ctatgctgaaagtacttctc

SEQ ID NO: 156400 - DNA, 20 bp, Artificial Sequence
  Description of Artificial Sequence: Synthetic oligonucleotide
  Target: ATXN1; (-) strand; PAM type: YTN; PAM sequence: TTC
attcctatgctgaaagtact

SEQ ID NO: 156401 - DNA, 20 bp, Artificial Sequence
  Description of Artificial Sequence: Synthetic oligonucleotide
  Target: ATXN1; (-) strand; PAM type: YTN; PAM sequence: CTG
ttcattcctatgctgaaagt

SEQ ID NO: 156402 - DNA, 20 bp, Artificial Sequence
  Description of Artificial Sequence: Synthetic oligonucleotide
  Target: ATXN1; (-) strand; PAM type: YTN; PAM sequence: TTG
agaatactgttcattcctat

SEQ ID NO: 156403 - DNA, 20 bp, Artificial Sequence
  Description of Artificial Sequence: Synthetic oligonucleotide
  Target: ATXN1; (-) strand; PAM type: YTN; PAM sequence: TTT
gagaatactgttcattccta

SEQ ID NO: 156404 - DNA, 20 bp, Artificial Sequence
  Description of Artificial Sequence: Synthetic oligonucleotide
  Target: ATXN1; (-) strand; PAM type: YTN; PAM sequence: CTG
cgatttgagaatactgttca

SEQ ID NO: 156405 - DNA, 20 bp, Artificial Sequence
  Description of Artificial Sequence: Synthetic oligonucleotide
  Target: ATXN1; (-) strand; PAM type: YTN; PAM sequence: TTC
tgcgatttgagaatactgtt

SEQ ID NO: 156406 - DNA, 20 bp, Artificial Sequence
  Description of Artificial Sequence: Synthetic oligonucleotide
  Target: ATXN1; (-) strand; PAM type: YTN; PAM sequence: CTC
ggtattctgcgatttgagaa

SEQ ID NO: 156407 - DNA, 20 bp, Artificial Sequence
  Description of Artificial Sequence: Synthetic oligonucleotide
  Target: ATXN1; (-) strand; PAM type: YTN; PAM sequence: CTG
agggaggggaactcggtatt

SEQ ID NO: 156408 - DNA, 20 bp, Artificial Sequence
  Description of Artificial Sequence: Synthetic oligonucleotide
  Target: ATXN1; (-) strand; PAM type: YTN; PAM sequence: CTC
gtctgagggaggggaactcg

SEQ ID NO: 156409 - DNA, 20 bp, Artificial Sequence
  Description of Artificial Sequence: Synthetic oligonucleotide
  Target: ATXN1; (-) strand; PAM type: YTN; PAM sequence: TTA
catatagccctcgtctgagg

SEQ ID NO: 156410 - DNA, 20 bp, Artificial Sequence
  Description of Artificial Sequence: Synthetic oligonucleotide
  Target: ATXN1; (-) strand; PAM type: YTN; PAM sequence: TTG
ttacatatagccctcgtctg

SEQ ID NO: 156411 - DNA, 20 bp, Artificial Sequence
  Description of Artificial Sequence: Synthetic oligonucleotide
  Target: ATXN1; (-) strand; PAM type: YTN; PAM sequence: TTT
gttacatatagccctcgtct

SEQ ID NO: 156412 - DNA, 20 bp, Artificial Sequence
  Description of Artificial Sequence: Synthetic oligonucleotide
  Target: ATXN1; (-) strand; PAM type: YTN; PAM sequence: TTT
tgttacatatagccctcgtc

SEQ ID NO: 156413 - DNA, 20 bp, Artificial Sequence
  Description of Artificial Sequence: Synthetic oligonucleotide
  Target: ATXN1; (-) strand; PAM type: YTN; PAM sequence: TTT
ttgttacatatagccctcgt

SEQ ID NO: 156414 - DNA, 20 bp, Artificial Sequence
  Description of Artificial Sequence: Synthetic oligonucleotide
  Target: ATXN1; (-) strand; PAM type: YTN; PAM sequence: TTA
tttttgttacatatagccct

SEQ ID NO: 156415 - DNA, 20 bp, Artificial Sequence
  Description of Artificial Sequence: Synthetic oligonucleotide
  Target: ATXN1; (-) strand; PAM type: YTN; PAM sequence: TTG
ttatttttgttacatatagc

SEQ ID NO: 156416 - DNA, 20 bp, Artificial Sequence
  Description of Artificial Sequence: Synthetic oligonucleotide
  Target: ATXN1; (-) strand; PAM type: YTN; PAM sequence: TTA
ttgttatttttgttacatat

SEQ ID NO: 156417 - DNA, 20 bp, Artificial Sequence
  Description of Artificial Sequence: Synthetic oligonucleotide
  Target: ATXN1; (-) strand; PAM type: YTN; PAM sequence: CTT
attgttatttttgttacata

SEQ ID NO: 156418 - DNA, 20 bp, Artificial Sequence
  Description of Artificial Sequence: Synthetic oligonucleotide
  Target: ATXN1; (-) strand; PAM type: YTN; PAM sequence: CTA
tgcttattgttatttttgtt

SEQ ID NO: 156419 - DNA, 20 bp, Artificial Sequence
  Description of Artificial Sequence: Synthetic oligonucleotide
  Target: ATXN1; (-) strand; PAM type: YTN; PAM sequence: CTA
tacctatgcttattgttatt

SEQ ID NO: 156420 - DNA, 20 bp, Artificial Sequence
  Description of Artificial Sequence: Synthetic oligonucleotide
  Target: ATXN1; (-) strand; PAM type: YTN; PAM sequence: TTA
aactatacctatgcttattg

SEQ ID NO: 156421 - DNA, 20 bp, Artificial Sequence
  Description of Artificial Sequence: Synthetic oligonucleotide
  Target: ATXN1; (-) strand; PAM type: YTN; PAM sequence: CTT
aaactatacctatgcttatt

SEQ ID NO: 156422 - DNA, 20 bp, Artificial Sequence
  Description of Artificial Sequence: Synthetic oligonucleotide
  Target: ATXN1; (-) strand; PAM type: YTN; PAM sequence: CTC
ttaaactatacctatgctta

SEQ ID NO: 156423 - DNA, 20 bp, Artificial Sequence
  Description of Artificial Sequence: Synthetic oligonucleotide
  Target: ATXN1; (-) strand; PAM type: YTN; PAM sequence: CTA
cgtaaaaggctcttaaacta

SEQ ID NO: 156424 - DNA, 20 bp, Artificial Sequence
  Description of Artificial Sequence: Synthetic oligonucleotide
  Target: ATXN1; (-) strand; PAM type: YTN; PAM sequence: TTA
ctacgtaaaaggctcttaaa

SEQ ID NO: 156425 - DNA, 20 bp, Artificial Sequence
  Description of Artificial Sequence: Synthetic oligonucleotide
  Target: ATXN1; (-) strand; PAM type: YTN; PAM sequence: CTG
gaagaattactacgtaaaag

SEQ ID NO: 156426 - DNA, 20 bp, Artificial Sequence
  Description of Artificial Sequence: Synthetic oligonucleotide
  Target: ATXN1; (-) strand; PAM type: YTN; PAM sequence: TTA
tggcctggaagaattactac

SEQ ID NO: 156427 - DNA, 20 bp, Artificial Sequence
  Description of Artificial Sequence: Synthetic oligonucleotide
  Target: ATXN1; (-) strand; PAM type: YTN; PAM sequence: TTG
tatggttatggcctggaaga

SEQ ID NO: 156428 - DNA, 20 bp, Artificial Sequence
  Description of Artificial Sequence: Synthetic oligonucleotide
  Target: ATXN1; (-) strand; PAM type: YTN; PAM sequence: TTT
gtatggttatggcctggaag

SEQ ID NO: 156429 - DNA, 20 bp, Artificial Sequence
  Description of Artificial Sequence: Synthetic oligonucleotide
  Target: ATXN1; (-) strand; PAM type: YTN; PAM sequence: CTA
aatgatcagatttgtatggt

SEQ ID NO: 156430 - DNA, 20 bp, Artificial Sequence
  Description of Artificial Sequence: Synthetic oligonucleotide
  Target: ATXN1; (-) strand; PAM type: YTN; PAM sequence: TTG
tcatgtctaaatgatcagat

SEQ ID NO: 156431 - DNA, 20 bp, Artificial Sequence
  Description of Artificial Sequence: Synthetic oligonucleotide
  Target: ATXN1; (-) strand; PAM type: YTN; PAM sequence: TTT
gtcatgtctaaatgatcaga

SEQ ID NO: 156432 - DNA, 20 bp, Artificial Sequence
  Description of Artificial Sequence: Synthetic oligonucleotide
  Target: ATXN1; (-) strand; PAM type: YTN; PAM sequence: TTG
tatatagaaatttgtcatgt

SEQ ID NO: 156433 - DNA, 20 bp, Artificial Sequence
  Description of Artificial Sequence: Synthetic oligonucleotide
  Target: ATXN1; (-) strand; PAM type: YTN; PAM sequence: TTT
gtatatagaaatttgtcatg

SEQ ID NO: 156434 - DNA, 20 bp, Artificial Sequence
  Description of Artificial Sequence: Synthetic oligonucleotide
  Target: ATXN1; (-) strand; PAM type: YTN; PAM sequence: TTT
tgtatatagaaatttgtcat

SEQ ID NO: 156435 - DNA, 20 bp, Artificial Sequence
  Description of Artificial Sequence: Synthetic oligonucleotide
  Target: ATXN1; (-) strand; PAM type: YTN; PAM sequence: TTT
ttgtatatagaaatttgtca

SEQ ID NO: 156436 - DNA, 20 bp, Artificial Sequence
  Description of Artificial Sequence: Synthetic oligonucleotide
  Target: ATXN1; (-) strand; PAM type: YTN; PAM sequence: TTT
tttgtatatagaaatttgtc

SEQ ID NO: 156437 - DNA, 20 bp, Artificial Sequence
  Description of Artificial Sequence: Synthetic oligonucleotide
  Target: ATXN1; (-) strand; PAM type: YTN; PAM sequence: TTT
ttttgtatatagaaatttgt

SEQ ID NO: 156438 - DNA, 20 bp, Artificial Sequence
  Description of Artificial Sequence: Synthetic oligonucleotide
  Target: ATXN1; (-) strand; PAM type: YTN; PAM sequence: TTA
catgtttttttgtatataga

SEQ ID NO: 156439 - DNA, 20 bp, Artificial Sequence
  Description of Artificial Sequence: Synthetic oligonucleotide
  Target: ATXN1; (-) strand; PAM type: YTN; PAM sequence: TTG
aaagttacatgtttttttgt

SEQ ID NO: 156440 - DNA, 20 bp, Artificial Sequence
  Description of Artificial Sequence: Synthetic oligonucleotide
  Target: ATXN1; (-) strand; PAM type: YTN; PAM sequence: TTG
taaaaaaaaaaaagcagaga

SEQ ID NO: 156441 - DNA, 20 bp, Artificial Sequence
  Description of Artificial Sequence: Synthetic oligonucleotide
  Target: ATXN1; (-) strand; PAM type: YTN; PAM sequence: TTT
gtaaaaaaaaaaaagcagag

SEQ ID NO: 156442 - DNA, 20 bp, Artificial Sequence
  Description of Artificial Sequence: Synthetic oligonucleotide
  Target: ATXN1; (-) strand; PAM type: YTN; PAM sequence: TTG
tttgtaaaaaaaaaaaagca

SEQ ID NO: 156443 - DNA, 20 bp, Artificial Sequence
  Description of Artificial Sequence: Synthetic oligonucleotide
  Target: ATXN1; (-) strand; PAM type: YTN; PAM sequence: TTT
gtttgtaaaaaaaaaaaagc

SEQ ID NO: 156444 - DNA, 20 bp, Artificial Sequence
  Description of Artificial Sequence: Synthetic oligonucleotide
  Target: ATXN1; (-) strand; PAM type: YTN; PAM sequence: CTT
tgtttgtaaaaaaaaaaaag

SEQ ID NO: 156445 - DNA, 20 bp, Artificial Sequence
  Description of Artificial Sequence: Synthetic oligonucleotide
  Target: ATXN1; (-) strand; PAM type: YTN; PAM sequence: TTC
atactttgtttgtaaaaaaa

SEQ ID NO: 156446 - DNA, 20 bp, Artificial Sequence
  Description of Artificial Sequence: Synthetic oligonucleotide
  Target: ATXN1; (-) strand; PAM type: YTN; PAM sequence: TTT
catactttgtttgtaaaaaa

SEQ ID NO: 156447 - DNA, 20 bp, Artificial Sequence
  Description of Artificial Sequence: Synthetic oligonucleotide
  Target: ATXN1; (-) strand; PAM type: YTN; PAM sequence: TTG
aaacaatgagtttcatactt

SEQ ID NO: 156448 - DNA, 20 bp, Artificial Sequence
  Description of Artificial Sequence: Synthetic oligonucleotide
  Target: ATXN1; (-) strand; PAM type: YTN; PAM sequence: CTG
ttgaaacaatgagtttcata

SEQ ID NO: 156449 - DNA, 20 bp, Artificial Sequence
  Description of Artificial Sequence: Synthetic oligonucleotide
  Target: ATXN1; (-) strand; PAM type: YTN; PAM sequence: CTC
tgttgaaacaatgagtttca

SEQ ID NO: 156450 - DNA, 20 bp, Artificial Sequence
  Description of Artificial Sequence: Synthetic oligonucleotide
  Target: ATXN1; (-) strand; PAM type: YTN; PAM sequence: TTG
aaagatatggctctgttgaa

SEQ ID NO: 156451 - DNA, 20 bp, Artificial Sequence
  Description of Artificial Sequence: Synthetic oligonucleotide
  Target: ATXN1; (-) strand; PAM type: YTN; PAM sequence: TTT
gaaagatatggctctgttga

SEQ ID NO: 156452 - DNA, 20 bp, Artificial Sequence
  Description of Artificial Sequence: Synthetic oligonucleotide
  Target: ATXN1; (-) strand; PAM type: YTN; PAM sequence: TTC
agtgtttgaaagatatggct

SEQ ID NO: 156453 - DNA, 20 bp, Artificial Sequence
  Description of Artificial Sequence: Synthetic oligonucleotide
  Target: ATXN1; (-) strand; PAM type: YTN; PAM sequence: TTC
attcagtgtttgaaagatat

SEQ ID NO: 156454 - DNA, 20 bp, Artificial Sequence
  Description of Artificial Sequence: Synthetic oligonucleotide
  Target: ATXN1; (-) strand; PAM type: YTN; PAM sequence: TTG
cacaaaagaaaaatgaatgt

SEQ ID NO: 156455 - DNA, 20 bp, Artificial Sequence
  Description of Artificial Sequence: Synthetic oligonucleotide
  Target: ATXN1; (-) strand; PAM type: YTN; PAM sequence: TTA
aaaaattgcacaaaagaaaa

SEQ ID NO: 156456 - DNA, 20 bp, Artificial Sequence
  Description of Artificial Sequence: Synthetic oligonucleotide
  Target: ATXN1; (-) strand; PAM type: YTN; PAM sequence: TTT
aaaaaattgcacaaaagaaa

SEQ ID NO: 156457 - DNA, 20 bp, Artificial Sequence
  Description of Artificial Sequence: Synthetic oligonucleotide
  Target: ATXN1; (-) strand; PAM type: YTN; PAM sequence: TTT
taaaaaattgcacaaaagaa

SEQ ID NO: 156458 - DNA, 20 bp, Artificial Sequence
  Description of Artificial Sequence: Synthetic oligonucleotide
  Target: ATXN1; (-) strand; PAM type: YTN; PAM sequence: TTG
aggagtacaggtaatgtttt

SEQ ID NO: 156459 - DNA, 20 bp, Artificial Sequence
  Description of Artificial Sequence: Synthetic oligonucleotide
  Target: ATXN1; (-) strand; PAM type: YTN; PAM sequence: TTT
gaggagtacaggtaatgttt

SEQ ID NO: 156460 - DNA, 20 bp, Artificial Sequence
  Description of Artificial Sequence: Synthetic oligonucleotide
  Target: ATXN1; (-) strand; PAM type: YTN; PAM sequence: CTT
tgaggagtacaggtaatgtt

SEQ ID NO: 156461 - DNA, 20 bp, Artificial Sequence
  Description of Artificial Sequence: Synthetic oligonucleotide
  Target: ATXN1; (-) strand; PAM type: YTN; PAM sequence: CTC
actttgaggagtacaggtaa

SEQ ID NO: 156462 - DNA, 20 bp, Artificial Sequence
  Description of Artificial Sequence: Synthetic oligonucleotide
  Target: ATXN1; (-) strand; PAM type: YTN; PAM sequence: TTG
aagcactcactttgaggagt

SEQ ID NO: 156463 - DNA, 20 bp, Artificial Sequence
  Description of Artificial Sequence: Synthetic oligonucleotide
  Target: ATXN1; (-) strand; PAM type: YTN; PAM sequence: TTT
gaagcactcactttgaggag

SEQ ID NO: 156464 - DNA, 20 bp, Artificial Sequence
  Description of Artificial Sequence: Synthetic oligonucleotide
  Target: ATXN1; (-) strand; PAM type: YTN; PAM sequence: TTT
tgaagcactcactttgagga

SEQ ID NO: 156465 - DNA, 20 bp, Artificial Sequence
  Description of Artificial Sequence: Synthetic oligonucleotide
  Target: ATXN1; (-) strand; PAM type: YTN; PAM sequence: CTG
aagaaaacaaaattttgaag

SEQ ID NO: 156466 - DNA, 20 bp, Artificial Sequence
  Description of Artificial Sequence: Synthetic oligonucleotide
  Target: ATXN1; (-) strand; PAM type: YTN; PAM sequence: TTG
agaagctgaagaaaacaaaa

SEQ ID NO: 156467 - DNA, 20 bp, Artificial Sequence
  Description of Artificial Sequence: Synthetic oligonucleotide
  Target: ATXN1; (-) strand; PAM type: YTN; PAM sequence: TTT
gagaagctgaagaaaacaaa

SEQ ID NO: 156468 - DNA, 20 bp, Artificial Sequence
  Description of Artificial Sequence: Synthetic oligonucleotide
  Target: ATXN1; (-) strand; PAM type: YTN; PAM sequence: CTG
atttgagaagctgaagaaaa

SEQ ID NO: 156469 - DNA, 20 bp, Artificial Sequence
  Description of Artificial Sequence: Synthetic oligonucleotide
  Target: ATXN1; (-) strand; PAM type: YTN; PAM sequence: TTA
aatgtacacctgatttgaga

SEQ ID NO: 156470 - DNA, 20 bp, Artificial Sequence
  Description of Artificial Sequence: Synthetic oligonucleotide
  Target: ATXN1; (-) strand; PAM type: YTN; PAM sequence: TTT
aaatgtacacctgatttgag

SEQ ID NO: 156471 - DNA, 20 bp, Artificial Sequence
  Description of Artificial Sequence: Synthetic oligonucleotide
  Target: ATXN1; (-) strand; PAM type: YTN; PAM sequence: TTT
taaatgtacacctgatttga

SEQ ID NO: 156472 - DNA, 20 bp, Artificial Sequence
  Description of Artificial Sequence: Synthetic oligonucleotide
  Target: ATXN1; (-) strand; PAM type: YTN; PAM sequence: TTT
ttaaatgtacacctgatttg

SEQ ID NO: 156473 - DNA, 20 bp, Artificial Sequence
  Description of Artificial Sequence: Synthetic oligonucleotide
  Target: ATXN1; (-) strand; PAM type: YTN; PAM sequence: TTT
tttaaatgtacacctgattt

SEQ ID NO: 156474 - DNA, 20 bp, Artificial Sequence
  Description of Artificial Sequence: Synthetic oligonucleotide
  Target: ATXN1; (-) strand; PAM type: YTN; PAM sequence: TTT
ttttaaatgtacacctgatt

SEQ ID NO: 156475 - DNA, 20 bp, Artificial Sequence
  Description of Artificial Sequence: Synthetic oligonucleotide
  Target: ATXN1; (-) strand; PAM type: YTN; PAM sequence: TTT
tttttaaatgtacacctgat

SEQ ID NO: 156476 - DNA, 20 bp, Artificial Sequence
  Description of Artificial Sequence: Synthetic oligonucleotide
  Target: ATXN1; (-) strand; PAM type: YTN; PAM sequence: TTT
ttttttaaatgtacacctga

SEQ ID NO: 156477 - DNA, 20 bp, Artificial Sequence
  Description of Artificial Sequence: Synthetic oligonucleotide
  Target: ATXN1; (-) strand; PAM type: YTN; PAM sequence: TTG
tgggaatttttttttaaatg

SEQ ID NO: 156478 - DNA, 20 bp, Artificial Sequence
  Description of Artificial Sequence: Synthetic oligonucleotide
  Target: ATXN1; (-) strand; PAM type: YTN; PAM sequence: CTT
gtgggaatttttttttaaat

SEQ ID NO: 156479 - DNA, 20 bp, Artificial Sequence
  Description of Artificial Sequence: Synthetic oligonucleotide
  Target: ATXN1; (-) strand; PAM type: YTN; PAM sequence: CTA
taccttgtgggaattttttt

SEQ ID NO: 156480 - DNA, 20 bp, Artificial Sequence
  Description of Artificial Sequence: Synthetic oligonucleotide
  Target: ATXN1; (-) strand; PAM type: YTN; PAM sequence: TTG
tagcactataccttgtggga

SEQ ID NO: 156481 - DNA, 20 bp, Artificial Sequence
  Description of Artificial Sequence: Synthetic oligonucleotide
  Target: ATXN1; (-) strand; PAM type: YTN; PAM sequence: CTT
gtagcactataccttgtggg

SEQ ID NO: 156482 - DNA, 20 bp, Artificial Sequence
  Description of Artificial Sequence: Synthetic oligonucleotide
  Target: ATXN1; (-) strand; PAM type: YTN; PAM sequence: TTC
ttgtagcactataccttgtg

SEQ ID NO: 156483 - DNA, 20 bp, Artificial Sequence
  Description of Artificial Sequence: Synthetic oligonucleotide
  Target: ATXN1; (-) strand; PAM type: YTN; PAM sequence: TTT
cttgtagcactataccttgt

SEQ ID NO: 156484 - DNA, 20 bp, Artificial Sequence
  Description of Artificial Sequence: Synthetic oligonucleotide
  Target: ATXN1; (-) strand; PAM type: YTN; PAM sequence: TTT
tcttgtagcactataccttg

SEQ ID NO: 156485 - DNA, 20 bp, Artificial Sequence
  Description of Artificial Sequence: Synthetic oligonucleotide
  Target: ATXN1; (-) strand; PAM type: YTN; PAM sequence: CTT
ttcttgtagcactatacctt

SEQ ID NO: 156486 - DNA, 20 bp, Artificial Sequence
  Description of Artificial Sequence: Synthetic oligonucleotide
  Target: ATXN1; (-) strand; PAM type: YTN; PAM sequence: CTG
atgataggatcttttcttgt

SEQ ID NO: 156487 - DNA, 20 bp, Artificial Sequence
  Description of Artificial Sequence: Synthetic oligonucleotide
  Target: ATXN1; (-) strand; PAM type: YTN; PAM sequence: TTA
ctgatgataggatcttttct

SEQ ID NO: 156488 - DNA, 20 bp, Artificial Sequence
  Description of Artificial Sequence: Synthetic oligonucleotide
  Target: ATXN1; (-) strand; PAM type: YTN; PAM sequence: CTT
actgatgataggatcttttc

SEQ ID NO: 156489 - DNA, 20 bp, Artificial Sequence
  Description of Artificial Sequence: Synthetic oligonucleotide
  Target: ATXN1; (-) strand; PAM type: YTN; PAM sequence: TTA
ccttactgatgataggatct

SEQ ID NO: 156490 - DNA, 20 bp, Artificial Sequence
  Description of Artificial Sequence: Synthetic oligonucleotide
  Target: ATXN1; (-) strand; PAM type: YTN; PAM sequence: TTC
aaatacgttaccttactgat

SEQ ID NO: 156491 - DNA, 20 bp, Artificial Sequence
  Description of Artificial Sequence: Synthetic oligonucleotide
  Target: ATXN1; (-) strand; PAM type: YTN; PAM sequence: CTT
caaatacgttaccttactga

SEQ ID NO: 156492 - DNA, 20 bp, Artificial Sequence
  Description of Artificial Sequence: Synthetic oligonucleotide
  Target: ATXN1; (-) strand; PAM type: YTN; PAM sequence: CTC
gcttcaaatacgttacctta

SEQ ID NO: 156493 - DNA, 20 bp, Artificial Sequence
  Description of Artificial Sequence: Synthetic oligonucleotide
  Target: ATXN1; (-) strand; PAM type: YTN; PAM sequence: TTA
catagatgacctcgcttcaa

SEQ ID NO: 156494 - DNA, 20 bp, Artificial Sequence
  Description of Artificial Sequence: Synthetic oligonucleotide
  Target: ATXN1; (-) strand; PAM type: YTN; PAM sequence: TTT
acatagatgacctcgcttca

SEQ ID NO: 156495 - DNA, 20 bp, Artificial Sequence
  Description of Artificial Sequence: Synthetic oligonucleotide
  Target: ATXN1; (-) strand; PAM type: YTN; PAM sequence: TTT
tacatagatgacctcgcttc

SEQ ID NO: 156496 - DNA, 20 bp, Artificial Sequence
  Description of Artificial Sequence: Synthetic oligonucleotide
  Target: ATXN1; (-) strand; PAM type: YTN; PAM sequence: CTT
ttacatagatgacctcgctt

SEQ ID NO: 156497 - DNA, 20 bp, Artificial Sequence
  Description of Artificial Sequence: Synthetic oligonucleotide
  Target: ATXN1; (-) strand; PAM type: YTN; PAM sequence: TTC
ttttacatagatgacctcgc

SEQ ID NO: 156498 - DNA, 20 bp, Artificial Sequence
  Description of Artificial Sequence: Synthetic oligonucleotide
  Target: ATXN1; (-) strand; PAM type: YTN; PAM sequence: TTT
cttttacatagatgacctcg

SEQ ID NO: 156499 - DNA, 20 bp, Artificial Sequence
  Description of Artificial Sequence: Synthetic oligonucleotide
  Target: ATXN1; (-) strand; PAM type: YTN; PAM sequence: CTG
agatttcttttacatagatg

SEQ ID NO: 156500 - DNA, 20 bp, Artificial Sequence
  Description of Artificial Sequence: Synthetic oligonucleotide
  Target: ATXN1; (-) strand; PAM type: YTN; PAM sequence: CTC
cggagctgagatttctttta

SEQ ID NO: 156501 - DNA, 20 bp, Artificial Sequence
  Description of Artificial Sequence: Synthetic oligonucleotide
  Target: ATXN1; (-) strand; PAM type: YTN; PAM sequence: CTA
ctccggagctgagatttctt

SEQ ID NO: 156502 - DNA, 20 bp, Artificial Sequence
  Description of Artificial Sequence: Synthetic oligonucleotide
  Target: ATXN1; (-) strand; PAM type: YTN; PAM sequence: CTC
tactccggagctgagatttc

SEQ ID NO: 156503 - DNA, 20 bp, Artificial Sequence
  Description of Artificial Sequence: Synthetic oligonucleotide
  Target: ATXN1; (-) strand; PAM type: YTN; PAM sequence: TTG
cacacctctactccggagct

SEQ ID NO: 156504 - DNA, 20 bp, Artificial Sequence
  Description of Artificial Sequence: Synthetic oligonucleotide
  Target: ATXN1; (-) strand; PAM type: YTN; PAM sequence: CTT
gcacacctctactccggagc

SEQ ID NO: 156505 - DNA, 20 bp, Artificial Sequence
  Description of Artificial Sequence: Synthetic oligonucleotide
  Target: ATXN1; (-) strand; PAM type: YTN; PAM sequence: CTC
caaacaacttgcacacctct

SEQ ID NO: 156506 - DNA, 20 bp, Artificial Sequence
  Description of Artificial Sequence: Synthetic oligonucleotide
  Target: ATXN1; (-) strand; PAM type: YTN; PAM sequence: CTG
gcatagggaaactccaaaca

SEQ ID NO: 156507 - DNA, 20 bp, Artificial Sequence
  Description of Artificial Sequence: Synthetic oligonucleotide
  Target: ATXN1; (-) strand; PAM type: YTN; PAM sequence: TTC
tggcatagggaaactccaaa

SEQ ID NO: 156508 - DNA, 20 bp, Artificial Sequence
  Description of Artificial Sequence: Synthetic oligonucleotide
  Target: ATXN1; (-) strand; PAM type: YTN; PAM sequence: TTT
ctggcatagggaaactccaa

SEQ ID NO: 156509 - DNA, 20 bp, Artificial Sequence
  Description of Artificial Sequence: Synthetic oligonucleotide
  Target: ATXN1; (-) strand; PAM type: YTN; PAM sequence: TTG
tgtttctggcatagggaaac

SEQ ID NO: 156510 - DNA, 20 bp, Artificial Sequence
  Description of Artificial Sequence: Synthetic oligonucleotide
  Target: ATXN1; (-) strand; PAM type: YTN; PAM sequence: TTC
cacggacagtgttgtgtttc

SEQ ID NO: 156511 - DNA, 20 bp, Artificial Sequence
  Description of Artificial Sequence: Synthetic oligonucleotide
  Target: ATXN1; (-) strand; PAM type: YTN; PAM sequence: TTT
ccacggacagtgttgtgttt

SEQ ID NO: 156512 - DNA, 20 bp, Artificial Sequence
  Description of Artificial Sequence: Synthetic oligonucleotide
  Target: ATXN1; (-) strand; PAM type: YTN; PAM sequence: TTT
tccacggacagtgttgtgtt

SEQ ID NO: 156513 - DNA, 20 bp, Artificial Sequence
  Description of Artificial Sequence: Synthetic oligonucleotide
  Target: ATXN1; (-) strand; PAM type: YTN; PAM sequence: CTT
ttccacggacagtgttgtgt

SEQ ID NO: 156514 - DNA, 20 bp, Artificial Sequence
  Description of Artificial Sequence: Synthetic oligonucleotide
  Target: ATXN1; (-) strand; PAM type: YTN; PAM sequence: CTC
ttttccacggacagtgttgt

SEQ ID NO: 156515 - DNA, 20 bp, Artificial Sequence
  Description of Artificial Sequence: Synthetic oligonucleotide
  Target: ATXN1; (-) strand; PAM type: YTN; PAM sequence: CTC
tcttttccacggacagtgtt

SEQ ID NO: 156516 - DNA, 20 bp, Artificial Sequence
  Description of Artificial Sequence: Synthetic oligonucleotide
  Target: ATXN1; (-) strand; PAM type: YTN; PAM sequence: TTC
ctctcttttccacggacagt

SEQ ID NO: 156517 - DNA, 20 bp, Artificial Sequence
  Description of Artificial Sequence: Synthetic oligonucleotide
  Target: ATXN1; (-) strand; PAM type: YTN; PAM sequence: TTT
cctctcttttccacggacag

SEQ ID NO: 156518 - DNA, 20 bp, Artificial Sequence
  Description of Artificial Sequence: Synthetic oligonucleotide
  Target: ATXN1; (-) strand; PAM type: YTN; PAM sequence: TTG
gtttcctctcttttccacgg

SEQ ID NO: 156519 - DNA, 20 bp, Artificial Sequence
  Description of Artificial Sequence: Synthetic oligonucleotide
  Target: ATXN1; (-) strand; PAM type: YTN; PAM sequence: TTG
ggttggtttcctctcttttc

SEQ ID NO: 156520 - DNA, 20 bp, Artificial Sequence
  Description of Artificial Sequence: Synthetic oligonucleotide
  Target: ATXN1; (-) strand; PAM type: YTN; PAM sequence: TTG
tgttgggttggtttcctctc

SEQ ID NO: 156521 - DNA, 20 bp, Artificial Sequence
  Description of Artificial Sequence: Synthetic oligonucleotide
  Target: ATXN1; (-) strand; PAM type: YTN; PAM sequence: CTA
ttgtgttgggttggtttcct

SEQ ID NO: 156522 - DNA, 20 bp, Artificial Sequence
  Description of Artificial Sequence: Synthetic oligonucleotide
  Target: ATXN1; (-) strand; PAM type: YTN; PAM sequence: CTG
ctattgtgttgggttggttt

SEQ ID NO: 156523 - DNA, 20 bp, Artificial Sequence
  Description of Artificial Sequence: Synthetic oligonucleotide
  Target: ATXN1; (-) strand; PAM type: YTN; PAM sequence: TTA
taaagcacatgcatctgcta

SEQ ID NO: 156524 - DNA, 20 bp, Artificial Sequence
  Description of Artificial Sequence: Synthetic oligonucleotide
  Target: ATXN1; (-) strand; PAM type: YTN; PAM sequence: TTT
ataaagcacatgcatctgct

SEQ ID NO: 156525 - DNA, 20 bp, Artificial Sequence
  Description of Artificial Sequence: Synthetic oligonucleotide
  Target: ATXN1; (-) strand; PAM type: YTN; PAM sequence: TTT
tataaagcacatgcatctgc

SEQ ID NO: 156526 - DNA, 20 bp, Artificial Sequence
  Description of Artificial Sequence: Synthetic oligonucleotide
  Target: ATXN1; (-) strand; PAM type: YTN; PAM sequence: TTT
ttataaagcacatgcatctg

SEQ ID NO: 156527 - DNA, 20 bp, Artificial Sequence
  Description of Artificial Sequence: Synthetic oligonucleotide
  Target: ATXN1; (-) strand; PAM type: YTN; PAM sequence: TTT
tttataaagcacatgcatct

SEQ ID NO: 156528 - DNA, 20 bp, Artificial Sequence
  Description of Artificial Sequence: Synthetic oligonucleotide
  Target: ATXN1; (-) strand; PAM type: YTN; PAM sequence: CTT
ttttataaagcacatgcatc

SEQ ID NO: 156529 - DNA, 20 bp, Artificial Sequence
  Description of Artificial Sequence: Synthetic oligonucleotide
  Target: ATXN1; (-) strand; PAM type: YTN; PAM sequence: TTA
agaacacatcaagtaataaa

SEQ ID NO: 156530 - DNA, 20 bp, Artificial Sequence
  Description of Artificial Sequence: Synthetic oligonucleotide
  Target: ATXN1; (-) strand; PAM type: YTN; PAM sequence: TTT
aagaacacatcaagtaataa

SEQ ID NO: 156531 - DNA, 20 bp, Artificial Sequence
  Description of Artificial Sequence: Synthetic oligonucleotide
  Target: ATXN1; (-) strand; PAM type: YTN; PAM sequence: CTG
aaatagagaatttaagaaca

SEQ ID NO: 156532 - DNA, 20 bp, Artificial Sequence
  Description of Artificial Sequence: Synthetic oligonucleotide
  Target: ATXN1; (-) strand; PAM type: YTN; PAM sequence: TTC
tgaaatagagaatttaagaa

SEQ ID NO: 156533 - DNA, 20 bp, Artificial Sequence
  Description of Artificial Sequence: Synthetic oligonucleotide
  Target: ATXN1; (-) strand; PAM type: YTN; PAM sequence: TTT
ctgaaatagagaatttaaga

SEQ ID NO: 156534 - DNA, 20 bp, Artificial Sequence
  Description of Artificial Sequence: Synthetic oligonucleotide
  Target: ATXN1; (-) strand; PAM type: YTN; PAM sequence: TTA
acccagaatttctgaaatag

SEQ ID NO: 156535 - DNA, 20 bp, Artificial Sequence
  Description of Artificial Sequence: Synthetic oligonucleotide
  Target: ATXN1; (-) strand; PAM type: YTN; PAM sequence: TTT
aacccagaatttctgaaata

SEQ ID NO: 156536 - DNA, 20 bp, Artificial Sequence
  Description of Artificial Sequence: Synthetic oligonucleotide
  Target: ATXN1; (-) strand; PAM type: YTN; PAM sequence: TTT
taacccagaatttctgaaat

SEQ ID NO: 156537 - DNA, 20 bp, Artificial Sequence
  Description of Artificial Sequence: Synthetic oligonucleotide
  Target: ATXN1; (-) strand; PAM type: YTN; PAM sequence: TTT
ttaacccagaatttctgaaa

SEQ ID NO: 156538 - DNA, 20 bp, Artificial Sequence
  Description of Artificial Sequence: Synthetic oligonucleotide
  Target: ATXN1; (-) strand; PAM type: YTN; PAM sequence: TTG
tttttaacccagaatttctg

SEQ ID NO: 156539 - DNA, 20 bp, Artificial Sequence
  Description of Artificial Sequence: Synthetic oligonucleotide
  Target: ATXN1; (-) strand; PAM type: YTN; PAM sequence: TTT
gtttttaacccagaatttct

SEQ ID NO: 156540 - DNA, 20 bp, Artificial Sequence
  Description of Artificial Sequence: Synthetic oligonucleotide
  Target: ATXN1; (-) strand; PAM type: YTN; PAM sequence: TTC
cacatttgtttttaacccag

SEQ ID NO: 156541 - DNA, 20 bp, Artificial Sequence
  Description of Artificial Sequence: Synthetic oligonucleotide
  Target: ATXN1; (-) strand; PAM type: YTN; PAM sequence: CTT
ccacatttgtttttaaccca

SEQ ID NO: 156542 - DNA, 20 bp, Artificial Sequence
  Description of Artificial Sequence: Synthetic oligonucleotide
  Target: ATXN1; (-) strand; PAM type: YTN; PAM sequence: TTG
cttccacatttgtttttaac

SEQ ID NO: 156543 - DNA, 20 bp, Artificial Sequence
  Description of Artificial Sequence: Synthetic oligonucleotide
  Target: ATXN1; (-) strand; PAM type: YTN; PAM sequence: TTT
gcttccacatttgtttttaa

SEQ ID NO: 156544 - DNA, 20 bp, Artificial Sequence
  Description of Artificial Sequence: Synthetic oligonucleotide
  Target: ATXN1; (-) strand; PAM type: YTN; PAM sequence: CTT
tgcttccacatttgttttta

SEQ ID NO: 156545 - DNA, 20 bp, Artificial Sequence
  Description of Artificial Sequence: Synthetic oligonucleotide
  Target: ATXN1; (-) strand; PAM type: YTN; PAM sequence: TTA
agtggcgtggaggcctttgc

SEQ ID NO: 156546 - DNA, 20 bp, Artificial Sequence
  Description of Artificial Sequence: Synthetic oligonucleotide
  Target: ATXN1; (-) strand; PAM type: YTN; PAM sequence: TTT
aagtggcgtggaggcctttg

SEQ ID NO: 156547 - DNA, 20 bp, Artificial Sequence
  Description of Artificial Sequence: Synthetic oligonucleotide
  Target: ATXN1; (-) strand; PAM type: YTN; PAM sequence: TTT
taagtggcgtggaggccttt

SEQ ID NO: 156548 - DNA, 20 bp, Artificial Sequence
  Description of Artificial Sequence: Synthetic oligonucleotide
  Target: ATXN1; (-) strand; PAM type: YTN; PAM sequence: TTT
ttaagtggcgtggaggcctt

SEQ ID NO: 156549 - DNA, 20 bp, Artificial Sequence
  Description of Artificial Sequence: Synthetic oligonucleotide
  Target: ATXN1; (-) strand; PAM type: YTN; PAM sequence: TTT
tttaagtggcgtggaggcct

SEQ ID NO: 156550 - DNA, 20 bp, Artificial Sequence
  Description of Artificial Sequence: Synthetic oligonucleotide
  Target: ATXN1; (-) strand; PAM type: YTN; PAM sequence: TTT
ttttaagtggcgtggaggcc

SEQ ID NO: 156551 - DNA, 20 bp, Artificial Sequence
  Description of Artificial Sequence: Synthetic oligonucleotide
  Target: ATXN1; (-) strand; PAM type: YTN; PAM sequence: TTT
tttttaagtggcgtggaggc

SEQ ID NO: 156552 - DNA, 20 bp, Artificial Sequence
  Description of Artificial Sequence: Synthetic oligonucleotide
  Target: ATXN1; (-) strand; PAM type: YTN; PAM sequence: TTT
ttttttaagtggcgtggagg

SEQ ID NO: 156553 - DNA, 20 bp, Artificial Sequence
  Description of Artificial Sequence: Synthetic oligonucleotide
  Target: ATXN1; (-) strand; PAM type: YTN; PAM sequence: TTT
tttttttaagtggcgtggag

SEQ ID NO: 156554 - DNA, 20 bp, Artificial Sequence
  Description of Artificial Sequence: Synthetic oligonucleotide
  Target: ATXN1; (-) strand; PAM type: YTN; PAM sequence: TTT
ttttttttaagtggcgtgga

SEQ ID NO: 156555 - DNA, 20 bp, Artificial Sequence
  Description of Artificial Sequence: Synthetic oligonucleotide
  Target: ATXN1; (-) strand; PAM type: YTN; PAM sequence: TTT
tttttttttaagtggcgtgg

SEQ ID NO: 156556 - DNA, 20 bp, Artificial Sequence
  Description of Artificial Sequence: Synthetic oligonucleotide
  Target: ATXN1; (-) strand; PAM type: YTN; PAM sequence: TTT
ttttttttttaagtggcgtg

SEQ ID NO: 156557 - DNA, 20 bp, Artificial Sequence
  Description of Artificial Sequence: Synthetic oligonucleotide
  Target: ATXN1; (-) strand; PAM type: YTN; PAM sequence: CTT
tttttttttttaagtggcgt

SEQ ID NO: 156558 - DNA, 20 bp, Artificial Sequence
  Description of Artificial Sequence: Synthetic oligonucleotide
  Target: ATXN1; (-) strand; PAM type: YTN; PAM sequence: TTA
cactttttttttttttaagt

SEQ ID NO: 156559 - DNA, 20 bp, Artificial Sequence
  Description of Artificial Sequence: Synthetic oligonucleotide
  Target: ATXN1; (-) strand; PAM type: YTN; PAM sequence: TTC
ggtggtgatgtgaaaggaga

SEQ ID NO: 156560 - DNA, 20 bp, Artificial Sequence
  Description of Artificial Sequence: Synthetic oligonucleotide
  Target: ATXN1; (-) strand; PAM type: YTN; PAM sequence: CTT
cggtggtgatgtgaaaggag

SEQ ID NO: 156561 - DNA, 20 bp, Artificial Sequence
  Description of Artificial Sequence: Synthetic oligonucleotide
  Target: ATXN1; (-) strand; PAM type: YTN; PAM sequence: TTC
ttcggtggtgatgtgaaagg

SEQ ID NO: 156562 - DNA, 20 bp, Artificial Sequence
  Description of Artificial Sequence: Synthetic oligonucleotide
  Target: ATXN1; (-) strand; PAM type: YTN; PAM sequence: TTT
cttcggtggtgatgtgaaag

SEQ ID NO: 156563 - DNA, 20 bp, Artificial Sequence
  Description of Artificial Sequence: Synthetic oligonucleotide
  Target: ATXN1; (-) strand; PAM type: YTN; PAM sequence: TTC
ggtttcttcggtggtgatgt

SEQ ID NO: 156564 - DNA, 20 bp, Artificial Sequence
  Description of Artificial Sequence: Synthetic oligonucleotide
  Target: ATXN1; (-) strand; PAM type: YTN; PAM sequence: CTC
catggcccaattcggtttct

SEQ ID NO: 156565 - DNA, 20 bp, Artificial Sequence
  Description of Artificial Sequence: Synthetic oligonucleotide
  Target: ATXN1; (-) strand; PAM type: YTN; PAM sequence: TTG
caccaggtgaaaacagggcc

SEQ ID NO: 156566 - DNA, 20 bp, Artificial Sequence
  Description of Artificial Sequence: Synthetic oligonucleotide
  Target: ATXN1; (-) strand; PAM type: YTN; PAM sequence: TTT
gcaccaggtgaaaacagggc

SEQ ID NO: 156567 - DNA, 20 bp, Artificial Sequence
  Description of Artificial Sequence: Synthetic oligonucleotide
  Target: ATXN1; (-) strand; PAM type: YTN; PAM sequence: TTC
aatttgcaccaggtgaaaac

SEQ ID NO: 156568 - DNA, 20 bp, Artificial Sequence
  Description of Artificial Sequence: Synthetic oligonucleotide
  Target: ATXN1; (-) strand; PAM type: YTN; PAM sequence: CTT
caatttgcaccaggtgaaaa

SEQ ID NO: 156569 - DNA, 20 bp, Artificial Sequence
  Description of Artificial Sequence: Synthetic oligonucleotide
  Target: ATXN1; (-) strand; PAM type: YTN; PAM sequence: TTG
cacttcaatttgcaccaggt

SEQ ID NO: 156570 - DNA, 20 bp, Artificial Sequence
  Description of Artificial Sequence: Synthetic oligonucleotide
  Target: ATXN1; (-) strand; PAM type: YTN; PAM sequence: TTT
gcacttcaatttgcaccagg

SEQ ID NO: 156571 - DNA, 20 bp, Artificial Sequence
  Description of Artificial Sequence: Synthetic oligonucleotide
  Target: ATXN1; (-) strand; PAM type: YTN; PAM sequence: CTT
tgcacttcaatttgcaccag

SEQ ID NO: 156572 - DNA, 20 bp, Artificial Sequence
  Description of Artificial Sequence: Synthetic oligonucleotide
  Target: ATXN1; (-) strand; PAM type: YTN; PAM sequence: CTG
aaaccctttgcacttcaatt

SEQ ID NO: 156573 - DNA, 20 bp, Artificial Sequence
  Description of Artificial Sequence: Synthetic oligonucleotide
  Target: ATXN1; (-) strand; PAM type: YTN; PAM sequence: TTC
tgaaaccctttgcacttcaa

SEQ ID NO: 156574 - DNA, 20 bp, Artificial Sequence
  Description of Artificial Sequence: Synthetic oligonucleotide
  Target: ATXN1; (-) strand; PAM type: YTN; PAM sequence: CTT
ctgaaaccctttgcacttca

SEQ ID NO: 156575 - DNA, 20 bp, Artificial Sequence
  Description of Artificial Sequence: Synthetic oligonucleotide
  Target: ATXN1; (-) strand; PAM type: YTN; PAM sequence: TTG
ccttctgaaaccctttgcac

SEQ ID NO: 156576 - DNA, 20 bp, Artificial Sequence
  Description of Artificial Sequence: Synthetic oligonucleotide
  Target: ATXN1; (-) strand; PAM type: YTN; PAM sequence: CTG
ttgccttctgaaaccctttg

SEQ ID NO: 156577 - DNA, 20 bp, Artificial Sequence
  Description of Artificial Sequence: Synthetic oligonucleotide
  Target: ATXN1; (-) strand; PAM type: YTN; PAM sequence: CTG
gtctgttgccttctgaaacc

SEQ ID NO: 156578 - DNA, 20 bp, Artificial Sequence
  Description of Artificial Sequence: Synthetic oligonucleotide
  Target: ATXN1; (-) strand; PAM type: YTN; PAM sequence: CTC
aacagactggtctgttgcct

SEQ ID NO: 156579 - DNA, 20 bp, Artificial Sequence
  Description of Artificial Sequence: Synthetic oligonucleotide
  Target: ATXN1; (-) strand; PAM type: YTN; PAM sequence: TTC
atgaaccacaagcagctcaa

SEQ ID NO: 156580 - DNA, 20 bp, Artificial Sequence
  Description of Artificial Sequence: Synthetic oligonucleotide
  Target: ATXN1; (-) strand; PAM type: YTN; PAM sequence: TTT
catgaaccacaagcagctca

SEQ ID NO: 156581 - DNA, 20 bp, Artificial Sequence
  Description of Artificial Sequence: Synthetic oligonucleotide
  Target: ATXN1; (-) strand; PAM type: YTN; PAM sequence: CTG
tttcatgaaccacaagcagc

SEQ ID NO: 156582 - DNA, 20 bp, Artificial Sequence
  Description of Artificial Sequence: Synthetic oligonucleotide
  Target: ATXN1; (-) strand; PAM type: YTN; PAM sequence: CTA
ctgtttcatgaaccacaagc

SEQ ID NO: 156583 - DNA, 20 bp, Artificial Sequence
  Description of Artificial Sequence: Synthetic oligonucleotide
  Target: ATXN1; (-) strand; PAM type: YTN; PAM sequence: TTG
tcatggctactgtttcatga

SEQ ID NO: 156584 - DNA, 20 bp, Artificial Sequence
  Description of Artificial Sequence: Synthetic oligonucleotide
  Target: ATXN1; (-) strand; PAM type: YTN; PAM sequence: TTG
gttgtcatggctactgtttc

SEQ ID NO: 156585 - DNA, 20 bp, Artificial Sequence
  Description of Artificial Sequence: Synthetic oligonucleotide
  Target: ATXN1; (-) strand; PAM type: YTN; PAM sequence: CTG
tgttggttgtcatggctact

SEQ ID NO: 156586 - DNA, 20 bp, Artificial Sequence
  Description of Artificial Sequence: Synthetic oligonucleotide
  Target: ATXN1; (-) strand; PAM type: YTN; PAM sequence: TTG
agctgtgttggttgtcatgg

SEQ ID NO: 156587 - DNA, 20 bp, Artificial Sequence
  Description of Artificial Sequence: Synthetic oligonucleotide
  Target: ATXN1; (-) strand; PAM type: YTN; PAM sequence: CTT
gagctgtgttggttgtcatg

SEQ ID NO: 156588 - DNA, 20 bp, Artificial Sequence
  Description of Artificial Sequence: Synthetic oligonucleotide
  Target: ATXN1; (-) strand; PAM type: YTN; PAM sequence: TTC
ttgagctgtgttggttgtca

SEQ ID NO: 156589 - DNA, 20 bp, Artificial Sequence
  Description of Artificial Sequence: Synthetic oligonucleotide
  Target: ATXN1; (-) strand; PAM type: YTN; PAM sequence: CTT
cttgagctgtgttggttgtc

SEQ ID NO: 156590 - DNA, 20 bp, Artificial Sequence
  Description of Artificial Sequence: Synthetic oligonucleotide
  Target: ATXN1; (-) strand; PAM type: YTN; PAM sequence: CTC
ggtaccgaaggccgggcttc

SEQ ID NO: 156591 - DNA, 20 bp, Artificial Sequence
  Description of Artificial Sequence: Synthetic oligonucleotide
  Target: ATXN1; (-) strand; PAM type: YTN; PAM sequence: CTC
tcggtaccgaaggccgggct

SEQ ID NO: 156592 - DNA, 20 bp, Artificial Sequence
  Description of Artificial Sequence: Synthetic oligonucleotide
  Target: ATXN1; (-) strand; PAM type: YTN; PAM sequence: TTC
agatatgggtgaggaagcag

SEQ ID NO: 156593 - DNA, 20 bp, Artificial Sequence
  Description of Artificial Sequence: Synthetic oligonucleotide
  Target: ATXN1; (-) strand; PAM type: YTN; PAM sequence: TTT
cagatatgggtgaggaagca

SEQ ID NO: 156594 - DNA, 20 bp, Artificial Sequence
  Description of Artificial Sequence: Synthetic oligonucleotide
  Target: ATXN1; (-) strand; PAM type: YTN; PAM sequence: CTA
tttcagatatgggtgaggaa

SEQ ID NO: 156595 - DNA, 20 bp, Artificial Sequence
  Description of Artificial Sequence: Synthetic oligonucleotide
  Target: ATXN1; (-) strand; PAM type: YTN; PAM sequence: CTA
ataccgtgctatttcagata

SEQ ID NO: 156596 - DNA, 20 bp, Artificial Sequence
  Description of Artificial Sequence: Synthetic oligonucleotide
  Target: ATXN1; (-) strand; PAM type: YTN; PAM sequence: TTG
aagacactaataccgtgcta

SEQ ID NO: 156597 - DNA, 20 bp, Artificial Sequence
  Description of Artificial Sequence: Synthetic oligonucleotide
  Target: ATXN1; (-) strand; PAM type: YTN; PAM sequence: TTT
gaagacactaataccgtgct

SEQ ID NO: 156598 - DNA, 20 bp, Artificial Sequence
  Description of Artificial Sequence: Synthetic oligonucleotide
  Target: ATXN1; (-) strand; PAM type: YTN; PAM sequence: TTT
tgaagacactaataccgtgc

SEQ ID NO: 156599 - DNA, 20 bp, Artificial Sequence
  Description of Artificial Sequence: Synthetic oligonucleotide
  Target: ATXN1; (-) strand; PAM type: YTN; PAM sequence: CTT
ttgaagacactaataccgtg

SEQ ID NO: 156600 - DNA, 20 bp, Artificial Sequence
  Description of Artificial Sequence: Synthetic oligonucleotide
  Target: ATXN1; (-) strand; PAM type: YTN; PAM sequence: CTC
caatgcttttgaagacacta

SEQ ID NO: 156601 - DNA, 20 bp, Artificial Sequence
  Description of Artificial Sequence: Synthetic oligonucleotide
  Target: ATXN1; (-) strand; PAM type: YTN; PAM sequence: TTC
atagagagaaaaatctccaa

SEQ ID NO: 156602 - DNA, 20 bp, Artificial Sequence
  Description of Artificial Sequence: Synthetic oligonucleotide
  Target: ATXN1; (-) strand; PAM type: YTN; PAM sequence: TTT
catagagagaaaaatctcca

SEQ ID NO: 156603 - DNA, 20 bp, Artificial Sequence
  Description of Artificial Sequence: Synthetic oligonucleotide
  Target: ATXN1; (-) strand; PAM type: YTN; PAM sequence: CTT
tcatagagagaaaaatctcc

SEQ ID NO: 156604 - DNA, 20 bp, Artificial Sequence
  Description of Artificial Sequence: Synthetic oligonucleotide
  Target: ATXN1; (-) strand; PAM type: YTN; PAM sequence: TTC
tttcatagagagaaaaatct

SEQ ID NO: 156605 - DNA, 20 bp, Artificial Sequence
  Description of Artificial Sequence: Synthetic oligonucleotide
  Target: ATXN1; (-) strand; PAM type: YTN; PAM sequence: TTT
ctttcatagagagaaaaatc

SEQ ID NO: 156606 - DNA, 20 bp, Artificial Sequence
  Description of Artificial Sequence: Synthetic oligonucleotide
  Target: ATXN1; (-) strand; PAM type: YTN; PAM sequence: CTA
tttctttcatagagagaaaa

SEQ ID NO: 156607 - DNA, 20 bp, Artificial Sequence
  Description of Artificial Sequence: Synthetic oligonucleotide
  Target: ATXN1; (-) strand; PAM type: YTN; PAM sequence: CTA
aggaaacctatttctttcat

SEQ ID NO: 156608 - DNA, 20 bp, Artificial Sequence
  Description of Artificial Sequence: Synthetic oligonucleotide
  Target: ATXN1; (-) strand; PAM type: YTN; PAM sequence: CTA
ctaaggaaacctatttcttt

SEQ ID NO: 156609 - DNA, 20 bp, Artificial Sequence
  Description of Artificial Sequence: Synthetic oligonucleotide
  Target: ATXN1; (-) strand; PAM type: YTN; PAM sequence: CTG
tgactactaaggaaacctat

SEQ ID NO: 156610 - DNA, 20 bp, Artificial Sequence
  Description of Artificial Sequence: Synthetic oligonucleotide
  Target: ATXN1; (-) strand; PAM type: YTN; PAM sequence: TTA
acatctgtgactactaagga

SEQ ID NO: 156611 - DNA, 20 bp, Artificial Sequence
  Description of Artificial Sequence: Synthetic oligonucleotide
  Target: ATXN1; (-) strand; PAM type: YTN; PAM sequence: TTT
aacatctgtgactactaagg

SEQ ID NO: 156612 - DNA, 20 bp, Artificial Sequence
  Description of Artificial Sequence: Synthetic oligonucleotide
  Target: ATXN1; (-) strand; PAM type: YTN; PAM sequence: CTT
taacatctgtgactactaag

SEQ ID NO: 156613 - DNA, 20 bp, Artificial Sequence
  Description of Artificial Sequence: Synthetic oligonucleotide
  Target: ATXN1; (-) strand; PAM type: YTN; PAM sequence: TTG
acaataccctttaacatctg

SEQ ID NO: 156614 - DNA, 20 bp, Artificial Sequence
  Description of Artificial Sequence: Synthetic oligonucleotide
  Target: ATXN1; (-) strand; PAM type: YTN; PAM sequence: TTA
aggaaacgattgacaatacc

SEQ ID NO: 156615 - DNA, 20 bp, Artificial Sequence
  Description of Artificial Sequence: Synthetic oligonucleotide
  Target: ATXN1; (-) strand; PAM type: YTN; PAM sequence: TTT
aaggaaacgattgacaatac

SEQ ID NO: 156616 - DNA, 20 bp, Artificial Sequence
  Description of Artificial Sequence: Synthetic oligonucleotide
  Target: ATXN1; (-) strand; PAM type: YTN; PAM sequence: TTT
taaggaaacgattgacaata

SEQ ID NO: 156617 - DNA, 20 bp, Artificial Sequence
  Description of Artificial Sequence: Synthetic oligonucleotide
  Target: ATXN1; (-) strand; PAM type: YTN; PAM sequence: TTT
ttaaggaaacgattgacaat

SEQ ID NO: 156618 - DNA, 20 bp, Artificial Sequence
  Description of Artificial Sequence: Synthetic oligonucleotide
  Target: ATXN1; (-) strand; PAM type: YTN; PAM sequence: TTT
tttaaggaaacgattgacaa

SEQ ID NO: 156619 - DNA, 20 bp, Artificial Sequence
  Description of Artificial Sequence: Synthetic oligonucleotide
  Target: ATXN1; (-) strand; PAM type: YTN; PAM sequence: TTG
ttttttaaggaaacgattga

SEQ ID NO: 156620 - DNA, 20 bp, Artificial Sequence
  Description of Artificial Sequence: Synthetic oligonucleotide
  Target: ATXN1; (-) strand; PAM type: YTN; PAM sequence: TTT
gttttttaaggaaacgattg

SEQ ID NO: 156621 - DNA, 20 bp, Artificial Sequence
  Description of Artificial Sequence: Synthetic oligonucleotide
  Target: ATXN1; (-) strand; PAM type: YTN; PAM sequence: TTT
tgttttttaaggaaacgatt

SEQ ID NO: 156622 - DNA, 20 bp, Artificial Sequence
  Description of Artificial Sequence: Synthetic oligonucleotide
  Target: ATXN1; (-) strand; PAM type: YTN; PAM sequence: TTG
ttttgttttttaaggaaacg

SEQ ID NO: 156623 - DNA, 20 bp, Artificial Sequence
  Description of Artificial Sequence: Synthetic oligonucleotide
  Target: ATXN1; (-) strand; PAM type: YTN; PAM sequence: TTT
gttttgttttttaaggaaac

SEQ ID NO: 156624 - DNA, 20 bp, Artificial Sequence
  Description of Artificial Sequence: Synthetic oligonucleotide
  Target: ATXN1; (-) strand; PAM type: YTN; PAM sequence: TTT
tgttttgttttttaaggaaa

SEQ ID NO: 156625 - DNA, 20 bp, Artificial Sequence
  Description of Artificial Sequence: Synthetic oligonucleotide
  Target: ATXN1; (-) strand; PAM type: YTN; PAM sequence: TTG
ttttgttttgttttttaagg

SEQ ID NO: 156626 - DNA, 20 bp, Artificial Sequence
  Description of Artificial Sequence: Synthetic oligonucleotide
  Target: ATXN1; (-) strand; PAM type: YTN; PAM sequence: TTT
gttttgttttgttttttaag

SEQ ID NO: 156627 - DNA, 20 bp, Artificial Sequence
  Description of Artificial Sequence: Synthetic oligonucleotide
  Target: ATXN1; (-) strand; PAM type: YTN; PAM sequence: TTT
tgttttgttttgttttttaa

SEQ ID NO: 156628 - DNA, 20 bp, Artificial Sequence
  Description of Artificial Sequence: Synthetic oligonucleotide
  Target: ATXN1; (-) strand; PAM type: YTN; PAM sequence: CTG
gattttgttttgttttgttt

SEQ ID NO: 156629 - DNA, 20 bp, Artificial Sequence
  Description of Artificial Sequence: Synthetic oligonucleotide
  Target: ATXN1; (-) strand; PAM type: YTN; PAM sequence: CTC
tggattttgttttgttttgt

SEQ ID NO: 156630 - DNA, 20 bp, Artificial Sequence
  Description of Artificial Sequence: Synthetic oligonucleotide
  Target: ATXN1; (-) strand; PAM type: YTN; PAM sequence: TTG
tagctctggattttgttttg

SEQ ID NO: 156631 - DNA, 20 bp, Artificial Sequence
  Description of Artificial Sequence: Synthetic oligonucleotide
  Target: ATXN1; (-) strand; PAM type: YTN; PAM sequence: TTG
ttgtagctctggattttgtt

SEQ ID NO: 156632 - DNA, 20 bp, Artificial Sequence
  Description of Artificial Sequence: Synthetic oligonucleotide
  Target: ATXN1; (-) strand; PAM type: YTN; PAM sequence: TTG
ttgttgtagctctggatttt

SEQ ID NO: 156633 - DNA, 20 bp, Artificial Sequence
  Description of Artificial Sequence: Synthetic oligonucleotide
  Target: ATXN1; (-) strand; PAM type: YTN; PAM sequence: TTT
gttgttgtagctctggattt

SEQ ID NO: 156634 - DNA, 20 bp, Artificial Sequence
  Description of Artificial Sequence: Synthetic oligonucleotide
  Target: ATXN1; (-) strand; PAM type: YTN; PAM sequence: TTT
tgttgttgtagctctggatt

SEQ ID NO: 156635 - DNA, 20 bp, Artificial Sequence
  Description of Artificial Sequence: Synthetic oligonucleotide
  Target: ATXN1; (-) strand; PAM type: YTN; PAM sequence: TTT
ttgttgttgtagctctggat

SEQ ID NO: 156636 - DNA, 20 bp, Artificial Sequence
  Description of Artificial Sequence: Synthetic oligonucleotide
  Target: ATXN1; (-) strand; PAM type: YTN; PAM sequence: TTA
tttttgttgttgtagctctg

SEQ ID NO: 156637 - DNA, 20 bp, Artificial Sequence
  Description of Artificial Sequence: Synthetic oligonucleotide
  Target: ATXN1; (-) strand; PAM type: YTN; PAM sequence: TTT
atttttgttgttgtagctct

SEQ ID NO: 156638 - DNA, 20 bp, Artificial Sequence
  Description of Artificial Sequence: Synthetic oligonucleotide
  Target: ATXN1; (-) strand; PAM type: YTN; PAM sequence: TTG
ccaaaatttatttttgttgt

SEQ ID NO: 156639 - DNA, 20 bp, Artificial Sequence
  Description of Artificial Sequence: Synthetic oligonucleotide
  Target: ATXN1; (-) strand; PAM type: YTN; PAM sequence: CTG
aaatatgttgccaaaattta

SEQ ID NO: 156640 - DNA, 20 bp, Artificial Sequence
  Description of Artificial Sequence: Synthetic oligonucleotide
  Target: ATXN1; (-) strand; PAM type: YTN; PAM sequence: TTA
ctgaaatatgttgccaaaat

SEQ ID NO: 156641 - DNA, 20 bp, Artificial Sequence
  Description of Artificial Sequence: Synthetic oligonucleotide
  Target: ATXN1; (-) strand; PAM type: YTN; PAM sequence: TTT
actgaaatatgttgccaaaa

SEQ ID NO: 156642 - DNA, 20 bp, Artificial Sequence
  Description of Artificial Sequence: Synthetic oligonucleotide
  Target: ATXN1; (-) strand; PAM type: YTN; PAM sequence: CTT
tactgaaatatgttgccaaa

SEQ ID NO: 156643 - DNA, 20 bp, Artificial Sequence
  Description of Artificial Sequence: Synthetic oligonucleotide
  Target: ATXN1; (-) strand; PAM type: YTN; PAM sequence: TTG
atctttactgaaatatgttg

SEQ ID NO: 156644 - DNA, 20 bp, Artificial Sequence
  Description of Artificial Sequence: Synthetic oligonucleotide
  Target: ATXN1; (-) strand; PAM type: YTN; PAM sequence: TTT
gatctttactgaaatatgtt

SEQ ID NO: 156645 - DNA, 20 bp, Artificial Sequence
  Description of Artificial Sequence: Synthetic oligonucleotide
  Target: ATXN1; (-) strand; PAM type: YTN; PAM sequence: TTG
cacagtttgatctttactga

SEQ ID NO: 156646 - DNA, 20 bp, Artificial Sequence
  Description of Artificial Sequence: Synthetic oligonucleotide
  Target: ATXN1; (-) strand; PAM type: YTN; PAM sequence: TTT
gcacagtttgatctttactg

SEQ ID NO: 156647 - DNA, 20 bp, Artificial Sequence
  Description of Artificial Sequence: Synthetic oligonucleotide
  Target: ATXN1; (-) strand; PAM type: YTN; PAM sequence: CTT
tgcacagtttgatctttact

SEQ ID NO: 156648 - DNA, 20 bp, Artificial Sequence
  Description of Artificial Sequence: Synthetic oligonucleotide
  Target: ATXN1; (-) strand; PAM type: YTN; PAM sequence: CTC
tttgcacagtttgatcttta

SEQ ID NO: 156649 - DNA, 20 bp, Artificial Sequence
  Description of Artificial Sequence: Synthetic oligonucleotide
  Target: ATXN1; (-) strand; PAM type: YTN; PAM sequence: CTA
gtaatcataaaatccactct

SEQ ID NO: 156650 - DNA, 20 bp, Artificial Sequence
  Description of Artificial Sequence: Synthetic oligonucleotide
  Target: ATXN1; (-) strand; PAM type: YTN; PAM sequence: CTC
ctagtaatcataaaatccac

SEQ ID NO: 156651 - DNA, 20 bp, Artificial Sequence
  Description of Artificial Sequence: Synthetic oligonucleotide
  Target: ATXN1; (-) strand; PAM type: YTN; PAM sequence: TTC
aagatgaacagtagctccta

SEQ ID NO: 156652 - DNA, 20 bp, Artificial Sequence
  Description of Artificial Sequence: Synthetic oligonucleotide
  Target: ATXN1; (-) strand; PAM type: YTN; PAM sequence: CTG
catgttcaagatgaacagta

SEQ ID NO: 156653 - DNA, 20 bp, Artificial Sequence
  Description of Artificial Sequence: Synthetic oligonucleotide
  Target: ATXN1; (-) strand; PAM type: YTN; PAM sequence: TTG
caatataatgctgcatgttc

SEQ ID NO: 156654 - DNA, 20 bp, Artificial Sequence
  Description of Artificial Sequence: Synthetic oligonucleotide
  Target: ATXN1; (-) strand; PAM type: YTN; PAM sequence: TTA
gataccgcatagattgcaat

SEQ ID NO: 156655 - DNA, 20 bp, Artificial Sequence
  Description of Artificial Sequence: Synthetic oligonucleotide
  Target: ATXN1; (-) strand; PAM type: YTN; PAM sequence: CTT
agataccgcatagattgcaa

SEQ ID NO: 156656 - DNA, 20 bp, Artificial Sequence
  Description of Artificial Sequence: Synthetic oligonucleotide
  Target: ATXN1; (-) strand; PAM type: YTN; PAM sequence: CTC
cttagataccgcatagattg

SEQ ID NO: 156657 - DNA, 20 bp, Artificial Sequence
  Description of Artificial Sequence: Synthetic oligonucleotide
  Target: ATXN1; (-) strand; PAM type: YTN; PAM sequence: TTA
ctccttagataccgcataga

SEQ ID NO: 156658 - DNA, 20 bp, Artificial Sequence
  Description of Artificial Sequence: Synthetic oligonucleotide
  Target: ATXN1; (-) strand; PAM type: YTN; PAM sequence: TTG
tggattactccttagatacc

SEQ ID NO: 156659 - DNA, 20 bp, Artificial Sequence
  Description of Artificial Sequence: Synthetic oligonucleotide
  Target: ATXN1; (-) strand; PAM type: YTN; PAM sequence: CTT
gtggattactccttagatac

SEQ ID NO: 156660 - DNA, 20 bp, Artificial Sequence
  Description of Artificial Sequence: Synthetic oligonucleotide
  Target: ATXN1; (-) strand; PAM type: YTN; PAM sequence: CTG
catcttgtggattactcctt

SEQ ID NO: 156661 - DNA, 20 bp, Artificial Sequence
  Description of Artificial Sequence: Synthetic oligonucleotide
  Target: ATXN1; (-) strand; PAM type: YTN; PAM sequence: TTC
ctgcatcttgtggattactc

SEQ ID NO: 156662 - DNA, 20 bp, Artificial Sequence
  Description of Artificial Sequence: Synthetic oligonucleotide
  Target: ATXN1; (-) strand; PAM type: YTN; PAM sequence: TTT
cctgcatcttgtggattact

SEQ ID NO: 156663 - DNA, 20 bp, Artificial Sequence
  Description of Artificial Sequence: Synthetic oligonucleotide
  Target: ATXN1; (-) strand; PAM type: YTN; PAM sequence: TTG
gatttcctgcatcttgtgga

SEQ ID NO: 156664 - DNA, 20 bp, Artificial Sequence
  Description of Artificial Sequence: Synthetic oligonucleotide
  Target: ATXN1; (-) strand; PAM type: YTN; PAM sequence: TTT
ggatttcctgcatcttgtgg

SEQ ID NO: 156665 - DNA, 20 bp, Artificial Sequence
  Description of Artificial Sequence: Synthetic oligonucleotide
  Target: ATXN1; (-) strand; PAM type: YTN; PAM sequence: TTC
aaggaatgtttggatttcct

SEQ ID NO: 156666 - DNA, 20 bp, Artificial Sequence
  Description of Artificial Sequence: Synthetic oligonucleotide
  Target: ATXN1; (-) strand; PAM type: YTN; PAM sequence: TTT
caaggaatgtttggatttcc

SEQ ID NO: 156667 - DNA, 20 bp, Artificial Sequence
  Description of Artificial Sequence: Synthetic oligonucleotide
  Target: ATXN1; (-) strand; PAM type: YTN; PAM sequence: TTG
tacaatttcaaggaatgttt

SEQ ID NO: 156668 - DNA, 20 bp, Artificial Sequence
  Description of Artificial Sequence: Synthetic oligonucleotide
  Target: ATXN1; (-) strand; PAM type: YTN; PAM sequence: CTG
gagtagggttgtacaatttc

SEQ ID NO: 156669 - DNA, 20 bp, Artificial Sequence
  Description of Artificial Sequence: Synthetic oligonucleotide
  Target: ATXN1; (-) strand; PAM type: YTN; PAM sequence: CTC
tggagtagggttgtacaatt

SEQ ID NO: 156670 - DNA, 20 bp, Artificial Sequence
  Description of Artificial Sequence: Synthetic oligonucleotide
  Target: ATXN1; (-) strand; PAM type: YTN; PAM sequence: CTG
ctctggagtagggttgtaca

SEQ ID NO: 156671 - DNA, 20 bp, Artificial Sequence
  Description of Artificial Sequence: Synthetic oligonucleotide
  Target: ATXN1; (-) strand; PAM type: YTN; PAM sequence: TTG
actgctctggagtagggttg

SEQ ID NO: 156672 - DNA, 20 bp, Artificial Sequence
  Description of Artificial Sequence: Synthetic oligonucleotide
  Target: ATXN1; (-) strand; PAM type: YTN; PAM sequence: TTT
gactgctctggagtagggtt

SEQ ID NO: 156673 - DNA, 20 bp, Artificial Sequence
  Description of Artificial Sequence: Synthetic oligonucleotide
  Target: ATXN1; (-) strand; PAM type: YTN; PAM sequence: CTT
tgactgctctggagtagggt

SEQ ID NO: 156674 - DNA, 20 bp, Artificial Sequence
  Description of Artificial Sequence: Synthetic oligonucleotide
  Target: ATXN1; (-) strand; PAM type: YTN; PAM sequence: CTG
acgtgtccagaagcagcact

SEQ ID NO: 156675 - DNA, 20 bp, Artificial Sequence
  Description of Artificial Sequence: Synthetic oligonucleotide
  Target: ATXN1; (-) strand; PAM type: YTN; PAM sequence: CTC
agggacggggcaggtgtgtg

SEQ ID NO: 156676 - DNA, 20 bp, Artificial Sequence
  Description of Artificial Sequence: Synthetic oligonucleotide
  Target: ATXN1; (-) strand; PAM type: YTN; PAM sequence: TTC
tcagggacggggcaggtgtg

SEQ ID NO: 156677 - DNA, 20 bp, Artificial Sequence
  Description of Artificial Sequence: Synthetic oligonucleotide
  Target: ATXN1; (-) strand; PAM type: YTN; PAM sequence: TTT
ctcagggacggggcaggtgt

SEQ ID NO: 156678 - DNA, 20 bp, Artificial Sequence
  Description of Artificial Sequence: Synthetic oligonucleotide
  Target: ATXN1; (-) strand; PAM type: YTN; PAM sequence: CTT
tctcagggacggggcaggtg

SEQ ID NO: 156679 - DNA, 20 bp, Artificial Sequence
  Description of Artificial Sequence: Synthetic oligonucleotide
  Target: ATXN1; (-) strand; PAM type: YTN; PAM sequence: CTC
tttctcagggacggggcagg

SEQ ID NO: 156680 - DNA, 20 bp, Artificial Sequence
  Description of Artificial Sequence: Synthetic oligonucleotide
  Target: ATXN1; (-) strand; PAM type: YTN; PAM sequence: TTC
acacctctttctcagggacg

SEQ ID NO: 156681 - DNA, 20 bp, Artificial Sequence
  Description of Artificial Sequence: Synthetic oligonucleotide
  Target: ATXN1; (-) strand; PAM type: YTN; PAM sequence: TTT
cacacctctttctcagggac

SEQ ID NO: 156682 - DNA, 20 bp, Artificial Sequence
  Description of Artificial Sequence: Synthetic oligonucleotide
  Target: ATXN1; (-) strand; PAM type: YTN; PAM sequence: CTT
tcacacctctttctcaggga

SEQ ID NO: 156683 - DNA, 20 bp, Artificial Sequence
  Description of Artificial Sequence: Synthetic oligonucleotide
  Target: ATXN1; (-) strand; PAM type: YTN; PAM sequence: CTG
cggaacctttcacacctctt

SEQ ID NO: 156684 - DNA, 20 bp, Artificial Sequence
  Description of Artificial Sequence: Synthetic oligonucleotide
  Target: ATXN1; (-) strand; PAM type: YTN; PAM sequence: CTC
tgcggaacctttcacacctc

SEQ ID NO: 156685 - DNA, 20 bp, Artificial Sequence
  Description of Artificial Sequence: Synthetic oligonucleotide
  Target: ATXN1; (-) strand; PAM type: YTN; PAM sequence: CTA
aagggactctgcggaacctt

SEQ ID NO: 156686 - DNA, 20 bp, Artificial Sequence
  Description of Artificial Sequence: Synthetic oligonucleotide
  Target: ATXN1; (-) strand; PAM type: YTN; PAM sequence: CTC
ccctaaagggactctgcgga

SEQ ID NO: 156687 - DNA, 20 bp, Artificial Sequence
  Description of Artificial Sequence: Synthetic oligonucleotide
  Target: ATXN1; (-) strand; PAM type: YTN; PAM sequence: TTC
tcccctaaagggactctgcg

SEQ ID NO: 156688 - DNA, 20 bp, Artificial Sequence
  Description of Artificial Sequence: Synthetic oligonucleotide
  Target: ATXN1; (-) strand; PAM type: YTN; PAM sequence: CTT
ctcccctaaagggactctgc

SEQ ID NO: 156689 - DNA, 20 bp, Artificial Sequence
  Description of Artificial Sequence: Synthetic oligonucleotide
  Target: ATXN1; (-) strand; PAM type: YTN; PAM sequence: CTC
cttctcccctaaagggactc

SEQ ID NO: 156690 - DNA, 20 bp, Artificial Sequence
  Description of Artificial Sequence: Synthetic oligonucleotide
  Target: ATXN1; (-) strand; PAM type: YTN; PAM sequence: TTC
cccccaccaggaagtggcag

SEQ ID NO: 156691 - DNA, 20 bp, Artificial Sequence
  Description of Artificial Sequence: Synthetic oligonucleotide
  Target: ATXN1; (-) strand; PAM type: YTN; PAM sequence: TTT
ccccccaccaggaagtggca

SEQ ID NO: 156692 - DNA, 20 bp, Artificial Sequence
  Description of Artificial Sequence: Synthetic oligonucleotide
  Target: ATXN1; (-) strand; PAM type: YTN; PAM sequence: TTT
tccccccaccaggaagtggc

SEQ ID NO: 156693 - DNA, 20 bp, Artificial Sequence
  Description of Artificial Sequence: Synthetic oligonucleotide
  Target: ATXN1; (-) strand; PAM type: YTN; PAM sequence: TTT
ttccccccaccaggaagtgg

SEQ ID NO: 156694 - DNA, 20 bp, Artificial Sequence
  Description of Artificial Sequence: Synthetic oligonucleotide
  Target: ATXN1; (-) strand; PAM type: YTN; PAM sequence: TTT
tttccccccaccaggaagtg

SEQ ID NO: 156695 - DNA, 20 bp, Artificial Sequence
  Description of Artificial Sequence: Synthetic oligonucleotide
  Target: ATXN1; (-) strand; PAM type: YTN; PAM sequence: TTG
ggttttttccccccaccagg

SEQ ID NO: 156696 - DNA, 20 bp, Artificial Sequence
  Description of Artificial Sequence: Synthetic oligonucleotide
  Target: ATXN1; (-) strand; PAM type: YTN; PAM sequence: TTA
ggtgagtgtgttgggttttt

SEQ ID NO: 156697 - DNA, 20 bp, Artificial Sequence
  Description of Artificial Sequence: Synthetic oligonucleotide
  Target: ATXN1; (-) strand; PAM type: YTN; PAM sequence: CTG
ttaggtgagtgtgttgggtt

SEQ ID NO: 156698 - DNA, 20 bp, Artificial Sequence
  Description of Artificial Sequence: Synthetic oligonucleotide
  Target: ATXN1; (-) strand; PAM type: YTN; PAM sequence: TTC
tgttaggtgagtgtgttggg

SEQ ID NO: 156699 - DNA, 20 bp, Artificial Sequence
  Description of Artificial Sequence: Synthetic oligonucleotide
  Target: ATXN1; (-) strand; PAM type: YTN; PAM sequence: TTT
ctgttaggtgagtgtgttgg

SEQ ID NO: 156700 - DNA, 20 bp, Artificial Sequence
  Description of Artificial Sequence: Synthetic oligonucleotide
  Target: ATXN1; (-) strand; PAM type: YTN; PAM sequence: TTT
tctgttaggtgagtgtgttg

SEQ ID NO: 156701 - DNA, 20 bp, Artificial Sequence
  Description of Artificial Sequence: Synthetic oligonucleotide
  Target: ATXN1; (-) strand; PAM type: YTN; PAM sequence: CTA
tgttttctgttaggtgagtg

SEQ ID NO: 156702 - DNA, 20 bp, Artificial Sequence
  Description of Artificial Sequence: Synthetic oligonucleotide
  Target: ATXN1; (-) strand; PAM type: YTN; PAM sequence: CTC
tatgttttctgttaggtgag

SEQ ID NO: 156703 - DNA, 20 bp, Artificial Sequence
  Description of Artificial Sequence: Synthetic oligonucleotide
  Target: ATXN1; (-) strand; PAM type: YTN; PAM sequence: TTG
tgagcctctatgttttctgt

SEQ ID NO: 156704 - DNA, 20 bp, Artificial Sequence
  Description of Artificial Sequence: Synthetic oligonucleotide
  Target: ATXN1; (-) strand; PAM type: YTN; PAM sequence: TTG
gaattgtgagcctctatgtt

SEQ ID NO: 156705 - DNA, 20 bp, Artificial Sequence
  Description of Artificial Sequence: Synthetic oligonucleotide
  Target: ATXN1; (-) strand; PAM type: YTN; PAM sequence: CTT
ggaattgtgagcctctatgt

SEQ ID NO: 156706 - DNA, 20 bp, Artificial Sequence
  Description of Artificial Sequence: Synthetic oligonucleotide
  Target: ATXN1; (-) strand; PAM type: YTN; PAM sequence: CTA
acttggaattgtgagcctct

SEQ ID NO: 156707 - DNA, 20 bp, Artificial Sequence
  Description of Artificial Sequence: Synthetic oligonucleotide
  Target: ATXN1; (-) strand; PAM type: YTN; PAM sequence: TTC
taacttggaattgtgagcct

SEQ ID NO: 156708 - DNA, 20 bp, Artificial Sequence
  Description of Artificial Sequence: Synthetic oligonucleotide
  Target: ATXN1; (-) strand; PAM type: YTN; PAM sequence: TTT
ctaacttggaattgtgagcc

SEQ ID NO: 156709 - DNA, 20 bp, Artificial Sequence
  Description of Artificial Sequence: Synthetic oligonucleotide
  Target: ATXN1; (-) strand; PAM type: YTN; PAM sequence: TTG
atcccatttctaacttggaa

SEQ ID NO: 156710 - DNA, 20 bp, Artificial Sequence
  Description of Artificial Sequence: Synthetic oligonucleotide
  Target: ATXN1; (-) strand; PAM type: YTN; PAM sequence: TTG
ttgatcccatttctaacttg

SEQ ID NO: 156711 - DNA, 20 bp, Artificial Sequence
  Description of Artificial Sequence: Synthetic oligonucleotide
  Target: ATXN1; (-) strand; PAM type: YTN; PAM sequence: TTG
ttgttgatcccatttctaac

SEQ ID NO: 156712 - DNA, 20 bp, Artificial Sequence
  Description of Artificial Sequence: Synthetic oligonucleotide
  Target: ATXN1; (-) strand; PAM type: YTN; PAM sequence: CTG
ttgttgttgatcccatttct

SEQ ID NO: 156713 - DNA, 20 bp, Artificial Sequence
  Description of Artificial Sequence: Synthetic oligonucleotide
  Target: ATXN1; (-) strand; PAM type: YTN; PAM sequence: TTC
tgttgttgttgatcccattt

SEQ ID NO: 156714 - DNA, 20 bp, Artificial Sequence
  Description of Artificial Sequence: Synthetic oligonucleotide
  Target: ATXN1; (-) strand; PAM type: YTN; PAM sequence: TTT
ctgttgttgttgatcccatt

SEQ ID NO: 156715 - DNA, 20 bp, Artificial Sequence
  Description of Artificial Sequence: Synthetic oligonucleotide
  Target: ATXN1; (-) strand; PAM type: YTN; PAM sequence: TTG
atttctgttgttgttgatcc

SEQ ID NO: 156716 - DNA, 20 bp, Artificial Sequence
  Description of Artificial Sequence: Synthetic oligonucleotide
  Target: ATXN1; (-) strand; PAM type: YTN; PAM sequence: TTT
gatttctgttgttgttgatc

SEQ ID NO: 156717 - DNA, 20 bp, Artificial Sequence
  Description of Artificial Sequence: Synthetic oligonucleotide
  Target: ATXN1; (-) strand; PAM type: YTN; PAM sequence: TTG
ggatgatttgatttctgttg

SEQ ID NO: 156718 - DNA, 20 bp, Artificial Sequence
  Description of Artificial Sequence: Synthetic oligonucleotide
  Target: ATXN1; (-) strand; PAM type: YTN; PAM sequence: TTT
gggatgatttgatttctgtt

SEQ ID NO: 156719 - DNA, 20 bp, Artificial Sequence
  Description of Artificial Sequence: Synthetic oligonucleotide
  Target: ATXN1; (-) strand; PAM type: YTN; PAM sequence: TTA
gtttgggatgatttgatttc

SEQ ID NO: 156720 - DNA, 20 bp, Artificial Sequence
  Description of Artificial Sequence: Synthetic oligonucleotide
  Target: ATXN1; (-) strand; PAM type: YTN; PAM sequence: TTT
agtttgggatgatttgattt

SEQ ID NO: 156721 - DNA, 20 bp, Artificial Sequence
  Description of Artificial Sequence: Synthetic oligonucleotide
  Target: ATXN1; (-) strand; PAM type: YTN; PAM sequence: CTC
acccagtttagtttgggatg

SEQ ID NO: 156722 - DNA, 20 bp, Artificial Sequence
  Description of Artificial Sequence: Synthetic oligonucleotide
  Target: ATXN1; (-) strand; PAM type: YTN; PAM sequence: CTA
actcacccagtttagtttgg

SEQ ID NO: 156723 - DNA, 20 bp, Artificial Sequence
  Description of Artificial Sequence: Synthetic oligonucleotide
  Target: ATXN1; (-) strand; PAM type: YTN; PAM sequence: TTC
cctaactcacccagtttagt

SEQ ID NO: 156724 - DNA, 20 bp, Artificial Sequence
  Description of Artificial Sequence: Synthetic oligonucleotide
  Target: ATXN1; (-) strand; PAM type: YTN; PAM sequence: TTT
ccctaactcacccagtttag

SEQ ID NO: 156725 - DNA, 20 bp, Artificial Sequence
  Description of Artificial Sequence: Synthetic oligonucleotide
  Target: ATXN1; (-) strand; PAM type: YTN; PAM sequence: TTT
tccctaactcacccagttta

SEQ ID NO: 156726 - DNA, 20 bp, Artificial Sequence
  Description of Artificial Sequence: Synthetic oligonucleotide
  Target: ATXN1; (-) strand; PAM type: YTN; PAM sequence: TTC
gttttccctaactcacccag

SEQ ID NO: 156727 - DNA, 20 bp, Artificial Sequence
  Description of Artificial Sequence: Synthetic oligonucleotide
  Target: ATXN1; (-) strand; PAM type: YTN; PAM sequence: TTT
cgttttccctaactcaccca

SEQ ID NO: 156728 - DNA, 20 bp, Artificial Sequence
  Description of Artificial Sequence: Synthetic oligonucleotide
  Target: ATXN1; (-) strand; PAM type: YTN; PAM sequence: TTT
tcgttttccctaactcaccc

SEQ ID NO: 156729 - DNA, 20 bp, Artificial Sequence
  Description of Artificial Sequence: Synthetic oligonucleotide
  Target: ATXN1; (-) strand; PAM type: YTN; PAM sequence: CTT
ttcgttttccctaactcacc

SEQ ID NO: 156730 - DNA, 20 bp, Artificial Sequence
  Description of Artificial Sequence: Synthetic oligonucleotide
  Target: ATXN1; (-) strand; PAM type: YTN; PAM sequence: TTG
gtcaacttttcgttttccct

SEQ ID NO: 156731 - DNA, 20 bp, Artificial Sequence
  Description of Artificial Sequence: Synthetic oligonucleotide
  Target: ATXN1; (-) strand; PAM type: YTN; PAM sequence: CTA
tgttggtcaacttttcgttt

SEQ ID NO: 156732 - DNA, 20 bp, Artificial Sequence
  Description of Artificial Sequence: Synthetic oligonucleotide
  Target: ATXN1; (-) strand; PAM type: YTN; PAM sequence: TTC
tatgttggtcaacttttcgt

SEQ ID NO: 156733 - DNA, 20 bp, Artificial Sequence
  Description of Artificial Sequence: Synthetic oligonucleotide
  Target: ATXN1; (-) strand; PAM type: YTN; PAM sequence: TTT
ctatgttggtcaacttttcg

SEQ ID NO: 156734 - DNA, 20 bp, Artificial Sequence
  Description of Artificial Sequence: Synthetic oligonucleotide
  Target: ATXN1; (-) strand; PAM type: YTN; PAM sequence: TTT
tctatgttggtcaacttttc

SEQ ID NO: 156735 - DNA, 20 bp, Artificial Sequence
  Description of Artificial Sequence: Synthetic oligonucleotide
  Target: ATXN1; (-) strand; PAM type: YTN; PAM sequence: TTC
aggataattttctatgttgg

SEQ ID NO: 156736 - DNA, 20 bp, Artificial Sequence
  Description of Artificial Sequence: Synthetic oligonucleotide
  Target: ATXN1; (-) strand; PAM type: YTN; PAM sequence: TTT
caggataattttctatgttg

SEQ ID NO: 156737 - DNA, 20 bp, Artificial Sequence
  Description of Artificial Sequence: Synthetic oligonucleotide
  Target: ATXN1; (-) strand; PAM type: YTN; PAM sequence: CTT
tcaggataattttctatgtt

SEQ ID NO: 156738 - DNA, 20 bp, Artificial Sequence
  Description of Artificial Sequence: Synthetic oligonucleotide
  Target: ATXN1; (-) strand; PAM type: YTN; PAM sequence: TTG
gactttcaggataattttct

SEQ ID NO: 156739 - DNA, 20 bp, Artificial Sequence
  Description of Artificial Sequence: Synthetic oligonucleotide
  Target: ATXN1; (-) strand; PAM type: YTN; PAM sequence: TTT
ggactttcaggataattttc

SEQ ID NO: 156740 - DNA, 20 bp, Artificial Sequence
  Description of Artificial Sequence: Synthetic oligonucleotide
  Target: ATXN1; (-) strand; PAM type: YTN; PAM sequence: TTC
atttggactttcaggataat

SEQ ID NO: 156741 - DNA, 20 bp, Artificial Sequence
  Description of Artificial Sequence: Synthetic oligonucleotide
  Target: ATXN1; (-) strand; PAM type: YTN; PAM sequence: TTT
catttggactttcaggataa

SEQ ID NO: 156742 - DNA, 20 bp, Artificial Sequence
  Description of Artificial Sequence: Synthetic oligonucleotide
  Target: ATXN1; (-) strand; PAM type: YTN; PAM sequence: TTT
tcatttggactttcaggata

SEQ ID NO: 156743 - DNA, 20 bp, Artificial Sequence
  Description of Artificial Sequence: Synthetic oligonucleotide
  Target: ATXN1; (-) strand; PAM type: YTN; PAM sequence: TTG
aattttcatttggactttca

SEQ ID NO: 156744 - DNA, 20 bp, Artificial Sequence
  Description of Artificial Sequence: Synthetic oligonucleotide
  Target: ATXN1; (-) strand; PAM type: YTN; PAM sequence: TTA
aagtggaaatccaaattgaa

SEQ ID NO: 156745 - DNA, 20 bp, Artificial Sequence
  Description of Artificial Sequence: Synthetic oligonucleotide
  Target: ATXN1; (-) strand; PAM type: YTN; PAM sequence: TTT
aaagtggaaatccaaattga

SEQ ID NO: 156746 - DNA, 20 bp, Artificial Sequence
  Description of Artificial Sequence: Synthetic oligonucleotide
  Target: ATXN1; (-) strand; PAM type: YTN; PAM sequence: TTT
taaagtggaaatccaaattg

SEQ ID NO: 156747 - DNA, 20 bp, Artificial Sequence
  Description of Artificial Sequence: Synthetic oligonucleotide
  Target: ATXN1; (-) strand; PAM type: YTN; PAM sequence: CTT
ttaaagtggaaatccaaatt

SEQ ID NO: 156748 - DNA, 20 bp, Artificial Sequence
  Description of Artificial Sequence: Synthetic oligonucleotide
  Target: ATXN1; (-) strand; PAM type: YTN; PAM sequence: CTC
agatcttttaaagtggaaat

SEQ ID NO: 156749 - DNA, 20 bp, Artificial Sequence
  Description of Artificial Sequence: Synthetic oligonucleotide
  Target: ATXN1; (-) strand; PAM type: YTN; PAM sequence: TTA
cctcagatcttttaaagtgg

SEQ ID NO: 156750 - DNA, 20 bp, Artificial Sequence
  Description of Artificial Sequence: Synthetic oligonucleotide
  Target: ATXN1; (-) strand; PAM type: YTN; PAM sequence: CTT
acctcagatcttttaaagtg

SEQ ID NO: 156751 - DNA, 20 bp, Artificial Sequence
  Description of Artificial Sequence: Synthetic oligonucleotide
  Target: ATXN1; (-) strand; PAM type: YTN; PAM sequence: CTG
gggcagaggggggagggagg

SEQ ID NO: 156752 - DNA, 20 bp, Artificial Sequence
  Description of Artificial Sequence: Synthetic oligonucleotide
  Target: ATXN1; (-) strand; PAM type: YTN; PAM sequence: CTG
ggccacactggggcagaggg

SEQ ID NO: 156753 - DNA, 20 bp, Artificial Sequence
  Description of Artificial Sequence: Synthetic oligonucleotide
  Target: ATXN1; (-) strand; PAM type: YTN; PAM sequence: TTG
tctgggccacactggggcag

SEQ ID NO: 156754 - DNA, 20 bp, Artificial Sequence
  Description of Artificial Sequence: Synthetic oligonucleotide
  Target: ATXN1; (-) strand; PAM type: YTN; PAM sequence: TTT
gtctgggccacactggggca

SEQ ID NO: 156755 - DNA, 20 bp, Artificial Sequence
  Description of Artificial Sequence: Synthetic oligonucleotide
  Target: ATXN1; (-) strand; PAM type: YTN; PAM sequence: TTC
agtttgtctgggccacactg

SEQ ID NO: 156756 - DNA, 20 bp, Artificial Sequence
  Description of Artificial Sequence: Synthetic oligonucleotide
  Target: ATXN1; (-) strand; PAM type: YTN; PAM sequence: TTT
cagtttgtctgggccacact

SEQ ID NO: 156757 - DNA, 20 bp, Artificial Sequence
  Description of Artificial Sequence: Synthetic oligonucleotide
  Target: ATXN1; (-) strand; PAM type: YTN; PAM sequence: TTA
tttcagtttgtctgggccac

SEQ ID NO: 156758 - DNA, 20 bp, Artificial Sequence
  Description of Artificial Sequence: Synthetic oligonucleotide
  Target: ATXN1; (-) strand; PAM type: YTN; PAM sequence: TTA
agaattatttcagtttgtct

SEQ ID NO: 156759 - DNA, 20 bp, Artificial Sequence
  Description of Artificial Sequence: Synthetic oligonucleotide
  Target: ATXN1; (-) strand; PAM type: YTN; PAM sequence: CTT
aagaattatttcagtttgtc

SEQ ID NO: 156760 - DNA, 20 bp, Artificial Sequence
  Description of Artificial Sequence: Synthetic oligonucleotide
  Target: ATXN1; (-) strand; PAM type: YTN; PAM sequence: TTA
acttaagaattatttcagtt

SEQ ID NO: 156761 - DNA, 20 bp, Artificial Sequence
  Description of Artificial Sequence: Synthetic oligonucleotide
  Target: ATXN1; (-) strand; PAM type: YTN; PAM sequence: TTT
aacttaagaattatttcagt

SEQ ID NO: 156762 - DNA, 20 bp, Artificial Sequence
  Description of Artificial Sequence: Synthetic oligonucleotide
  Target: ATXN1; (-) strand; PAM type: YTN; PAM sequence: TTA
gaatgtttaacttaagaatt

SEQ ID NO: 156763 - DNA, 20 bp, Artificial Sequence
  Description of Artificial Sequence: Synthetic oligonucleotide
  Target: ATXN1; (-) strand; PAM type: YTN; PAM sequence: CTT
agaatgtttaacttaagaat

SEQ ID NO: 156764 - DNA, 20 bp, Artificial Sequence
  Description of Artificial Sequence: Synthetic oligonucleotide
  Target: ATXN1; (-) strand; PAM type: YTN; PAM sequence: TTC
cttagaatgtttaacttaag

SEQ ID NO: 156765 - DNA, 20 bp, Artificial Sequence
  Description of Artificial Sequence: Synthetic oligonucleotide
  Target: ATXN1; (-) strand; PAM type: YTN; PAM sequence: CTG
ttccttagaatgtttaactt

SEQ ID NO: 156766 - DNA, 20 bp, Artificial Sequence
  Description of Artificial Sequence: Synthetic oligonucleotide
  Target: ATXN1; (-) strand; PAM type: YTN; PAM sequence: CTA
aatatataaaatgactgttc

SEQ ID NO: 156767 - DNA, 20 bp, Artificial Sequence
  Description of Artificial Sequence: Synthetic oligonucleotide
  Target: ATXN1; (-) strand; PAM type: YTN; PAM sequence: TTC
taaatatataaaatgactgt

SEQ ID NO: 156768 - DNA, 20 bp, Artificial Sequence
  Description of Artificial Sequence: Synthetic oligonucleotide
  Target: ATXN1; (-) strand; PAM type: YTN; PAM sequence: TTT
ctaaatatataaaatgactg

SEQ ID NO: 156769 - DNA, 20 bp, Artificial Sequence
  Description of Artificial Sequence: Synthetic oligonucleotide
  Target: ATXN1; (-) strand; PAM type: YTN; PAM sequence: CTA
gggatttctaaatatataaa

SEQ ID NO: 156770 - DNA, 20 bp, Artificial Sequence
  Description of Artificial Sequence: Synthetic oligonucleotide
  Target: ATXN1; (-) strand; PAM type: YTN; PAM sequence: TTC
tagggatttctaaatatata

SEQ ID NO: 156771 - DNA, 20 bp, Artificial Sequence
  Description of Artificial Sequence: Synthetic oligonucleotide
  Target: ATXN1; (-) strand; PAM type: YTN; PAM sequence: TTT
ctagggatttctaaatatat

SEQ ID NO: 156772 - DNA, 20 bp, Artificial Sequence
  Description of Artificial Sequence: Synthetic oligonucleotide
  Target: ATXN1; (-) strand; PAM type: YTN; PAM sequence: CTT
tctagggatttctaaatata

SEQ ID NO: 156773 - DNA, 20 bp, Artificial Sequence
  Description of Artificial Sequence: Synthetic oligonucleotide
  Target: ATXN1; (-) strand; PAM type: YTN; PAM sequence: CTC
tttctagggatttctaaata

SEQ ID NO: 156774 - DNA, 20 bp, Artificial Sequence
  Description of Artificial Sequence: Synthetic oligonucleotide
  Target: ATXN1; (-) strand; PAM type: YTN; PAM sequence: CTC
tctttctagggatttctaaa

SEQ ID NO: 156775 - DNA, 20 bp, Artificial Sequence
  Description of Artificial Sequence: Synthetic oligonucleotide
  Target: ATXN1; (-) strand; PAM type: YTN; PAM sequence: TTA
ataagaaaccaacaaacaag

SEQ ID NO: 156776 - DNA, 20 bp, Artificial Sequence
  Description of Artificial Sequence: Synthetic oligonucleotide
  Target: ATXN1; (-) strand; PAM type: YTN; PAM sequence: CTA
ttaataagaaaccaacaaac

SEQ ID NO: 156777 - DNA, 20 bp, Artificial Sequence
  Description of Artificial Sequence: Synthetic oligonucleotide
  Target: ATXN1; (-) strand; PAM type: YTN; PAM sequence: TTA
gtcagggcgaaaagaaaaaa

SEQ ID NO: 156778 - DNA, 20 bp, Artificial Sequence
  Description of Artificial Sequence: Synthetic oligonucleotide
  Target: ATXN1; (-) strand; PAM type: YTN; PAM sequence: TTA
caatggaacacaatcaccaa

SEQ ID NO: 156779 - DNA, 20 bp, Artificial Sequence
  Description of Artificial Sequence: Synthetic oligonucleotide
  Target: ATXN1; (-) strand; PAM type: YTN; PAM sequence: TTT
acaatggaacacaatcacca

SEQ ID NO: 156780 - DNA, 20 bp, Artificial Sequence
  Description of Artificial Sequence: Synthetic oligonucleotide
  Target: ATXN1; (-) strand; PAM type: YTN; PAM sequence: TTG
cgtttacaatggaacacaat

SEQ ID NO: 156781 - DNA, 20 bp, Artificial Sequence
  Description of Artificial Sequence: Synthetic oligonucleotide
  Target: ATXN1; (-) strand; PAM type: YTN; PAM sequence: TTT
gcgtttacaatggaacacaa

SEQ ID NO: 156782 - DNA, 20 bp, Artificial Sequence
  Description of Artificial Sequence: Synthetic oligonucleotide
  Target: ATXN1; (-) strand; PAM type: YTN; PAM sequence: TTT
tgcgtttacaatggaacaca

SEQ ID NO: 156783 - DNA, 20 bp, Artificial Sequence
  Description of Artificial Sequence: Synthetic oligonucleotide
  Target: ATXN1; (-) strand; PAM type: YTN; PAM sequence: CTT
ttgcgtttacaatggaacac

SEQ ID NO: 156784 - DNA, 20 bp, Artificial Sequence
  Description of Artificial Sequence: Synthetic oligonucleotide
  Target: ATXN1; (-) strand; PAM type: YTN; PAM sequence: CTA
gtaacagcaggccttttgcg

SEQ ID NO: 156785 - DNA, 20 bp, Artificial Sequence
  Description of Artificial Sequence: Synthetic oligonucleotide
  Target: ATXN1; (-) strand; PAM type: YTN; PAM sequence: TTA
aactagtaacagcaggcctt

SEQ ID NO: 156786 - DNA, 20 bp, Artificial Sequence
  Description of Artificial Sequence: Synthetic oligonucleotide
  Target: ATXN1; (-) strand; PAM type: YTN; PAM sequence: TTT
aaactagtaacagcaggcct

SEQ ID NO: 156787 - DNA, 20 bp, Artificial Sequence
  Description of Artificial Sequence: Synthetic oligonucleotide
  Target: ATXN1; (-) strand; PAM type: YTN; PAM sequence: TTT
taaactagtaacagcaggcc

SEQ ID NO: 156788 - DNA, 20 bp, Artificial Sequence
  Description of Artificial Sequence: Synthetic oligonucleotide
  Target: ATXN1; (-) strand; PAM type: YTN; PAM sequence: TTT
ttaaactagtaacagcaggc

SEQ ID NO: 156789 - DNA, 20 bp, Artificial Sequence
  Description of Artificial Sequence: Synthetic oligonucleotide
  Target: ATXN1; (-) strand; PAM type: YTN; PAM sequence: TTC
catttttaaactagtaacag

SEQ ID NO: 156790 - DNA, 20 bp, Artificial Sequence
  Description of Artificial Sequence: Synthetic oligonucleotide
  Target: ATXN1; (-) strand; PAM type: YTN; PAM sequence: TTT
ccatttttaaactagtaaca

SEQ ID NO: 156791 - DNA, 20 bp, Artificial Sequence
  Description of Artificial Sequence: Synthetic oligonucleotide
  Target: ATXN1; (-) strand; PAM type: YTN; PAM sequence: TTT
tccatttttaaactagtaac

SEQ ID NO: 156792 - DNA, 20 bp, Artificial Sequence
  Description of Artificial Sequence: Synthetic oligonucleotide
  Target: ATXN1; (-) strand; PAM type: YTN; PAM sequence: CTG
ttttccatttttaaactagt

SEQ ID NO: 156793 - DNA, 20 bp, Artificial Sequence
  Description of Artificial Sequence: Synthetic oligonucleotide
  Target: ATXN1; (-) strand; PAM type: YTN; PAM sequence: TTC
ctgttttccatttttaaact

SEQ ID NO: 156794 - DNA, 20 bp, Artificial Sequence
  Description of Artificial Sequence: Synthetic oligonucleotide
  Target: ATXN1; (-) strand; PAM type: YTN; PAM sequence: TTT
cctgttttccatttttaaac

SEQ ID NO: 156795 - DNA, 20 bp, Artificial Sequence
  Description of Artificial Sequence: Synthetic oligonucleotide
  Target: ATXN1; (-) strand; PAM type: YTN; PAM sequence: CTT
tcctgttttccatttttaaa

SEQ ID NO: 156796 - DNA, 20 bp, Artificial Sequence
  Description of Artificial Sequence: Synthetic oligonucleotide
  Target: ATXN1; (-) strand; PAM type: YTN; PAM sequence: TTC
tttcctgttttccattttta

SEQ ID NO: 156797 - DNA, 20 bp, Artificial Sequence
  Description of Artificial Sequence: Synthetic oligonucleotide
  Target: ATXN1; (-) strand; PAM type: YTN; PAM sequence: TTT
ctttcctgttttccattttt

SEQ ID NO: 156798 - DNA, 20 bp, Artificial Sequence
  Description of Artificial Sequence: Synthetic oligonucleotide
  Target: ATXN1; (-) strand; PAM type: YTN; PAM sequence: CTT
tctttcctgttttccatttt

SEQ ID NO: 156799 - DNA, 20 bp, Artificial Sequence
  Description of Artificial Sequence: Synthetic oligonucleotide
  Target: ATXN1; (-) strand; PAM type: YTN; PAM sequence: TTC
tttctttcctgttttccatt

SEQ ID NO: 156800 - DNA, 20 bp, Artificial Sequence
  Description of Artificial Sequence: Synthetic oligonucleotide
  Target: ATXN1; (-) strand; PAM type: YTN; PAM sequence: TTG
ttctttctttcctgttttcc

SEQ ID NO: 156801 - DNA, 20 bp, Artificial Sequence
  Description of Artificial Sequence: Synthetic oligonucleotide
  Target: ATXN1; (-) strand; PAM type: YTN; PAM sequence: TTT
gttctttctttcctgttttc

SEQ ID NO: 156802 - DNA, 20 bp, Artificial Sequence
  Description of Artificial Sequence: Synthetic oligonucleotide
  Target: ATXN1; (-) strand; PAM type: YTN; PAM sequence: TTT
tgttctttctttcctgtttt

SEQ ID NO: 156803 - DNA, 20 bp, Artificial Sequence
  Description of Artificial Sequence: Synthetic oligonucleotide
  Target: ATXN1; (-) strand; PAM type: YTN; PAM sequence: CTT
ttgttctttctttcctgttt

SEQ ID NO: 156804 - DNA, 20 bp, Artificial Sequence
  Description of Artificial Sequence: Synthetic oligonucleotide
  Target: ATXN1; (-) strand; PAM type: YTN; PAM sequence: TTA
ccgacagccgtcttttgttc

SEQ ID NO: 156805 - DNA, 20 bp, Artificial Sequence
  Description of Artificial Sequence: Synthetic oligonucleotide
  Target: ATXN1; (-) strand; PAM type: YTN; PAM sequence: TTT
accgacagccgtcttttgtt

SEQ ID NO: 156806 - DNA, 20 bp, Artificial Sequence
  Description of Artificial Sequence: Synthetic oligonucleotide
  Target: ATXN1; (-) strand; PAM type: YTN; PAM sequence: TTG
caatatttaccgacagccgt

SEQ ID NO: 156807 - DNA, 20 bp, Artificial Sequence
  Description of Artificial Sequence: Synthetic oligonucleotide
  Target: ATXN1; (-) strand; PAM type: YTN; PAM sequence: TTT
gcaatatttaccgacagccg

SEQ ID NO: 156808 - DNA, 20 bp, Artificial Sequence
  Description of Artificial Sequence: Synthetic oligonucleotide
  Target: ATXN1; (-) strand; PAM type: YTN; PAM sequence: CTT
tgcaatatttaccgacagcc

SEQ ID NO: 156809 - DNA, 20 bp, Artificial Sequence
  Description of Artificial Sequence: Synthetic oligonucleotide
  Target: ATXN1; (-) strand; PAM type: YTN; PAM sequence: CTA
tgtccactttgcaatattta

SEQ ID NO: 156810 - DNA, 20 bp, Artificial Sequence
  Description of Artificial Sequence: Synthetic oligonucleotide
  Target: ATXN1; (-) strand; PAM type: YTN; PAM sequence: CTG
tactatgtccactttgcaat

SEQ ID NO: 156811 - DNA, 20 bp, Artificial Sequence
  Description of Artificial Sequence: Synthetic oligonucleotide
  Target: ATXN1; (-) strand; PAM type: YTN; PAM sequence: CTC
tgtactatgtccactttgca

SEQ ID NO: 156812 - DNA, 20 bp, Artificial Sequence
  Description of Artificial Sequence: Synthetic oligonucleotide
  Target: ATXN1; (-) strand; PAM type: YTN; PAM sequence: TTA
caaggatcagccatgtgcct

SEQ ID NO: 156813 - DNA, 20 bp, Artificial Sequence
  Description of Artificial Sequence: Synthetic oligonucleotide
  Target: ATXN1; (-) strand; PAM type: YTN; PAM sequence: CTT
acaaggatcagccatgtgcc

SEQ ID NO: 156814 - DNA, 20 bp, Artificial Sequence
  Description of Artificial Sequence: Synthetic oligonucleotide
  Target: ATXN1; (-) strand; PAM type: YTN; PAM sequence: TTC
agcttacaaggatcagccat

SEQ ID NO: 156815 - DNA, 20 bp, Artificial Sequence
  Description of Artificial Sequence: Synthetic oligonucleotide
  Target: ATXN1; (-) strand; PAM type: YTN; PAM sequence: TTC
ggtgccgttcagcttacaag

SEQ ID NO: 156816 - DNA, 20 bp, Artificial Sequence
  Description of Artificial Sequence: Synthetic oligonucleotide
  Target: ATXN1; (-) strand; PAM type: YTN; PAM sequence: CTT
cggtgccgttcagcttacaa

SEQ ID NO: 156817 - DNA, 20 bp, Artificial Sequence
  Description of Artificial Sequence: Synthetic oligonucleotide
  Target: ATXN1; (-) strand; PAM type: YTN; PAM sequence: TTC
ttcggtgccgttcagcttac

SEQ ID NO: 156818 - DNA, 20 bp, Artificial Sequence
  Description of Artificial Sequence: Synthetic oligonucleotide
  Target: ATXN1; (-) strand; PAM type: YTN; PAM sequence: TTA
acgatgacaggggtagaaat

SEQ ID NO: 156819 - DNA, 20 bp, Artificial Sequence
  Description of Artificial Sequence: Synthetic oligonucleotide
  Target: ATXN1; (-) strand; PAM type: YTN; PAM sequence: CTG
tgtagcaaacattaacgatg

SEQ ID NO: 156820 - DNA, 20 bp, Artificial Sequence
  Description of Artificial Sequence: Synthetic oligonucleotide
  Target: ATXN1; (-) strand; PAM type: YTN; PAM sequence: TTC
tgtgtagcaaacattaacga

SEQ ID NO: 156821 - DNA, 20 bp, Artificial Sequence
  Description of Artificial Sequence: Synthetic oligonucleotide
  Target: ATXN1; (-) strand; PAM type: YTN; PAM sequence: CTT
ctgtgtagcaaacattaacg

SEQ ID NO: 156822 - DNA, 20 bp, Artificial Sequence
  Description of Artificial Sequence: Synthetic oligonucleotide
  Target: ATXN1; (-) strand; PAM type: YTN; PAM sequence: CTG
tcaccgcttctgtgtagcaa

SEQ ID NO: 156823 - DNA, 20 bp, Artificial Sequence
  Description of Artificial Sequence: Synthetic oligonucleotide
  Target: ATXN1; (-) strand; PAM type: YTN; PAM sequence: CTC
tgtcaccgcttctgtgtagc

SEQ ID NO: 156824 - DNA, 20 bp, Artificial Sequence
  Description of Artificial Sequence: Synthetic oligonucleotide
  Target: ATXN1; (-) strand; PAM type: YTN; PAM sequence: CTC
ccagagcagcctctgtcacc

SEQ ID NO: 156825 - DNA, 20 bp, Artificial Sequence
  Description of Artificial Sequence: Synthetic oligonucleotide
  Target: ATXN1; (-) strand; PAM type: YTN; PAM sequence: TTG
gcgggccccgaggctcccag

SEQ ID NO: 156826 - DNA, 20 bp, Artificial Sequence
  Description of Artificial Sequence: Synthetic oligonucleotide
  Target: ATXN1; (-) strand; PAM type: YTN; PAM sequence: TTG
cagacgttggcgggccccga

SEQ ID NO: 156827 - DNA, 20 bp, Artificial Sequence
  Description of Artificial Sequence: Synthetic oligonucleotide
  Target: ATXN1; (-) strand; PAM type: YTN; PAM sequence: TTT
gcagacgttggcgggccccg

SEQ ID NO: 156828 - DNA, 20 bp, Artificial Sequence
  Description of Artificial Sequence: Synthetic oligonucleotide
  Target: ATXN1; (-) strand; PAM type: YTN; PAM sequence: CTG
tttgcagacgttggcgggcc

SEQ ID NO: 156829 - DNA, 20 bp, Artificial Sequence
  Description of Artificial Sequence: Synthetic oligonucleotide
  Target: ATXN1; (-) strand; PAM type: YTN; PAM sequence: CTC
ctgtttgcagacgttggcgg

SEQ ID NO: 156830 - DNA, 20 bp, Artificial Sequence
  Description of Artificial Sequence: Synthetic oligonucleotide
  Target: ATXN1; (-) strand; PAM type: YTN; PAM sequence: TTC
aaataggaagaacgcacaga

SEQ ID NO: 156831 - DNA, 20 bp, Artificial Sequence
  Description of Artificial Sequence: Synthetic oligonucleotide
  Target: ATXN1; (-) strand; PAM type: YTN; PAM sequence: CTT
caaataggaagaacgcacag

SEQ ID NO: 156832 - DNA, 20 bp, Artificial Sequence
  Description of Artificial Sequence: Synthetic oligonucleotide
  Target: ATXN1; (-) strand; PAM type: YTN; PAM sequence: CTC
ttcaaataggaagaacgcac

SEQ ID NO: 156833 - DNA, 20 bp, Artificial Sequence
  Description of Artificial Sequence: Synthetic oligonucleotide
  Target: ATXN1; (-) strand; PAM type: YTN; PAM sequence: TTC
tcttcaaataggaagaacgc

SEQ ID NO: 156834 - DNA, 20 bp, Artificial Sequence
  Description of Artificial Sequence: Synthetic oligonucleotide
  Target: ATXN1; (-) strand; PAM type: YTN; PAM sequence: TTT
ctcttcaaataggaagaacg

SEQ ID NO: 156835 - DNA, 20 bp, Artificial Sequence
  Description of Artificial Sequence: Synthetic oligonucleotide
  Target: ATXN1; (-) strand; PAM type: YTN; PAM sequence: CTT
tctcttcaaataggaagaac

SEQ ID NO: 156836 - DNA, 20 bp, Artificial Sequence
  Description of Artificial Sequence: Synthetic oligonucleotide
  Target: ATXN1; (-) strand; PAM type: YTN; PAM sequence: TTG
tggcagctttctcttcaaat

SEQ ID NO: 156837 - DNA, 20 bp, Artificial Sequence
  Description of Artificial Sequence: Synthetic oligonucleotide
  Target: ATXN1; (-) strand; PAM type: YTN; PAM sequence: CTT
gtggcagctttctcttcaaa

SEQ ID NO: 156838 - DNA, 20 bp, Artificial Sequence
  Description of Artificial Sequence: Synthetic oligonucleotide
  Target: ATXN1; (-) strand; PAM type: YTN; PAM sequence: CTC
ccttgtggcagctttctctt

SEQ ID NO: 156839 - DNA, 20 bp, Artificial Sequence
  Description of Artificial Sequence: Synthetic oligonucleotide
  Target: ATXN1; (-) strand; PAM type: YTN; PAM sequence: CTG
ccacccacggtcaccactcc

SEQ ID NO: 156840 - DNA, 20 bp, Artificial Sequence
  Description of Artificial Sequence: Synthetic oligonucleotide
  Target: ATXN1; (-) strand; PAM type: YTN; PAM sequence: CTG
tggaggggaccacctgccac

SEQ ID NO: 156841 - DNA, 20 bp, Artificial Sequence
  Description of Artificial Sequence: Synthetic oligonucleotide
  Target: ATXN1; (-) strand; PAM type: YTN; PAM sequence: TTG
gccagtggctgtggagggga

SEQ ID NO: 156842 - DNA, 20 bp, Artificial Sequence
  Description of Artificial Sequence: Synthetic oligonucleotide
  Target: ATXN1; (-) strand; PAM type: YTN; PAM sequence: CTG
agcgtgttggccagtggctg

SEQ ID NO: 156843 - DNA, 20 bp, Artificial Sequence
  Description of Artificial Sequence: Synthetic oligonucleotide
  Target: ATXN1; (-) strand; PAM type: YTN; PAM sequence: TTC
tgagcgtgttggccagtggc

SEQ ID NO: 156844 - DNA, 20 bp, Artificial Sequence
  Description of Artificial Sequence: Synthetic oligonucleotide
  Target: ATXN1; (-) strand; PAM type: YTN; PAM sequence: TTG
tgtgtgtgcgttctgagcgt

SEQ ID NO: 156845 - DNA, 20 bp, Artificial Sequence
  Description of Artificial Sequence: Synthetic oligonucleotide
  Target: ATXN1; (-) strand; PAM type: YTN; PAM sequence: CTG
ttgtgtgtgtgcgttctgag

SEQ ID NO: 156846 - DNA, 20 bp, Artificial Sequence
  Description of Artificial Sequence: Synthetic oligonucleotide
  Target: ATXN1; (-) strand; PAM type: YTN; PAM sequence: CTG
gacgggaagtgtggcctgtt

SEQ ID NO: 156847 - DNA, 20 bp, Artificial Sequence
  Description of Artificial Sequence: Synthetic oligonucleotide
  Target: ATXN1; (-) strand; PAM type: YTN; PAM sequence: CTG
agcctggacgggaagtgtgg

SEQ ID NO: 156848 - DNA, 20 bp, Artificial Sequence
  Description of Artificial Sequence: Synthetic oligonucleotide
  Target: ATXN1; (-) strand; PAM type: YTN; PAM sequence: CTC
tgagcctggacgggaagtgt

SEQ ID NO: 156849 - DNA, 20 bp, Artificial Sequence
  Description of Artificial Sequence: Synthetic oligonucleotide
  Target: ATXN1; (-) strand; PAM type: YTN; PAM sequence: CTG
cctctgagcctggacgggaa

SEQ ID NO: 156850 - DNA, 20 bp, Artificial Sequence
  Description of Artificial Sequence: Synthetic oligonucleotide
  Target: ATXN1; (-) strand; PAM type: YTN; PAM sequence: TTG
gagccctgcctctgagcctg

SEQ ID NO: 156851 - DNA, 20 bp, Artificial Sequence
  Description of Artificial Sequence: Synthetic oligonucleotide
  Target: ATXN1; (-) strand; PAM type: YTN; PAM sequence: CTT
ggagccctgcctctgagcct

SEQ ID NO: 156852 - DNA, 20 bp, Artificial Sequence
  Description of Artificial Sequence: Synthetic oligonucleotide
  Target: ATXN1; (-) strand; PAM type: YTN; PAM sequence: TTG
agacttggagccctgcctct

SEQ ID NO: 156853 - DNA, 20 bp, Artificial Sequence
  Description of Artificial Sequence: Synthetic oligonucleotide
  Target: ATXN1; (-) strand; PAM type: YTN; PAM sequence: CTT
gagacttggagccctgcctc

SEQ ID NO: 156854 - DNA, 20 bp, Artificial Sequence
  Description of Artificial Sequence: Synthetic oligonucleotide
  Target: ATXN1; (-) strand; PAM type: YTN; PAM sequence: CTG
tgtccttgagacttggagcc

SEQ ID NO: 156855 - DNA, 20 bp, Artificial Sequence
  Description of Artificial Sequence: Synthetic oligonucleotide
  Target: ATXN1; (-) strand; PAM type: YTN; PAM sequence: CTC
ggggtctgtgtccttgagac

SEQ ID NO: 156856 - DNA, 20 bp, Artificial Sequence
  Description of Artificial Sequence: Synthetic oligonucleotide
  Target: ATXN1; (-) strand; PAM type: YTN; PAM sequence: CTC
ctcggggtctgtgtccttga

SEQ ID NO: 156857 - DNA, 20 bp, Artificial Sequence
  Description of Artificial Sequence: Synthetic oligonucleotide
  Target: ATXN1; (-) strand; PAM type: YTN; PAM sequence: CTG
caagtgggcaggcccctcct

SEQ ID NO: 156858 - DNA, 20 bp, Artificial Sequence
  Description of Artificial Sequence: Synthetic oligonucleotide
  Target: ATXN1; (-) strand; PAM type: YTN; PAM sequence: TTC
tgcaagtgggcaggcccctc

SEQ ID NO: 156859 - DNA, 20 bp, Artificial Sequence
  Description of Artificial Sequence: Synthetic oligonucleotide
  Target: ATXN1; (-) strand; PAM type: YTN; PAM sequence: TTT
ctgcaagtgggcaggcccct

SEQ ID NO: 156860 - DNA, 20 bp, Artificial Sequence
  Description of Artificial Sequence: Synthetic oligonucleotide
  Target: ATXN1; (-) strand; PAM type: YTN; PAM sequence: TTT
tctgcaagtgggcaggcccc

SEQ ID NO: 156861 - DNA, 20 bp, Artificial Sequence
  Description of Artificial Sequence: Synthetic oligonucleotide
  Target: ATXN1; (-) strand; PAM type: YTN; PAM sequence: CTT
ttctgcaagtgggcaggccc

SEQ ID NO: 156862 - DNA, 20 bp, Artificial Sequence
  Description of Artificial Sequence: Synthetic oligonucleotide
  Target: ATXN1; (-) strand; PAM type: YTN; PAM sequence: TTC
cacggtcttttctgcaagtg

SEQ ID NO: 156863 - DNA, 20 bp, Artificial Sequence
  Description of Artificial Sequence: Synthetic oligonucleotide
  Target: ATXN1; (-) strand; PAM type: YTN; PAM sequence: TTT
ccacggtcttttctgcaagt

SEQ ID NO: 156864 - DNA, 20 bp, Artificial Sequence
  Description of Artificial Sequence: Synthetic oligonucleotide
  Target: ATXN1; (-) strand; PAM type: YTN; PAM sequence: TTT
tccacggtcttttctgcaag

SEQ ID NO: 156865 - DNA, 20 bp, Artificial Sequence
  Description of Artificial Sequence: Synthetic oligonucleotide
  Target: ATXN1; (-) strand; PAM type: YTN; PAM sequence: CTG
gagtcaacccattttccacg

SEQ ID NO: 156866 - DNA, 20 bp, Artificial Sequence
  Description of Artificial Sequence: Synthetic oligonucleotide
  Target: ATXN1; (-) strand; PAM type: YTN; PAM sequence: CTG
gagccatgtagcctggagtc

SEQ ID NO: 156867 - DNA, 20 bp, Artificial Sequence
  Description of Artificial Sequence: Synthetic oligonucleotide
  Target: ATXN1; (-) strand; PAM type: YTN; PAM sequence: CTC
tggagccatgtagcctggag

SEQ ID NO: 156868 - DNA, 20 bp, Artificial Sequence
  Description of Artificial Sequence: Synthetic oligonucleotide
  Target: ATXN1; (-) strand; PAM type: YTN; PAM sequence: CTA
agacgcactctggagccatg

SEQ ID NO: 156869 - DNA, 20 bp, Artificial Sequence
  Description of Artificial Sequence: Synthetic oligonucleotide
  Target: ATXN1; (-) strand; PAM type: YTN; PAM sequence: TTC
taagacgcactctggagcca

SEQ ID NO: 156870 - DNA, 20 bp, Artificial Sequence
  Description of Artificial Sequence: Synthetic oligonucleotide
  Target: ATXN1; (-) strand; PAM type: YTN; PAM sequence: TTT
ctaagacgcactctggagcc

SEQ ID NO: 156871 - DNA, 20 bp, Artificial Sequence
  Description of Artificial Sequence: Synthetic oligonucleotide
  Target: ATXN1; (-) strand; PAM type: YTN; PAM sequence: TTC
atttctaagacgcactctgg

SEQ ID NO: 156872 - DNA, 20 bp, Artificial Sequence
  Description of Artificial Sequence: Synthetic oligonucleotide
  Target: ATXN1; (-) strand; PAM type: YTN; PAM sequence: CTG
tcaccacacggaatagtgaa

SEQ ID NO: 156873 - DNA, 20 bp, Artificial Sequence
  Description of Artificial Sequence: Synthetic oligonucleotide
  Target: ATXN1; (-) strand; PAM type: YTN; PAM sequence: TTG
cagaaagagccagccaagga

SEQ ID NO: 156874 - DNA, 20 bp, Artificial Sequence
  Description of Artificial Sequence: Synthetic oligonucleotide
  Target: ATXN1; (-) strand; PAM type: YTN; PAM sequence: CTG
ccgccacgttgcagaaagag

SEQ ID NO: 156875 - DNA, 20 bp, Artificial Sequence
  Description of Artificial Sequence: Synthetic oligonucleotide
  Target: ATXN1; (-) strand; PAM type: YTN; PAM sequence: TTC
aggagccccgtgcgtctgcc

SEQ ID NO: 156876 - DNA, 20 bp, Artificial Sequence
  Description of Artificial Sequence: Synthetic oligonucleotide
  Target: ATXN1; (-) strand; PAM type: YTN; PAM sequence: CTT
caggagccccgtgcgtctgc

SEQ ID NO: 156877 - DNA, 20 bp, Artificial Sequence
  Description of Artificial Sequence: Synthetic oligonucleotide
  Target: ATXN1; (-) strand; PAM type: YTN; PAM sequence: CTG
gggcggggagccttcaggag

SEQ ID NO: 156878 - DNA, 20 bp, Artificial Sequence
  Description of Artificial Sequence: Synthetic oligonucleotide
  Target: ATXN1; (-) strand; PAM type: YTN; PAM sequence: CTG
agtgctggggcggggagcct

SEQ ID NO: 156879 - DNA, 20 bp, Artificial Sequence
  Description of Artificial Sequence: Synthetic oligonucleotide
  Target: ATXN1; (-) strand; PAM type: YTN; PAM sequence: CTG
cggatgctgagtgctggggc

SEQ ID NO: 156880 - DNA, 20 bp, Artificial Sequence
  Description of Artificial Sequence: Synthetic oligonucleotide
  Target: ATXN1; (-) strand; PAM type: YTN; PAM sequence: CTG
ctgcggatgctgagtgctgg

SEQ ID NO: 156881 - DNA, 20 bp, Artificial Sequence
  Description of Artificial Sequence: Synthetic oligonucleotide
  Target: ATXN1; (-) strand; PAM type: YTN; PAM sequence: TTC
ccctgctgcggatgctgagt

SEQ ID NO: 156882 - DNA, 20 bp, Artificial Sequence
  Description of Artificial Sequence: Synthetic oligonucleotide
  Target: ATXN1; (-) strand; PAM type: YTN; PAM sequence: TTT
cccctgctgcggatgctgag

SEQ ID NO: 156883 - DNA, 20 bp, Artificial Sequence
  Description of Artificial Sequence: Synthetic oligonucleotide
  Target: ATXN1; (-) strand; PAM type: YTN; PAM sequence: CTT
tcccctgctgcggatgctga

SEQ ID NO: 156884 - DNA, 20 bp, Artificial Sequence
  Description of Artificial Sequence: Synthetic oligonucleotide
  Target: ATXN1; (-) strand; PAM type: YTN; PAM sequence: CTC
ccacctttcccctgctgcgg

SEQ ID NO: 156885 - DNA, 20 bp, Artificial Sequence
  Description of Artificial Sequence: Synthetic oligonucleotide
  Target: ATXN1; (-) strand; PAM type: YTN; PAM sequence: CTG
gagggaaggagccaggaggg

SEQ ID NO: 156886 - DNA, 20 bp, Artificial Sequence
  Description of Artificial Sequence: Synthetic oligonucleotide
  Target: ATXN1; (-) strand; PAM type: YTN; PAM sequence: CTG
gccagagcagggctggaggg

SEQ ID NO: 156887 - DNA, 20 bp, Artificial Sequence
  Description of Artificial Sequence: Synthetic oligonucleotide
  Target: ATXN1; (-) strand; PAM type: YTN; PAM sequence: TTC
tggccagagcagggctggag

SEQ ID NO: 156888 - DNA, 20 bp, Artificial Sequence
  Description of Artificial Sequence: Synthetic oligonucleotide
  Target: ATXN1; (-) strand; PAM type: YTN; PAM sequence: TTC
cccattctggccagagcagg

SEQ ID NO: 156889 - DNA, 20 bp, Artificial Sequence
  Description of Artificial Sequence: Synthetic oligonucleotide
  Target: ATXN1; (-) strand; PAM type: YTN; PAM sequence: CTT
ccccattctggccagagcag

SEQ ID NO: 156890 - DNA, 20 bp, Artificial Sequence
  Description of Artificial Sequence: Synthetic oligonucleotide
  Target: ATXN1; (-) strand; PAM type: YTN; PAM sequence: TTG
atcttccccattctggccag

SEQ ID NO: 156891 - DNA, 20 bp, Artificial Sequence
  Description of Artificial Sequence: Synthetic oligonucleotide
  Target: ATXN1; (-) strand; PAM type: YTN; PAM sequence: TTG
gttgatcttccccattctgg

SEQ ID NO: 156892 - DNA, 20 bp, Artificial Sequence
  Description of Artificial Sequence: Synthetic oligonucleotide
  Target: ATXN1; (-) strand; PAM type: YTN; PAM sequence: TTT
ggttgatcttccccattctg

SEQ ID NO: 156893 - DNA, 20 bp, Artificial Sequence
  Description of Artificial Sequence: Synthetic oligonucleotide
  Target: ATXN1; (-) strand; PAM type: YTN; PAM sequence: TTG
tttggttgatcttccccatt

SEQ ID NO: 156894 - DNA, 20 bp, Artificial Sequence
  Description of Artificial Sequence: Synthetic oligonucleotide
  Target: ATXN1; (-) strand; PAM type: YTN; PAM sequence: CTT
gtttggttgatcttccccat

SEQ ID NO: 156895 - DNA, 20 bp, Artificial Sequence
  Description of Artificial Sequence: Synthetic oligonucleotide
  Target: ATXN1; (-) strand; PAM type: YTN; PAM sequence: TTC
cttgtttggttgatcttccc

SEQ ID NO: 156896 - DNA, 20 bp, Artificial Sequence
  Description of Artificial Sequence: Synthetic oligonucleotide
  Target: ATXN1; (-) strand; PAM type: YTN; PAM sequence: TTT
ccttgtttggttgatcttcc

SEQ ID NO: 156897 - DNA, 20 bp, Artificial Sequence
  Description of Artificial Sequence: Synthetic oligonucleotide
  Target: ATXN1; (-) strand; PAM type: YTN; PAM sequence: TTT
tccttgtttggttgatcttc

SEQ ID NO: 156898 - DNA, 20 bp, Artificial Sequence
  Description of Artificial Sequence: Synthetic oligonucleotide
  Target: ATXN1; (-) strand; PAM type: YTN; PAM sequence: TTT
ttccttgtttggttgatctt

SEQ ID NO: 156899 - DNA, 20 bp, Artificial Sequence
  Description of Artificial Sequence: Synthetic oligonucleotide
  Target: ATXN1; (-) strand; PAM type: YTN; PAM sequence: CTT
tttccttgtttggttgatct

SEQ ID NO: 156900 - DNA, 20 bp, Artificial Sequence
  Description of Artificial Sequence: Synthetic oligonucleotide
  Target: ATXN1; (-) strand; PAM type: YTN; PAM sequence: TTG
gctttttccttgtttggttg

SEQ ID NO: 156901 - DNA, 20 bp, Artificial Sequence
  Description of Artificial Sequence: Synthetic oligonucleotide
  Target: ATXN1; (-) strand; PAM type: YTN; PAM sequence: TTT
ggctttttccttgtttggtt

SEQ ID NO: 156902 - DNA, 20 bp, Artificial Sequence
  Description of Artificial Sequence: Synthetic oligonucleotide
  Target: ATXN1; (-) strand; PAM type: YTN; PAM sequence: TTT
tggctttttccttgtttggt

SEQ ID NO: 156903 - DNA, 20 bp, Artificial Sequence
  Description of Artificial Sequence: Synthetic oligonucleotide
  Target: ATXN1; (-) strand; PAM type: YTN; PAM sequence: CTT
ttggctttttccttgtttgg

SEQ ID NO: 156904 - DNA, 20 bp, Artificial Sequence
  Description of Artificial Sequence: Synthetic oligonucleotide
  Target: ATXN1; (-) strand; PAM type: YTN; PAM sequence: TTC
ccttttggctttttccttgt

SEQ ID NO: 156905 - DNA, 20 bp, Artificial Sequence
  Description of Artificial Sequence: Synthetic oligonucleotide
  Target: ATXN1; (-) strand; PAM type: YTN; PAM sequence: CTC
attcccttttggctttttcc

SEQ ID NO: 156906 - DNA, 20 bp, Artificial Sequence
  Description of Artificial Sequence: Synthetic oligonucleotide
  Target: ATXN1; (-) strand; PAM type: YTN; PAM sequence: TTA
aagctcattcccttttggct

SEQ ID NO: 156907 - DNA, 20 bp, Artificial Sequence
  Description of Artificial Sequence: Synthetic oligonucleotide
  Target: ATXN1; (-) strand; PAM type: YTN; PAM sequence: CTA
tatagttaaagctcattccc

SEQ ID NO: 156908 - DNA, 20 bp, Artificial Sequence
  Description of Artificial Sequence: Synthetic oligonucleotide
  Target: ATXN1; (-) strand; PAM type: YTN; PAM sequence: CTG
accagtgtgctatatagtta

SEQ ID NO: 156909 - DNA, 20 bp, Artificial Sequence
  Description of Artificial Sequence: Synthetic oligonucleotide
  Target: ATXN1; (-) strand; PAM type: YTN; PAM sequence: CTG
tgccaatagagtctgaccag

SEQ ID NO: 156910 - DNA, 20 bp, Artificial Sequence
  Description of Artificial Sequence: Synthetic oligonucleotide
  Target: ATXN1; (-) strand; PAM type: YTN; PAM sequence: TTC
tgtgccaatagagtctgacc

SEQ ID NO: 156911 - DNA, 20 bp, Artificial Sequence
  Description of Artificial Sequence: Synthetic oligonucleotide
  Target: ATXN1; (-) strand; PAM type: YTN; PAM sequence: TTT
ctgtgccaatagagtctgac

SEQ ID NO: 156912 - DNA, 20 bp, Artificial Sequence
  Description of Artificial Sequence: Synthetic oligonucleotide
  Target: ATXN1; (-) strand; PAM type: YTN; PAM sequence: CTT
tctgtgccaatagagtctga

SEQ ID NO: 156913 - DNA, 20 bp, Artificial Sequence
  Description of Artificial Sequence: Synthetic oligonucleotide
  Target: ATXN1; (-) strand; PAM type: YTN; PAM sequence: TTA
gcatgtgcaatactttctgt

SEQ ID NO: 156914 - DNA, 20 bp, Artificial Sequence
  Description of Artificial Sequence: Synthetic oligonucleotide
  Target: ATXN1; (-) strand; PAM type: YTN; PAM sequence: TTT
agcatgtgcaatactttctg

SEQ ID NO: 156915 - DNA, 20 bp, Artificial Sequence
  Description of Artificial Sequence: Synthetic oligonucleotide
  Target: ATXN1; (-) strand; PAM type: YTN; PAM sequence: TTT
tagcatgtgcaatactttct

SEQ ID NO: 156916 - DNA, 20 bp, Artificial Sequence
  Description of Artificial Sequence: Synthetic oligonucleotide
  Target: ATXN1; (-) strand; PAM type: YTN; PAM sequence: TTT
ttagcatgtgcaatactttc

SEQ ID NO: 156917 - DNA, 20 bp, Artificial Sequence
  Description of Artificial Sequence: Synthetic oligonucleotide
  Target: ATXN1; (-) strand; PAM type: YTN; PAM sequence: TTT
tttagcatgtgcaatacttt

SEQ ID NO: 156918 - DNA, 20 bp, Artificial Sequence
  Description of Artificial Sequence: Synthetic oligonucleotide
  Target: ATXN1; (-) strand; PAM type: YTN; PAM sequence: CTT
ttttagcatgtgcaatactt

SEQ ID NO: 156919 - DNA, 20 bp, Artificial Sequence
  Description of Artificial Sequence: Synthetic oligonucleotide
  Target: ATXN1; (-) strand; PAM type: YTN; PAM sequence: TTG
cttttttagcatgtgcaata

SEQ ID NO: 156920 - DNA, 20 bp, Artificial Sequence
  Description of Artificial Sequence: Synthetic oligonucleotide
  Target: ATXN1; (-) strand; PAM type: YTN; PAM sequence: CTT
gcttttttagcatgtgcaat

SEQ ID NO: 156921 - DNA, 20 bp, Artificial Sequence
  Description of Artificial Sequence: Synthetic oligonucleotide
  Target: ATXN1; (-) strand; PAM type: YTN; PAM sequence: CTC
ttgcttttttagcatgtgca

SEQ ID NO: 156922 - DNA, 20 bp, Artificial Sequence
  Description of Artificial Sequence: Synthetic oligonucleotide
  Target: ATXN1; (-) strand; PAM type: YTN; PAM sequence: TTC
tcttgcttttttagcatgtg

SEQ ID NO: 156923 - DNA, 20 bp, Artificial Sequence
  Description of Artificial Sequence: Synthetic oligonucleotide
  Target: ATXN1; (-) strand; PAM type: YTN; PAM sequence: TTC
attctcttgcttttttagca

SEQ ID NO: 156924 - DNA, 20 bp, Artificial Sequence
  Description of Artificial Sequence: Synthetic oligonucleotide
  Target: ATXN1; (-) strand; PAM type: YTN; PAM sequence: TTT
cattctcttgcttttttagc

SEQ ID NO: 156925 - DNA, 20 bp, Artificial Sequence
  Description of Artificial Sequence: Synthetic oligonucleotide
  Target: ATXN1; (-) strand; PAM type: YTN; PAM sequence: TTG
tcccatttcattctcttgct

SEQ ID NO: 156926 - DNA, 20 bp, Artificial Sequence
  Description of Artificial Sequence: Synthetic oligonucleotide
  Target: ATXN1; (-) strand; PAM type: YTN; PAM sequence: CTT
gtcccatttcattctcttgc

SEQ ID NO: 156927 - DNA, 20 bp, Artificial Sequence
  Description of Artificial Sequence: Synthetic oligonucleotide
  Target: ATXN1; (-) strand; PAM type: YTN; PAM sequence: CTA
aacacttgtcccatttcatt

SEQ ID NO: 156928 - DNA, 20 bp, Artificial Sequence
  Description of Artificial Sequence: Synthetic oligonucleotide
  Target: ATXN1; (-) strand; PAM type: YTN; PAM sequence: TTC
taaacacttgtcccatttca

SEQ ID NO: 156929 - DNA, 20 bp, Artificial Sequence
  Description of Artificial Sequence: Synthetic oligonucleotide
  Target: ATXN1; (-) strand; PAM type: YTN; PAM sequence: TTT
ctaaacacttgtcccatttc

SEQ ID NO: 156930 - DNA, 20 bp, Artificial Sequence
  Description of Artificial Sequence: Synthetic oligonucleotide
  Target: ATXN1; (-) strand; PAM type: YTN; PAM sequence: CTT
tctaaacacttgtcccattt

SEQ ID NO: 156931 - DNA, 20 bp, Artificial Sequence
  Description of Artificial Sequence: Synthetic oligonucleotide
  Target: ATXN1; (-) strand; PAM type: YTN; PAM sequence: TTC
tttctaaacacttgtcccat

SEQ ID NO: 156932 - DNA, 20 bp, Artificial Sequence
  Description of Artificial Sequence: Synthetic oligonucleotide
  Target: ATXN1; (-) strand; PAM type: YTN; PAM sequence: TTG
gttctttctaaacacttgtc

SEQ ID NO: 156933 - DNA, 20 bp, Artificial Sequence
  Description of Artificial Sequence: Synthetic oligonucleotide
  Target: ATXN1; (-) strand; PAM type: YTN; PAM sequence: TTA
taaaataattggttctttct

SEQ ID NO: 156934 - DNA, 20 bp, Artificial Sequence
  Description of Artificial Sequence: Synthetic oligonucleotide
  Target: ATXN1; (-) strand; PAM type: YTN; PAM sequence: TTC
aggtataggaattataaaat

SEQ ID NO: 156935 - DNA, 20 bp, Artificial Sequence
  Description of Artificial Sequence: Synthetic oligonucleotide
  Target: ATXN1; (-) strand; PAM type: YTN; PAM sequence: TTT
caggtataggaattataaaa

SEQ ID NO: 156936 - DNA, 20 bp, Artificial Sequence
  Description of Artificial Sequence: Synthetic oligonucleotide
  Target: ATXN1; (-) strand; PAM type: YTN; PAM sequence: CTA
tttcaggtataggaattata

SEQ ID NO: 156937 - DNA, 20 bp, Artificial Sequence
  Description of Artificial Sequence: Synthetic oligonucleotide
  Target: ATXN1; (-) strand; PAM type: YTN; PAM sequence: TTC
tatttcaggtataggaatta

SEQ ID NO: 156938 - DNA, 20 bp, Artificial Sequence
  Description of Artificial Sequence: Synthetic oligonucleotide
  Target: ATXN1; (-) strand; PAM type: YTN; PAM sequence: TTG
tggttctatttcaggtatag

SEQ ID NO: 156939 - DNA, 20 bp, Artificial Sequence
  Description of Artificial Sequence: Synthetic oligonucleotide
  Target: ATXN1; (-) strand; PAM type: YTN; PAM sequence: TTT
gtggttctatttcaggtata

SEQ ID NO: 156940 - DNA, 20 bp, Artificial Sequence
  Description of Artificial Sequence: Synthetic oligonucleotide
  Target: ATXN1; (-) strand; PAM type: YTN; PAM sequence: TTT
tgtggttctatttcaggtat

SEQ ID NO: 156941 - DNA, 20 bp, Artificial Sequence
  Description of Artificial Sequence: Synthetic oligonucleotide
  Target: ATXN1; (-) strand; PAM type: YTN; PAM sequence: TTT
ttgtggttctatttcaggta

SEQ ID NO: 156942 - DNA, 20 bp, Artificial Sequence
  Description of Artificial Sequence: Synthetic oligonucleotide
  Target: ATXN1; (-) strand; PAM type: YTN; PAM sequence: TTG
gagcaataggaacatcatca

SEQ ID NO: 156943 - DNA, 20 bp, Artificial Sequence
  Description of Artificial Sequence: Synthetic oligonucleotide
  Target: ATXN1; (-) strand; PAM type: YTN; PAM sequence: TTT
ggagcaataggaacatcatc

SEQ ID NO: 156944 - DNA, 20 bp, Artificial Sequence
  Description of Artificial Sequence: Synthetic oligonucleotide
  Target: ATXN1; (-) strand; PAM type: YTN; PAM sequence: CTA
agatgggaaaacacacatgg

SEQ ID NO: 156945 - DNA, 20 bp, Artificial Sequence
  Description of Artificial Sequence: Synthetic oligonucleotide
  Target: ATXN1; (-) strand; PAM type: YTN; PAM sequence: CTA
aaccaacactaagatgggaa

SEQ ID NO: 156946 - DNA, 20 bp, Artificial Sequence
  Description of Artificial Sequence: Synthetic oligonucleotide
  Target: ATXN1; (-) strand; PAM type: YTN; PAM sequence: CTG
gatccactaaaccaacacta

SEQ ID NO: 156947 - DNA, 20 bp, Artificial Sequence
  Description of Artificial Sequence: Synthetic oligonucleotide
  Target: ATXN1; (-) strand; PAM type: YTN; PAM sequence: TTG
actggatccactaaaccaac

SEQ ID NO: 156948 - DNA, 20 bp, Artificial Sequence
  Description of Artificial Sequence: Synthetic oligonucleotide
  Target: ATXN1; (-) strand; PAM type: YTN; PAM sequence: TTG
aattgactggatccactaaa

SEQ ID NO: 156949 - DNA, 20 bp, Artificial Sequence
  Description of Artificial Sequence: Synthetic oligonucleotide
  Target: ATXN1; (-) strand; PAM type: YTN; PAM sequence: TTC
gagtattgaattgactggat

SEQ ID NO: 156950 - DNA, 20 bp, Artificial Sequence
  Description of Artificial Sequence: Synthetic oligonucleotide
  Target: ATXN1; (-) strand; PAM type: YTN; PAM sequence: CTT
cgagtattgaattgactgga

SEQ ID NO: 156951 - DNA, 20 bp, Artificial Sequence
  Description of Artificial Sequence: Synthetic oligonucleotide
  Target: ATXN1; (-) strand; PAM type: YTN; PAM sequence: TTA
cttcgagtattgaattgact

SEQ ID NO: 156952 - DNA, 20 bp, Artificial Sequence
  Description of Artificial Sequence: Synthetic oligonucleotide
  Target: ATXN1; (-) strand; PAM type: YTN; PAM sequence: CTT
acttcgagtattgaattgac

SEQ ID NO: 156953 - DNA, 20 bp, Artificial Sequence
  Description of Artificial Sequence: Synthetic oligonucleotide
  Target: ATXN1; (-) strand; PAM type: YTN; PAM sequence: TTG
gcttacttcgagtattgaat

SEQ ID NO: 156954 - DNA, 20 bp, Artificial Sequence
  Description of Artificial Sequence: Synthetic oligonucleotide
  Target: ATXN1; (-) strand; PAM type: YTN; PAM sequence: TTT
ggcttacttcgagtattgaa

SEQ ID NO: 156955 - DNA, 20 bp, Artificial Sequence
  Description of Artificial Sequence: Synthetic oligonucleotide
  Target: ATXN1; (-) strand; PAM type: YTN; PAM sequence: TTT
tggcttacttcgagtattga

SEQ ID NO: 156956 - DNA, 20 bp, Artificial Sequence
  Description of Artificial Sequence: Synthetic oligonucleotide
  Target: ATXN1; (-) strand; PAM type: YTN; PAM sequence: CTT
ttggcttacttcgagtattg

SEQ ID NO: 156957 - DNA, 20 bp, Artificial Sequence
  Description of Artificial Sequence: Synthetic oligonucleotide
  Target: ATXN1; (-) strand; PAM type: YTN; PAM sequence: CTC
agaaaaacacacaccacctt

SEQ ID NO: 156958 - DNA, 20 bp, Artificial Sequence
  Description of Artificial Sequence: Synthetic oligonucleotide
  Target: ATXN1; (-) strand; PAM type: YTN; PAM sequence: CTC
atgtggactcagaaaaacac

SEQ ID NO: 156959 - DNA, 20 bp, Artificial Sequence
  Description of Artificial Sequence: Synthetic oligonucleotide
  Target: ATXN1; (-) strand; PAM type: YTN; PAM sequence: TTA
caactcatgtggactcagaa

SEQ ID NO: 156960 - DNA, 20 bp, Artificial Sequence
  Description of Artificial Sequence: Synthetic oligonucleotide
  Target: ATXN1; (-) strand; PAM type: YTN; PAM sequence: TTT
acaactcatgtggactcaga

SEQ ID NO: 156961 - DNA, 20 bp, Artificial Sequence
  Description of Artificial Sequence: Synthetic oligonucleotide
  Target: ATXN1; (-) strand; PAM type: YTN; PAM sequence: CTA
tttacaactcatgtggactc

SEQ ID NO: 156962 - DNA, 20 bp, Artificial Sequence
  Description of Artificial Sequence: Synthetic oligonucleotide
  Target: ATXN1; (-) strand; PAM type: YTN; PAM sequence: TTA
atatcactatttacaactca

SEQ ID NO: 156963 - DNA, 20 bp, Artificial Sequence
  Description of Artificial Sequence: Synthetic oligonucleotide
  Target: ATXN1; (-) strand; PAM type: YTN; PAM sequence: CTC
attaatatcactatttacaa

SEQ ID NO: 156964 - DNA, 20 bp, Artificial Sequence
  Description of Artificial Sequence: Synthetic oligonucleotide
  Target: ATXN1; (-) strand; PAM type: YTN; PAM sequence: TTC
tcattaatatcactatttac

SEQ ID NO: 156965 - DNA, 20 bp, Artificial Sequence
  Description of Artificial Sequence: Synthetic oligonucleotide
  Target: ATXN1; (-) strand; PAM type: YTN; PAM sequence: TTG
ttctcattaatatcactatt

SEQ ID NO: 156966 - DNA, 20 bp, Artificial Sequence
  Description of Artificial Sequence: Synthetic oligonucleotide
  Target: ATXN1; (-) strand; PAM type: YTN; PAM sequence: TTT
gttctcattaatatcactat

SEQ ID NO: 156967 - DNA, 20 bp, Artificial Sequence
  Description of Artificial Sequence: Synthetic oligonucleotide
  Target: ATXN1; (-) strand; PAM type: YTN; PAM sequence: CTT
tgttctcattaatatcacta

SEQ ID NO: 156968 - DNA, 20 bp, Artificial Sequence
  Description of Artificial Sequence: Synthetic oligonucleotide
  Target: ATXN1; (-) strand; PAM type: YTN; PAM sequence: CTG
ccacatagactttgttctca

SEQ ID NO: 156969 - DNA, 20 bp, Artificial Sequence
  Description of Artificial Sequence: Synthetic oligonucleotide
  Target: ATXN1; (-) strand; PAM type: YTN; PAM sequence: TTG
atggtaagaggaatacgggc

SEQ ID NO: 156970 - DNA, 20 bp, Artificial Sequence
  Description of Artificial Sequence: Synthetic oligonucleotide
  Target: ATXN1; (-) strand; PAM type: YTN; PAM sequence: TTT
gatggtaagaggaatacggg

SEQ ID NO: 156971 - DNA, 20 bp, Artificial Sequence
  Description of Artificial Sequence: Synthetic oligonucleotide
  Target: ATXN1; (-) strand; PAM type: YTN; PAM sequence: CTT
tgatggtaagaggaatacgg

SEQ ID NO: 156972 - DNA, 20 bp, Artificial Sequence
  Description of Artificial Sequence: Synthetic oligonucleotide
  Target: ATXN1; (-) strand; PAM type: YTN; PAM sequence: TTA
gcctttgatggtaagaggaa

SEQ ID NO: 156973 - DNA, 20 bp, Artificial Sequence
  Description of Artificial Sequence: Synthetic oligonucleotide
  Target: ATXN1; (-) strand; PAM type: YTN; PAM sequence: TTT
agcctttgatggtaagagga

SEQ ID NO: 156974 - DNA, 20 bp, Artificial Sequence
  Description of Artificial Sequence: Synthetic oligonucleotide
  Target: ATXN1; (-) strand; PAM type: YTN; PAM sequence: TTT
tagcctttgatggtaagagg

SEQ ID NO: 156975 - DNA, 20 bp, Artificial Sequence
  Description of Artificial Sequence: Synthetic oligonucleotide
  Target: ATXN1; (-) strand; PAM type: YTN; PAM sequence: TTT
ttagcctttgatggtaagag

SEQ ID NO: 156976 - DNA, 20 bp, Artificial Sequence
  Description of Artificial Sequence: Synthetic oligonucleotide
  Target: ATXN1; (-) strand; PAM type: YTN; PAM sequence: TTT
tttagcctttgatggtaaga

SEQ ID NO: 156977 - DNA, 20 bp, Artificial Sequence
  Description of Artificial Sequence: Synthetic oligonucleotide
  Target: ATXN1; (-) strand; PAM type: YTN; PAM sequence: TTG
ttttttagcctttgatggta

SEQ ID NO: 156978 - DNA, 20 bp, Artificial Sequence
  Description of Artificial Sequence: Synthetic oligonucleotide
  Target: ATXN1; (-) strand; PAM type: YTN; PAM sequence: TTT
gttttttagcctttgatggt

SEQ ID NO: 156979 - DNA, 20 bp, Artificial Sequence
  Description of Artificial Sequence: Synthetic oligonucleotide
  Target: ATXN1; (-) strand; PAM type: YTN; PAM sequence: TTT
tgttttttagcctttgatgg

SEQ ID NO: 156980 - DNA, 20 bp, Artificial Sequence
  Description of Artificial Sequence: Synthetic oligonucleotide
  Target: ATXN1; (-) strand; PAM type: YTN; PAM sequence: TTT
ttgttttttagcctttgatg

SEQ ID NO: 156981 - DNA, 20 bp, Artificial Sequence
  Description of Artificial Sequence: Synthetic oligonucleotide
  Target: ATXN1; (-) strand; PAM type: YTN; PAM sequence: CTT
tttgttttttagcctttgat

SEQ ID NO: 156982 - DNA, 20 bp, Artificial Sequence
  Description of Artificial Sequence: Synthetic oligonucleotide
  Target: ATXN1; (-) strand; PAM type: YTN; PAM sequence: TTC
tttttgttttttagcctttg

SEQ ID NO: 156983 - DNA, 20 bp, Artificial Sequence
  Description of Artificial Sequence: Synthetic oligonucleotide
  Target: ATXN1; (-) strand; PAM type: YTN; PAM sequence: TTT
ctttttgttttttagccttt

SEQ ID NO: 156984 - DNA, 20 bp, Artificial Sequence
  Description of Artificial Sequence: Synthetic oligonucleotide
  Target: ATXN1; (-) strand; PAM type: YTN; PAM sequence: TTT
tctttttgttttttagcctt

SEQ ID NO: 156985 - DNA, 20 bp, Artificial Sequence
  Description of Artificial Sequence: Synthetic oligonucleotide
  Target: ATXN1; (-) strand; PAM type: YTN; PAM sequence: TTT
ttctttttgttttttagcct

SEQ ID NO: 156986 - DNA, 20 bp, Artificial Sequence
  Description of Artificial Sequence: Synthetic oligonucleotide
  Target: ATXN1; (-) strand; PAM type: YTN; PAM sequence: TTG
tttttctttttgttttttag

SEQ ID NO: 156987 - DNA, 20 bp, Artificial Sequence
  Description of Artificial Sequence: Synthetic oligonucleotide
  Target: ATXN1; (-) strand; PAM type: YTN; PAM sequence: TTT
gtttttctttttgtttttta

SEQ ID NO: 156988 - DNA, 20 bp, Artificial Sequence
  Description of Artificial Sequence: Synthetic oligonucleotide
  Target: ATXN1; (-) strand; PAM type: YTN; PAM sequence: TTT
tgtttttctttttgtttttt

SEQ ID NO: 156989 - DNA, 20 bp, Artificial Sequence
  Description of Artificial Sequence: Synthetic oligonucleotide
  Target: ATXN1; (-) strand; PAM type: YTN; PAM sequence: TTA
ggttttgtttttctttttgt

SEQ ID NO: 156990 - DNA, 20 bp, Artificial Sequence
  Description of Artificial Sequence: Synthetic oligonucleotide
  Target: ATXN1; (-) strand; PAM type: YTN; PAM sequence: TTA
ttaggttttgtttttctttt

SEQ ID NO: 156991 - DNA, 20 bp, Artificial Sequence
  Description of Artificial Sequence: Synthetic oligonucleotide
  Target: ATXN1; (-) strand; PAM type: YTN; PAM sequence: TTG
caattattaggttttgtttt

SEQ ID NO: 156992 - DNA, 20 bp, Artificial Sequence
  Description of Artificial Sequence: Synthetic oligonucleotide
  Target: ATXN1; (-) strand; PAM type: YTN; PAM sequence: CTT
gcaattattaggttttgttt

SEQ ID NO: 156993 - DNA, 20 bp, Artificial Sequence
  Description of Artificial Sequence: Synthetic oligonucleotide
  Target: ATXN1; (-) strand; PAM type: YTN; PAM sequence: CTC
agggcacttgcaattattag

SEQ ID NO: 156994 - DNA, 20 bp, Artificial Sequence
  Description of Artificial Sequence: Synthetic oligonucleotide
  Target: ATXN1; (-) strand; PAM type: YTN; PAM sequence: CTG
ctcagggcacttgcaattat

SEQ ID NO: 156995 - DNA, 20 bp, Artificial Sequence
  Description of Artificial Sequence: Synthetic oligonucleotide
  Target: ATXN1; (-) strand; PAM type: YTN; PAM sequence: TTC
tgctcagggcacttgcaatt

SEQ ID NO: 156996 - DNA, 20 bp, Artificial Sequence
  Description of Artificial Sequence: Synthetic oligonucleotide
  Target: ATXN1; (-) strand; PAM type: YTN; PAM sequence: TTC
catatattctgctcagggca

SEQ ID NO: 156997 - DNA, 20 bp, Artificial Sequence
  Description of Artificial Sequence: Synthetic oligonucleotide
  Target: ATXN1; (-) strand; PAM type: YTN; PAM sequence: CTT
ccatatattctgctcagggc

SEQ ID NO: 156998 - DNA, 20 bp, Artificial Sequence
  Description of Artificial Sequence: Synthetic oligonucleotide
  Target: ATXN1; (-) strand; PAM type: YTN; PAM sequence: TTA
atcttccatatattctgctc

SEQ ID NO: 156999 - DNA, 20 bp, Artificial Sequence
  Description of Artificial Sequence: Synthetic oligonucleotide
  Target: ATXN1; (-) strand; PAM type: YTN; PAM sequence: CTT
aatcttccatatattctgct

SEQ ID NO: 157000 - DNA, 20 bp, Artificial Sequence
  Description of Artificial Sequence: Synthetic oligonucleotide
  Target: ATXN1; (-) strand; PAM type: YTN; PAM sequence: TTG
cttaatcttccatatattct

SEQ ID NO: 157001 - DNA, 20 bp, Artificial Sequence
  Description of Artificial Sequence: Synthetic oligonucleotide
  Target: ATXN1; (-) strand; PAM type: YTN; PAM sequence: CTT
gcttaatcttccatatattc

SEQ ID NO: 157002 - DNA, 20 bp, Artificial Sequence
  Description of Artificial Sequence: Synthetic oligonucleotide
  Target: ATXN1; (-) strand; PAM type: YTN; PAM sequence: TTC
agagaacttgcttaatcttc

SEQ ID NO: 157003 - DNA, 20 bp, Artificial Sequence
  Description of Artificial Sequence: Synthetic oligonucleotide
  Target: ATXN1; (-) strand; PAM type: YTN; PAM sequence: CTG
ttcagagaacttgcttaatc

SEQ ID NO: 157004 - DNA, 20 bp, Artificial Sequence
  Description of Artificial Sequence: Synthetic oligonucleotide
  Target: ATXN1; (-) strand; PAM type: YTN; PAM sequence: TTC
tgttcagagaacttgcttaa

SEQ ID NO: 157005 - DNA, 20 bp, Artificial Sequence
  Description of Artificial Sequence: Synthetic oligonucleotide
  Target: ATXN1; (-) strand; PAM type: YTN; PAM sequence: TTT
ctgttcagagaacttgctta

SEQ ID NO: 157006 - DNA, 20 bp, Artificial Sequence
  Description of Artificial Sequence: Synthetic oligonucleotide
  Target: ATXN1; (-) strand; PAM type: YTN; PAM sequence: TTA
aacgtttctgttcagagaac

SEQ ID NO: 157007 - DNA, 20 bp, Artificial Sequence
  Description of Artificial Sequence: Synthetic oligonucleotide
  Target: ATXN1; (-) strand; PAM type: YTN; PAM sequence: TTT
aaacgtttctgttcagagaa

SEQ ID NO: 157008 - DNA, 20 bp, Artificial Sequence
  Description of Artificial Sequence: Synthetic oligonucleotide
  Target: ATXN1; (-) strand; PAM type: YTN; PAM sequence: TTT
taaacgtttctgttcagaga

SEQ ID NO: 157009 - DNA, 20 bp, Artificial Sequence
  Description of Artificial Sequence: Synthetic oligonucleotide
  Target: ATXN1; (-) strand; PAM type: YTN; PAM sequence: TTT
ttaaacgtttctgttcagag

SEQ ID NO: 157010 - DNA, 20 bp, Artificial Sequence
  Description of Artificial Sequence: Synthetic oligonucleotide
  Target: ATXN1; (-) strand; PAM type: YTN; PAM sequence: TTT
tttaaacgtttctgttcaga

SEQ ID NO: 157011 - DNA, 20 bp, Artificial Sequence
  Description of Artificial Sequence: Synthetic oligonucleotide
  Target: ATXN1; (-) strand; PAM type: YTN; PAM sequence: CTG
tattttttaaacgtttctgt

SEQ ID NO: 157012 - DNA, 20 bp, Artificial Sequence
  Description of Artificial Sequence: Synthetic oligonucleotide
  Target: ATXN1; (-) strand; PAM type: YTN; PAM sequence: TTA
gtgctgtattttttaaacgt

SEQ ID NO: 157013 - DNA, 20 bp, Artificial Sequence
  Description of Artificial Sequence: Synthetic oligonucleotide
  Target: ATXN1; (-) strand; PAM type: YTN; PAM sequence: TTT
agtgctgtattttttaaacg

SEQ ID NO: 157014 - DNA, 20 bp, Artificial Sequence
  Description of Artificial Sequence: Synthetic oligonucleotide
  Target: ATXN1; (-) strand; PAM type: YTN; PAM sequence: TTA
tttagtgctgtattttttaa

SEQ ID NO: 157015 - DNA, 20 bp, Artificial Sequence
  Description of Artificial Sequence: Synthetic oligonucleotide
  Target: ATXN1; (-) strand; PAM type: YTN; PAM sequence: CTT
atttagtgctgtatttttta

SEQ ID NO: 157016 - DNA, 20 bp, Artificial Sequence
  Description of Artificial Sequence: Synthetic oligonucleotide
  Target: ATXN1; (-) strand; PAM type: YTN; PAM sequence: CTG
cttatttagtgctgtatttt

SEQ ID NO: 157017 - DNA, 20 bp, Artificial Sequence
  Description of Artificial Sequence: Synthetic oligonucleotide
  Target: ATXN1; (-) strand; PAM type: YTN; PAM sequence: TTG
cagtcatactgcttatttag

SEQ ID NO: 157018 - DNA, 20 bp, Artificial Sequence
  Description of Artificial Sequence: Synthetic oligonucleotide
  Target: ATXN1; (-) strand; PAM type: YTN; PAM sequence: CTT
gcagtcatactgcttattta

SEQ ID NO: 157019 - DNA, 20 bp, Artificial Sequence
  Description of Artificial Sequence: Synthetic oligonucleotide
  Target: ATXN1; (-) strand; PAM type: YTN; PAM sequence: TTC
ttgcagtcatactgcttatt

SEQ ID NO: 157020 - DNA, 20 bp, Artificial Sequence
  Description of Artificial Sequence: Synthetic oligonucleotide
  Target: ATXN1; (-) strand; PAM type: YTN; PAM sequence: CTC
attcttgcagtcatactgct

SEQ ID NO: 157021 - DNA, 20 bp, Artificial Sequence
  Description of Artificial Sequence: Synthetic oligonucleotide
  Target: ATXN1; (-) strand; PAM type: YTN; PAM sequence: CTG
ggtgggctcattcttgcagt

SEQ ID NO: 157022 - DNA, 20 bp, Artificial Sequence
  Description of Artificial Sequence: Synthetic oligonucleotide
  Target: ATXN1; (-) strand; PAM type: YTN; PAM sequence: TTG
cagagagctgggtgggctca

SEQ ID NO: 157023 - DNA, 20 bp, Artificial Sequence
  Description of Artificial Sequence: Synthetic oligonucleotide
  Target: ATXN1; (-) strand; PAM type: YTN; PAM sequence: CTT
gcagagagctgggtgggctc

SEQ ID NO: 157024 - DNA, 20 bp, Artificial Sequence
  Description of Artificial Sequence: Synthetic oligonucleotide
  Target: ATXN1; (-) strand; PAM type: YTN; PAM sequence: CTC
agcatgcttgcagagagctg

SEQ ID NO: 157025 - DNA, 20 bp, Artificial Sequence
  Description of Artificial Sequence: Synthetic oligonucleotide
  Target: ATXN1; (-) strand; PAM type: YTN; PAM sequence: CTC
tcagcatgcttgcagagagc

SEQ ID NO: 157026 - DNA, 20 bp, Artificial Sequence
  Description of Artificial Sequence: Synthetic oligonucleotide
  Target: ATXN1; (-) strand; PAM type: YTN; PAM sequence: TTA
ccctctcagcatgcttgcag

SEQ ID NO: 157027 - DNA, 20 bp, Artificial Sequence
  Description of Artificial Sequence: Synthetic oligonucleotide
  Target: ATXN1; (-) strand; PAM type: YTN; PAM sequence: TTC
attaccctctcagcatgctt

SEQ ID NO: 157028 - DNA, 20 bp, Artificial Sequence
  Description of Artificial Sequence: Synthetic oligonucleotide
  Target: ATXN1; (-) strand; PAM type: YTN; PAM sequence: TTT
cattaccctctcagcatgct

SEQ ID NO: 157029 - DNA, 20 bp, Artificial Sequence
  Description of Artificial Sequence: Synthetic oligonucleotide
  Target: ATXN1; (-) strand; PAM type: YTN; PAM sequence: CTC
gaatttcattaccctctcag

SEQ ID NO: 157030 - DNA, 20 bp, Artificial Sequence
  Description of Artificial Sequence: Synthetic oligonucleotide
  Target: ATXN1; (-) strand; PAM type: YTN; PAM sequence: TTC
ctcgaatttcattaccctct

SEQ ID NO: 157031 - DNA, 20 bp, Artificial Sequence
  Description of Artificial Sequence: Synthetic oligonucleotide
  Target: ATXN1; (-) strand; PAM type: YTN; PAM sequence: TTT
cctcgaatttcattaccctc

SEQ ID NO: 157032 - DNA, 20 bp, Artificial Sequence
  Description of Artificial Sequence: Synthetic oligonucleotide
  Target: ATXN1; (-) strand; PAM type: YTN; PAM sequence: CTT
tcctcgaatttcattaccct
